United States Patent 11,180,807 (METHODS FOR DETECTING A GENETIC VARIATION IN ATTRACTIN-LIKE 1 (ATRNL1) GENE IN SUBJECT WITH PARKINSON'S DISEASE) - sequence listing, part 2

SEQ ID NO: 84 - DNA, 144704 bp, Homo sapiens
ggagcagatctttgttaatctggatttaatcacgaccttttgaagtaacattctccctttttaagattcttgctgtggtcattatttgatctcttttaggaatttagtccttttttttttttttttcagtgtttaccttttcttcacctggaattgtcagatgctcttcaaagtcatctgaatcacagttttccttattctgacattaaaaaatttgtagttcattagcaagcagcactctctctacttgcttatacttccgaagcagactcttgattttcgcattcaattctgtattgcttgaattggtttgaatttaatgtttaatgtttaatttcatatttaaattttgagggccagttataatggaaaataactttgattttccagaaacctattgcttatccgaggagagctttcatttctcagtgacgatttcaattaaatggtttgctgtccttttccttaccatcttagattctttactcctgtcgttaccatttcatttacatttcagtagttgtcttttaagtgtttctctcatatgaggtatctttctccatcagtttatttaagacttaaaataatgttgagatctgtgccggtatgatagccactagccacatgtgataattattgagtatttgaaatgtgtttttttaggctgggcgtggtggctcacgcctgtaatcccaacactttgggaggttgaggcgggtggatcacttgaggtcaagagtttgagaccagcctggccaacatggtgaaaccccatctctactaaaaaccgaaaaaaaaaaaaaaaaaaaaaaaaaagcagggcatagtggcatatgcctgtaatcccagctactcgggaggctgaggcaggagaatcacttgaactcgggaggtggaggttgcagtgagccaagatcacgccactgcactccagcctgggtgacagaatgagactgtatctcgaaaaaaaatcagaaatgtggtttttccaaattgatatgtattgtaagtataaaatacacatcagattttgaagacttcctttgaaaaaaagcgtgtaaaatagtaatattttgcattgattatatgttgaagtgatatttagacatattagacaatgtaaaatattaaagttaatgctgcctcttttactttaaaaaatatggctactagaaaatttcaaacgacatatgtggttcaccttcatggcttgtgttatttttctctttggccacactggtctagattggatgaagaagtaaagttactttcttcagaaatcgtcttaatataaaccattaatttagtcagaaaagttttagcacatttaaaaaatgcatttatgtacctggtttctaatgtggatgtaaacttagaaccttttcatcttttttagctattaataaaactctaataactcaaaattcaattttatattaattgtagtcacagaattatttgtcaataattgagtcagaagactaaattgagaaataggcttccccaagttcactgttccagcaactgcgatttttaggcagcctgtagaacgtcatgaagtaacaggttgtggtttaatgcatctctggaaaaactatcttagtaggaagtttttttttctagtgtgccattttaagtagttgtttcattacttttaaacttaaaaataatgggggattcccaaacttagcagatgaacaagatgtggctaaaaataatttatatacgtctcctcaccctaaagcattttgagaagaagaaactcctcaaatgaatcccttcccatccataaactattataaaatatctacattgctgacctctagcagatagttttccaaataggacaatctttgttctgatcttttttgtttctgcttaattgacaacaattacaggaagggagatagtagtcagaaactctttctttctcgagtccagtttactcctaccttttctcttttttgtgtgtggcctttgactttctcttgagttgactgtgttcggttttccacctgccatctcctcacggagatattaagccccagacctaaaacacgaaaacacaaagatgcacctttcagtctttaaaaattggtcttcgctctttgtctcacaaactgaaactactgtgtttaaaacagtaaggagctgtccaaagaaaaatggtagaggtctctatttcaataattatcatcaattgctacattctttagtgaactaggactaaggttttctggagcctatttttgtgagtggccatgaactaaataataaacacttgtgtgccaggcacgttggctgatgcctgtaatcccagcactttgggtggccacagtgggcggatcgcttgagcccaggagttggagaccagcctggccaacatggtgaaaccccgtctctactaaaaatacaaaagttagccgggcgtggtggtgcacacctgtaatcccagctacttgggaggctgaggcaggagaatcgcttgaacgtgagaagcagaggttgcagtgagccaagattgcaccactgcactgcagcctggatgacaaagggagaccctgtctcaaaaaaacaaaacaaaataaaatataagtaaaattaatttaattttttttttgtttttgagacggagtcttgctatgtcacccaagctggagtgcagtggtacggtcttggctcaccgtaacttctgtctcccgggttcaagcaattctcttgtctcagcctcccgagtagctgggactacaggcgtgtgccactaagcccagctaatttttgtatttttagtagagacgggatttcagcatattggtcaggcttgccttgaactcctgacttcaggtgatccactcaccacctccacctcccaaagtgctgggattacaggcgtgagccaccaaccttggacataaaatgggtaaaaaaaaaaaaaaaaaaaaagacttaagtaatttaaagtttttatcatccctcccactttcaaaatagaaaatcatggggaaaaggaaataagtaaatgtcttttattggctatctaatttgaatgtttttttctggtgtgtgtgtgtgtgtgggtgtgtgtgtggtgtatacagtggaacatgatctggatcagattgactacatagacagctgcaccgcagaggaagaggaggccgaggtgagacagcccaagggaccagacccagacagccttagttcacagtttatggcgtatattgaacagcggcgaatctctcatgaggtagtacacagattgaagcctaaatatgttgctatcccttcataaaaataattcataatagtataaagttttgttatatcagtgatttgttgactgaagcctaattgttttcattatgttcacttctgatttcagtcctgagtttttcagatttattcagaaaactcagacagcagcctcaagtaggctttaggtttatttttcaaacaagaagaaagatttcagaattttgcaggaggaataaaagaagtctaggtactgttaaggccttggaagaaagtacaaagaaaaatacagtgatgcttttcattgttgtttttattgcttttttattgttactaactgataaatcatagtttggtcagtagttaattaacagttaaaccaaaaagttgacttttgtggcaacatgcagacttaaccatagaatttttataatatgctgaattatattggagcttttgtgctaagtcacacagaatgtaaattgtttgctattaaagttcttgggtatctcttaagtggagcattgaattgccttagaaaacaaatgtgcattcagcccactacagaatctctgccaattccccaagggtctcagatagaatagcattcttcagtctatcttgtcagcataataaaatggcttcactttagtggatgtgatgttgatgtctggagctggtttcaggctctgagcagtgattatttgagaaacacttgggcccttttagagaatgatgtattatccttttagaaatagagaagaatctctttggtctgagacagctaaaaggaaagaaaaaaaaagaaatagagaataatcatttcaagtgggacatgttgtagagtgatattatcattctttatttaatgaagcagagtcactctgtcgcccaggctggtgtgccttggcacgatctcggcttactgcagcctctgcctcccaggttcaagtgattgtccttcctcagcctcccgagtagctgggattacaggcacctgccaccatgcccggctaatttttatatttttagtagagacggggtttcaccatgttggccaggctggtctcaaactcctgacctcgggtgatctgcccgcctcagcctcccaaagtgctgggattacaggtgtgagccaccgcacccagccagtattatcattcttttttttaaaaaaagggccttggtttttcctatctgaatacttttgaacaccgtattttttgttggtaaagagacatacttgtatttaaagttggataaaattagataagtcaaagtcctacagcccagagatggcagtgtactaggtgactgatgaaactacttgttgaggctgctggagcaaggggcaactaactattttgcaataaaattaaaaatgacacattataatccttaaaggaattcattttcttttttcctggtctttctctttgatcatgttatggttacttaggctgtataaatggagtatctctactaaaagtgaaaatgcctattatactactataaaaaaatagtatttctttaattcattgtattgttttgtaataatatttttaaaattctggctgcctgttacgtatggtagtctttatgacttctgtgtcataaagctttcgtaaaatttagcatctgtgaaaatgtgatgaggcagcattattttagatggtttcacaaccagtgaagtatctttttattttcctgaacactatctaaaaatggaatgttaaaaactaacctatgtgaggtgttaaacactctactattatttaattttattataatacttgtcacatacatagaccattcctgtctgaacatggtatgattttttttttaattaaaccaatgtcacattcattttgtcatgaaaatttcgtgtgcctcttagaataattttagataattgcagtatcataaaactaggatggggctggacatggtggctcacacctgtaatcccagcactgtgggaggccaaggcaggtggatcacttgaggtcaggagtttgagaccagactggccaacatgaagaaacgctgtctctactaaaaatatatattaaaaaaaaaaaacttagctgggtgtcatggcaggtgcctgtaatcccagccactcgggaggctgaggcacgagagtcacttgaacctgggcagcggacattgcagtgagccgagattgtgctactgcactccagcctaggtgacagagcaagattctgtatccaaaaaaaaaaaactagggtggtaagccactggtacagcgtcctaggagagatttgtgtttattgtttaaagtggtgtagcttggcctggtggctccttcctgtagtctcagccactcgggaggctgaagtaggaagactgcttgagcccggcagtttgaggccggcctgggccacatagcgacactctgtctccagataagcaaaaattttaaaatggtgtcttcactaaaattagagaaattatttttgcatcagagttgtagaattgtagtttattatttgggatctcatgtccagactttaagacagtcagttgttagccctttgaagtaactcaccaaaagtttctaatgatgtgtgatatacctgtttcttggaggtagatgctatttcttggaagtagatggtaagtagttttatgtttgatttgtagatatcctttttgggaaagttgttttcttatttttcccttgatgaataaccattttgatgattatttttggtgttgaaacaagattgtattgcttctataggttttcctttgataacctttaatcctctacctttgatttataattttatttttcagtgcgtggtctgtattttaaaccagtttaattttcctcagtaatactttttgaaaatgacgttttactctttggtttgtagataagtaaaattgccaataatattttccttttaaatacggtattttaccataaatagaaattactttttgttttgtcttgatattcaccgacacactcaagactgtttgtatgagtatgataagagacaatttgttgtgatggataaataaagaaatgtaacctgcccagtgaactcactattaccagaaatattcaagagaaactgagcaaatgttagggtagggtaggtgggaatttctgtcctaaatggaagtctgttagtgacctcttcggttcctttctaattctaacatcttattattcagtaaatattactgtgcttggtcactgtaatgtatataatacagtgagaaggaaatctactttcttataaaataaaataaatgtttgtggattgtgaatgtttttgtttattaaagcagcagtatagcatatgatgcttttaaacttaaagtttacatttgaagagtctattaaaatgttttttagtgtaatatataaattaaatgacaaattggatgtgaactgtgtaatcgcagtgttctggattaatatactaaatttatttatttctgtcctctggcctagggttcaccagtaaagccagtagccattagggagtttcaaaaaacagaagatatgagaagatatttacatcaaaacaggtttgaaaaaccaattctacttaatttgtttctgtcttaatcatgagagcataaagtaattttggttttatgcagatctgtgtgtaataaagatgtttacatggcatgtatttagaactgagcgacggtgtgcttttttgtactcatgccatagaaaaggtaaaaactgatttgattctaaattgagaccatctaaatcattacctacacagttaatcgatctgaagatacttagtagcaatgagattttgtggtgaagctatatggattcatgcacaaaaagggctaaaagaatttcaggactgggcatagtggctaacacttgtaatcccaacactttgggaggccaagacgggaggcttgcttgagcccaggagtttgagaccagtctgagcatcattctacccctctacaaaaagaaaaaaaaatagcctggcatggtggtgcatgcctgtggtcccagcaactcagaggctgaggtgggaggatcgctcgaactgggagggtgagactgcagtgaacccagtttgtgccattgcagtccaacctgggcaacagagtgagaccctgtctcaaaaaaaaaaaaaaatacaaaatacaaaaaacgaatttcgagagttctaattttttttaacttacatttttgactggataacagagagaaatagtcagagacagtgatatgtatcaccagtcctgtctccgttaatacactctttccactgtacttggtgcctctcagaatattttgaaaattaggccctgtgcggtggctcatatctgtaatgccagcactttgggaggctgaggcaggtggatcatttgaggtcaggagttcgagaccagcctggccaacgtggtgaaacgccgtctctactaaaaatacaaaaaatagctgggtgtggtggcacacgcctgtaattccagctacaggtggcacatgcctgtagtctccaggctgaggcaggataatcgcttgaacccaggaggcggaggttgcagtgagccgagatcgcaccattgccctccagcctgggtgacagactgagactccatctcaaaaaaaccaaaaaaagaatattttgaaaattagcttgatcgtttagagcactgcttctcattcttgaattccagaatgtttcttgccatgaagaatttcacagtagttggaaatttcagcctttagttctttgccttctggttttatgaagtcttggtacacctattcttaagtgacggtgaatttacgtagttcttatacttgacaaggtattaaaggtaactcgggggactgagctatagatggaataaatgtgtagggagaaaaaagacagacatcactgtgacatttatactcttatcacttaactcatggagatttaattaaatttgatatgctttgaaatttatttcagaatgtcttttcagttgccacgtgtccttttattgagagtgtagtcttttaagattccagttttatgcaggagtttccagttacattccccaccttgagtgggcctgcattttatatctcctgcccctctcacgtcctgcatccatcataggtgaagctcaagagctccaggatttagtagaaaccctcaaggtaaaagctggctctttcactcagttaccttatgtgttagttttctgttgcttgtgttacaaagttagcagtttagaacaacacctctttattatattatacttctggaggatagagcctgggcaggccccgctgggttctctacttagaggccaaagtcagggtatcggctggcctggattctcatgtggagactgtggaggagaattcattttcacgctcctacatcttggcagaattcagtttgatgcagttaccggtccccattactgaggtccccattattttcctggctgccagctggtggccattcttggtgtttagagcccactcacattccttcttcatggctccctccatcttcaaaccaggaatgacaggccaaatcctccttatgtttggaatctttcttacttccctttctgccacatctcgcaaattcttttgcttttaagggctcgtgattatattaggtcaacctggataatctccccattttaaggccagctgattagtaaccttaatttcatctgcaaagccttttttaaatgtaatacaacagcattcactagagtaaggccagggaccgagatcgtggaagccaaaagtctgcctaccgcatcttagtccagagttcctgtttttacttctttttgaaggtctgtggattctttattttcatggcaccttagcaatacattttaaaagcttgttttattttattcagcattttggttatttccattggaagagtcattcagggcgtttagtctgccacagtgctggaaactaaagctaggattacatgttttgttttgttttgttttgttttgttttgttttgttttgtgacagggtcttgctctattgccttaggctggggtgcagtgttgtgatcatggtcactgcagcctctacctcccaggctcaagcaatcctcccacctcagccgctggagtagctgcaacttcaggcgtgtgctacatactcagcaaattttttgttatttttaggagagacagaaatctccctatgttgcccaggccggtctcagactcccagattgaagtactaaccctcctgctttggcctgccaaagcgctgggattacaggtgtgagccactgcacccagccatgattactgtttaactcggggttccatagcacagtccttggataagaactccatacttgatcctagtaaccagttaggctctaggatcaatatatacttcatgtttttaattagcaggtatttgtgaaatatctactatgtgccaagttcctttccagatgttgggatatagctatgaacttagtcaaaattcccgcactcctggagcttacattcaagtgaaatgttgaattcgaacctaaaaagacacagtcgcctcagaatgactgacagctctcagaccagcaagacttgtctctaatctgaataacatgttaacaaaaagactctacctcagcagtctgtcagttacagcaactcaaaaacattgagtgagcataaggaatcctctgctagtgagctgaaaaggaaagcttgcttacccgtttttttcttccagttcttttcccctaccctcatccaacacatacatttcttcccacctaccactcccctaccgctacccacatagagtctaccctactgggagatcataaacatagggagatacaataaataaaaagtgtgaatgttttgtagtatttgccaagatggattatgtaaatttgaaattgaaactagcaaaaattatgttttaaaaaaattgttaaaataattttttatgggctgggtgcagtggcttatgtctgtaatcccagcactttgggagcccgaggccagcagatcacctgagctcaggagttccagaccagcctggccaacatggtgaaacctgatctctactaaaaatacaaaaattagccgggtgtggtagcttgcacctatagtcctagctacttgggaggctgcggcaggagaatcgcttgaaccctggaggtggaggttgcagtgagccgagattgcaccactgcattccagcctgggtgacagagcaagactctgtcttaaaaaaaaaaaaaaaaaaattatagggcctacttataatttgaatagcattttagttcaggagagatgataataccagactaggttctgtaaagtgtgttatagcttctataagaagcaatatagaattaacatttagataaaacctggaagtttttttgtttcatgttatatagacacagccagaaaagctactcacattaattatgtgattttgtaaataaagaaaaacagagaaggcagtttagtctgccttatactggccaggtgtaatacacctgtattacctgtatagtgctgggtgtaatcccagcactatactggccgggtgtaatacacctgtaatcccagcactttgggaggccaaggcaggtggatcccctaaggtcaggaattcaagaccagcctggccaacatggcaaaaccctgtctctactaaaaatacaaaaaattagttgggcgtggtggcatgcacctgtaatcccagctacttgggaggctgaggcaggagaattgcttgaacttagaaggcagaggctgcagtgagctgagattgtgcccctgcacgccagcctgggcaacagatacgccatctcaaaagaaaaaaaaaaagtctgccttatagagataaaagtctggtttacttagctcaagtaagttcaagatttaaaggagatacatacatgttacctgcatttttgtttttttatgtctcaatattccacactttttcgggagagggtgctactgtcattcattcaagcaatatttcttaagcactatagtggttctgtctctgttccaaatccctgatattttagagttactttttagtggatgtagacaaatatatgtaacaagcatgtttcaggtactgctaggtgctatgaagaaaaataaagcaggataaaagagatggtagggtgagggaagagtgcaagtaatgttagatgccatgataatatttcagtagaaacctgaaaaagagcaaacattatggatgtctaggggtgaaacgttctaggtagaggttctgaggtaggaacatgcttttggtgtattcaagaaacacccaggagtctgagtaaagcaggacaaatctgggatgtgagatgagagttctgctgtggttatgttctatttcaggtacctacaagacatccaagtggaattatcaagtaagcagttagatttatgagtttggagtaaggtggcaagaattagggcttgaacaaccagaaaaacaaactgagtggggtggtcatggggataggagaaagagggtggtgtcctagaggctaaatgagaatggttgttgtttttgtttttttgagacacgtctctgtcacccaggctggagtgcagtggtgtcatcatagctcataagcagccttgatctcctggactcaagatcctcccgccttggcctcccaaaatgctgggattaaaagcatgagccactgtgcctagccttgaaaacagtgtttgaagaagtatagagaggaatgaataacatcacttactgctcataggttttttgtttttttttttcccagatggagcctcactctgtcgccaggctggagtgcagtggcgcgatcttgactcactgcaacctccacctcccaggttcaagcgattcccctgcctcagccttctgagtagctgggactacaggcgcgcaccaccacacctggccagtttttcgtatttttttagtagagacggagtttcaccatgttgaccaggatggcctcttatctcctgactttgtgatccgcccgcctcggcctcccaaagaagtgctgggattacaggcgggagccactgcacccggccctgctgataggtttaataaggggaggactaagaaatagctattggatttggggatgtcaagatcattgacagacttgtgaggtgaaagaaagttttagtgaaactgaaaggacgggacgcagattggattgggtgcaaaatacagtaatgagataaagtggaaacaatgggtttgactggctttttagagaagtattgtaaaaagagggtaaatgaatctatgtacttgtaatcccagcactttgagaggctaaggtgggtggtttgcttgagcccaggagttcaagaccagcctgggcaacatggcgaaaccccatctctaccaaaaatagatgaaaattagccaggcatggtggtgcacacctgtagttccagctgcttgggaagctgaggtaggattgcttaactctgggaggtggaggtctcagctgagatcgcaccactgcattcaagcctggacaacagagtgagatgagactctgtcaaaaaaaaaaaaaaaagaaagaaagaaagaaacataggtagaaagaagatttaaaggagatacatacatgttatctgcatttttgttttttatgtctcagtattccatgctttttcgggggagggtgctactgtcattcattcaagcaatatttcttaagcactagaaagtgcttaagaaagtagaaagaaagtgtgtattaaaaaattgaaaagcggctgggcatggtggctcacacctgtaatcccagcactttgggaggctgaggtgagtggatcacctgaggtcaggagttcaagaccagcctggccagcatggtgaaaccccgtctctactaaaaatacaaaaattagccgagtgtggtggcgcatgcctgtaatcccagctactcaggaggctgacgcagaagaatctcttgaacctgggaggtggaggttgtggtgagcgagatcgtgccactgcactccagcctgggtgacagggcaagactctgtctcaaaacaaaacaaaacaaaaattgaaaagcatttttaaagtttagtgttcaggttagggcacataaacacacttgagttggtttatttggtcctttctatgttttgtttcagttcatctacagatggccgctaaaagctatgggaaattttaacagtgaaattagtaatctagggagaaagttgcagttaattcctgttactctaaatgtgtaatcagggcgtggcgtggtggcccacacccgtaatcccagcactcggaggcctcggtgggtggatcacttgaaagctcaggagtttgagagcgacctgggttaacctagcaaaacccggtctctacaaaaactgcagaaataagcctgggttggttgacacacacctgtaggccagctgttcgaaaggctgaggcgatattatcgcttgaggccaggaggtcgaatctgcagtgagccatgatcacggcattgcactccaccttgggccacaaaaaaaaaaaaaaacaaaaaaaaaacggctgggcgcagtggctcacacgcctgtaatccaattactttaggaggctgaggtgggaggatggcttgaggggcaggagtttgagaccagcctgggcaacataataagaccctcattgccacagaaaaattaaaaaaaaaaaaacaaaaaaaacaaagacagctgggcgtgatggctggagcccaggaggtcaagactgcagtgagccatgatgatgggttttttttggttgccctaattagcacactgatttcagtgcctgtagatcagcctgataggctaatcatcatagttttggaggccacgtcctaaacgtcagacagtaactaatcttgccagttttagtttcagacacaaagatgagttacagagacttgagcaatgaaatctgtttcaggaaaaggataaatagtaaactataagaattaacactgatagcagtgagaaggaagtactactttttttttgtttttttaagcattaaaaagggctttgtatttttcttaaaaataaaaaaaccagaatctttatttctgtgttaaaattgcttcatcgattgaaaataagagcaggtgtgctttataagtacagttacgaggttctgtagttgataaaaatgactgtatgtaaaaggatctcagtttacatgtatcgtgttttaatcatggtggtaacgaagataatagttatttgtgttataaagaaatgatgctgtttgcaaggtgatctcaattaactgtattgttggtattggctgacatagacagttgataccacatgaaacgtgagttggaggcatcagattttcctctggtttcacttaatgacttggacttaggtttacaaaatgcagctactccttcaatgctaactaggcagtttgctactgattaatagaaagctacatttacaataaaaatttcatttgttttttatgtatctgtttgtctttttatcaaagagtttttttctttcttttttcttttttgggtcagggttccagctgagccatcttccctcctgtcactatcagcaagtcacaatcaggtaatgtttagtagttgtgtttatttttgctttttaaactaagatgattttttttcttttataatacttaaattgccattaattgccaggtatatttaagcattactagctgtctcaatcgattaatataacatatgtacgtgatacttgctaacagtgtttttagacactagatagaaaatctttaccttcatgatggctttatagtattagtttggtgcaccaacctaatacatataagaaccgtgcaaagacgggaaaagattagccaataaacacatttcaagcaatgctaggtgacttcaaagcaaaagttgcatgggtcaacagtagttccctaaattgatagggaatattggtaacgtgatcctcatttttacttttgtatgcacaataacgctttggttccagctgtcacacacagacctggaacttcatcagagaagggagcagttagtagagcgcactcggagagaggctcagcttgctgccctgcagtatgaggaggagaaaataaggaccaagcagatccagagagatgctgtcctggactttgtcaaagtgagtcgtttgaatgatgctgttcaagctgctgactggctaagtgcttatttgtttggtcaggcccgttggtttttattgtccattaaaatgtcgaccatttttctctctgtaaggaatcttgactaaatagagtgtctcttttacttgtgtctatctgcatgaggacagaacaagtgattatcttgttaacggtaaatctgtcattggacatgtcactttactatccagctgccatttcctcaatttctagtgtcatagtaaagatcagtaagatgaaagtgaaagtgctgtgtgaaccataaaaggcccgtgcagatgcaaactgttactcagacctctctccagcttcctcgcttttgtaaataacaaaagtttgctagcctcacaggcttaatcctttgcaggaactttgatttgttcctttctgctctccacacacatccaattaacaacgccattaatatttcttaacgttttgcagcctctatagtagtgcctgaaatgttgtcattttattttacctgtattgcttatctttttgttctgaaatcgtcattttttcttcataattaattatttgtaattttgtttacttaatatctgtctctcatttatctgtaaactccatgaaggtaagaaccatgtctgttttacttactgctgtgtccctagaccttagcaggtcttagctcatagtaatggtcaataagtatttgttgaatgattaaatgaatttttcttgtccactaaagactttcctgtatttcatactttaactagagaccatctcctttaagtacgatgcgtatgtctgttttactgttttacctgataaactctttttttctgaatgtaccagacccttggcaatgacgtttaactctctttctcacctgattcctcttcatccaacaagttcccttgtctcttgttttctataaaaatgcaggcaaatctggccgggtgtggtggctcacgcctgtagtcccggcactttgagaggccaaggtgggtggatcacctgaggtcaggagtttgagaccagcctggccaacatggcaaaaccctgtctcaagtaaaaataaaaaaattagctgggcgtggtggtgcatgcctgtaatcccagctaaccaggaggctgaagtggaggaattgtctgagcctaggaaacggaggttgcagtgagctgagatcgtaccactgcacttcatgcagcctggttgacagagtgagactccacctcaaaaaaaaaaaaaaaaaaaaaaaaagtaggcaaatcttttgaccaatagcaaaaatactaaaattaatattcctacaagcagaagttcacaaaggtacctccctccctcaaaaccttgtctgccctgagatgtttcttctttttgtgccttttcaaccctcataagaattgttaatgtactaatggccatgttctcttgtcctcctttatctctgtcattgtattttcacacaagtcatctaatactatacatactatatctcctaatttgtctaaccatttctctttcccttaagtccctgcttgatttgttactacatacaaacttttttatatagttctcttgaaactaacggaaatactttattggtttattcttaataggtcatttggaggtgttcaggtttcacagatgaggaagctgtaggtctaggaagattaagcaatgtggtcatttatagtacatttgttttcttaatcaggaggcaaacctagacttctgaaagcctaacttggttcgtccatttgacttgatagacctttatggaatgctggttgtacaaggaatataaagatgcataaaatacaagccctgcccaccaggcacagcttagaccttatcagggaaataaacacaaataaaacagaaaataaggcagcttataatgaaagtgctagttttatattcaagacagtagaagacttagagaacaagtatcatcagaattgacctcaaaaagaaattatagggaccctgaagagtgagtaggtaggatttagccaggaagaaaagactggatgatggtgtaaaggggggttcgttttaggctgaggaaatctaaacaggatgggagctgggaatggccttgtgtgatttgtagatttaaaataatggcacttgcaggaaacaccagctggcctggagagtttgtattgaagacttatgggaaaaatgaattattgagatgatgataatcgtacttaaaacttattgaatgcttattatgtagtaggcactattttaagtacattatatatatttactcatttaattctcccaactctctttaggtaccattttttctttttttttttttttttccttttaattacatttattttaatgctgaatttactcccgtgccgtaagtttttgtttcttcagtttcttctgggatatctttttcttctgggcaacctcctcttctggtttaggaacaatctgttccttttccataaggatcatctcaatgtggcagggagagctcatgtatgggttaatccgaccatgagctctgtaggtccggcggcacatctcaggtgctttgttcacttggatatgctcaatgaccagagaatctacatctgaacccttaagttcagcatcactctctgcatttttaagcacgtgcagcaaaaattcagcactctttctgggccaccgaccttgtgtccagccccactgcttggcctgcgcacacctgccaactccatcattgtaacgtcggaatggtacacgctgtttctgtaaagtgacatctttcagatacttcgtggcttttcgtatatgcatacccttggtggcctgagcagttccacgagtgttcttaaagtgaacacgaagattggaacctcttgatttgcatgatttcgtggggttctccgggtcaagtgaatagcgaaccatttttcacagattacctcaggctgcttagggaaagagcccattttttctttttatgaacaaggaaacacgctcagagagaataacagtttactaagattaaatactcaggaagtggcaggattaaaatcctgtgattagaacaaggcaggttggctctgaagcctattctgtgagcacagtctatgctgcctctcggtaataatggttaacactgaatcttaagtgctgttctatgtgttttgcataaattaacttactcagtttgccttccgtagaagtcacacagccagtaagagatagtcaacttgtagagagtcttgattaaatgtcaaattagtgttggatcttgatctattaagtaaaagagaacacttgagtttcaaagcaggaaaaaacatgagaagagagagacttctgaaaaactaattgacttgcgttagaactggttaggaagaaagactagaaagaggaaaatgaagaaggaaattgcaatagttagactagggtgcaaaataaggcataaaaaccagatggtttctaaaggtcctaagggttggcagtattgcagtgacaagagcctaaattcagaaatctctgcatttgaatccagctttgccacttgccgtgcgcttgactttcagaaagctactgagccattttatgctgttaggttcctcctgtgtgtgatatttaactattaaatattaactatctcagaattattatggatatacctaatgcttaatactagtatggtagatgctatatcccctattactataataaaatggatttgctgaattacctataagagagatggtgaataaatcacagatggtgaataaatcactgaagagggtgaaaaaaaagaagctcccaaagcaaggtttggaggctgaaagatggtttcaaatgagggtctagcattgtggaaagaacacaggctttgcagtcggaaggcaggcccaaaccagttatgctgctgacgaacttggagaccttgcacgtgccgcataacctctcttctcgattttctcatctctaaatgaatatgatgatgatattttatctcacacagtagaagaatcactgaaatactgtgtacacagtgacatacagtagagcacgttgtaaagcagggaccacaccaatgctataatgttattattagattattagacatcacacgttggagaaaatagccagttagtatgggacattgtgagtttgtttttgaatgtgtcagatatgaggtggagtggggtttccaagtagagagtttccatagacagttgaaaacacaaacctgagatttgcttctagctaaggttattagcattcgagtgatactaaagccattagagggagagaataagttcatcgagtaagaggtcaatattctgattataaatgtgtttgtgtagatatatgtatagtttttaaaatttctagctaaacattttctaactagtaaatctagaaaaatgctataaacaagaggtaaaaaaattaatttgagtgattattttagtaaatagaatttgttatttgcagtgttccaggctctaaccaacttccttttttggggggttttgggattatacagcaaaaagcatcacaaagtccacaaaaacagcacccgctcctagatggcgtagatggtgaggtaagttgatgtaatctccttttctttggagttgattatttttgcaatggaaatgaaatgtttacatgtaattgtcatgttttcagtgctcggaatattgccatttttctttttccacctcacaatattctccttatgagggagatgatacaagccaaggagtttactagaatctatagatcaaggcttttttcagctatacacatccatctagagatgatatttccctccctgacccccaccagaggcaccgtccccgtctcctccacttttgaagcgttgtgtgtagagtcctgggagctttacctggtacaggtaaatggagtggctactaaacaaaaaaagactcttacataggatttcagattcagtgctatcaatgataacacttattttataatatcaaatagtacatttttcttacagattaacagaaaataaatcacttaaccttttaaaaatctacacacctcttttgatctgttaaaatgaagcttactaaatgtttttcttgtagttggctttctcattaaccattttccctttaaaaacctaccagttttttctttttctttttctttttttttgagacagagtctcactttgtcacccaggctggagtgcagtggcgcgatactggctcgctgcaacctccgactcccgggtccaactgattcttctgcctcagcctcccgagtagctgggactacaggtgtgcaccaccacgcctggctaatttttgtattttcagtagagacggggtttcactgtgttggtcaggctggtctcgaactcctgacctcataatccacctgcctcggcctcccaaactgctggaattacaggcacttaattccactgcgcctgacccagtttgttttaatttatgatcattacctccttgaaaaatgcataaaagcgttgtttcatgtgaattttgactttgcttttcataaaataagttatttgaaaacctaacacgtggggctttacaagcaacaattttcagtgtttttaaagcacaggagtttctggtatggaaaagtgtattgtttgaaatgttttcaattgtccattagaaaggtttttaaaaagttttatcagacatagaactacttctgtttttttatgttagaacattatatatttgtataatacctcaaagattggctccagcatgttcacttgtcttttcttcacctggtaataatactaacacattttcgacaaccaaagtttgataaatttaatgtgtgttttcttttttaccccaatatttccttcttgatgattgttttcaagtaattcattctcaagaaaactaaagctccacaggaaaataacataaacagttctaaaaattgtaattgtacttttcattttgcttaagaaagaaaatgaagagatacttagactagaaattatgactctgggcttcttgtttgttactggctcactaaatgaccataggttctttatgttattgttacatctctctccagctttctgttccctccttgctttgtaaggttttaggcaataagatcgtatttgaagttgtttaaactctgggagaagatcagtactcagaaccaacttactgactattataatgcatgaattccagatgattgtgaatgtggtcctctatgtcaacgtcttcaaaagtatgtcttaatatgtctcttcccttgtgtgtgtattcgtgaaatacgtcacacgtgtgcgtagtttgtttctgacatggcttcatttttctccatctctccagtgccccttcccatccagaaggtctcagcacactgatgatagtgccttgtgcatggtaagagttttgcacaaaacggagtttcgcatttctgtgtttagagattgtactttttattcagaaactatctaaataccataaaacatgatgaacatcattactaaatgctttatgaagaactaaaccattttcccacatgaccatttgtgattgacccagtgtttcaaagttctgcagctcatatctttgtcagtgccaccgaaaggaaaacatttgccttgagaaccatattggctttgtgtgtgctgggaatggaggcataacataatattcatgttttaaatgtgtctaattccaggagcacttactttattaatcattaatttggctcatgggtcacctatatgttaaggtgactcatgacactgattgcacagctgtatatttggcatccaattttatgatgtattttcagctactgaaaatccttcactttggttttaaatacttacagctcaagattattccttcatgttcactttttaaacccaaggaaacattaactgctgatcgtgttgaacactggcttacttttattgcctgtttcatcagctcaaaatgagtataagatggaaggtttatttaacatcttattagccttgcgaaagaattctaaccatttctagaatttctttccccatcatgttttatgtgattgttttcatagtagtacgttcagaggtctagtgcctacagtgctagtaactgctgccagggtgcatcctgctgcgtgagctgcatgcctcagcatgacattcctgttacatcagcttccgtggtctgttcgcattgctgtgtattccacaaccttcatttcctttgagatggataaagcaccttttaactgggcggtcttataggtgaatacaatcatcacactctagagttttagtttaagtgaattggcctaagaagcgaataataagttaaaaatgtagacaaatattgagagcctccgacgatccaaacacttaccaaaattatctcatttactcctcgcagcaaccttaagagtgaaggttaaacttatcacctttttacaaatgattactgaggcccagaatgtgacttgtccaatgtcgcatagacagtaagtgcaaggctgggaatccacatctgtctggctgatgggagaacctgcattaaacaccatactgaaactgaaaaccgtttaggaaaccgaaggtttaataacacatggaataagtggtataagtctgagtgccaagacttttttgtcaacaaaacagtggaatttagaaaaacaacaacagcaaaatccccttagtgcgtaacttgaaattcccttcggccgtttgtcaaaacacactcacttaagtcttagttctcagtattcatatctgatcctccaaattagacggcctttaaaacacatctcacatttctttgtctgccaaatagtgtccaaccaacactgtgcaaaaagagtcgtattttaaataaaacctcatattatcaaaactgtgcttcagaaggctcccgttgcttagagtgaagtccgaacgtggcctcgaagctccctcgtgctctactgcctccctctccagtctcctctctgggcttgtgccataccagcattgtttccagctcttcaaatatcataagccctttcccatctcagacctttgcaaatgctgtttcttttacatagaatgcctttccctccctgcatgtaccccttgattaattcctactcacctatcaggtatttgtttaaatgttccatctttaacatgacttttcggcagcccaccacccttaaatcagcccacagtttgacagttaaataaactgacaggagctccagtgcgtttgatgaaaaggaggcccgggaagtatacatagtgtattactgttgtcacggtaatttttttatcatggtagttttatttgggtgtttattattttattttgtatttttaaatttaattttattctttatttttatttatttatttaattattttgagacagagtctccctctgttgccgaggctggagtgcagtggcatgaacatggttccttgaagcatcagcctcttgagtagctgggactacgggtgcatgcaccacacgtggctaatttttttatttttttgtagagtcagggtctcactgtgttgcccaggctggtctctaactccagggctcaagcaatcctcctgccccagcctcccaaagtgctgagattacaggcatgagccaccgtgcccagcttgtttattcttttattatctcttttctgttggactactagactataagcttcatgaacacaaggatattctattttgtcttaatgtaccttaatacactccatccctaccacagttcctgggatatattaggtgctcagtaaatatttcctgaatgaacatataaattctgtgcatctactgattattaaattgttttgtgatgaaaaggtctgatgaacgatatcataaggtaaatgctgaatttgatttaaagaccttgaaacttacgatttgaaatgaagatttataacagctaatatcagtttacactgacattgtcttcgggctgcccctcaagcttctattaatatcagtttacactgacattctcttcgggctacccctcaagctcctgttaatatcagttacactgacattatctttgggctacccctcaagctcctgttaacatcagtttacactgacattgtcttcgggctacctctcaagctcctgttaatatcagtttacactgacattgtcttcgggctacccctcaagcccctgttaatatcagttacactgacattctcttccggctacccctcaagctcctgttaatatcagtttacactgacattgtcttcgggctacccctcaagctcctgttaatatcagtttacactgacattgtcttcgggctacccctcaagctcctgttaatatcagtcacactgacattctcttccggctacccctcaagctcctgttaatatcagtttacactgacattgtcttcgttctgcccctcaagctcctgctagtatcagttacactgagattctcttcaggctacccctcaagctcctgctagtatcagttacactgacattctcttcgggctacccctcaaactcctgttgctttcgtctatatcaggtctcattttaaaagaatatgaggctcattttacctcttcttcctccactcctagttttcctttttatatttgacattggcagtagttccagtacctttgattaaaaagcaggcccaggaaatctaaaccccagaagtatacacagtgtattaccattgtcacagttttgctctttggtatatttttatcttcattatttgctgccttaagatagattttgtgatacatataatacattgtgtgttacatgctgcttttgttaaataaaaatatgttaattctcattaaaaatacagttgtatttatttcattgaccatatacataccttttcctaaacacctgtttgttttcttgttcatttatctcatagtttagaaatttatggtcctagtttaaatttttaaaaattacttataaagacttcactatttttaagctcttggcattttgttgttttaataggtaaaaccttatccagggctctttgtgaaagtattgtcttctctgatttccactctccatgtggcaaatgagaaaaattgtcatgttttgagcacctcttacctgtaatcaaaattctatgtaatactttaaatttttgtctttttaattgacaataattatatagatacaatctatctctaatacagctaaccagttgttatgttggttggtgaaagataaaggattcgaagaaaagggaaattccaccttcccctcttatagtcattaggagtttcacagaggcagagatgaaatgccggttcctcctttaggttgatgcagaatcctcatgtcctaattataatatatataatttggattaatgttgaaaagatattgtttttattgatgccagttctgcttggttaaaacccctcatcgtaggaacaggactcactagtttcaaggctactatgctaacaatgttgatgttctgttttatttctgcataaaatcatttttcagaaatcatgcctctcatttcttgattaatgtggcatgaggtattgagactatcctgaattatacaagtggaaaaactgtgtccatgggtttttgtcccccaaatattctcttcctgccctgtcagtagcttagtaaaccatttgaaagatcgtcagtgacctttccttttctcatttcactagtcagatctgcctgcctgacatttgctaacataaatgctgccttctgtttcttctctttctcatttgaaatgtagtcgctgtcagggttgaatcaagtgggctgtgctgctaccctgcctcattcttctgccttcacgcctcttaaggtatctcttgttattgtaattcaccaggaagtttggggaggaggtggatataaggtcttgaattttttggtgaattgatctaacaatctgaaatataggatcgcataaatatacctgtttatggaactatttgtttaacattgatttcccttgaaattttttgaaagttttatgatgctagagatagtcatagagctcacattaattcttcgtattcagattgtttgatgtgtcattctgatttttttatcaaaggtgtttttcttgtgagttattatttcactttggttagtatataatattgaattaactctgttgtctaatgtgcatgcaaaataatttgagtccaaaaaaactatcactaccaaaaccttctacagtaggggtcaaccaactatggcccctaggccacctgtttataagtaaagctttatttttacatagccagtcccttttgtttatgcattgcctatggctgcttgcacagtaaacagctgaggtggaataattgtgaccaacatcatatacctacaagcctaaaatatgtacagtctggccctataagaaaaaaaatcgcaaacccctgctttttatcagcaataatgtcataagagatgatacattccaccttctggaaaaatttaatctaaactctaaaaattaagaacctgtagtattttattttttgaaggcctctaggagtggtaattccatatttgttatcactggatatgtacaaaatgatcaataattctcactgtcaagaagacctttgtctaacttacaactgtcctgctgtggtttatacttcttttctttccagagtggagattttctagttatttagcattttttaatgtaagaatcctttttttttttacacaaaatacaatatttttttaatgtaagaatttaaaaacaattacgatgccatccttagcttcttcctaaataaactcagattcttttacatgcctttcccagactgttcatctttaatgaattttcacaagttctgtgccctccattctggcttcatggtccaaactagaaatacatccctcgttagagcttgctcatttagggtgatttttaaatttttggtcttcattttgctcagtatccactggaattctcaaatattttagttatacctcttctatgtgttgagacagggtcctgctctgtctcccaggctggatcctccctccctagcctcctgagtagctgggaatacagatgcgcaccaccatgcctggctgactttttaagtttttgtagaaacaaggtctcactgtattgcccaggcgggtctcaaactcctgggctcaagagatcatcctgcctcggcctcccaaagtgctaggtgtcagccactgcgcccaacctccttcaacttctaaatgacagttactttccacgtgttgtattctttattttttcttgaatatttaattttgctgtttgaatatttttacttgtctcatgtaccagaatactttcaaattgttgcattgagccaggtacactggctcacacctgtaatcccagtgttggtagcccgagggggaatacaattgaggccaggaactcaagactgcagtgagctgtgatcacaccactgtaccccagcctgggacagtgcaagactgtgtctctaaaaacattaaaaccgaattcttgtatcatgtcctttttttttttactttttaatttttgtgggtacatagtaagtgtgtatatggggttcatgaggtattttgatataggtatacagtgcataataattatatcaggtaaatgggctatccatcacctcaagcatttatcctttgtgttacaaacaatccagttatactcctttagttatttttaaatgtacaattaaattattgactgtgatgaccattttgtactatcaaatgctggatcttattctttttattttttttggacccattaactgtccccatttccttcccccaccctcccactacccttcccagcctccggtaaccctcagtttagtctgtctgcattgtgcttttttaaatgctgaccccaactttttttttttttttttgagacggagttttgctcttgttgcccaggttagagtgcaatggcacaatctcggctcactgcaacctctgcctcctgggtttaaagcgattctcatgcctcaggcttccgagtagctgggattacaggtgcccaccaccaagcccggctaataacctcaactttataacaactgtaaatctgagaaacctcctctggttattgttgagcatgccctacatacctggatgcctcctgaaaaaacttcataattctcttccatgtgaaccctttgctagccgttctcaactgggatccttactggaacaacacagaaaattatttcagcaactttttttcaaaatgatctcaaggaaggtccataactggcaccattctagatgtatgggagagaagttaatttgttgtactccatgaacaccttcgggcattgtggcttattcagagtcataactgagagttgttttgactgtgccaaaagttgtgtggtccagacagaccacagtgtcttgttctacagtgactgtcatatgagattaaaaataaaacttcactagatttaagatagataagtcttttttttctatccgacctgctgtactgtcaaattattattttaaaagatttattctttatttttttagtatctctattactttcacagcaattatacattatacttatgaatttatttcttttattgcttagctaggcttaaaagttgagtttatatcagttctgggtttttttttctttccattgcctcaattctctagtgagagattatttcttaaccttttttttgctctccagttttccaagagttcccaaatgtagttaatggcctcacagtgatttaagctaatgatttttagtatcctagaatgcaagtcacttagatttatagctttaataaaaatacatttcagaaaccatttttacacgtctcctctcctctggctttgttttcatcacgcccagtagtatattatctgttgctgtttctttcttttttgttttcctttgagacggactcttgctctgtcgctcaggctggagtgcagtggtgagatctcagctcactacaaacctctgcctcccagtttcaagtgattctcctgcctcagcctcccgagtagctgcgattacaggcgcatgccaccacgcccagctaatttttgtatttttagtagagatgggattttaccgtgttggccaggctggtttcaaactcctgacctcaggcaatctgcccacctctgcctcccgaagtgctgggattacaggcgtgagcctactgcgcccggcctgttgctgtttcaaaccgaaggagagaacattcgctgcccttcattgttgtttcagctcttctcatctcataaagttgcctgttaactttctccttttattccttaatacttttaaatttctagtctatgtcctgttaataggaagtgttttttaaatttctagtctatgtcctgttaataagtgttttttaaatttctagtctatgtcctgttaataagtgttttttaaatttttgaaaatattttttcctccattgtctagaataatctctaccttgaatgtttctctttttgtattattggtccttgaacatgtctttgtttaaccaattttctacttattcacaaccctggaaaataaacatagtcttttacttccttgtaaagatatctggcttttgcctcatttacctgttcattccttttaccagtttctgttactcttgtttgaattaaatttcttatttaaatttccattttttctcaacacccagaacttagtttacttgcatctataaacccgatgaacgtgtcttttccacttaagatgtgaacacactgccttacgagctcagctcactgtttaaatcttagttctccacctgtgatatcaaactaaggaattgttaccagaaaattgtctccaagtgagtcttgagaattttctcaacatatggccttggtttatttatttattatttatttatttatttttagcagttaaaattatttgtcctcatttatctgacccaactgtaagtagcgatgtaagagttctgaaaatattgaaaccaatggtagggaaagtatgggagcagatttgtatgtttgtgttaattttagagtcattatgtccagaaatgtgccttagtcgtatcataaagttataatatatttagattatatttcaaggcaattagatgtcaaggcctaaaaaactattaatgttattctagcttttcttttatttatttatttattttgagatggagtctcactctgttgcccaggctggaatgcagtggcgccatctcggctcactgcaacctccgcctccatgttcaagcgattctcctgcctcagcctcccaagtagctgggactacaggcgccaccaccatgcccacctaatttttgtatttttagtagagacggggtttcaccatgttggccaggatggtctcaatctcttgaccacgtgatccacccacctcagcctcccaaagtgttgggattacagatgtggcccatcgcgctcggcctattctagcttttcttaactgtactcccctgccaagtcttcagcagctttaacctagtcaacctacatttctttgtaaattagcttaactacatttccctttctttaggtaagctttgtaactgtttggctagttcttcctcctttttacagttcttttggtcaatgaattgaaaatgtcttggactcaaatactagtgtagaaaatatatctatcatctcttaaacatcttctctcctaaccgaaattaggaaacctatattactttttaaaaatattaaattttattctccagagaaaaaagtactttagaaactattatggagaaatactattagaaaataaaatgttgctttttctttctcatatatttcccagtaacattttctgtcttaggatgatcatttttcatagtcttaggaagagcttgttaaataatggactgtctttatataaacacaactaggccgggcgtggtggctcatgcctataatcccagcactttgggaggtcgaggcaggtggatcacctgagggtcgggagtttgagaccagcctgaccaacatggagaaaccctgtctctactaaaaatacaaaattagccaggtgtggtggcacatgcctataatcccagctactcgggaggctgaggcaggagaatcacttgaacccgaaaggcagaggttgtggtgagctgagagtgctctattgcactctagcctgggcaacaagagcgagactccatctcaaaaataaaaaataaaaacagctgggcgtggtggctcatgcctgtaatcccagcactttgggaggccgaggcaggcgaatcacctgaggttgggagttcgagaacggcctgactaacatggagaaaccccgtatctactaaaaatacaaaaaaattagctgggtatggtggtgcatgcctgtaatcccagctacttgggaggctgaggcaggagaattgcttgaacccgggaggcggaggttgtggtgagctgagatcgtgccattgcactccagcctgggcaataagagctaaactccatctcaaaaaaaaaaaaacaaaaaacaaaaaaacaaaaacttggcttttaaaaatacagaattaattcatttcaccaaatcctcatttctttttcttcttcttctttttttttttttttttccaaagggggtcaggccaggcacggtaactcatgcctataatccagcactttgggaggctgaggcgggtgcatcgcttgagctcaggaggttgagactaacctggctaacatggcaagacactgtctctacaaaaaatgcaaaaattaactgggcatggtgatgtgtccctgtagtctcaactacttgggaggctgaggtagaaggatcacctgagcctgggagatcatggcattgcaatctagcctgggcaacaagagtgagaccttgtctcaaaaaaagagagagagagggagagagagagtctccctctgtcacccaggctggagtgcagtggcacaatcattactcactgcagtctttaattcctaggctcaagcaaccctccctcctcagcctctacaggagcacaccacaatgcctgaccaattttttagacgttttgtagagacagggtctcactatgttgcctaggctggtctcaactcctgctctcaagtaatcctcgcacctcagcctcccaaagtactgggattacaggcatgagccactgcacctgacccaaattctcacctctagacttaatcgtgaaggagagttacctgttttttgtcttttataatttcaaaattaccataaaagtagaaagtatttcttcttgaataacaattattgatatatgtctgtttctccacagagtgatgacagacctaatgctctattaagttcacctgcaacagaaacaggtaatagacacaaaggtgcaattaaccacatcaagattataattctttatttttttatttaaaaaataataataaatagagacgaggcctttctgtgttgaccagggtggtctcaaactcctgggctcaagggatcctcctgccttgttctcccaaagtggtgggattacagatgtaagccacagcacccggctaagattataattttttaccaagattttcctaaattacttgttagagagctgtggctgctttttctgagatagaaatcagatacagaattggaaaccactgggtttttttttttttttcccatttttaaattaaattggttgctcagctagtcagccatttgatatgaataagtgaacaacagccgtaggtctgcgggagactgttcaatatgataacattcattctgcctttattgataacaccaaaaataacatgacaatgtaaaatacatacaagcggtcctcctggtttcatgattattttctgtaccagacttttcatcattaaatagaattattttatatcattgccatgtttattttttacttgttacttttgtaacttgtatgtctgctattatattttcatctcctttaatctcattttatttttcatgctaatttagttcatcattcccctgcatattcttttcctgctgctatccagagaaatcagcctcagcgccctgaaagcttccttttccgagcaggtgtcagggcagaaaccaacaaaggtaggtggtggtgattttaaaagccaggagcgaggggaggtttacacaacgacgctagctgttagatggatgcttttaaacttctgcatatagtataagacaaagctatcagctcggcaaaagcatgtgtctgtgatctcactgatactaaagcaggaaaatcttatctgaatttgtttggatgagaaagtttcttagtgccacctaaaagcaggttatagagtgtttgaacaaataaaatgcgctttcgaggctttagagaatgttctttgtcttggtaatgaactctttttcacatttttctattgataaaagctgttttcttaaaacaataattgttttaaaatctactttaagtctcatgttcttttagttaataatgacaaatttctccctggtccccaaagaagttacctgggagtggaaacaaacatttcaagtcaaaaataacaacttttatcatggtggtgtgtgcctgtggtcccagctacttgggaagctggcggggaggattgcttgagcccaggacttcagggttacaatgagttataattaaaagcaccactgttctccagcttggccaacagagcaagactctgtctcttaaaacaaacaaacaaacaaacaaacaaaaataaggtcaggcgtggtggctcacgcctgtgatcccagtgctttgggaggccaaggcaggcagatcacttgaggtcgggagtttgagatcagcctggctaacgtggtgaaaccctgtctctattaaaaatacaaaaaatggctgggcacggtggctcacacttgtaatcccagcactttgggaggccaaggcgagcagatcacgtcatttgaggagttcatgaccagcctggccaacatggcgaaaccccgtctctactgaaaaaatacaaaaattagccgggtgtggcagcaggcgcctgtaattcctgctactcaggaggctgaggcaggagaattgcttgaacttgggaggcagaagttgcagtgagccaagatggcgccactatactccagtctgggcggtagagtaacaaactggccaggcatggtggcaggcgcctgtaatcccagctactcgggaggctgaggcagagtcgcttgaacccaggaggtggaggctgtagtgagctgagattgcgccactgcactccagcatggatgacagtgtgaaacttatgtctcaaaaaaaattaaaaaataggccaggcgtggtggcacgtgcctgtaatcctcgcactttgggaggccgaggtagatgggatcacttgagctcaggagttcgagaccatcctgtgcaacatggcaaaaccccatctcttaaaaaaatacaaaaaattggctgggtgcggtggctcacacttgtaatcccagcactttgggaggctgaggcgggcagatcacgaggtcaggagatcgagaccatcctggctaacacggtgaaaccccatctctactaaaaatacaaaaaaaattagccaggcatggtggcaggtgcctgtagtcccagctactcgggaggctgaggcaggagaatggtgtgaacccgggaggcagagcttgcagtgagccgagatcgcaccaccgcactccagcctgggtgacagagcgagactccgtttcaaaaacaaaaacaaacaaacaaaaaaaggcatggtggtgcaggcctgtagtcacagctacttgtggggctgaggcgggaggatggattgagcccaggaggttgaggctgaagtgagtcaagattgcgcgattgcactccagcttgggtaacaaagtgaaaccctgtctcaaaaaaacaaaaaaaacacaacttaccttcaatgttaccaacagatgcattcacagtaagatttaaaagtcaaactacagatgcactgctggtgagagtgtaagaaagcatggaagactgttatcagtcagcctctgtacccacagattctgtatttatggattcaaccagtcatggacagaaaaatcttcagaaacaagacaacgataataaacaatgccacaataaagaaataatactaattttgaaatacagtatagtaacaatttatatagcatttacattgtattaagtattgtaagtaacagagatgatttaaagtatagtataaaggaggatatgcatagtttgtatgcaaataatactacattttatatgagtgacttgagcgtccacaaagtttggtatgagagaggtggtttctggaactaatttcccctggatactgacggatgactgtgtaccctatgaccagcagttttacttttgagaaatatgtacacacgtgtaccaacaacgtgtacaaaaatattcatagcagcattattcataatagcctgaaactgaatgtccatcaagagaatggataaatgaattgtggtatatttgtacaatggaataccatataagcaatgaaaatgaaccaattcctatatacagcaacatggataaatctcataaacttaccattgatcaaaggaagccagaagcaaaagaatacatacaatacagcataatttatacaaagttcaaaaatgaaccagaccagcctacagtgttagaagtcagggtgcggttttgagcacgttgggtacttatgggcaaggagcatggaaggggctcctgggattggtaagattgcattaaaaacctgattgtgttcacttggtgaggagaattttttgagcactgtgcttacgatttgtgtatttttctgtgtattaattttcaataaaaacatttttaagtggatgtaatcaaacaaaagtagttgagtcaactgggtaatgaacattacatatttttctatactattctctgttgtgtatatttgaaaatctccataataaaaacccttttaaaaagtcaatccagaaagtggaaagcaatatactgtacttgcaggaagtagaaaccaatatactgtacttgcaggaagtagaaagcgatgcactgtacctgcaggaagtagaaagcgatgcactgtacctgcaggaagtagaaagcgatacactgtacctgcaggaggtagaaagcgatgcactgtacctgcaggaggtagaaagccatgcactgtacctgcaggaagtagaaagcggtgcactgtacctgcaggaagtagaaagcggtgcactgtacctgcaggaagtagaaagcggtgcactgtacctgcaggaggtagaaagccgtgcactgtacctgcaggaggtagaaagcggtgcactgtacctgcaggaagtagaaagcggtgcactgtacctgcaggaggtagaaagccgtgcactgtacctgcaggaggtagaaagcgatgcactgtacctgcaggaggtagaaagcgatgcactgtacctgcaggaagtagaaagcgatacactgtacctgcaggaggtagaaagccatgcagtgtacctgcaggaggtagaaagccatgcagtgtacctgcaggaggtagaaagcgatgcactgtacctgcaggaggtagaaagcgatgcactgtacctgcaggaggtagaaagcgatgcactgtacctgcaggaggtagaaagcgatgcactgtacctgcaggaggtagaaagcgatgcactgtacctgcaggaggtagaaagcgatacactgtacctgcaggaggtagaaagccatgcagtgtacctgcaggaggtagaaagccatgcactgtacctgcaggaggtagaaagcgatgcactgtacccgcaggaggtagaaagcgatgcactgtacccgcaggaggtagaaagccatgcactgtacctgcaggaggtagaaagcgatgcactgtacctgcaggaggtagaaagccatgcactgcacttgcagggaaactgtgatgaggcagagccggatgttctcctagcactgccagttgcctttctgtcttacatattaatatttttataggtcatgcttcaccccttcctccatctgctgcacctaccactgattctacagattccataacaggacagaattcaagacagagagaagaagagctggaattaatagaccaactgcgtaaagtatgtacattacctttgatttacactttttcagtattactgctatagatcataatcctgtgatcacgtcttcatttgacacatcatttttatttattttttttttagacggagtctcactctgtcacccaggctggagttcagtggcatgatcctggctcactgcagcctatgcctcgtgggttcaagcaattcttctgcctcagcctcctgagtcgctgggattacaggcgcccatcactgcacccagctagtttttgtatttttagtagagaaggagtttcaccatgttggccgggctggtctcgaactcctgacctcaggtgatccactggcctcgacctcccacagtgctgggatggcaggcgtgagcttccgcgcccggctgtaatttttaacagattagtgctgggattgcaggcgtgagcttccgcgcccggctgtaatttttaacagattagtgctgggatggcaggcgtgagcttccgcgcccggctgtaatttttaacagattaaatgagtgcccattgtgtgccatgttttgtgatgaatgtaaacattttgctattaaggaaattcttttcagctatttacttagaaaatgagatagatggcttattctataaagctcaattcctagctctactcatttaaattttttccttttttctacttcctgttataaagaaatattgtcagtaataatttatatgtgtgtgcacacatatataaatatcacacttacacatatatagtgagtgattgcctctttattttatgttggaattgaaggagaatctaggtttttttttttaatcagaaagttgtaaatgaatttttgttgtactttgtaccactatgccctggctgccgtccatatatattagatctccttaagttaaacttaggatagagggataaaatggatattgtggtacttatttcctttttatcttgatttttaattagatttcattataactcccttatgtcctatatgtcagtctttcttcaattaatctattacatgttttttgttctttcagcatattgagtaccggttgaaagtgtctctaccttgtgatctcggagcagctctaactgacggtgttgttctttgccatttggccaatcatgtgcgacctcgatctgtcccaagcattcatgttccctcaccagctgtagtaagttgataatcctaaaaagccttggctattcatcagacatttgttaagcacagtggacagacatttcttaagcattgtgctagatattaaggatacagatataaagagtccagtctctaccttcctggtctcacttctactcgagaagaaatagacatgtatacagctacttacagcagtgcgataaatgtaagaaaggcatgtacagtgtgtgttatagggatataaaaaggggccacttaactccacctggagagttcagggaagccttcccagaacgggcaaaatttgaactaattcttgaagtttaagaaggaattttccagcagtacagagaggggagggggccttccaggcataggatttctagattcagaagctaaggaaagtttggcttttacttaaggaattggtaaattgttcagaatggatcgtgcacagggttgtaatacaaatggtaaggggtaaggctagagacgtgagctggggccgtggtacaaaggccttatgaaccgtgtgaaggacgtttaccctagtacagacaatgaggatacactgaattaaagagggaataccatgattctaactgcagtttagaatgacgaatctaggctgggcgcggtggctcatgcttataatctttgcaatttgggaggccgaggcagacgattgcttgagcccaggagtttgagaccagccaggacaatatggcaaaaccccgtctctaccaaaaatacaaaaatcagctgggtatggtggcatgtgcctatagtcccagctactcaggaggctgatgtgggaggatcacttgagcccaggagttcgaggctgcagtgagccgtgattgtgccagtgcactccagcctaggtgagagagcaagaccctgtctcaaagaaaaaaaaaaaaaaaaaaaaggaatgatgaatctaggtgctaagtgagaaatggaaaaattaaaggtggtacactacaaagatgcccaagccaggctcagtggcttgtgcctgtagtcccagctacttgggagcctgaggcatgaggatcctatgagcccaggagtttgagaccagcttgggtgatcttgtttcttaaaagaaaaaggaaaagagactgggtgcactggcttacgcctataatcccagcgttttgggagcccgaggctggtggatcacctgaggtcaggagttcgagaccagcctggccaacatggtgaaaccccaactctactaaaaatacaaaattagccaggagtggttcatacatctgtaatcccagctacttgggaggctgagccaggagaatcacttgaacccaggaggcggagcttgcagtgagctgagatcgcaccactgcactccagcctgggcaagacagagcgagactctgtctcaaaagaaaaaaagggaaaagaaaagaaagatgcccaattaaaaggctgttgtattagtccaggccaggaagataacaagccgggactaaagcctggactaactgggcagtgagagggaagatggttcaaaggtaaaactgacatgatctgtgaccgacctcaggtggaagatgagggagaaaatgcattcaggataactggcaggttctctttgcactgctggtcaggtctgggcatcagtttcaggatggcagtccacaaaagaacaggctttgggttgacacacccctcctctgttttcctcacatttttatcatgaaaaatttcaaccttcagaaaagtggaaagaatcctacaacgaacactattaaagtctgcacctagatctgacgtttcttgcattttgccgcacttgctttatgtatctatatttgtatgtgtattttaactacaccatccaaaacttacagatgtaatatacttttcccccagtgtgtttcagggacctgtcctaggccaccttgctcttcccttaagcccatagccagtgacggacaagcatggggctgagccctcctacctcaaggagggagtgtcgtgtggttcacacttgtgagctccctgtgggatcaagctgaagctgagaaggagacaagcaggaggatcacctgtggctgggagtttaagaccagcctgggcaatatagtgagatcccatctctacaaaaatacttaaaaaaattaggcgtgcacctgctactcaggaagctgtggcgggaggatcacttgggcccaggagtttgaggctgcagtgagccacgatcatgccactgcacaacaacctgggcaacagagcgagaccctgaccctaaaaaagaaagaaagggccaggcacagtggctcttgcctgtaatcccagcactttgggaggcccaggtgggcagatcacgaggtcaggagttcgagaccatcctggccaacatgatgaaaccccatctctactaaaaatacaaaaattagctgtgcatggtggtgcacacctgtagtcccagctacttgggaggcagaagcaggagaatcacttgagtccaagagacggaggttgcagtgagccaagatagcaccaccacactccagcctggcgacagagtgagactctgtctcaaaagaaaaaaaaaaaaaaaaaagactgaaaggaaatgaatcaagtgttgtagttacatttaaatgatgaactatgggtaattaatttttttggctgttcctccaagttttctttagtgcaggggtccccaacccctgggccacaaatgggtaccagtctgtggcctgttaggaactgggctgcacagcaggaggtgaacaggccagtgagcaaagcttcatctgtatttacagccactccccattactcacatcaccacccgagctctgcctcctgtcagatcagcaacagtattagatcctcagaggagcatgaacgctggtgtgaactgcgcatgcgaggaagggatctaggccacgggctccttatgagaatctaatgcctgatgatctgtcagtgtctcccatcatccccagatgggactgtctagttgcaggtaaacaagctcagggctcccactgactctacattacggtagatttcattatgtatgattatttcattatatattacaatgtaataatagaaataaaatacacaataaatgtaatgtgcctgaatcagcctgaaaccatcccccccagctccagccctgtccatggaaaaattgtcttctgtgaaaccagtccctggtgccaaaaaggttgaggactgctgccttagtgttacactgttttaaaatggaaaaaaaaagtttgtaactattcgttcaaagtttttctatttagtacttgccttccaaaatcaaagccaatgtctcaagtgtggggtgacaaagtactgcccacaggccagcacttcttcttgtaaatcaagtttcactggaacccagtcacactttcttgtttgcatattgtctatagttgctttcaagctcctggcagactcgagtggttgcaacagttctttttttttttttgaaatggagctttgttcttgttgcccaggcaggagtgcaatggtgcgatctcagctccccacaacctctgcctcccgggttcccgggttcaagtgattctcgtgcctcagcctcccgagtagctgggattacaggtgcccgccaccacacctggctaatttttgtattattagtagagacggggtttctccatgttcgtcaggctggtctcgaactcccgacctgaggtgatccgcccacctcagcctcccaaagtgctgggattatggcgtgagccaccgcacctggcattgcaacagttcttatggccctcagaactaacatttattatctgatcctttaaaaaaaagttcgctgaccccctagtctacagcattgagagttatgaagcgattgccaggagtatttctaaagttagcaaatattttttaatgttgctagtaggctgggcatttagctgatgcctctgatcccagcactttgggaggctgaggcaggcagattgcttgaactcaggaattcaagaccagcctgggcaacgtggcgaaccctgtctctacaaaaattgcccaggtgtgatggcatgcaactatagtcccagctacttgggaggctgaggtgggaggatcacctgagcctgggaggtcaatgatacagcgagccaggcttgcgccactgcactccagcctgggtggcagtgagaccctgtcccagaaacaaaacttctctagtaacacattttcttttcctcatttcagcctaaattaacaatggcgaaatgcaggcgaaatgtggaaaatttcctagaagcttgcagaaaaattggtgtacctcaggtaataaatttatcattttttatgttgcctaaatagacttggttgtcctaaaattttagaaatgtaaatctctaaaatcttacaggactagctctgagctaagtcgatcataattaacatgactttgtgttacaagagtcagtgtacttttgaacagttttccttgattatttccaaggaccacacaaagaaattataaatatatagattgaaataagtataagtaatttgaaataattattctattttcctaaactttcccacttgctatttgacaactaaatatatccttcaaaaactaagtatatctcagattgagaatgctgcagttggcttcagtgttctaacacttgctttgatactttttaaaatgttttagacttccagaaatgttgaaaaaatagcctagagttccttttgtatacttcagtcaatttcttctaatgttaactaacgtctaatacaaacataggacagtaattcaaactaagtaacatgagaacaatacgattaactgaattacaggctttatttggatttcatcagtttttccatgaagctctggttctttggagtctggcatgcaacaggccatttctaagctgttgtcctgctatgaggatttattgcctccagctcagttataactttattgccctttaatattacaaatagttaaatttatttatagatgcgattaagggaaatgaacttgatacagtcttatccaataacccctttaaaaagcaattatattaaaccaactaagtattatactattaaggaatattatgtggtataaagacaaatttaaagaaataaatgacttggtgccatgtgatactttttcattaaccacgaccattacaagtcttgttaacatattttgtctatagcctgcaaggaggaaaacatgattcttctctatcaccttctaattaggtatcagtaactcaggggtggccctggggctcatcaacagctccaccattgctctcagagtttggttcctgttcctgtagcttccatgacagtgattctctttacccaactcaccgcacccatggcagtgattctctttacccaactcaccgcacccatgacagtgattctctttacccaactcaccgcacccatggcagtgattctctttacccaactcaccgcacccatggcagtgattctctttacccaactcaccgcacccatggcagtgattctctttacccaactcaccgcacccatggcagtgattctctttacccaactcaccgcacccatggcagtgattctctttacccaactcaccgcacccatggcagtgattctctttacccaactcaccgcacccatggcagtgattctctttacccaactcaccgcacccatggcagtgattctctttacccagttcaccgcacccatggcagtgattctctttacccaactcaccgcacccatggcagtgattctctttacccaactcaccgcacccatggcagtgattctctttacccagttcaccgcacccatggcagtgattctctttacccaactcaccgcacccatggcagtgattctctttacccaactcaccgcacccatggcagtgattctctttacccagttcaccgcacccatggcagtgattctctttacccaactcaccgcacccatggcagtgattctctttacccaactcaccgcacccatggcagtgattctctttacccaactcaccgcacccatggcagtgattctctttacccaactcaccgcacccatgacagtgattctctttacccagttcaccgcacctctttctaactagccaggagttgactaggccacagcatcacatgttacaaagtgaaagagagagcgcccagctccacagatcatctgtgtcagccagcaggattcccaggattgtttttctcttatgaaagtagatcatcattctattatttattttttacttttttcttttgctgttttttttttaactgaattatacaagaatggaaatttacataaagtggtagttagcaaacacctttttgattcctatggacaaattgaaagcaaaattttcgtttttatattatgttgttttataaagggtcatcttttagaacagacctttttaaatattttgagagcactgaatatggtttctgaagaaataacatacattcttttaaacaagtttattctaatagtgcacattagcctccagttcttcccttctgcttcctaaagaggttcttgctacacaaacatccagtgtctgctctagttccctgccacagtgtctttaaacaaagagagtatggcatgggttggtgcagagaatgggaaatgcaaaatagacaggagagtgctgaaaatggccccactcaagcaagtcatgttgacttaccagatgtcaaaacctgttgaaaggtctaagcctgtccgcggggctttcggaagcatcctctgagggtctctgagatttaaagtccgtaccttggaattatttcaggatgttcccaccatcagccaacaaagtacaaaacagtgtgccttaaaatacacatttaagttggtatttgcatgcagtggttgaccatgtttgttatgggccagcctgcccctgttcctaccagagctgtgctgttggaaggcaagtacgaagaaaaaaaaaatacagttttaaaagactgggtctttttccagagtggttaggctgaggttttgatgcatcctccctccttctccgtcaccagaaagaggaaatggacgttcccataggctgccccttccttctccccttccacctcccacccacgtccccaccacaaccactgccagttttacacggcttcctagcaagctgctacttctgctgaaaaattagtcatctgtctagaacaaagtgaaagaaaatgaataaacgcacaaactcgtaggttcaaactagccttctgaggtccctctgccagaggaagagaagaaacttctacctcctcgtcttcctttttctcctggtctccaggtcattctggcctttacttaaacatccccactttgctctgtgtgacttgaacattgggaatgtaataatgaccacttttgaaaatgtaaaacagaaaacaatattacaaatatttttgtcagattctatacccaggtaagatagataaagacaaataatttcccttctctgtgtaacttttaaagtgttgtacaagttaaagtatgagtgaaatactgaagaacaaggcagttattaaaaacctctgatgacattgggcatgtgggtatttgctttatttttatgcttctattcaatatgctacattcaaaaaaactgtaatgggtgattaaaaacttgtatctgagtccagtatcttttgtcccagagtcgttatgttatgtgttaaaggatgtctgtctccctgttgtcaagtccattcttgtatttatttaatgaattttgcaatctgtaaaatggagggtttggatgatctctgaggcccttaacagctctgccttcattttgaacacattctcgagctggacttggttaaaatagacaccccctggccgggcgcggtggctcacgcctgtaatcccagcactttgggaggccgaggtgggcggatcacgaggtcaggagatcgagaccatcctggctaacatggtgaaaccccgtctctactaaaaatacaaaaaattagccgggcgtggtggcgggcgcctgtagtcccagctgctcgggaggctgaggcgggagaatggcgggaacccgggaggcggagcttgcagtgagccgagatcagcgagactccgtctcaaaaaaaataaaaaataaaaaaataaaataaaacagacaccctctgatttttagaggaatgccaagtcattgaatgcatttggcttctgggtagtaaattacccccggatcatgaggctttcctcagtctttgaacctttttgatgtacatggctttctccaaaaacgtccgtctcctcagcctctgcagttttcgtccttgctttctgacctactttttttttttttttaaatagaggagaatgagtcaggaaagaggttgcttcacacacacctcactacattcaggcctcacacgaccctaaaccaacatccacttctgtgtattgtattttttttttttttttgagacggagtctcgctctgtcacccaggctggagtgcggtggcgcgatctcggctcactgcaagctccgcctcccgggttcccgccattctcctgcctcagcctcccgagtagctgggactacaggcgcccgccaccacgcccggctaattttttgtatttttagtaaagacggggtttcaccgtgttagccgggatggtctcgatctcctgacctcgtgatccacccgcctcggcctcccaaagtgctgggattacaggtgtgagccaccgcgcccggcctgtgtattgtattcttaatgttcagaccagtcaccaacaaacgaattttattctgctatttagtagtaagatcaggctcagcatggagaagattctttgtagtttgggttttcagcgttttatttttgttcctcaatgtaaaaatgttacaggatgtgtatatgtgaatatgactgagatgatcatatgaattctatactcaaatctgcatttctgatccactgactttgtttttctgttttcctttcctgcttacactttggacaggacaatctttgttccccttccgacatccttcagctaaacctcagcgttaaaagaactgttgaaacgctcctttctcttggggcacactcagaagaatccagttttgtctgtctctctctgcagcttctgggttttgtggcattttactgtactgtgatgttaactctctgtgtgctttattactggctcttccccgctcgctgaaagattgcactccggtgactttctgcctcattcctgtgcttggtaaaggaggtttgtttctcatccagaattatttacataagtgctttttctccctgctggccctcaaagagctaacccataaaggaggtaaatcctttctttatatttgcagatgagcaccccctcacattagtaaacatttacgattgctaacaaagagtaaaagaccagcattttttctcctggtcatccgtccattctcctggcctgtggccttgtttctcttaccataaatgctgaagcatttttactaatacaattctgaacttgtacttcgaatatgacatgtagagctttatttccaagtcacacaatacaactcccatctggccatttttccgtgcctcagcacaagtgttgaattgtggagtgactgaacctttgcagcagctgctcacgaggagaaccgtcgtgccttttctggttttggccgcacccggttacttagatttctgctttgaactgtgtcctgagatcctgaatccccgctttgtcggtaggcacaggtccatataagcatttgcggtctggacgtttcaaaggtattggccataattttaataattttagtttggtcagaatgttcagtttgaagatcacccacattccctagactgctcttctgagcccagtctatacgctgtatgtgctgcacacgagcagatgggctggagctggcctctcagggtgggcaccttccagattgtgtttgttatgtgtgactgaggttcactcccagcattctgtttaaatttggaatttatgtgatttctaacatattcaaaccttcttaatagtgaaacagtagcaggagaagtattagggcagcagtccctgttctgtgctcaaggcagtgaatattgtctagctctttcagaatgcgtagcacttagctgctagacgttaatgctggaaactataattgcggttagattctagtttcataagtggtgtttctgaatattcaggaaccttctgaactctgttaacaaaattgggataaaggatgaactcaagtgtgaagagagattgtgaggagcataatatccggtttagaattcagcctgagggaggagcataacatctgggtgtagaattcagcctgaggggctcactggtttggttttcttccatatgaaatgggacagctattttcacaggtcaaaagactgttcactattaatgctgaaacactcaacactgtgatgatgaaaacttcagttttctgtgtcagtaggtgcctttcagactttggggaattgggttggttatatttttaagatgtctcagagttgaaacacctgttaaaaaacacacacaggctctcatgtggtttaggggttgtaattgtacattctcttgagaacacacggcactccctctagtccagctgggaggtgagggtgccccagaaagcacaggcttctgagtgtgaacaccggccgcgcaggtcctagggcgctgctgagaggaagagaccagggaatcagccttggagaaagcacgtctcttccgacagcaaaacactgggcaggttcattttaagtatcatttatctagacttgcagttgcactcaaagtatttctacaaagttgctagtttttttagatcaaaagattacagttacctcattttatcaaaataagtattaaataaaaagtaagcacaagtaccaataactgcctcaaaaatacttgttatatattttattgtaactggttttataaaatttcctagtaatatcgtctcaatgaaaagcaaaacaaaaaacaaaaaacaaaaaaacccaactagttgttttaacaaacatatataatctttttttagtggcaccagaattctatattctgttctttgtaagagcaatctcttttctttttggaatatttaatcttaacagaaagctagtgataaatgctgttcttaagatttgcctttttctctcacaagaaagggttaacctaacaaattaacgatgcacacattaaggaagcgtttaacttcctcaagcaaacagtgtcaacacttctcacatgttggtaatcaacatgttcctgcctaagcttacatagtagttccctggaataattcaggctgttaaataccaggatattaaatcctttacattttcaaatactgcttttaattctgtaattcagatttttaattcagacaggcccttccatgaattattcaaattagggggaagtttctcaagagctcaggatacactgagtttcttgccctatctggtctggaaaccctggttttcacagtcaggattataatgcagatagcgtagaactcatgcaggctgagttatgttttcaaactatctttcattcttgtggtagggaacttaccctcaagtgtagtatcttttactcttgagccatctggtagcgtggaattgtttttctatttttcacctgcctattttatagacctgtattgaccttttattcatcagggataaaggatgttgctttcaccctgcggtattgttttccctctgttgtatgtatagatatatgctacttgtcaattttccaattttgaaaatgatctgtatgtacttttagttgtattaataaagtgacagtgagtgtcagacaccatctctctaactcatatttacactgaggtcagtttcccaggtactaattttcatatctaagttgatgattgtgaaggggagaagtgcttattttttcctttcagttctatgatattcatccgattttcttttttgtttgttttcatgttacgttgtccctttcaggagcaattatgtttgcctctccacattttagaagagaaaggtttgagccaggttgcagtgacggtccaggctctcctggaacttgccccacccaagcaacagcagcaccagttatctgctgtttgaggatccccaggacggtgggcactggcctggccaaaacaaggaacaggacaccgtgattgctgctgccagctgtctgcttaaacaaagctcttgtgtgttctcagaagggaccgttcccatgattcctaacaggaatattttgcttcatttctccattttaggggaggttatttccatttccattgaatttttttacgaagacaccattggttttctcagatgaaacttctcttactgaaaacccagcacctaacttggctgtgttttcctggagagcaggcgtgtttcacgtgccagaaagcacatcttctgtgttaggcacaagcatgctgtgccattgtttttacctggtctcaagacaactggtctgctggtttctaaacttggttgttcattagactctcctggagtatttgttaaaatacagattcacattcagtagagctggggtaaggcctaggaatctgcattttcaacaaccattgcacatgtttttgtttttgttggagaaggagttctgctcagtcgcccaggctagagtgcagtggcataatctcagctcactgcaacctccgcctcccgggctcaagcgattctcctgcctcagcctcccgagtagctgggacaacaggtgcccgccaccatgcctggctaattttcttgtatttttagtagagatgggattttgtcatgttggccaggctggtctcaaactcctgacttcaagtgatccacctgcctcggcctcccaaaatgctgggattacaggcgtgagccactgtgcccggcctcccagagtgctgggatgacaggcgtgagcccccgcgcccggcctccgagagtgctgggattacaggcgtgagccactgtgcccggcctctgagggtgctgggattacaggcgtgagccactgcgcccggcgcccggcccattgcacgtgtttttcatgtagtggaaccactgttcaaagctagatatttgtatgtttgcgggggagggtaatggccccctgcatttttcacccacatttaaaatcaaaagctatattatgaggagttggactgttctgtcaaaggcaaaacaaaaataatatagaaggcctaggttttgcatagtcttcttttttttaagagttggggtcttgccgtattgcccaggctggtctgaaactcctgggctcaactgatcctcccgcctcagcctcccaaagtgctgggattactggagtgagccatcgggcctggcccagattttgcatagtaaaacagtgaaacagatagagttgtatttaaggtcagtattctaggcctcccttcaactgcagtcataccatcatagaagatagttctatgtcatcctgttatctggacattataataaacaacaagccctctatacacaggttccaaaccccgttatctagacattatcaacaacaagccctctctctatacagagtttccaaattctgaagctgatagcgcacttggtctcactgagcctccctccccgccctcctgctgctcctcagacatctgggcctgcagacacattgcagttacagcacatacacttctagctcggaaaagcctagtttcttgtatttctttcaggtaactgccagtttctgtggctgaatttaagcacttacagcatcttcctagctgggtgtggtggctcacacctgtaatctcagcactttgggaggctgaggcgggcagatcacctgaagttgggagtttgagaccagcctgaccaacatggagaaaccccgtctctactaaaaatacaaaattagctgggcgtggtggtgcatgcctgtaatcccagctactcgggaggctgaggcaggagaattgcttgaacccaggaggcggaggttgtggtgagccaagatcgtgccattgcaccccagcctgggcaacaaaagcgaaattccatctcaaaaaaagaaaacgcgccccatctcgctccaccacaagcgcctttatatactcaatgatgggtggaggaaaagggcccaagggctcacaccgcacaggagcctttactcaagtttcagctagttttccttcccctgcattttgaactccttttagttgttggtgatatcctttggtgttcactgcctttgtaaaacaagtaaataaagtaagcggaagatatctcttttgtttctgtagttgttaactgttctggattttctttacaatgcatccatttgggcataatgttatccctctttttatcaggtaaatgtagcatctaaaagtagctttggatcaaatcatgttgaatacctggtcaaagtaatgttttcttccttgttcttgcagagaaacaaattcatcagaacattaccacttgaccaggtttaaaattgtataacaggctgggcatggtggctcatgcctataatcccagcactttgggaggccgaggcaagaggatcacttgagcccaggagtttgagagcagcctgggcaacatagcaagaccctgtctcccaaaaattaaaaaaaaaaaaaaaaaaccaggtgtggtggcacctgcctgtactcccagctactcaggaggctggggtgggaggatcacttgagcctgggaggttgaggctacagtgagccatggctgcaccactgcactccagcctgggcaacagagtgagaccccatctctaaaaataaattgtacaacatctaacttcaatgcccaatcttatagaacaaaagtaaaatgtctttatgtaagaccccattatatttacagttcccaacagacccaccaactcttatatacccttatataacttgtttagaatttagccatgtgcatttttaaactgtgtttgtcaacattaagcctcagtacagtctccaaattatatgccaccagaaatgaaattcagcaaaggacaggattgtttttaacatacgcaagccagcctggccaacatggtgaaaccttgtctctactaaaaatacaaaaattagctgggcgtggtggtgggcacctgtaatcccagctacttgggtggctgaggcacaagaatcgcttcaacctggaagccgaaggttgcagtgggctgagattgtgccactgcactccagcctgggcaacagagcgagactctgtctcaaaaaaaaaaaaaaaaaaaaacccaccaaaccaaaaatatactatgcaaggaataattctagaagacattacataatgcaatacttgcaacatttgcaactaattttcccatagggataaatggaaatttcaacttatttcaaattttgcacatattatgaaaccttattaatgtatttttatcaaactaaatcagatttgtatttgaattgttaggaaaaaccatgtgcagttttggctgataattgaaggaaaaatatcaaatgctttgaattttttttctcttttttcaaaccctctgcagaggtaggaaggtatgaatttcttttttatgtcaagatgcaaaaacaaatcatgatgcttttgttgggagaatttttgtattcagtattttgtatgtacctttttttttttaaattggaaagcacaattcggtttaacatttagctttgcttgactccagtgtaagatgaagatgaccttgtcacagctcccctgacctgaagcagagcccttcccatcactgacagtgttgggggttgagagccccccagcagagcccttcccatcactgacagtgtgtcggcagctgagagctcccccagcagagcccttcccatcactgaacagtgttggcggctgagagccccccagcagagcccttcccatcactgacagtgttgggggctgagagccccccagcagagcccttcccatcactgaacagtgttggcggctgagagccccccagcagagcccttcccatcactgacagtgttgggggctgagagcccccctagcagagcccttcccatcactgacagtgtctggggctgagagccccccctagcagagcccttcccatcactgacagtgttgggggctgagagccccccagcagagcccttcccatcactgacagtgtctggggctgagagccccccagcagagcccttcccatcactgacagtgtctggggctgagagccccccctagcagagcccttcccatcactgacagtgtcgggttgagagccacccccagcagagcccttgccacgtacagagattttctgtcagcagtttcccagtatttcagactcataatctgtgtttagcactccagtgttctcttgtaatagccaggtctggaaacgacccatggaaagaggggcctttgtattctgctagaacacagagcatagtagtagatcacttttctgaagagctttttaaaatacagctaatcaaggagtttgcgatttctcttactttctacagctcagcagtgactaatgatgtgtgactatgcgaatgagtttgatgaattcgtaaaaactaagcgcttaaatggttatagaaatgaaaacatggatatttagaagcctttctatatacacagtgcagttgagatggtttacagcaaatttcgttttatttctgaaaatgttgtaaacatgtaattagtgaaagattttgtaaaacattgtcctgtatttttgtctgtaaatatattgcataagttctaagtataaatatgtcagtatcatgtatgttattttaaattgcctgtacgccactttacacattgacattcaaataaaagccaacacttcagtggcgtgtaataaaagctgattggagcgtgttcatacctgaggtgtggttcccttggcaaaggtgaatcaaggaaagagcatctcatttccagagggaatgtcagtggaaatgggggcttcgggacaaacttttgagatcaaattcattttttaaggaagtacagatatcaagactgagctttatttggagttagatagaaggcttaattcatgaaatgtatgtgacacattaggacaactttgctcttggaaacctttagcatcccaaggcattgttttgactcatcaaggcaagcatgatctggtgggtgcattttttttctaggagaagagggagagtgacagctttcctatttgccaggcacaagttagatattttcacacacctgatttcttttcatcttaacactccataaagtggggattggtggctctagtgtttcacttgtcaaaaatatctccaaactagccttccagagaacctgtgtccccatctttatagtttgtaaagttgtatatcctaacatcctatttctagcttgtatttataatttgtatccctgtttcctagaaaagttgctgaagcagcttacaactggatatgtattccatgccattttcacctgaataaaaacaccaaagtgacgataaatctaaaaggcaggcaggaaccaacatttattaaaactttgctgtgtatatattatgctggacagctaataacatcatattgtaattcctactgaatacttttgctcataagagttttttcactacagacaaattgggtaaaatcaaaatctgacattacaggaattactcaagtttcaatgcgtcactgtagctaagccagtgaactcctttgttctgctgagaaagagcaagaagaatgaatcttcacaggactactagaaacttcttcccagcaaggtatgaggaagccctaagtcaatggtgtaatcctaaatcagggtttgaaaacccacctaacaggcagagtgaaattaacaggcaaagtgaaatcaggcttccctgggaaagtctcaataggaaacaacctgtagatgagtcatctttgaggtaccaggtgtttcttaactctctccaagtccttcccacctccagaataccagcagaaaacacaaaagagaacttggtcacttcttcttgcctctcctcttatccttgcctttacctttgccttttgaatccttgctatcaactttgtctttaggcatcttgaaaccaccaatttctctccgtatcatagtgcctcgccaccaggcctggagctggaagagaaaaggggagtgagtacgacgtatgctatgcctgacaagctgcattctttccacataaagggactgttgaataaagtaacttctgtctgacaaacagtctctctccaggacatggaagtagccaggcacgtaatcacttcagcgatgctctcctgtcgtgcaggacccggagcttaagccatggactcaagagtgaagttctcaagtaaaaataaagaaaaggaatctgatttgacctattttttcttcacccgtagaaatctgacttccttatactgctttccttgaggaaagtccaggttccccatacttaacagctatttgaaccaaaaagaatgttagttacctgggccaagggcaaaagcactcggccaaaaatgcacagataatgccaggtgcggtggctcatgcctgtagtcccagcactttgggaggctgaggtgggcagatcactttgagctcaagggtttgagaccagcctgggcaacatggcaagaccctgtctctacaaaaatacaaaaaagaaaaaaaattagtcaggcctggtggcttgtgcctatagtcccagctgtttgggaggctgaggcaggaggatctcttgagcccgggaagcagaggttgcagtgagcagagattgcgccactgcactccagcctgagtgacaaagtgagatgctgtctcaaaaaaaaaaaaaagaaaagcacagataagtctagatgactttcataggcttgcttgtgcatttcatatctttagtgattgcttaaaagatcagttgtcctagtacttttaaaaaagatttagttagctttcttgaatatcttggttttagataacagttgttctcaatacggtctctactgctttaaagtcagactaaaccctaaagactggaagcaaatccactagtgaaaagaaagcaaacgtgctcttcagctcgttcttaacatgtttgttgtaaattcaggaatactgacaagttttatggggaaacaccattgaaacttgataaatacttgctacttacacatctgactccttatgggaagcccaactttgggtctggatacctggtccagaatgtggtataaaacttaactattttagatcaccctaatatacaacccaaactacagtgtacccactagggcctcgaccttcagagagaagggccagctccagacaggtgccgtccagctttcagtttttgcttgcgagtatttcacgtgatctgtgacctgccagtttcatcatcactgagacacacaagttcacataaaactaaaatatctctatttttttctaacttgctgcttatccttcccacctaagcagcttgtatcagaacccagcagatagtctgggctgatgtataagcaggattttaagaagtagaaggatattaaaaagaatcattctgtcaagagctggttttggttagacatagtaatctgatatttcgtctcttggcctaggttttgcttccgctgctaaccacctctttttccccagatgaagagctgggggcacgtccttttctatgttaactgtctccctgcaccatggactgttggcaaattctaataataacaaaagtccatgcttcttctcagatctgcagttccttgatatactgagatgtgtttgataatgaattggaaatgcttttgtgttcctcagtgttaagccagctgtggcgagatactgattatggttctttacctttataacgctctttaattccaagagatcctgttttaccttcttcttgctcctctccttttctatacgatcttcaatgatgacctgttcatactctcttatctgcaaagatagacattcatcatttattatagtactctcttggctaagctgtagcccagccagccctgcacttttaatataaaatttcaaaataaaacatgctcaatctaaagataaaccaaagaaaaaaatgtaatagattcctagatggtaaatattcacatattaactttataattgttcccaaaactttttcagttttaataattcaaatttaaattctatcttttataaaaaatgaaatatgaattaatgtgtgatcaatgatctcaaaataatatggattgttttttaaactttgggagaatgtacatacacaagtagtcagctgtcttttttgtttgtttgtttgttttgagacagagtctcactctgtctgtcacccaggctggagtgcagtggcgcagtgttggctcactgcaacctccgccttctgggttcaagtgattcttgtgcctcagcctcctgaatagctggaattacagccacgtgccaccatgcatggctaatttttgtatttttagtagagatagggttttgccatgttacccaggctggtctcaaactcctgatctctactgatctgctcgcctcggcctcccaaagtgctgggattataggcgttagccaccatgcccagcagtagctgacttttgaaagaaatttaggaagttctgcatttattccataatgaaaccataatcacaagcttgttagaaatcatcactgactctctccagaggtcataaactaagaataatcacagtatctgtctcaaggggctgtgtgggtagcaccttggacagagtaggcactacgtaagttagctactgcagctgtccccgtcagcagcagcagcatctaaaaagaatcctggtggcttataagcgcacctctacttttgaccccaaatagcaatacccagctactgtggcctatttgccactccttcctcggtgagcaccctgattccttccactccctcctcagtgagtgccctaattccttccactccctcctcagtgagcaccctaattcctttcactctgtcctcagtgagcgccctaattccttccttaccatctttgccaggtcttgaaggtgtgctaagtcactggcctttgtggctttgagagcatttagttcattctgtttcatttctgtgtccttatcgtatttctccatccagaactccagcctctcctcaagtttctatttggaaagaacatgaaaacatggcattcagcagacacaaaacgctgtatactgtatgattccacttatacgagtttcaagattaagcagaacattccatagtgagagaaggcagaacagtagttacttacctgggtggagagttggatttctgattgggaatgggggtgagggggactttgggatgctgtaaatgttctctgtatctttatccaggtggtggttacatgaatgtgtatacataactgttcatcaaactatacactaagtacttacacattttacttgtatgttagtgaattttaaaatagggggccaggcgcggtggctcacgcctgtaatcccagcactttgggaggctgaagtgggcggatcacctgtggtcaggagttcgagaccagtctgaccaacgtggagaagccccgtctctactaaaaatacaaaattagctgggcatggtggcgcatacctgtaatcccagctactagggaggctgaggcaggagaatcacttgaacccaggaggcggaggttgcggtaagcccagatcgcgccattgcactccagcctgggcaataatagcaaaactccgtctcaaaaaaaaaaaaaaaaaaaaaaatagggggaggagggtaatctagatgtctggataagggaagttgcaatgaagaggaaacaaaaggtatgtagaaaagtctgaaggataaggaatagcatcggatctctctttgattgacagcactaaatcctagtcaagaaggatacaatgtattcaaaattctaaaagaaaatgaatgtagggccgggcgcagtggctcacgtctggaatcccagcactttgggaggccgaggtgggcagatcacagagtcaggagatcgagaccatcctggctaacacggtgaaaccctgcctctactaaaactacaaaaaaaaaaaaaagccaggcatggtagccggcacctgtaatcccagctactcgggaggctgaggcaggagaatctcttgaacccgggagacagaggttgcggtgagccaagattgcgccacagcactctagcctgggtgacagagtgagactccgtctcaaaaaaaaagaaaaagaaagaaaagcaagtgaatgtgaatcaaagattctacacatagccaacccagcattcaaatgtaaaggaaagaaagactatactcaatatttctgagagagttattcaaggatgtactactgtagcaaaataaaatgaaagagatatattaagaaatggaagagaaccagtaaaacatgtatttaagctatgtgatagtttttaatcataaatcataattcagaattaaaatcccaaagtaggcaggatagtctagttgaaagagcacaactctggcactgaaagaaagtttacttaaattctctaagcttctggttccctcatatataaaattctatacctagccaataatacagtattactattacagtcatagtacaaacctcagagggttgttgtgatgctgaaataatccttgtgaagtccacccacaatgcgcatatatatacataatatctgcatatatattatcactatatatatttacatataaagtgaatgacttcaacatgggatgaagagcgagagaagaggtaagtgaagtctctttgccttaataaaggcaaaagaaggtataaacattgactaactctcgacagagaaattctaaaagtataaaaatatatgttaacattttaagagttgtgctcacttcagtaacatatataccaaaattggaacaatacagagatgattagcatggctcctgcgcaagagtgacacacagattcgtgaagcattccatatttgtgtactttctagaaacaaaaaatttaaaggttacccctaaaagaacagaaatgtgtaactttcagactcggggacgatgcacctcaagagtgaaacattgagaagttccttaggtggcacatagcatagaattttttaaaaacatggctatagtcaatcattgcgattacactgagcggggtggcttgtgcctgtaatcccagcagtttggaaggcagaggtgggaggactgcttgaggccaggagtttgaggccaccctgagcaacatagtgagaccccatctctacaaaaatgtttttaattagccaggtgtggtggcgcctgtggtcccagctactcagagccgaggcagggtgattacttcagcccaggatttgagggtgcagtgagctatgattacgccactgcactccagcctgggcaatggaatgaaacccagtctcttaaaaaaaaaaatctgattatgttagaacaacatgtcagtttggtgctgtcacatctcttacatcttctctttcttcctcttgttaacacttaaaaacaaaaacaaacaaacaaaaaaaacaaagagggaacaggctccagacaggcaaaaaggtctggctacaaggtaataacatcatttggtattttttgcaattctatttacattattttatttatttatttactttgagataaggtctggatctgtcacccaggctggagtacaatggcacaatcttagttcactgcagcctccacctccagggctcaagtcatcctcccatctcagccttctcagcagctgggactacaggtgtgcaacaccatgtccggctactttcttgtattttttggtagtgatggggtctcattatgttgcccaggctgatctcaaactcccaagcgatccacccacttcagcctcccaaattgctgggattacaagtgtgaggcaccatgcccagcctatttatactaatttctatttatggaaggtgatactggtttttccttttatagtaatgatataaaaatcttaatttaaaatgaattgatttatctgtttaggtgagtatttaggtagaaaatattgaccgggtgccgtggctcacactataatcccagccagcactttgggaggccgagcaggtggattacttgagtccaggagtttgagatcagccttggcaacatggcaaaaccccatcgctacaaaacataggaaaattagccaggcacggtagcatgcatttgtagttccagctacttgggaggctgaggcaagaggatcacttgagcccaggatgcggaggttgcagtgaactgagattgcaccattgcactccagcctgggcaacagaacaagaccctgtctcaaaaaaaaaaaaaaaaaaattaagtaattactgcaactgggatgcattgtcagaaaaaaaatgaaaagttaaaaaaaaaaaaaaaaggctgggcgcagtggctcacacctgtaatgccagcactttgggaggccaaggcgggcagatcacctgaggttgggagtttgagaccagcctgaccaacatggagaaaccccgtctctactaaaatacaaaaaactagctgggcgtggcagcacatgcctataatcccagctactttggaggctgaggcaggagaaatgcttgaacccaggaggcggaggttgtggtgagccaagatcgcaccattgcactccagcctgggcaacaagagcaaaactccgttaaaaaaaaaaaattaataagtaacaggtggtatacagatattacaaaactatgagaatggcatgcaaataactagagtttggcaaaaaattgaacaacaaaaattctatcaatccaagaaaagaaggaaacaaaataaagtatataaattaattacaaacaaatgaaaaatcacaataaaagtaagctggggtaaatccttttgtcttagtccattccagctgctataacagaatgccagagactgggcggctcataaacaaattgatttgtcacagttctggaggctgggaagtcccaaatgaaggcactggcaaatcccgtgtctggtgagtgcctgcttcctagactgccatctctgtgctgtaacttcacttggcggaatgggaaagggatttctctgaggtctcttttttaagggcactaatcttattcattagagtttcaccctctatcaccttgggaatttggatttcaacatatggatttgggtgatgtaaaaattgagcccactgtactaccctctgaaagaaaaacttctttccccttcaaaaaaaatccagctatgaactacttagagaactacatgcccttgacatgtggggattattgcaattcaaggtgagatttgggtggggacactgaaccgaaccatgtcagatggtgtttttgtaaagatcaataaaatggtcaaacctttaataagtttcagtaagaaaaaaggaaagaagacacatctttttaaaaagttaatgaaaaatatttcattactacagaaataaaggactttttaaaattgtaaaaaaaaaactatacagtatagctttatgctaataaatttgaaatcagtgtttagatgaaatggattatcttctaggaagacgtaagttacaaaaaagactcaaaaagagataaaacaaccagagcaaaaggaaagcaggtttgacaattaatatctggcaaaatataaatcaatcaagccaaatataattaagagagacaagggatattttatactaataaaagacaaattctagatattacaattatgaaccgctatattctttttttggttctgtttatttatatttgcctcaggcccaagatagctgctgatggaacttttatgttgtaataacatattttagaatatatataaagcaaacattattagaaataatttctgtacaagatattaacagatccacaatcatcttaggaaactatcacacatctctgaaattaataggtcaggtaagccaaaataagtaacaaaatgaaaaatctgacagctagactaatagacatttataaaatattgtctgtaacagagattgcacactgtttcaagcacccatggaatatttacatagtctgaccataaccataaatccgaataagagcttgacaaattccaacaagcataaacctttttttttttttttttttgagacagagtctcgctctgtcgcccaggctggagtgcggtggcccaatctctgctcactgaagctccgcctcccgggttcatgccattctcctgcctcagcctcccgagtagctgggactacaggcacccgccaccacgcccagctaatttttttttttttttttgtatttttagtagagacgagctttcaccatattagccaggatggtctcgatctcctgacctcgtgatccacctgcctcggcctcccaaagtgctgggatcacaggcatgagccactgtgcccagccaagcataaatcttacatttcacattctgagaccacaatgcaagacagtaagaatagaacctccagtgacggggctgttgtgaggaataggaagcctacgctcttccctcacctcctccaagtacccagacatttaagaaacacccttttaaataattcttgagttacaaaggaaataacaaattataaactaaaaatcatttggaaaggaatgacaatgtaagcattatatatcagatcctgtaaattacagccaaatagtactcagaaaatatattggtttacatgcatttactagaaaataaaaaagtgaaaataaatgaattgaacatttaggaaactagacagattagcaacataaactcaaagaaagtgcaagaaaattactcaaaacaaaaaccagtgtggtagagaaaaagcagatttgctcaagaaaagcaaaagatggtgtattagtctgttctcatactgctgataaaggcatatcggagactgggtaatttataaaggaaagagctttaactgactcacagttcagcatgcctggagaggcctcaggaaacttacaatcatggcaggagagagaacgagtgccgagcgaaggaggaagccccttataaaaccatcagatcttgtgagaactcactcactatcacgagaacagcatgagggaaaccaacccatgattcaatgatctccacctggtctcgcccttgacatgtggggatcattacaattcaaggtgagatttgggtggggacacagaaccaaaccatatcagatggtgtttttgtaaagatcaataaaatggtcaaaccttcaacaagtttcagtaagaaaaaaggaaagaaggcacatctttttaaaaagttaatgaaaatgatttcattactacagaaataaaggactttttaaaattgtaaaaaaaactatagggcatagctttatgctaataaatttgaaatcagtgtttagatgaaacagattattttctagggagacgtaagttacaaaaaagactcataaagagataaaagatcaataatcctttttttacagttgaaaaggtagccaaatagctccaattaaatataaccagacaaaattgtttatgattgaattttatcaagcttcaaggaatagataatgttttcactgaagaaggcattagctaaaaaataaaatcataataataatctggtttgttttctgtttttatgtttcagagcataaaaagatggaaagcttccaattcacgctgccaagcataactctgacagcaattcaacaaagcagcaccaaaaaatacacctacaggttaatctcacttgtggaatatataaacacaaagtaaaagtctaggctggctgtggcggcaggtacctagaatcccagctccttggaggctgaggtgggaggattgcttgagcccaggagtttaagaccagcctgggcaacacagtgagaacccctgtctcaaagaaaaattttaaaaatccatggtattgatcttgtgtttacccaagaatgccacaagacaacacaaaataagggagagataagatatcaaaaggaaaaaaagaaaaatgaaaatcagtagaaagaaaatgcagcagaggctgtgcagagtgagagggcgaaatagaagcctccactgatagttccccccaccacccagaaacactaaatttgacaactatctgtacaaaaaagcaccttcataagaaccaaaaatcaggtaagcaatcgcagtacctggttttaacttcgttttgctgaaagaggcactgaagagggtaggaaagacggctttgaattgctgacgacactctccaccccctggcagcagccacacggcacgggtaggatctgagcagctgtgggagggcgggcgcggcacctgagatgtgcattgaactcagtgctgccgtcacagtggaaaaagcaaaaccgggttgaactcgggtgacgcccacccatggagggagcactgagaccagccccagccagaggagaaccgcccagcctagcagtgggacccgagtcccagcaagcctcagcatctcgggctacgccgctctggggtcctcaatacacttgaaaggcggtctaggccaggaggactacgaccctctacaacccttacgcaagccctggtcctggtgcctgtggacttgggggacttggacctagtgagacaccagccatggtggttaagggagtgcttgtgtcacccatcccccaacctcaggcagtgcagcctctaaaagagatttccccttcttctgtttgaggagagggaagagtacagaggactttgtcttgcatcttggataccagctcagccacagcagaatagagcactgggcagaggacaccagctcagccacagcagaacaaggcactgggcagaggatagcagctcagccacagcagaacagggcactcagcagaggacaccagctcagccacagcagaacaaggctctgggcagaggataccagctcagccacagcagaacagggcactcggcagaggataccagctcagccacagtagaatagggcactgggcagaggataccagctcagccacagcagaacaaggctctgggcagaggataccagctcagccgcagtagaatagggcactgggcagaggataccagctcagccacagcagaatagggctctgggcagagtcatgaggcccccactccaggccttagctcctgggtggccttcctagacacaccttgggccagaagggaacccactgccttgtaggggagggcccagtcctggcaggattcatcatctactgacgaaagagcccccgggccctgaataaccagcaggggtccacaggggtacaccatgggccttgggtgagactcttgagatgtgctgccttcgaagacatggtagtggctatggtgagagactcctgcttgagaaaagcagaggaaaaagtaaaaggggactctgtcttacaccctaggtaccacctcaactataatggggtagagtaccaagaggctcttggagtccccagttcaggccttgactcttttttttgagatggagtctcactctgttacccaggctggagtgcagtggcacgatcttggctcactgcaacctccacctctggggttcaagcgagtctcctgcctcagcctccaagtagctggcattacaggcacttgccaccatgcccggctaatgtctgtatttttagtagagaccaggtttcaccatgttagccaggttggtctcaaactcacgaccccaggtgatccacccctctcagcctctcaaagcgctgggattataggcatgagccaccgcccccggcccaaggccttgactcttggatggcatttctggtcctgttctgggcaagagggtagcccactcccctgaagagtaagtcccaggcctggcagcattcaccacaaactgactggagagtccttgggccttagctgaacatcagcagtagcctggcggcactctccatgggcctgtggtagtagtggccatgagcagcggctcctccgcatgtggaaagcagatggaagaggaggaaggactttgtcttgtggcttgaaggccagcttagctgcaggagtttagagcataaggtagacttctaaggtttttgactccagctcttggctcccagacagcatctctggacccgcccagggcctggggggactggccactctgaagggaaggatacaagcctggctgatttcgccacctgctgattgtagagtcctagggccttgagtgaacataggtggtagccaggtagtggttacagccttgggtgagaccaggtgctgtgctggcttcaggtatgacctagcacagtcccagtggtggtggtcaccagggggcttgtgtcaccccattctcagctccaggtagctcagcaaagagttagagactctgggagaaagtaaggaaaaagaacaagagtctctccctggcaatccagaaaattcttctggatcttatttaagaccaccaaggtgatacctctacatgtctgcatgaaccacagaattaggggcttggagtgttccctaatgaggtacggcttagaccacaacactcaagtcccttcgtatgcctagaaagcctttgcaagaaggatgagtacaaataaacccagactgcaaggactacaatgaatacgtaattcgtcaatgcccatataccgatgaacatccagaagcatcaagaccattcaggaaaacatgacctcaccaaacaaatgaaataaagcaccagggactaatcgtggagaaacaaagatatgtgacgttttagacagagaattcaaaatagccattttgaggaaactcaaagaaattcaagataacacagagaaacaattcagaaatctatcagataaacttaacagagattgaaataattaaaaagaagcagaaactcttgagttgaaaaatgcaattgacatattgaagaaggcatcagagtctcaagagcagaagtgatcaagcagaagaaggacttcgtgagcctgaagacaggctatttgaaaatacacaggaaagacaaaagaaaaaaggataaaagaaatggaaagatattccatgttcatggattggaagaatcaatattgttaaaatgtacattactacccaaagcaatccacagattcaatgcactccctatcaaaataccaatgacattcttcacagcaatagaaaaacaatcctaaaatttatatggaaccacaaaagacccagaatagccaaagctatcctgagtaaaaataaactggaagaatcacattacctgatttgaaattatactatagagctatagtaaccaaaacagcatggtactggaataaaaacagacacatagaccaatggaacagaatagagaacccagaagcaaatcaataaatctacactgaattcatttttgacaaaggtaccaagaacaaacactggggaaaggatagtcctttcaatgaatggtgctgggaaaactgaatatccatatgcagaagaatgaaactagactagacagctatctctcaccatttacaaaaatcaaatcaaaattggttaaagagttaaacttaagacctcaaactatgaaactactaaaagaaaacactggggaaactctccaggacattggactgggcaaagatttcttgagtaataccccacaagcacgagcaaccaaagcaaaaatgaacaaatggatcatatcaagttaaaaagcttctgcacaggccaggtgtggtggctcacacctgtaatcccagcactatgggaggctgaggcaggtggatcacttgaggccaggacttcaaggccagaggtgaaaccccacctctactaaaaatacaaaaattagccgggcatggcagtgcactcctgtagtcccagctacttgggaggctgaggcacgagaatctcttgaacccaggaggcggaggtcgcagtgagccaagattgtgccactacactccagcttgggcgagagagcaagactctgtctcaataaataaatatataaaatataaaaggcttctgcatagcaaacaaaacaattaaagtgaaaagacaacccaaagaactggagaaaatatttgcaaactacctatatgacaagggtttaataaacagaatatatgaagagctcaaacaagtctataggaaaaaatctaataatgtgaaaaatgggccaaaagggccgagtgtagtcactcacacctataatcccagcactttgggaggcctaggctggaggaatgcttgagctcggagttcaaggcccgcctgggcaacaatagtgagatcttgtctctctctctctctatgtgtataacatatacatacatacatacacacacacatatatatatacatacatatatatatacatacatatatatatacatacatatatatacatacatatatatatatacatacatatatatatacatacatatatatatatatatatatatatttttttttttaaagggccaaagatctgaataggcatttctgaaaagaagacacacaaacaccaaacagacatatagaaaggtgctcagcatcacagatcatcggagaaatgcaaatcaaaactacgagacatcatctcgccccagttaaaatggtgtgtatctaaaagacaggcaataatgaatgctagcaaggctgtggagaaaaaggaatcctggtacggtattggttggtggaaatgtaaattagcacaaccactatggagaacagtttggaggatcttcaaaaaactaaaaatagagctaccatatgatccagcaattccactgctaggtatatacccaaaagaaaggaaattagatgtggaagagatgtctgcactcctatgtttattgcagcactgttcacaatagccaagatttggaagcaatgtaagtgtctaccaacagacgaacggataaagaaaaggtggggccgggcgtggtggctcatgcctgtaatcccagcactttgggaggccgaggcagatcacctgaggtcagaagtttgagaacagcctggccaatatggagaaaccccatctttactaaaatacaaaaattagctgggcgtggtggcgcacacctgtagtcccagctactcgggaggctgaggcaggagaattgcttgaacctgggaggcagagattgcagtgagccaagattgtgggcaacagagcaagactccctctcaaaaaggagtaaataaataaataaatttaaaaaggtgggacatataaacaatggcgtactattcggcccagaatgagattgtgtcatttgcaacaatatagatggaactgaggtcattatgttaagtgaaataaaccaggcaggggaagacaaacttcacatgttcttctttgtgagagctaaaaattaaaacaattgaactcatggaggtcgagagtagaagggtggttaccagaagctgggaaggtagtgggggatgcggagggtgtggggatggttaatgtgtacaaaaaagtagaaagaatgaataagacccagcatttggtagcaaaacagggcgaccatagtcaataatttaattgtaaatttaaaaagaaccaaacgcgtgtaatgagatcatttgtagcacaaaggataaaggctcaaggtgatggagaccccaattcccctgatgtgactcccacgtgtcacacgcctgtatcaaagtacgtcatgcactccataagtatatacacctactatgtgcccacaaaaattaaaaattagaaaaagaaaagagtttaaaatagaaacaattttaagtctataaatcagtttttcagcagtctattaaaggaataacaggccgggtgtgatggctcacacctgtaatctcagcacttcgggaggctgaggcgggtggatcacctgaggtcaggagtttgagaccagcctgaccaacataagaaaccctgtctccactaaaaaaaatacaaaattacccaggcatggtggcaggcgcctgtaatcccagctactcgggaggctgaggcaggagaatcacttgaactcgggaggcggaggctgcggtgagctgagatcgtgccactgggcaacaagaacaaaattccaatctcagaagaaaaaaaaaaggaataacacattatgatcgagtaaggtttatcccaagaatttgaagatgactcaacatcagcaagtctattaatgtatttccctttattaacatattaaagaagagaaaacaatatcatctcaattaatgaaaaaaaaatccatctcaaaattgagtactcatcctgatgagaagaaaaacttttaacaagaaaaaaagatacttcctgaagttgataaagcttgtctaccagaaacctacagagtaaatctcacagttgatgattaaaaaaaaaaaaactcatttgtggcagttaccaatttactgcctgtcagctccaaatccacctctttgctttgtgaaagtggatgcttgctgtgaacgtttttcttgccagctgacaaaatgctaagctgtgtcagtagagggcgctggaggcacacgacaggagggcgtctcactgtccggtcaccagagtgcggctgccagcggtatgtgggtgggacacccggccgcacttgtccacccacacgttttactgagaccgcgcaggaggattcctgctggccaaacacgttatgacctagtagggtttatcccaggaatttaaagatgactcaaatcagcaactctctcaatgtattctactttattaacatattaaaggagaaaaaataactcaatggacaaaaaaactgtttttcttttttttttttccctaattgagtacgcatccagattaggaaaacaaaacaaaacaacaaaaaaaacttttagtaaggtatctgtcacctaaccaccattaatctcccattttgactagtggccacgctgtcactttgggtccccgtgcatgaacatcaattcagagccaatgcttcagtcatctcagaaggcctgggtagtttgctttccccagtgcacagtcactctgtaaatagcacaggtcttctgagtagggcctagagggagacttacagtaggtacttgcagcagggctgcagagttcattctttgggggaaatccccccacaccctcacaccccagttcataaaggggccctggggctgtgaactgactcagtcctaagagctaggggagaggccgtgactctctgctgtggtgattcaaatcaggtttctggctaccagacccagaatttttttctgttatacttgagtaggcagcccaacaattttgttcctagagataccatcattcattagccattgccaagaatcccagtggccaaaggcattctgattacatctctgccgcccttcgtggtaaatgtgcccaccttatctctgacaattaagtgctcccaattatccggaggcacttcaggatcccatcaccccactgataccaggaagctcatctcaatgacaacatccttagggtcacacctgcctatgtaggaaagcaagcacagagcttttagagaggcagatgctcccctcactattctatttctcaatgtcttagtaaagaagtgtcttctgggccttctcatggttaggaatgggtgcttggtggtagacgtgtaagtcacacatgataaatccactgtgacattcctgtctccctacatctttggattctctcccccaaatcatagcagggaagctctgacatctccacctcatcaaatgtaggcaaatgttgagtcacctcctgctgctcaagctaaaccatgaaatccagactctctggtaagtgcatctatatcaatgaattaaacaaatggagtgtgatagcctaccctgttggatctaacactcttagaatcaactcgacatgtttcccaggtttcttccaatatttattagcaaaatcttaccattcttttggtgtgtaagtgatttccttctgagttagttatctgagttttatgtcccactgtaacatgctaagatttgaccctagttatggatccagtgacaacaggggtgactgtaccaggtctgaagagtgagccgtttccaaggcatcctcccagatgaagttatcacaggggtgactgtaccaggtctgaagagcaaccctttccaaggcatcctcccagatgaagttatcacaggggtgactgtaccaggtctgaagagcaaccctttccaaggcaccctcccagatgaagttatcacaggggtgactgtaccacgtctgaagagtgacccctttcccaggcatcctcccagatgaagttatcacaggggtgactgtaccaggtctgaagagcaaccctttcccaggcatcctcccagatgaagttatcacaggggtggtgactgtaccaggtgtgaagagcgagcaaccctttccaaggcatcctcccagatgaagttatcacaggggtgactgtaccaggtctgaacagtgagccctttccaaggcatcctcccagatgaagttatcacaggggtgactgtaccaggtctgaagagcgatccctttccaaggcaccctcccagatgaagttatcacaggggtgaatgtaccaggtctgaagagtgacccctttcccaggcatcctcccagatgaagttatcacaggggtgactgtaccaggtctgaagagcaaccctttccaaggcatcctcccagatgaagttatcacaggggtgactgtaccacgtctgaagagtgacccctttcccaggcatcctcccagatgaagttatcacaggggtgactgtaccaggtctgaagagcaaccctttccaaggcaccctcccagatgaagttatcacaggggtgactgtaccacgtctgaagagtgacccctttcccaggcatcctcccagatgaagttatcacaggggtgactgtaccaggtctgaagagcaagcaaccctttccaaggcaccctcccagatgaagttatcacaggggtggtgactgtaccaggtctgaagagcaaccctttccaaggcaccctcccagatgaagttatcacaggggtggtgactgtaccaggtctgaagagcgagcaaccctttcccaggcatcctcccagatgaagtcatcacaggggtggtgactgtaccaggtctgaagagtgacccctttcccaggcatcctcccagatgaagttatcacaggggtgactgtaccaggtctgaagagcaagcaaccctttccaaggcaccctcccagatgaagttatcacaggggtgactgtaccaggtctgaagagcgagcaaccctttccaaggcatcctcccagatgaagttatcacaggatcttcaggcaaaggaagtgcggtgtcctcagacacaggagggcagggtacttccgctgccaagggagctttaaagtgatttgccagtttcatccgaatctgagcaggtgttctcattccaagtttcagggtcctgttctttccctgtgagtgctctaacttgcatatcagtaacttggcatgactatgacaaactcatgtgtaatcctgactaaaacaccagaacagtggtgttgtattaacaaccaataatagaaaaaggattccccattgtcactactacaaccaacaagtacactggactttctagctagacaacaagccatgaaatgaaaacagacatataaataataaaaaggataatataaaattgttatttgcatgcagtaagattttccacctaggaaatccaaatgaatccactgaaaaaccattagagggtttaacaaatccacagcaatacacaaaagaaatacctttccacataccatacacttagagacagaaccaagaaggtttcgcaatgttatcacagaaaaacctggaaacaacctaaatctactgacagaatggttcactaaatttcagtatattctgagtgtgagatatattctatcaatcagctgtactgctacagaaaacattaaaaacaaagtaaatgtaagaagaaaacaacaggctctggaacactatatatagcatgatccaatttacttaagaaacaaatactaggccgggtgcagtggctcatgcctgtaatcccagcactttgggaggctgaggccagcagatcacttgagggcaggagttcaagaccagcctgaccaacatggtgaaaccccatctctaccaaaaatacaaaaattagccaggtgtggtggcaggtgcatgtaatcccagctactcgggaggctggcaggagaatcacttgaacctggaggcagaggttgcagtgagccgagatcgcgccattgcactccagcctgggcaacagagcaagactcctctcaaaaacaaaacaaaacaaaaaaccaccactgagaataggtatgtttttaggtataagtatgtatatgaaaagaaatacatgtggaagaaacttcccttcagaaaggggagtaatttaagagggctttcactttctttaacctatgtatttctgtctgaaattgtagctggacgtggtggtgcacacctgtagtcccagctactcaggaggctgaggtgggaggatcacttgggcccaggagtttgaggctgcagtgagctatggtggcaccactgcactgaagcctgggaaacagagagagaccctgtccctaaaaaataaaaaataaaaaaatatatacttatgtattgcttgtgttattgggctgaagatctgggaaactctggcgtcatcccttcgtgatccatttatctaccaactcactgataaatatccaacacctgccaggtatctcacacttgaaacaggtaacatgatacataattcttaaagtgcagggctacagaaccctaattctaatagcctaccaggtatttttttcagtaaagacctgcaagagagcatctacaaattctcctctttaaccacacatttggaatccttgactgaaaactcattagctttttccaaaggcaagctgtattataactaagctggaaaattttctctttattcatccaatagggttattttgaaagactccagctggggctgggcacggtggctcacgcctgtaatcccagcactttgggaggccgaggcaggtggattacctgaggtcaggagttctagaccagcctggtcaacacagtgaaaccccatctctactaaaaatacaaaaattagctggacgtgcgcctgtaatcccagctactcaggaggctgaggcaggcgaatcgcttgagcccaggaggccgaggttgcagtgagccaagatcacgccactgcactccagcctgggcagtaaagcaagactgcatctcaaaaacaaaacaaaaaaaaaaaaaaaaagaaagaaagactccaggtagacttagacataattctaaccttagatatattatagacccagcttggttattagtattgaaaatgctcttaaaaccaccgtgtcatatatatttcacacaagaagaaataaattgagtaaacatgtggaaaaatgttatgttcacctgttaataagcaaaaataaaaaataaaacaactcattaaattagcagactttgaaaaatattgaaaatggctactaatattgaagagaccttgaaattactgcctgcaacactgctaacggcagcacagattcgagagtattagcaatgtttattaaaagtcacaaaatactagtctctgaaacaaaaatctcatgactgagattggcttttagtaaatagttgccatgaagaaaaacagttctttgggcaaagctttaatgagtgcattatttataataacaaactttagaaacaacctaaatataaaaaaaaagtgtaacaaataaactgtggcacaaccattcaatggaacgttaaacacaattttcaattattttataaagaaactgtaataacataaaaaatgaaaagcaatgagtaattttaaaaatcttcactcaactgggaatgttatttttatagtgtaaaagattagtaaatttttttttttttgagacagattcttgctctgttgcccaggctggagtgagtggcatgatctcggctcactgtaacctctgcctcctgggttcaagcgattctattgcctcagccttctgagtagctgggattacaggcgcccgccaccatgcctggctaatttttgtatttttagtagagacggggtttctccatgttggccaggctggtctcgaactcctgacctcaggtgatccgctggcctctgcctcccaaagtgctgggattacaggcgtgagccaccatgtccggcctttatttatttttcttttttatttattggccactatactattgggaaaaatttttaaatatagtcataatttaaaaataattaatttaaaaattatgtctttttttggtttttgtttttgagacggggtctcgctctgttgcctaggctggagtacggtggcgtgatctcagctcactgcatcctctgcctcccaggttcaagcaattctcccacctcagcctcctgaatagctgggattacaggcgcaccaccatgcccggctaatttttgtattttttaatagaaacagggtttcaccatattggtcaggctggtcccaaactcctgaactcaggtgatccaccctccccggcctcccaaagtgctgggatgacaggcgtgagccactgtgcccagcccataaatttgtaggtcataatttgacttaataaattttaagtcataaattaagtcataatttgaaaattatgagtatacagcaatatagaaatcgaaaaatttcttatgtaagctcaatgataaaagcagaaaacaaaattttacctgcactctctcaaattacagctatataagatatctattcagatgcataaccctgaaagaaaacatgagctaaagttcattaggctgaaagaatgatggttggttttccttcaaaatattctttttgtttcctcagtataagcagagtacaaaaaaaaagtcaaagcatagaaaagctgtggggacccacctgctgctcctttctaaggaacatttcaatctctgtatgagtccgggcctcttcttcggttttcatcctgagtttctgtaagaacaatcagataccagtacgtcttccccgcagggctgggaatcagaagttctcaagatgagagcagcagctcggtcggtagctgaggctccctttaccagctgggatcccgggctttcagttccctgcaactcctgttcaccaacactgcagagccacgtggcgcggcactgtgtggactgcgtgtgtccctaacgagacgagcacaatcccgtgagctgaacagaggtgcccactgaaggacagaaacggcgctccaagggcacaaggctgtggggcttaaaaagggggattccggagtgccaggaagagtgttgacgtggccttgagccacgtcagtctcagagcgaggagtcctcccacacacagattccacggcccaaggacgtttgttcctgcttccctcttcccatctgcctgctgctctttcttgttttcttttcttttttgtgagaagggagtctccctagttgaagtctgaagttgcccaggctggcttcaaactcaaggatcctcctgcctcactgcctcacctccgattagctgggactagtgcctggctttgcgtgtgtgcgtgcgtgcgtgcgtgcgtgtgtgcgtgcgtgcgtgtgtgccatttagcattcccctcaaagaagatctaccacttctttcttcctcctggcatttttcaccgtgacttctcatcctataaactcaggtttgaacgaagttcagcgctctcgatgctgtatttcttactggaggagtgaaaggtactggttagatgaaagaaacagcagcaaaatcctgccataactaagcacctcgttttgccctctccctataattagtcagaaaaatggtgattggtttgccaaaataagaagtgaccaaggagagaaagtgcagccaattttcaaagtcattatgaggcgggagatggaggctacagcccactggaatctctgcttgcgaacacgcatatcctcatttaggcttttattttcaacctcaagtggaggggctgttgccgatagagatggagggaaatctttgtctccctcctttgttagctgagaggggatcaggagtgacagctcaattgccatctcctgggttcttggctaatgtcccagggattacctcaatctcttccaccaagagttcctctgttctgttacactttttctgggtctgggcaatctgcagctcggtattggttttcatgtagcgattctccaagttggattttgccttcatctcttgcagttggtccttgaggttagcaatatactcattctgactctgtagtggaaagaccaggtttctaaattgaaaatacattctacctccattcagttcagtcagcggcttacggttcccttttatgcgtataaatcaataaggaactggaactatttttccgctgtcacacaatgggaaatttagccaacaatcatgaagtgtatagatgaaagtgagtaacacagcatttctaagaatcagggcgcatcagggctgtgagattagttcccaggcacattattgctgtactccgtatgtcccacacagctttctcattttggtaggaagaacactggtcaaaatgatcaaaagaactgacttcccacccaggcctccagctgtgtgaacttggccaagtcaaatctccaactttttactttctataaaacaaacacacaaacatacaaacacccaacctgcctgaagtatctcagagagtgattattaggtttccttgagaacacgtgtgaaaacgctttctttttgcaggtcaccaagtgcttggcaattgtgaggactcaatagtcattaagaaaaatatttattcagcaccaggcactgagctaggaaaattgtggagatctaaacagacatattcccttccctcatagagcttacagtctaatagaagagaggtggttaaaaagagacaaacacatgtgtaaacttccaaaaattgtgcaaaatgatagaaaaggaaggctcgagaggctgtgggaggaaataacaagggaggagtacattagactctggaaggtctgagaaggactctctcgggaaagcgatggctcattcgatacctgaaggacaggtaagcccaccacatgaaaaataggcttggccaggcacgggggctcacgcctgtaatcccagcactttgggaggctgaggcatggcgaccagctgaggtcagcagtttgagaccagcctggccaacatggtgaaaccccgtctctactaaaaatacgaaaaatagctgggagtggtggcgggcgcctgtaatcccagctactcgggaggctgaggcagaagaatcacttgaacccgggaggtggaggttgaagtgagctgagatcatgccactgcagtccagcctgggtgatagagcgagattctgtctcaaaaaaaaaaaaaaaaaagaaaagaaaaagaaaaaaaggaaagaaaaagaaaagaaaaatagggttaagggaactctaaaaaaaaaaaaaagaataagtatatgcccaaatcctgaagcaatcaagacctggatacattccaggaactgaaagaaagctccggaggctctagcctagtgagggttgaggggaggacaggatgaggttggaggtcggtaagggcaccacacaggaccccggagacccaactgagaaattcagattttattccaactgtcatgggaatccttggaaagcttttagtcagggaggtaacatttgtttgaaaagaactgtttgggcggaatcagtgtgtgagtaagtccacagggaggggacctgacggcacagcaaacaagcacacgactagcaacaaaagtgcttcaacccgagacctgctcctctagataccaaccgcctttcttctctttttacattttttttgagatggaggctcgctcttgttgcccaggctggagtgtagtggcatgatcttggcttactgcaagctccacctcccaggttcaagtgatcctcctgcctcagccttctgagtagctgggattacaggtgctcaccaccacacccagctaattttgtatttttagtagagatggggtttctctacattggtcaggatggtcttgatctcccgacctcaggtgatccacctgcctcggtctcccaaagtgctgggattacaggcgtgagccaccacgcctggcctccaattgcctttcgtcttaaccatgtaagtagggtagaattagttcttttgtattaaaaaaatttttttgtttagagacaggatctccctctgtcactcaggctggagtgtagtggctcgatcacagctcactataacctccaattcctgggctcaagccatcttcccaagtagctagtactacaggtgcatgtcaccatgcctggctaactttttaatatttttagagatgggggtctcactctgttgcccaggctggtctcaaactcttggcttcaagggatcctcctgccttggtctctcaaagtgctgggatcacagacatgagccactgcgcccggctttgttgttgttgttgttgttgttgtttttgagacggtcttgttctgtcactcaggctgaagtgcagtggcatgatcacggctcactgtaactttgacctcccaggctcaagaaatcctcctgcctcagcctacagagtagttgggactacaggtgcatgacatcacactcagctaattattattattattgtagaaacagagtctcactgtgttgcccaggctggcctcgaaaccctgggctcaaatgatcctcccacctcagcctcccaacatgctaggattacaggcaggagccactgctgcagccagcctcttttctttcttgagatagggtccaccgtgtcccccaggctgtagtgcagtgtcaccagcatagctcactgtagtcttgaactcctagactcaaggaatcccctctctccagcctcccaagtacctagggaattaattctaagtaaccattggaagaaaaaacaaagtggtaattggacaaatcctccgttaaggaaagcaagcataggcagcggtgtccaatcttttggcttccctgggccgcactggaagaagaattgtgttgggccacacacaaaatacaccaatgatgaactaaaaaaaaaaaaaaatcacacaaaaaaatctctcataatgttttaagaaagtttacgaatttgtgttgggccccagtcaaagccatcctgggccgcatgtggcctgcgggctacaggttggacaagcttgacttaaagtatcattaggccccaacctggtggggtggctcacgcctgtaattccaatgctttgggaaaccaaggcaggaggctcgcttgaacccaggagttcaagagcagcctgggcaacacagtgaaaacctgtctctacaaaaaaatttaaaaattagctgggcctggtggcatgcgcctgtagtcccagctactagggaggctgaagtggtagactcccttgagccccggaggccgaggctgcagtgagctatgctcatgccattgcactttagcctgggcaacagagcaagaccctgtctcaaaaaggtccctaagatgaatcagaacggaattcttcaagttattttgtctactagcttcttgatataactctgcagaatcattctaattgtatgacagttattccaactagatcggaatcattcctaagagacggagcatctctggcacagaatatgctataggccctttgaaaatatgtcttaatatttcatattctcttacaagttgtaggattgcaggcaaattactggacctcactaagcctattttctcatctgtaaaatcctgcccaggctggagtgcctggcacaacttatatgctcaataaatgttgatgaaatgaattttaagagatgtctgcttttggctcactgtttttcttccattctttctatacgcacttcccttctcccctgtcttccccatttctcttttctcttttttttttttgagacagagtctcgctgtgttgcccaggctggagtgcagtggtgcgatcttggctcactgcaacctctgcctcccgggttcaagcgattctcctgcctcagcctcccaagtagctgggattacaggcatgtgccaccatgcctggctaattttttaatttctttttagtagagatggggtttcaccatgttggccaggctggtctccagctcctgacctcaggggatctgcccgcctcagcctcccaaagtgctgggattacaggcatgagccaccatgcccagcccatttctcctccttcttcctcttccctcccttctatttccaaattgtatggcagtcagtgaatcttttttttttttttttgagacaagatctctctgttgcccaggctggagtgcaatggtgcgatcttggctcactgcaatctccgcctcccacctcaacctcccgagtagctgggcctacatgtacgtgctaccacgccaccacacccagctaattttttgctttttttttttttttttttttttttggtagagatggggttttgccatgttgcccaggctggtctcaaactcctggtctcaaacaatctacctgcctcggcctcccaatgtgctgggattacaggcatgagccactgtgcctggtataggtttgaatctttaggaagactagagttaaagcaaaaatgtgatggttttacttcttcatcaactggaatccttttacctatataatcccttagatttccttcaaggtccaccttatatatcactcaagtaaataaagccttttgcagaaaacctcagcccacattgataactgtagttttgtttctcacagaatctaaatagtgttagacagggatttattgaatagtgtccgtacatacaaaaatatacttttgaaaactcaagagcatgttctggtaatttttctttctcaaatggaatattaagacttcagagtaacagtctgaagatcagaaatgcagagttaaaagtctttagcttctgcccatggtaaacagaaggtactgcatcatggaagtgttttttattgttgttgttttagaccgagttttgctcttgtcgtccaggctggagtgcagtgatgcaatcttggctcattgcaacttcggtctcccaggttcaagcgattctcctgcctcggcctcccaagtagctgggattacaggcacctgccactacgctgggctaattttgtatttttagtagagacagggtttctccatgttagtcaggctggtctcaaactcctgacctcaggtgatccacctgcctcggcctcccaaagtgctgggattatagacatgagccaccatgcccggccaatgtaagtgtttataaggacgtacaacattggctgtgccaagccaaaggcatctggttttaatgccgttgccatgggcctctgagtaccctgagttccttcctggattggtattttgcacaaacattttaatggccctccacggtgaccgtgtggaaacacagagaaagatataaaatcctgacaggctatgatggtaaaaccaagatcgaggcatactaacaagcgagcggaagtgctattccgtgtcctcttcttcccagtgtgtgagaacagccagcctagaagcagtggggtacaggctccttttcagagtttcactaagaaaagatttgccttcactacaacctcgaatccgagttgtccatggtgtcgggaaccttcctcgtggtcaggtccatggactgatgcatcacagttttgggttttcatggcagaccaaacattacttccaaatcccaaaattgccttcagatcgggacctctggacttgttattcgaattcagagaagcatgatttactaataaaaagaggcagtctaccaactcgagttaataaggctgtgatggctgccataataacgtgagccaagggctttaatggtagtgtctgctttcataactgtacataaagtacagaacggagtactggttcctggaagtttggaagctactatctgggaagttggcacttgtcttagacctcaggcttcccctctggttgggtagcaaaaggaaaatggtaatgttgtctattaaagagacaaaagccacaggaaaaaaatagttctctattaaattaacatttacagccaggctcggtggctcacgcctgtaaacccagcactttgggaggctgaggcgggtggatcacttgaggtcaagagttcgagaccagcctggctaacatggtgaaaccccatctctactaaaaaaaaaaaaaatacaaaaattagccaagtgtggtggcgtgcacctgtaatctcagctacttgggagggtgaggcaggagaatcacttgaacctgggaggcagaggttgtagtgagctgagatcgcggcactgcactccagcctaggagacagagtgagatcacatctcaaaaataaaataaaataaaataaattaacatttctatttgctgtctatgacttagaataccggctgatactatacgagtccatagactcagaataaactctgagctccagtaatcctagttacttgggaagctgaggtaggactagttacttgggaagcttgaggccaggagttcaaaacaagcctgggcaacaaagagagaacccccccatctcaattaaaaaaaaaaaaaaaaaggccagtcgtgatggctcatgcctgtaatcccagcagtttgggagactgaggcaggtggatcacctgaggccaggagtttgcggccagcctggacaacatggcaaaactccgtctctactaaaaacacaaacataagctgggcctggtggcatgtgttttactattgtttttgttgctgctgttagagtcaatgctaggcattgatagttttgatgctattgtaaataatatatataaattttcaattttctattctaaatctgttgctgatgtataaaagatagatttttatatatgaatcttggttctttttttcccaggagtttcatggaagtgctgatccattgttatcttgctttggatgttgatgttcagaagtctgaaactttttttgctttgtgactctttctttttgctgagtatctaaggcaattaatcctacacatctaagctaccaccaacactttcatatacaaaaacctgccattcttgttggcatcattttctgacccacagttccctaatgtgcatatacttcctatcttcttgttttccaaccttgacctgactactggttttcagtaactccggggatttaacctgatttcatcttggtcgacccgactactggttttcagtaactccggggatttcacctgatttcatcttggtcgacccgactactggttttcagtaactccggggatgtaacctgatttcatcttggtcgacccgactactggttttcagtaactccggggatgtaacctgatttcgtcttggtcgacccgactactggttttcagtaactccggggatttaacctgatttcgtcttggtcgacccgactactggttttcagtaactccggggatttaacttggtttcttcttggtcgacccgactactggttttcagtaactccggggatttaacttggtttcttcttggtcgacccgactactggttttcagtaactccggggatttaacttggtttcttcttggtcgacccgactactggttttcagtaactccggggatttaacttggtttcttcttggtcgacccgactactggttttcagtaactccggggatttaacttggtttcgtcttggtcgacccgactactagttttcagtaactctgcggatttaacctggtttcatcttggtcgacccgactactggttttcagtaactctggggatttcacctggtttcatcttggtcgacccgactactggttttcagtaactctggggatttcacctggtttcatcttggtcgacccgactactggttttcagtaactctggggatttaacctggtttcatcttggtcgacccgactactggttttcagtaactctggggatttcacctgatttcatcttgattgacccgactactggttttcagtaactctggggatttcacctgatttcatcttggttgacccgactactggttttcagtaactctggggatttcacctggtttcatcttggttgacctgactactggttttcagtaactctggcgatttaacttggtttcatcttggtcgacccgactactggttttcagtaactctggggatttcacctggtttcatcttggtagttcttttttgttccaaggcttgccttggatcttctagtcttggtttctttctttctttttttaagacccactacgaagcagaatcttggtttcttaacctattttttttgctgatgatcacaatatctgaatgatattctactttaattttactttggctgaatgtaatggctgagaatataattaagaggatacatctcaggagcaagtgttgttgctgttaggaaaattctaccatcaacaggtgtggtccttatggtagaatgggagttaactggcaaagtgctaaatctgaggtttcttttgacattgctttggagggcttaaaaggagactaatataaatatcttctggccaggcacagtggctcacatctgtaatctcagcactttgggaggccgaggcgggtggatcacctgaggtcagaagttcaagaccagcctggccaatatggtgaaaccccatctctactaaaaacacataaattagccaggtgtggtggcctacacctgtaatcccagctacttgggaggctgaagcaggagaatcgcttgaactcgagagacggaggtcgcagtgagccaagatcgagctgctgcactccagcctgggcgacagagctagactccatctcaaaaataaaaataaataaataaataaataaataaataaatatcttctattttaaaacatacttaaaagatacttatcttctataagataatgtcaaaagattcatgacttttaaaatagaagatatttatattagtctttttaaattatgagagtttttcagggaaaagagttaggaaacctctgaaaaagtctattcattacagagaaaacttaaacacaaactagttttcatgaagtttcccagagaagaaaagtagtttttaaaaaatataagctacatgcagagggttaagagggataatgacatcaagacctagagctacctaaggtgctttgtaattggcaaatacaaaataagagaaggtgttaggcaatttgcttggaagacttacagataatatcttaaaaaaaagtctagtgactttgtttttgagacggtctcactctgttgcccaggctgcagtgcagtggggagaccacagctcactgcagcctcaacctcctaggctcacgcagtcctcctaccttagcctcccacgcagttaggactacagatgtgtactaccacatccagataatttttttacttttccagttatttttataagttatttatttatagagacagagtcttgctatgttgcccaagctggtcttaaaccccaggcctcaaatgatccttccacctcctagtgaccttttaaaaacaattcttccatataaacttacaatattctcaggcccagtgcagtggttcacacctatcatcctagcgttatgggggggccaaggcagacagatcacttgagctcaggagttcgagatcagcctggacaacatagtgaaaccctgtctgtatcaaaaatttaagaaattatctgggtgtggtggcaggtgcctgtagtcccagctatctgggggctgaggcaggagaatcatttgagcctgggaggcagaggttgcagtgagctgagatcactccactgcactccagcctaggtgacaaagtgagaccgtgtctcaaaaacaaaacaaaacaaaaaacagtaaaaaataaataaataaaaatattctctcagctgggcatggcagctcatgcctgtaatcccaatgctttgagaggccaaggagggagaaacactcgaggccaggaggctgagaccagcctggacaacaaagcaagaccccacctctacgaacaattaaaccgcagcctggcgtggtggcacgtgcctgtagtcccagctactcaggaggctgaggtgggagaattgcttgagcgcaggattgcaatgaactataattgtgccattgcactccagcctgagtgacagagtgaagatcctgtgtctacaacaaataaataggctgggcacggtggctcacacctgtaatctcaacattttgggaggacgagatgggcagatcacctgaggtcaggagtttgagaccagcctggtcaacatggtgaaaccccgtctgtactaaaaatattttaaaaattagctgggcatggtggtgcatgcctgtagtcccagctactcgggaggctgaggcaggagaatcgcttaaacccaggaggcagaggtttcagtgagccgaaattgtgccattgcactccagcctgggtgatggagtggacagggtgagactccatctcactccaccaaaaaataaaaataaaaatgaaatatataaataaaatagttttccaacgtctatgtagggaataacgaaaattcccttctgtgaagcataaacttgtccaaacagctggtcagtgaaaagctgataacgggccatcctctgtaactttctcttttctttttttgagacggagtctcgctctgtcaccaggctggagtgcagtggcactgtcttggctcactgcaacctccgcctcccaggttcaagcgattctcctgcctcagcctcctgaatagctgggactacaggtgcgcaccaccacacccggctaatttttgtattttgagtagaaacggggtttcagcatgttggccaggatggtctcgatctcttaacctcgtgatccgcccgtcttggcttcccaaagtgctgggattataggcgtgagccaccgcgcccggccatcctctgtaactttctaaactgctcctagaaaagttgtcagtcatcctaatacagctggtttctaactgcttaggttgtagccccaactttgttttgcaagtcaattccttaaaacttgggatgcattttcttataaaagtaaactagatacgaggttaggtcctaatgaccacaaaagctcgcaaatccactttgtcctcaaaatacaatacaaataacataatgaagcccaaccactatgtatgagaaggttcataatgtgctgaatgtcttctttaggaatatacttttccatctgggatgtgagagtacaagagactgcctgagacaaggccccctgtgggggagggtgggggtgtatgtggggtgggatatgacgatgggatgaggtcatctgtgggggagggtggtggtgtatgtggggtgggatatgaggatgggatgaggtcatctgtgggggagggtgggggtgtatgtggggtgggatatgaggatgggacgaggtcatctgtgggggagggtgggggtgtttgtgaggtgggatatgaggatgggacgaggtcatctgtgggggagggtgggggtgtttgtggggtgggatatgaggatgggatgaggtcatctgtgggggagggtgggggtgtatgtggtgggatacgaagatgggaactaagggctccagggggttggggtctcgcagggctctatattccagacacacctgtacgacccaggccagctctctacttgctatctttatatcttctgtttttttttttttttttctgagacggaatctcgctctgtcacccaggctggagttcaatggtgcaatcttgactcactgtaacctcccagggttcaagtgagtctcctgcctcagcctcccaagtagctgggattacgggcacctgccaccatacccggctaatttttgtatttttagtagagatggggtttcaccatgttggccaggctggtctcaaattcctgacttcaggagatccgcccgcctcagcctcccaaagtgctgggactacaggcgtgagccaccgtgcccggctatgttttcaatagtaaaggaatgccggaggaaacaacaatcttttacatgtaactcttctctgcttgagaaagatggcttccatatatttaatagctgtgttagctcggtcacttttggtgttaagcaggtaattcttacctggacttcaaattgccattcctttttgacattaattagctgtttttgaagtgatattatctgttttcttcctttttcctccctagaagatataagaatgatttgtgtttagagcagtgcttctcaaaacttacgtgcacaaggaccaccccgcacataagaaaaccagattcctggcctcttcccccagagaatctgactcagcaggtctgggaggggcctgaagtgtgcatctctatcgagttcccaagcaatgctaacagggctggtccacgtcacattttcaataacacgttttaaaagacagatttgttttaatagattggaggaagattctctggcttgtcagtgtcgaatctaaaaatagctgctgctgagaaaaagtgaagaagagaaggacagcaagaggagaaagaagaatcctttctactttgggcacttcaattacatattctaaccctcacaatagcctgatttctattttaccgatgagaaaatgcggtgtagacagctaaggtgagttgatgtgctggatgtgagaatgtgcctcaccgatctccaactacagggggcgtaagtcagcaagggtcccggcttctaggctctgcaatccttctctgtgtgttctgaggccacactgcccacagactgctcccatcccattattaagtgtggcaggaatcacatgggatgggcctttcctggggagtcagggcgtctctgatggttgactttggctcaaggactcttgatgaccttgccaaacacagccgtgtcttccagcctctccttcactgggggtcagccttgcactggttctgaaggttccctccccattttctctcacgcagatctttcccctgataaaatctttgcatgaataattccatctcagcatccatttttcagaagacctggactaacacacttgccatggtcacacaaacagtaaatggcagaaaggggttcaaactcaggactgtcggacaccggagcctgtgaacttaactactttgtatgactgtttctcaatctactctgagaaacagccttctgcttctctccagcaatcccattatttaggtttaaaacaaacaaaaaatagcaaaacaataccagaataaacaaaacaaaacaaaagaagacttctcactaaactgcagctaggtaaagatttttactcaagaatttctatttttatgtatttatttttctttttttgagacagagtctcactctgttctccaggctggagtgcagtggcacgatctcgactcattgcaacctccgcctcccgggttcaagcaattcttctgcctcggcctcctgagtagctgggattacaggcatgtgccaccacactggctaatttttgtatttttagtagagatgggtttttaccatgttggccaggctggtctcgaattcctgacgtcaggtgatccacccgccttggcctcccaaagtgctgggattacaggtgtgagccactgcacccagccaggaatttttagaaagcacatagttaattaactagaatcttgagattgtcattgccaaaacaaactatagattatgtacttcccactcatagatcacaaaaaatagataagaaagctacagaatgagtactttccgtctactattaattcaatatcccaaggaaaggtttattgaaacaaacaaatatcatttacatgagattataaaagtgcccattttacacatatacaccatggaatactatgcagccataaaaaaggatgagttcatgtcctttgcagggacgtggatgaagctggaaaccatcattctcagcaaactgtcacaaggacagaaaaccaaacaccgcatgttctcattcataggtgggagttgaacaatgagaacatatggacacagggaggggaacatcacacactggggcctgttgtggggtggggggctgggggagggagagcattaggagaaatacctaatgttgatgacaggctgatgggtgcagaaaaccaccatggcacatgtatacctatgtatcaaacctgcacgttttgcacacgtgccctagaacttaaagtatcaaatgcaaagaaagtatgaagagaaataaaaatcacccataatcccactatctggagttaactatcattgaaattttattatatttccttccagtcaatacacactataattttttcttacaaaactaagttatattatgggtattatttttatcctaactttttcacttgacataaccatgtgctctttctcattttatttagcaggtgaacacatgcatttatttctgttccctctttttttttttttttttgtttttttgaggcagagtcttgttgtgtcgcccagcctagagtgcagtggcgcaatctcggctcactgcaacctccacctctcgggttcaagcgattctcctgcctcagcttcctgagtagctggggactacaggtgcgcatcaccatgcctcgctaatttttgcatttttagtagaggtggggtgtcaccatgttggccaggctggtctcaaactcctgacctcaaatgatccatccacatcgtcttcccaaagtgctgggattacaggcgtgagccaccatgcctagccctctgttcactcttgaaacaatactaaaataacaggcaagaaataatgaaaggtgtaaacctataaacacaaagagattgggagaagaaatgatgcagctgacagacatcagcaaaattaaagaagatataaagcagacaagagaaaaatgagatctaaatgtgtacagaatgagaagctaagaagaagaaaacagaataaagctacaggccccccagaaaagctcagcacatgaaggcactacacatcttcgaaggcacaactgtgccacagggctaaatccaggtggagcgatcaaaagtctggcaaaggagcaggatgacctgattcccttccccagccctgtggccaggcagctgccttttctcctctcgggagatcatgggtgtttggttagttttggccaggttgcctggaatggttgaaccaaggatttggacttgcagacggacaccagacacagctggaggtggagatgaaggaccatgctaaaaacagggggaccaaaaaacattctgcttaatggatggtgagtttccccagcctttccctggctagctctcaacacatgggtagtcagagaataaccactgacaataaccattacttcttcactgctcctcacccctcccagcaaagattggtagattcttcgagaatgctgactacaccaagggaaaagatgtacttttcttttctgcccagccatgctacagtgcagtgttgcccacatgcacagagcagagcatccatcagcttcttggcacttcactcttaaatacaaacggacagccaaagatgaccaaacacaattcccctaacattaaaaacagagactagagccaggtgcggtggctcacacctataagcccaacactttgggaggccaaggtggaaggatcacttgaggccaggagttggagactggcctgggcaacatagtgagacttcatctctaaaaaaacaaacaaaaaaaattagctgggcatagtggcaaatgtcttccagctactcaggaggctgaggcagaaggatagcatgagctcaggagttcgaggctgcagtgggctatgatcatgccactgcactccagcctgggtgacagagtaacatttgctctaaaaaatttagatgtaaattaaaaaacaaaacaaaacaaaacagaaaaacagaaggctgggcatggtggctcatgcctataaccccagcactttgggaggccgaggcaggcgaggcaggcggatgaactctagcatgggcaacaagagtgaaactctgtctcaaaaacaaaacaaaacaaaacagaaactaaaacaaatgggagaaaaagtaactcggagagaagaaagacaatacaagaaacagaagacaacttaaacaaaaaaagacaactataattaatgttcttagaaatatatgagaaggccaggcacggtggttcaaacctgtaatcctagcactttgggaggccaagacgggcagatcacttgagctcaggagttcgagaccagcctgggcaacatggcaaaaccccatctctacaaaaaaatacataaaattagctgggcatgcctgggtccccagcgacttgagggggctgaggcaggaggattgcttgagcccaggaagtcgaggctgccatgagccaagatcatgccactgcactctagcctgagtgacaaaaaagaatactataaaaaatgaaaaactcagggaagagctcttagaaatcaatgttagcataacattttgaaaaattaaacacaagggttagaagataaggccagttgtggttggggttacaggcgtgatcctagcactttgattacaggcatgatcccagcactttgggaggccgaggcgggtgggttgtttgagcccacgattttgagaccagcctggttaacatggtgagactctgactttacaaaaataaaacaattagccaggcatggtggcacacacctgtggtcccagctactcgggaggctactcacttgagcctgggacccaggatgaggctgcagtgagctgtggatcgtgccactgcactttggcccgggaggcagagcgagactcagtctcagaaaaaaaaaaaaaaaaagaaagaaaagaaaaggaagagcctgtgttcccagcactttgggaggccgaggtgggcggattacgaggtcaagagatcaagaccatcctggccaacgtggtgaaacactgtctctactaaaaatacaaaaattagccaggcgcagtggtgggtgcctgtaatcccagctactagggaggtggaggcaggagaatcacttgaacccgggaggcggaggttgcagtgagccaagattgtgccactgcactccagtctggtgacagagcgagactccatctcaaaaaaagaaaaaaaaaagaaaagaaaagaaagaaagagttggaagacaaagttaaggaaatctctctaagaatagaataaaaacaatgcagatggtaaatgagcaaaaaaggacaagaaaaatgcaggatcaatcattacaggatcaacatccaaagagagttccaggccgagcgcggtggctcatgcctgtaatcccagcactttgggaggctgagatgggtggaccacttgcagtcaggagattgagaccagcctggccaacatggtgaaaccccatctctactaaaaatacaaacattagccaggcgtggtggcaggcgcctgtaatcccagctacttcggaggctgaggcaggggaatcgcttgaacctgggaagcggaagttgcagtgaactgagatcgtgccactgtactgcaacctgggtgacagagcaagactccatctcaaaaaaacaaaacaaacaaacaaacaaaaaaagagttctagacagaattcataaattgaaaggttctggaaaagaaaaactttccttggcattcatttgttattgttcagtgattttcaatgaattaaatctatttttttttttgagatggagtcttgctctgtcgcccaggctggagtgcagtggtgcgatctcggctcactacaagctctgcctcactacaagctctgcctcccgggttcaggccattctcctgccttggcctcccaagtagctgggactacaggcgcccgccaccacgcccggctaattttttgtattttttagtagagatggggtttcaccgtgttagccaggatggtcttgatctcctgacctcgtgatccgcccgcctcagcctcccaaagtgctgggattacaagcgtgagccaccgcgcccggccgaattcaatcttaagaaaggttactagagaaggaagaatggtcttgatatattgtaaatacagataatgaagtcctagaaatctgacttattgtcccagcagaactaggaagaaaacccaaattctgacttctagttatcttccctggaaagcacacggttggtttgctttaaaattcaaggatttccagtaagagtgttttagcactttaaaatacagcaaagcaagtaaacctaacatgactctgacctggcaatgatgtcatagaaatgcattttgttttccctctctttgctcaaagcttgcaggagactgttgtaagtggccgaatcttgcaactccttaatggtatctgcaatcacatcgctgaaaaactgcctgtaaggagaaacagaccaacaaaaaatgagttaataaattctattttcagccgggcatggtggctcacccctgtaatcccagcactttgggaggctgaggcaggcggatcacgaggtcaggagatcaagaccatcctggccaacatggtaaaaccccatccctactaaaaatacaaaaaaattagccaggcgcggtggcaggtgtctgtaatcccagctactcggaaggctgaggcaggagaattgctggaacccgggaggtggaggttgcggtgagcagagatcaccaatgcactccagtctggcaacagagtgagactccgtctcaataaataaataaataaataaataaataaataaataaataatattttcaggccaggtgcagtggcatgtgccctaattccagctacttgggaggctgaggtggaagaattgcttgagcccaggagtttgagatcagctgggactacacagcaagacctggtctcaaaaaatatatatatgtattatatatatatgtatttatatatgtattatatataatatacattatatatgtataatatatattatatatgtataatatatgtattatatatgtattatatgcatattatgtattatatatatgtataatatatattatatattattatatattatattatattgtattatatattacatattatatatgtataatatatattaatataaaatattatatattatacatatatataaaatacatatattatacatatatatataaaatacatatattatacatatatatatataaaatacatatattatacatacgcatttccctacattcacaaagggctacagaagtcacacaagttaagacccaggccaggtgcagtggctcacgcctgtaatcccagcactttgggaggccaaggtgggtggatcacttgaggtcaacatagtgaaacctcgtctctactaaaaatacaaaaattagccaggtgtggtggtgcccacctgtaatcccagctactcgggaggctgaggcaggagaattgcttgaatccagaaggcagaggttacagtgagctgagattgtgccactgcactccagcctgggcaacacagccagactcttgtctcaaaaaaacacaaaaaacaaaaaaaccgcaaaagtttgattaggtctttaaaaaaatttttttaaatgatttaactttttcaaaattatgaagtatttcaaaaattcagaaagtataaagaataaaataatgaatatttatgtacgtaacaccaaatttaaatattttaccatggtagagacttggttttttttaaagattacatgtgtcagatatatctgaagtctctagtcccagtcccctcaatcttccccagagataaacactcttctgaatttggtgattattattctctagcatgttgtgatacttttattatgtgtttgtgtgttttatttaaataatacatgtagttttacatgttattatttttatttcatttttttttgagatggagactcgctctgttacccaggctggagtgtggtggtgtgatcttggctcactgcaacctctgcctcctgggttcaagcgactctcccgccttagcctcctgagtggctgggagtacaggcatgggccacctcacccagctaaaaaaaaaaaaaaaaaaagaagttttctttaatttctagtttgctaagaggtttttagtgttgatttttatatgttgaattttgccaaatgccttttctgcatctattgatctttctatttatttatttttttacattttctaatgctaaactatttttgcattcctgggataattccaattttcattatgatgttcattctgggtctttttttttttttttttgagacaagagtgtcgttcttgttgcccaggctggagtgcagtggcacgatctcggctcactgcaacctgcacctcccaggttcaagcgattctcctgtctcagcctcccgaggagctgggattacaggcacgtgccaccacacccagctaacttctgtatttttagtagagacagggtttcaccatgttgaccaggctggtgtgaaactcctgacctcaagtgatctgcccacctcggcctcccaaagtgctgggattacaggcgtgagccacggcgcccggccaaacgttcacattttcgagatgagtaaaccaggttcaggaaacattcacatttttgagatgagtaaaccaggttcaggaaagttaagtgacttgcccgtggtcacatacctagtttgagaaagagctggagacatatagcccaggtttcctaacgcgtagtccgctgttcttcatgatcctctcctaagtggagctgtttaggccgggcacaagagctcacacctgtaatcccagcattttgaggggccgaggcaggaggatcgcttgagtccaggatttcaagaccagtctgggcaacatagtgagaccccctccccccaccccatctcacaaaaattaaaaaaaaaaaaaaggctggtcatggtggcacgtgcctgtagtccctgccacttgggaggctgaggtgggagggtcgtttgaggctgtagtgagtcatgtttgtgccactgcactcctgcctgagtgacagagtgagaccctgtctcaaaataatgataataataaaataaaaattaaaaatggctatttaatgtcttgacacagttggcaagaattatagttactattttacataacaactcaagggagagggagatttagagaatagccagttttagctggtatggtaaggaagtcccctttgctttaatctttccaagaaaagtaattttgtggccgggcgcagtggctcatgcctgtaatcccagcactttgggagactgaggcgggcggatcacctgaggtcgggagttcgagatcagcctggctaacatggtgaaaccctgtctctactaaaaatacaaaattaaccaggcgtggtgacgcacgccagtaatcccagctactcgggaggctcaggcaagagaatcgcttgaacccaggaggcggaggttgcgtgagccgggattgcgccactgcactccagtatgggcgacagaacgagactctgtctccaaaaaaaaaaaaagaaaagaaaagtaaatttgtgatttttaaaattgttaattaattaattagagacagggtctcgccctgtcactcaggctggaatgcagtggcatgatcgtaactcactgtaacctcaacctccccggcttgagtggtcctcccccgcctcagcctcctcagtagctaggactaaagcacgccaccacgcccagctaatttttttcatttttgtggagatgaggtctcgctatgttgcccaggctggtcttgaactcctagcttcaagcactcctcccacttcagcctcccaaagtgctgggatcacaggtgtgagccaccgcctgcagccaggaaagtaacttcaacatgaccattcacgttatagtctctgtttctgctttcttcagccctttctgcctgtaaagccaacctcctctgcccaggtcatcagaacagtacttctacttcatagaatgaggtgttgcctgatttagaattgcaaataaaagccaattaagatgtttagatttgtggcctggcgcggtggctcacgtctgtaatcccagcactttgggaggctgagacgggcggatcacctgaggtcaggagttcaagacctgctcgggaggctgaagcaggagaatcacttgaactcaggaggcggaggttgcagtgagccaggattgtaccattgtactccagcctgggcgacagagtaagactctgtctcaaaaaaagaaaaaaaaagatatttagatttgttgtaattttgtcttttgacagtagtatgttatgataaaataattattaattcaatgcaataagacaataatgcataaagatgagtacagcaaggaaagcatacacaagcttcctacaaattcccattttaaattcataaagagttgtagtttttttgttgttgctgttttgctttttaagtttttttttgagatggggcctcactgtcacacacgctggagtgcagtggcacaatcacggctcactgcagcctcaatttcctaggctcgggtgatcctcccacctcagcctccagagtagctgggaccacaggcccaccaccatgcccagctacttttcttgatttttagtagagatgagatttcactatgttacccagctggtttcaaactcttgggctcaagcaatcctcccaccttggcctcccaaagcattaggatcacaggtgtgagctgccacgcctggcctgttgtagtttttatgtccttgatattttgatttccacttgattctggataactggtggagatgtacattttgtgaatataccctgggtttcagatggaatataaatctaaaactaatcccctacaaataattgcgactggtattttgggtctttcaggaaaagatacgagccacacactgagaatgaaaaggacatgaagcgggcaatttataagcaggttgcctttctgtccgatgcagatctgggccaggctgactttagcaagatcttactcttggttagggtcgaataccgaggtcagcaaactctttctgtaaagaggcacgtagtaaatattcggctttgcagggcgtaagttctctttggcaacgactcaactctgcattgtggcatgaaagcagtcacaggcaacgtataaacaaatgggcgatgccgtattccaataaagcttttcaaaaacagacttcagactggatttagctagtggtcctgcgtaattgcagtaaaaactctcatttaccaaaagttcttaacgtaatgttacaccctcttaacaggcttatttgtcatcgagccagctgacaacaaaacattatgagacaatgggaatttagactgcctttaagaaaccctcaggattaaaacacagtttggaatttggctatgtagaataataatagctatatagtagctattaatggataaagcatcacaatagctaccaagctgtgccaggtactaaagccttatttctaacccttacactaaggttgcaaggttgctatcacggtctttttcttttctcttttttttttttcaagacagagtcttgctctgtcacccaggctggagtgcagtggtgccatctcagctcactgtaacctctgcctcccaggttcaagcaattctcctgcctcagcctcctgagtagctggtgccgaggcacctgagattacaggtgtccaccaccacgcctggctaatttttgtatttttagtagagacagggtttcactttattggccaggctggtcttgaactcctgacctcgtgatccaccagcctctacctcccaaagtgccgggattacaggttgagcccccgcgcccagcccattctcatttttaataattgaaaacagccagtgtggctgtagtcccagctatgtgagaggctcactggaagccagaagcttgagggcggcagtgctctatgatctctccagtcaatagcactggcttccagcctgggctacagagtgacctcgtctctaaaaaataaacaatctgcaggtatacagctgaaggaaaaaaagaaaaagaaaaaaatttaaaaaataaataaaataaaaattggaaacaaagacaaagggccgggcgcggtggctcacgcctgtaatcccagcactttgggaggccgaggcgggtggatcacctgaggtcaggagttcaagactagcctggccaacatggtgaaacccgttgtctactaaaaaatacaaaaattagccgggcatggtggcgtgcacctgtaatcccagctcttcaggaggctgaggcaggagaattgcttgaacccgggaggcggaggctgcactgcgccgagatcagaccattgcactccagccttggtgacaagagcgaaactccatctcaaaaaaaaaaaaaaaagacttaataacttatgcaatatcatatagctgccttgctttccattcatatcaccctgcctctaggcagtctttagctaattctattctcagcagtcattttgcatacacagtaatgactaacctgtagacgatagcagtcagccacctgggcgccccttcgctcatctatgtgtaaatacgttatttcactgccaaatgtcttccttccttacctatcaatctgaattttcttcagtgtctccgtagtcatgatggtctgccttgtaggttttttgaagacaagatcctgcattttgttaaactccacagcgaaccggcctctgtgtctgatttctggcaagttgggtccttcctcagttattaacggactgggtatttttgtgattgttgaggccattggaagtttgtctagattcgttccttctagattcatttctctgcttttcttttaaaacaataaacaattagaaagaatttttttaaagagacaatacaacaagaaagaggcctttgtgtacatttttcaacattatcttctctgacttctactctatactccaagaaaatgtgcccctttcttcagccacaccaaaccacacgcgccctgctgctaacttcacacaacattcttcttctccgtcattccccaacttaccacctggtacactctgctcaaaagtaaagttctttgtgaaatatctctgttagcaggcatttctcatgttgtaattttttataaagtatctccatcaggtcgtggtttctagggtcggggggacagtgtcttagagatcttggttccacttcaagaaaaactttttttgaagactagtctcaagttatttttggaacaagattggatattcaataaatgtggccatctttgtagtcccattgcttagaacaatgactagcatatagcagagacgcaaatgttccttgaacatatgaacttgaaatacaaataaaaaaaggagaatcatactaaaagcagaggttgatagtacatttagtggtgtggtgtagactttgaggatcatggagggaaaagccaaaataatttttttcagaaccaaacttgaatattaagggaccgcaggaacggcgtatgcctttcagctgatggtgctgactattaagggaccgcaggaacggcctatgcctttcagctgatggtgtaaactaaactgtggctaaaagcttgagccactgaggcacacgatgcagcgactacacatacggattctgaagccatgtttgaatcctgctgtctctcaactctattgaccttgggcaactagttaacatctctgtgtccccattttcccactggtaaaataaatggttattattttagattttgcctaaggcaataaggggaaatgtaaggtctaggaggctccactgtcttttttttttttgagacagggtcttgctccgccgcccaggctggagtgcagtggcgcgatctcggctcactgtgacctctgggatgccccattttctgagttccctaaccactattcctctacctttatacttggacatctggaaaaggaaccaaatgtgtctcatggcctgatttactgattactagaaagaaatgtgaatttttagaatagaattaaagaaacgagctaagtgttctagttgacgcactaaaaaaaattttttttgagacagagtctcactgtgtcgctcaggctggattatagtggcaccatctccactcactgcaacctctgcctcccgggttcaagcgattctcctgcctcagccttccaagtagctgggattacaggcccacaccatcatgcccggctaatttttttgtatttttagtagagatgaggtttcgccattttggccaggctggtctcaaactcctgacctcaggtgatccacctgcctcggcctcccaaagtgctgggatgacaggcgtgagccaccgtgcctggcctctaaaaatttacatatatatatatatataataatatattttatattgcacatgctatgtacaagatagggttttttaccgtaaggaaaaagagaagaaaaacagtattccctgcaagaaaactctttccaaactttggtcaaatcactctcatttctggcagaaccacgtatattaatatatttttcatcctttcatttcataattctaatacatgaaaatgtatctggagatggccttagccataaaaacggctttaaaagagggaaaatgctaatctttcctctcaacgttgttaaaaggctcaaggatgtcaagcctttgggaaaggaaacatccatatactaacatttaaaaatatacagcctaggccctacagggcagcggcatcttcaaattcatgagtcagaacaactatagtaccatgaaatacaaaccaaaaaatattttaagagattcacaatttttaaaagatatgaagctaacatattgagaaatgggcttttaaattgctattaatcaacatgattaaagttactataattatacatattatatattactatttacactacagtaaaatcacaaggagggtttctgttgagtcagaaaattttgtgggtaaaagatcactatgataaaccagaaaaaaacagtgcaaaagtttcattcatttactggagtagtgaccactgctgaacactgtcgattaatttagaacactgtcattcttgatattccatgatggcaaattactcttttcaaaggctgacagcaggtagcattgaaaagacttcatttattaactgaatgccttcccatttgtttgtccttccttccttccttccttccctccctccctccttcctctctctcctctctctctcccctctctcctctgtctctttctttcccttccttcctccctcccttcccttccctctccctgccctcccttccccctccctcccttcctaccttcctctcttcctttctttcttttcctccctccttccctttcttccttccttcctctctctctcccctctgtctctttctttcccttccttccttcctccctctctcccctcccttccccctccctcctctcccatccccctccctcctctcccatccccctccctcctctcccatccccctccctcctcacccttccccctcccccttcccctccctccctcccttcctcccttccttccttcctttctctctttctctttctttctttccctccctccctcccttccttctttctttctctttcaacaaggtctcactctgtcacccaggttggcatgcagtggtgtgaccttggcttgctgcagcctcagtctcatgggctcaaatgatcctcccatatcagcctcctgagtagctgggactacaggcgtacgccacaattcctggctaatttttgtattttcttggtagagacagggtcttctatgctgcccaggctggtctcaaacttctggcctcaagtatttctcccaccttggcctcccaaagcacccattttattttttattcttgctgaaggagataataaataggaagaatacaccagtctcttctgtactatttgttagccagcttaaattgttaagattagcctcttattttaaatgcagtggaagattttgttcttagatccttatctgtttgcccttcataagttaacaaggaagttaacttacattatacaattcctgtgatacttacagcattttaaaactaccccaaaactcgcagaatgccagctctggaagggatctatgggtcatttaggtaaaactccattacaacttacaaatgagaaaacttagaccaaaaaagtgaaatgattgctaacagcacgtaactatatcccaaacgtctcctgactccaaatccattgttttgtaaaatcttatctaaactttttaaactttaatgaaagctttaagaacccgggctgctcgggaggctgaggcaggagaatggcatgaacccgggaggcggagcttgcagtgagccaagatcgcgccactgcactccagcctgggcaacagagcgagactccgtctcacaaaaaaaaaaaaaaaaaaaaaaaaaaaaaagagcccaggctgtatatataacaataataatttagaaaatttgaaattttaatggaaaattaaagggaaatttaattttcttctcttgataaatatggactttactgttagaaatgaaaagcaaaaacaaaacaaacaaaatgaaaaaaaaagcaatttaccctcttatttatatagcaattttcaatggtcatagaatcagacataagaatatcttctgggctgggtgtggtggctcacgcctgtaatcccagcactttgggaggccgaggtgggcagatcacctgaggtcgggagttcaagaccagcctgaccaacatggagaaactccgtctctactaaaagtacaaaattagctgggcgtggtggcgtaatcccagcacttgggagactgaggcaggagaactgcttgaacccgggaggcggaggttgcggtgagcctagacactcctgggcaacaagagcgaaactccatctcaaaaaaaaaaaaaaaaaagtatcttctgaacaagttatataatgttattatttataacttgataaatgtgtacttctatttataaattgtttccattttatacctacaacctaagttactgaaatgtacaagagcttaaaaatgcataaagactttgctcactactaagttaattttctgataactcagtgctgcttcacagaggattcatcaatgacaacaaagtcattttagattaaagcgttaagagtggagttgaatttcctccccctagtgttcagttaggttgcagcagctgagaaatacaagttgggtgggacaactcagtaattccatctcttcagtatatagattgtattcatactgatttcagtagaggcctttttgggtaaaaccaatatactagaaaaggatattctgtctggtaatataccttgagttatggcaatttcactccatcagttgagagtgcatatctcagatagttattgtagcccctttatctgaaataaaggtgctatttcccacgtgatatttaatggcaccagcctggacaacatagtgagatcccatctctatagaatttttataaaaaattagctgggtgtggtagtgcaggcctgtagtcccagctacccaggaggctgaggtgggaggatcacttgagcctgggaggtagaggctgcagtcagccatgatggcaccactacactccagcttaggccacagagcgagaccctgtcaaaaaaaaaaagaaaagaaacaaagaaggaaagagagagagagaaagaaagaaaaataagtacatttaatgggataggtactataaatgagggagaaataaaaaataaagcaaaattaactcatggtgagtgggtctataccacgcagatgctctgtctcccttcgtactgaacgggcatgatgtagttcagaatagagagctggtctgtggtgtcctccagaactgccgagatcctcagcacatctggaagggacagtggctctagagtttccgggatttctgggatgatttctatgtctgtttctttaggtattccttcttcttctacggtactaggtggttcgcctgtcactgacaccgtcatctcagaatgccaaacttttggaggaaggtttgagtcttccaggctgtctctaaggaaagaataaagaaaaaataagtcagcaaccaatatttaaacattactttaactcaaaagcacaggcagcaacgtgctgggctcctgtgatattcacatcgtcgtataatagaacctagatgaaaaaaaaggaggatttggcgtgtgattctgctaagtatcttccattttgaccaaccaaaggcaaacaacttactctttttttttttttctttttttcagatggagtttcgctcttgttgcccaggctggagtgcaatggtgctatctcagctcaccgcaacctctgcctcccaggttcaagcgattctcctgcctcaccctcccgagtagctgggattacaggcatgtgctaccacacctggctaagtttgtgtttttattttattttattttattttattttttttgagacagagtctcactatgttgcccaggctggagtgcagtagcgcgatcttggctcactgcaagctctgcctcctgggttcacaccattctcctgcctcagcctcccaagtagctgggactacaggcgtccaccaacacacctggctaattttttgtatttttagtagagacgtggtttcaccgtgttagccaggatggtctcgatctcctgacctcgtgatccgcccacctcggcctcccaaagtgctgggattacaggtgtgagccaccgcgcccggccagtttgtgtttttagtagagattgggtttctccatgttggtcagactggccttgaactcctgacctcaggtgatctgcccaactcagcctcccaaagtgctgggattacaggcgtgagccaccgcgcctggcctactgtttaataaaggtatgtagttcatgcaatttggctattctgatcaatttgaatttgagccaaaattaacttttttttccctaggagtatctttggatgctaaccaaaagtgtctcatgatgagtgaaaaacagaatgtggtatccagcctccaaggtggcccaaatgattctcactttctagtgttaacgcctctgtgtagtctacaccacaccgagcaggactagcctatgtaaccagaaggttacggtggggatgacggagtgtgacttgcaaggctaggtgataaaagacattgcagcttctgcctcactctctcaaatctctcactgtgagggaagacagctgccttggtatgaggacacttcagcagcactgtggacacatccatgaaggtaaggaactaaggcctcttgccggcagcctgcaccaacttgccagctctgtcaatgaaccaccttggaagtggatactgcagcccccatcaagtgttcagatcattgccacccctggccaacttcaagttcaggagagacctcaagccagcaccatccagctaacctgctcctaaccttgggacccacagaaactgtgggaaagaataaatgtttatattttaagtcactaagttctggggtaatctgttacgcagcaatagataaggtatacacagaaatttaacagaaggcataatttaaatacatgtatacaaaaaacattggaattttaaacatactcttccattcttctgtagcttcgttaccctccgtggtatatttataatctcacaaaagtgcagttacctaaaatgggaaagaaacactgagattagtttatgggcgtcttgaatgatgtttcagttatttctataccatttcattaagagaaaattaaatgattacgggagctgtgactatcgcctctttgtgcggagtggagcagtcccagaggcgaaagagcctccgacatcatggagtgcaggtctatgaagaagtcaactgagttattactgctctaccaaactcaagacacatgcactctgtgagcctcttctttaggtaaattaatgttcaacgtggttttagtatgttctattatatcaccgatttttaattggtaatctctatatacttgattttttctatcattctgattactgtaatatttaattaggtcactcaattcatcttctctgccagataacagaatttgctccacatggacttagaggaataagtgagatgacacttagaaaaactgtattaattggggccgggcgcgggggctcacgcctgtaatcccagcactctgggaggccgaggcaggcggatcacaaggtcaggagatcgagaccatcctggctaacacggtgaaaccccgtctctactaaaaatacaaaaaattagccgggcgtggtggcgggtgcctgtagtcccagctactcgggaggctgaggcaggagaatggcgtgaacctgggaggcagagcttgcagtgagccgagatcgcgccactgcactccagcctgggcgacagagcgagactccgtctcaaaaaaaaaaaaaaaaaaaaaggaaaactgtattaatcctggaaatcagtttaacattgctatcaagatgttacccctcctcagtaaaccaaaatcctttctgcttaaatgagctttacagtgaaaacccctatggagaagtttgcgttgtactgaatggacagtgagtggtgagtttccaatgtaaatttgtccacaataaagcaactctgagagacgtggtgcaaatatgactcttgcaacaaaaatcttacatgcaaaaattcaaacacacaaaacagaatcttcacataaatttgaaaaagtacttcagactagccaaatgtcctgatgcaggggcagttttaggaggaagtagcatggtattaagcagaatacctttctttttttcttttctttttttttgagatggagtttttctcttcttgcctaggctgcagtacgatggcgcgatcttggctcactgcaacctctgcctcccaggttcaagtgatttccctgcctcagcctcccgagtaactgggattacaggctcacaccaccattttgtatttttagtagagacggggtttcaccatgttggccaggctggtctcgaactcttgacctcaggtgatccacctgcctcagtctcccaaagtgttgagattacaggcgtgagccaaggcgcccaggcggattttactttctatttccatatctcctaagctggacctagttgttgctgtgtttgtttgtttccttgttttcttttttgcttgaactactccaacaacctctaaattggaagtgatcttttaatttttaaattttttttttctgatatcctgacagaaggttcaggaagtgagctttttaaaatgaaagggtgatcttttaaaatggaaaatctcatcatgtccttccctagaacccttcaatggtttcccgttgccttaggacaaagaagaaaattcttgacttggtccacaaggtctgtatgatctgggcccctctgttcctctctagacccaactacaactgcactttccttgctctctgggctccagccacagtgggcttctttcagttcttctctggactcatgctcccttgcaactcagggtctttgcacctgctattccttccagtggagccactcttccctcaccttttcaccgtgtaaagtcccactgacccatcaccagcttaagacagtgtcatttttctaggtgaaatctctaacattttctgtgctctgagagatggacccgtatggagtatatccaggggagattccagaaagagattcagtgtagagaagtgagatcagacatttattctccctgctccttctctgccagaatataattggttggttatgttcctctatcaaaggtcatggctcctgtcaggcaattctctccaaacgtctctctctgggcttaggtaactatttctttcctaggtcccgggagactccatcatcccttgtagtttcactcctgctttaccttttttttttttttttttttttttgagacggtctcactctgtcaccaaggctggagtgcagtggcaggatctcagctcactgaaacctccccctaccaggttgaagcgattcttgtacctcagcctcccaagtagctgggatgacaggcacacaccaacacccctggctgatttttgtatttttagtagagacagggtttcactatgttggccaggctggtctcaaactcctgacctcaagtgatccacccacctcagcctcccaaagtgctgggatgacaggcgtgagccactgcgcccggcccatactttgttttaaaaagtattcttatcatgctctactaatggtcatcacctgcagtttgaaaaatgccttaactgacacttgtccaagtgatcctttcgctgactcgtcaggccagatcaggcttctgggcactcatgccactactttcccgcagagctgtgttcacaatttgttacgttagtgtcagtttccccccactagacaactgttccatgaaagcagcaacatgacaacgatgctcacagttgtatcaggtgctaagtctcagtgctcaataagtatttgtggaacgaataatacacgagcaaacgaatgaaactcacacttaatgtgttattcctcccaggaggacttccatatagaactttgacaaatcaatatctaatagtgaaatttctagcacatttctttctgggacagggaacactgggtggggtagtaggctacaaggtacaagttctatcctgttgtatttaagagaggatctgattttaaaagtgacttatatacatctatttcatacaacttcggagtcatactttactctctctcattcctcatccaccagcaaatcttgccagaatttaaatatattcagaattccagtactcaatatcctctgtttacacaccatcacctctcatcatagtcactacaggaacctataattatcttcctgctgatacccttgcctcccttcactttcaacacagtgactttgtcaatatagaagtcagatagagtcacccttctgttcaggacccttaaatagttcccatctcaaagcaggggaagcctcttttacatacttcccatctcaaagtggggaaagcctcttttacagtggcctctctgcttaattttcttcacagaaattatcatcttctaacgtgtcatctatttttacttgctcattgtgttgctccgcctcgtaggatataagctccacgagggcatagatttgtttactgccgtgtcatcttacacaaaccttggtacagggtagtcattcattaaactatgtgttaaataaatgaatgaatccataggataacccaaataaatatgcaataattcggaaatgtgaatctctggcgtccactaatccacctctacaagtatctacggaggacctactaggtgcggacacgaggcagctaaacgagttctcctaaaagggcgataaagcctcctgcaggcagtcctcctcatacctcggatccaaaaagaagaatggaggtaagaacttaagtcatttcattcattttttttttcttttgtagaggttgggggaggtggtctcactatgttgcccaggctggtctcgaactcctggcctcaagcgatcctcccgcctcggcttcccaaagagctgggtttacaggcgtgagccactgtgcccagtctcatttcttgaaagagataaataagtagaggggagaaaagaagtatagaaaaagaaaaaagagaaggaagaggtcctgctgccttcgtgctcccggcctttctcttccatgctagattaggatcccagaatttccgttctgtctattgctgtgtgtatcgagagaaaagcaccccactgttggcaaatcaatcttacagtcaatcattctttaggcagcgggaacatcctccactcagggttcgcctttccacctacggcgtccggggacgcaggaagtaaactaagttgtttctatggcaacgcacagctttggcggatttagctggctaccattttgccttcccttgttcccaagtagtacattttgcagcctaccaagatgaaaggacttaggaaaataattgtaagagtgctattgaatgtggcttatttcagtgcgaagccgatttccgaggattgtttttctggcgtttggagaagatgcctaaattgagggcggagtcgaaagatgtttaatcccacaaggccacgcggcggggcctcgtccttctcttaccgccatcttggctcctgtggaggtgagtgaagggtctgctgctgaaatttgggggcaaataaccggagtaggtttgttcctgtgccttggcgagtcgccggtgcgtatcggagtctctgccagccattgatttctacgggtttcaagaagagggagaacaggatggaggagatgttgggctgatggtgtttggtcccctgacacccggagaacggctgcccgggttatcccagttaaattcctgggcctgaacggagtgaaacgatgtttttgttcgtgtgcagttgtccatgaggcagtgcttccttcatccgtttcctcccagtccataccttccttggcttgtctgaccagtctctttcctcagcttttctcccccagccattgcataaaagtcttacgtgtgtgtttctctttaaggcttcatttcttttcctgagtgttgcctactgataacggcatgcattttctcaggcttttctgagagtcatttttgtgactcctgtcccttagttttgtcttcattctgaagtttgcttagataccagctgttctctgaggtttgaatgtcttgccggaccctgcgtttcatatggatgttctggcattgttgtccccgaactcctacatgaaactcccatccaaaaggaatttgctttaggggcttaaacgagaggggacgaggtgggaaacttgtgtggcttggttttaaactaatctttttgtttgttttaaggcctgctgggaacgggacttctaaaaggaactatgtctggaaggtacgcgttttaaatatagttctttatttttgtgtgttagacgtgaacgtaaatgcgagcttaaaattggcaagaaaaaacttagatgtttgctctgagtaacttttgggtgggggtgattacaagtcagattggttttttgaagcttatgtttcatgttgtgtatcttttgtgtcttaggctgtggtccaaggccatttttgctggctataagcggggtctccggaaccaaagggagcacacagctcttcttaaaattgaaggtgtttacgcccgagatgaaacagaattctatttgggcaagagatgcgcttatgtatataaagcaaagaagtaagtttatgacactggtaggttttgggtttttgagatctgcctcattttcttttttatataacggagtcttgctctgttgccgaggctggaatgcagtgacttggtctccctcaccgaaacctccgcctcccgggttcaagcaagtgtcctgtctcagcctcccgagtagctgggattacaggcgccggccaccacgcccggctagtttttgtattattagtagagacagggtattgccatgttggccaggctggtcccaaactcctgaccttaggtgatccgcccacctcggcctcccaaagtgctgagattacaggcttgagccaccgcgcctggcctcattatcctattgaaataataaacaaaagatttagctgaagtacttggtattgtttttttgtttttgtgacaagagtctctgttgcccaggttggagggcagtagcgcgatcttggctcgctgcagcctctgcctcctggctcaagcgattctcctgcctcagcctcctgagtagctgggcttacaggggtgtgccaccacgcccggctaatttttgtatttttactagagaatgggtttccccatgttggccaggctggattggtattgctgtggcttctattttgcgtcattaaggaacttaatggggagttttagaaggacgttacttctgagggtggtgttggatttaggtaccttttgcacttgtaagcaataaaggaggtaattccttatattgtgatccttttaaggtttctaattttttttctcggctccttttgccagaatttaaggatttttagaacacttgtgcttaatgcattttgttaatgccttaaaattatgggttttttttttttttttttttttttttggagacggagtctcactgtcacctaggctggagtgcagtagcacaatatcggctcaccgcaacctccgcctcccgggttcaagggattctcctgccttagcctcctgagtagctgggattacaggcggccgccaccatgcctgtctaatttttgtatatttagtagagatggggtttcaccattttggccaggctggtcttaaactcctgaacttgtgatccacccacctcagcctcccaaagtgctgggattacaggcaggagccacggtgccccgccccttgttttttcttttctttcttttctttttttctttcttttttgagacagagttttgctcttgttatccaggctaaagtgcaatggcacaatctcagctcactgtaatctctgcttcccgggttcaagcgattatcctgcctcagcctccgagtgaggtgggattacaggcgtgtgccaccacacccagctaattttatgtttttagtagaaacggggtttcacagtgttggtcactctggtcttgaactcctgacctcaagtaatccacctgcctcggcctcccagagtgctgggattatagcgcaagtcactgcaccaggccaaaattagtttttatgcatgcctaaagatgtttatgctgtagacttttttttttttttgagacaaagtgttgctctgttgcccaggctggagtgcagtggtgtgatctcagctcactgcaacctcagcttccccagtagctgggattacaggcgcgcaccaccacacccggctaacttttgtatttttagtagagacagggtttcaccatgttggccaggctggtctcgaactcctgacctcgtgatccacccgccccagcctcccaaagtgctgggattacaggcgtgagccatcgtgccattgcaccttagcctggacaacaagagcaaatcctattgtcttcacccactccaagccaattaaaatctctgggaaagtgttttaatcattgccccaccttttcttctacagccaatgtgttcctttaaaattttaagtcaggtgcagtggctcacacttgtagccccagcatttgagagccctaggtgggaggattgcttgatgccaggagatagaggctgcagtgagctatgattgggccactgtactgcagcctgggtgacaagacaaccccgtggtctttaaaggaaatatatataaagtcatatcctttgtacattgctcgaaccacagtagtttctctcattcagtaaaagcccgtcattaagagctccataattctctttatctcagctgggattaaccccttggtgtcttcagtctttcttccggccaggacacacactccttggccccagtgcctgcgctagtcatcccgtgatcacttcatggcatttcccctccctttccagtctttgttccatggtcacctcagtgagaccttccttggctatttaaaatggcaggtaattcctcctttctgtacacacaaatatcctcacacttgtccttttttgctattttttcaatattgcctctgttatcatctgacctatgtattttccttaaacttacttggttatcatgtgaaagatttttgttttatagctgctgtattttacagaagggcctggcatacaatagttactcgataagtatctgttgaatgaatggtgttctaggcatttaaagtttctcaggtgatgaagtgggtaaccagggttgagagccactcgtgtagaggtcaccttgaatttgtatccaactatatcagcttgtattcctcttctttccctttttaaaatcagcaacacagtcactcctggcggcaaaccaaacaaaaccagagtcatctggggaaaagtaactcgggcccatggaaacagtggcatggttcgtgccaaattccgaagcaatcttcctgctaaggccattggacacagaatccgagtggtgagtatggtttttagcaaaatggacgtctgatgaatcagactaggttcaaggtgttgtgctttgacttctgaggacttctgtggttgtgaaattgacaccagtaaattatgctgcaaaatttgtgtattgcagaacactggagagatagtaattgaaagaattaggtgtttggttgtttgttttttgttttttttttggggggagacagggtctcactttgtcacccaggctggggtgcagtggcataatcacagcttattgcagcctcgacctcctgggttcaagcaatccttccacctcagccccccaagtagctgggaccataggcgtgtgccaccacacccagctaatttttggggtttttgttgtgtttttttgagacaaggtctcactttgtcacgcaggctggagtgcagtggcatgatctcagcttgctgctacctttgcctccaaagttcatgtgattcttgtgcctcagcctcccgagtagctggaattacaggcgtatataccaccatgcccagataattttttgtatttttgtattttgtttctccatgttgcccaggctggtcttgaactcctgagcccaagtgatctgcccaccttggcctcccagagtgctgggattatatgcttgagccaccacagccagccttgaataaatagttttctggtgaagatatttattgggcactgaagtaattgttagaaagcaacaattcaacagttacgcctggcataattgttaatattttgccatttccatcatgtcagtcttgttagaacaggtgttagtagctttattttgtacatgaagaaaacagactctcatgttcctaggtctcaggtctttggtgccagccttggactctaaatttttctcaattttctcctgtaatttttctcaaatagttcgtactttttctttagggtccattttggaatgtagactgtatattcttgggaccaagaatatatgcataccatgtattcttggggccagggggtactgttgaaccctgctaagtggttcattagggtttatcaacagaggaggcttttactctgtctttagaagaagcaaaattaaatgtaccttcagtacatgtttttctttttctttttttttttttgagaccagagtctcattctgtcaccaggctggagtgcagtggtgggatcttgcctcactgcaagctcccaggttcaagcgattctcctgcctcagcctcctgcgtagctgggactataggcacgtaccaccatgcccagctgatttttgtattttttagtagagacagggttttaccatgttggccaggatggtctctatctcttgaccttaggatctgcccgcctaggcctcccaaagtgatgggattacaggtgtgagccacagcacctggccagtacatgttttttatgagtgccggttcttacggtatgttcacgtagagactgaaggctataaaaactttccttaccactagaacatgtaattggtagcctttcagagatttatccgtattacggttcttgatttgtagacgtatatataacattcacctaatgttttgtgttcttttttccctgcagatgctgtacccctcaaggatttaaactaacgaaaaatcaataaataaatgtggatttgtgctcttgtatttttaagtggattaaaaaacttactaccttaaattgatttgctacatgcttaaaatgatagaggttgctcagcatttttggagtacaagggggtcagagagacatgtgatgaaaattacagggcgagtacagagatttagaagggaacgggttttaatgcgagtatctttgacagagtcttgctctgttgcccatgctggagtgtagtggtgctcgctgcagcctcacattcaaaggctcaagcaatcctcccttggcctttgaagtagctgggaccacaggctcatgccaccatccctgggtcatttttaaattttttgtagagagggtctgactcttgcctatgctggcttcaaactcctgggctcaagcaatcctccttccttggcctctcctgaagtgctgggatacagttatgagccaccacacctgccaagtgctttgtgatactatgcatttgttcaatgcagattgggaaacttaaaatttgaatggagattatgttgatgggctttggcagttcatttggatagactgggatgagaagctcttgggacttgtgactggacaaagcattccagtatattaaaataaaattaagccatattactccactcataaaaagcaatcctatggtaggtacatggaggttgggaatagtgcacggaaaggtggcagctttctttggcttcatgttttaatctggtaaagttcaagattgcactttaagcaggcctcctaaatattttagatttcttggggatatgctaaaataaaacaactaaggcatcagttttgctgtatggttttttttttttttttgaagacaaggtcttgttttgttgcttgggctggagtgcagtggcgtgattacagcttactgcaacctcaacctcaacctcctcggctcaggcaaacctcctgcctcagcctcctaaatagctggggccacaggcatgtgcagccacaaccagttaactttttagttatttgtggagatgggcctcactatgttgcccaggtagtactacatttctaactgatgcagtaacagtctttttgtctgccccctgagggttactgatctctacagcacaggtagttttttaaattaacatctttaaattgcactgaaaatgtcaacaagaaactgggagtttgccacctaagcccttttgcagttttgcagcgtgtatgggttctcttgtctatgctgcaaaagaattaacatgctggaaatgtattaggataagagggtgaaagaaaggattgggtaggaaaagcacactggctgttgtgttatttggtcttccatctcctggagacaggactgagaaggaaagtttttgtagtaagggaaaagagtgggaatactgtccagctttcccacttccccttcctccagtaacatcctgttacaaatctgctaacctacaaagagggtagtgagatatactgacccaagagaaagcaagacgccctcccccagaggtccctctgtcacactggcagttctaagaaaggtttggtcagtccaatggtggtatgcaagccaaagctgccattgttggagtcccgtgcttcgtggacatgggcttgtgttagtactctgccaggctcatttattaggattgtggtggtttttttttttttttttttgagacagtcttgctctgtcgtctaggctggagtgcagtggcgcaatcttggctcactgcacgctccgcctcccgggttcacgccattctgtctcagcctcccaggattgtggttttaaggcaaacaaagtgcactgatgctgtattcaccagaagtgagcagtacttcaaggccggaagttggaagttgtatattagaatgctaatgaaattgaacttgggaattacgcagtcagcgcgaggaagtgctgatcttggacacccactccaaaaggccaacataagctaaaagtacctactgtgttcattgtgccagttaagtagatgtgatcagtagtactcggggtattcagggatagaggcatgtaggtatactggctgcgtaacataaaaccgtaaagtgtagaggaagaaatagggcggcatctcaaagaggaaatggcaggaagattttaggaacacaagtggctgactggaaagtccagaaaactaaaatgccacatgagaggtctcctgtactgaactgaggatcttaggcttaagattgttcttgagtgtaatacaacgtcactgaagaacttgattcacaggaaattttaaaatttactcatttgagacagggtttctgttgcccagcctgtagtgcagtggtgtgatcatagctcactgcacctttgaacttctaggctcagacaatcccctgcccacaacctccagagaatctggtgcatgccaggcacgtccagccaattaaaatgttttttcggggtcccaggctggtctcgattcctggcctcaagtgatccccctgccttgttctcctaaagtactgggattacagatatgagccaccagctcagattatttcaaatcccaatggcatcccagcataaacaagggaaaattaggtgggcttttcagtctcaaatggagaattctaacatgtttctggctttgggggctggatggataatggtgcatttacaaagttggggaatcaggagatggttttgtgggaggagctaaagttgaatttgaggaagctgtaagatgttaacctgtggacatatccatgaagacagatgggtatttcaggtctgggttaggcatatggagaagtggatggtattctgagtggaacagacacacggtaagtggtaggcatctgagcaaagcgggggaaaacaaacggttgagactttaactcgagtaacttacatgtgcaatggcaaatgagactcaaaagcaaatacatgctcttccttactgagatgatgcagcatttgtaaataataaatgtatgtttttatgtttttctcctcccatatggaaattaagtcaaaagtactcaagtcaccgttgccaaaggaggagtcctgtggtttacaggaaagggcttgcgtggctggtaacttgtccactacaccattgaaacagctttgcctcctggctgggcgcggtggctcacgcctgtaatcccaacactttgggaggcggaggcgggcggatcacctgaggtcatgaggttgagaccagcctggccaacgtggtgaaactacgtctctactaaaaacataaaaattggccgggcgtggtggcgggtgcctgtaatcccggctactcgggaggctgaggcaggggaatagcttgatcccgggaggcagaggttgcattgagccgagattgtgtcactgcactccagcctgggcgacgagtgaaactccgtctcaaaaaaaaaagaaacagcctttcctcagcataacactattgttacagccaggagcttaggatgactggttccattctttattcacaatagcaatttatttgtggtattgtagtggaaagggcacgtttcctaagttacaaatgtggtttggaatcccaccttccactagttgtgggatgatacacacatttagtgagtatttacttgtaaaatggtaatacttaaaacaccaccccatcctcgtagctgaatctccacccatagtttgtaacttgaggttttccttctttcctactccttcatttcccagtatagtagcttacctattcaattcccgttgaatgacttccagctcagtgagttcgtaattttacttcttagtgtcatgagccactgggatttgtcccaatttcccattttgtatagttcctcacggctcagtttcgaaggcaaggtttccttaatggccaggatcccccttatctcaggtgcagtggcaattcttggctggaaactaaaagatggagttgagtaaaacagtaaacggtgtatcatagatttttataggaaatggcgttagttaagtaatgggcctaaagttggtgactcaggataagtaaatgaaagtattccactcaccttttcatacagaggactacactgaaagattttgcagagggttgtatgtacgtctaaacacctggcacctagtaggtgcatgtcactttggtaaatgaaagaactgaaaaactgcctcaagacacccacatacggccaacgcccgctagcctttcttcctcccacagccccactcacgtgggcctccaaacagcatttattggccggcttcgcgccacgagacgcgatggacgtgatcgccgccctcatcttctgcggcgaacttctagcgggtgacgctgtccaatcggaaagcgcctttccgccggctgggccctccgtctacccccagcggcgaggggcggggccggcgcgggcgcagaggcgtcacgcactccatggtaacgacgctcggcccgaagatggcggccgaatggggcggaggagtgggttactcgggctcaggcccgggccggagccggtggcgctggagcgggtctgtgtgggtccgaagcgttttactcctgttgggcgggctccgggccagcgccacatctactcccgtctccttgggcagttcccctccctgccggcaccacgtcccctctgacactgaggtagggcgacatgggcgggagcgggccctctcagggtaaagtcacccagaaggagcaggcgtaggagatagtgactgggagaaggtgtcctggatgagaaagcgaaattggggcagagcctgactcttacaggcctgggacccgctctcagctccctacaccctgcaagttggctgttaggcgctcagaacagtatcacttctgtgcggagggttgtgcttagcagtagccctcgaggagtggttttcaaacttgagcgtgcatcacagtcacccgacgcacatggtacaacacggattgccgccctcagtcccccacttagtgactcagtaggtctgggatgagtccccagagttgacagtttacgttcccagctggttggtgagatatgcttgtccggggaccactttaggaaccgctgacctgaagtttcgggaagacattgaacggagagccagatagaggcgttggtgggacgttgggggctcactggagacaaaattcaggtttcttttcacgttatgtcgtcactttgtttgctttacccggttcctctgctctggaagtgcctgcccgcctcccatcccatttttctctctgcttaaattctttgtctcatttcaaattccctaacctcaaggcagcctgctgaaaccaccacagcgcaatattcttttcattaaaaagtacatcgtgtctgtactccctcctggcatttaaccaagtactgctatgggataatggcttattttttaggcgtatcttgcctttgcagttagattataaggttccgtgggataaggtttgtgtttcatactttgattccttcacagtatttaggtcagaggtgggtccacgataatccatattctttgagaaagggagagtacctggggcagggctgcatgctgatacacctacacatgttcaattcagcccagaaatctaaagacactcatttttatggtaatttcccaaaatgttacatgcatactcttcataaccaagtgagccaaaatattaacttcggagtttatagcttttttgcagcttttatcatgctgcattttcgctgaattctttaaaaaaaatttcccacaaaaccctgcacttctctcttttaatttggattaaaataagagaaagagtcctggtccctaatacgtttcgctagttcctcatagagtatataaataccctgtcgtcctcactattctccttgttttaacctggacacggagtatagccaggagctacagtgttcactgtagttacgctaatgactatacctctgttcaatgctacaggaaattacataacttttttggttttggtggtgttggggagctacaaaacagttttactttttaactggttctcaactaaagcctgtaagttttgtttttaccttttattacgccggtacaaacaacatcagaataatttaatgaacccgcatggacccatcacctagctttaacacctagctttaaggttccgccattcttgtttcatatactttcagccattccgcagccccctacttgagttactgttcttttgaagttttttggtaaaatttacatatattgaaatgccacaaatgtatccatgcacatccacataaagcatacaacccatcacaacatagaacgttcccacatctccagacgttccctcctgtcctgtgccagtctcctgcccaccccaggcaactagttttctaattgttttttttttaaatactagattagtttggccaattctagagcttcgtgtattgaatggaattatatggtatgtactcctctgtatttggcatctgctcagcattatgtctgtgagattcgtgttgtatgtgatagtaatttattcctttgaattgctgagtattccattgaatacttatatcacaatttgtttttccgttatcttgttcaaagatgggtattttggtttcttccagattttagctattataaataaagctgctgtcaatattcttgtacagtaatttttgtggatatatgttttcattgttcttggataaatacctaggggtgaaattactgggtcaagggtaggtgaatgtttataaaaaatactaaccctttctccaaaatactctaccattttacacccccatcaacaaaatattagttatggttgctgcatatcctcaccaacagatgtcctttctaagaaatctttaaataccccctaggtcataaaaatattctcctgtgttctagaagccttcacttttaggattatgattcatctgaaattaatttttatatatgatgtgagataggggatcaatatcctttttttttttttttgccccatatgggtattcagttgcctggattatgtacctctgtaataaatattgaaatcagacagtattgttattgtaagcattcctgctttgttcttccttttcaaaatgattttggctattttaaggcttttatatttccatataaatttatttattttttggcagggggaggctcaaagacagatccatataaattttagagtcagcttctcagtttcttcaaaaaagcctgatgggtttatgattgggattgcatttactctatagatgatttggagataattgacatctaacagtatcaagtctttcaatccatgaacataatgtatgtttctccatttattgaggtgatgcataatttttctcagcaaaaatgtatagatcttgcattttttcttctgttttcttttctctctcttttttttttttgttttgttttgagacagtcttgctctgtcactcaggctggagtgcagtggcagaatcatagctcacagcaggcttgaactcctgggctcaaatgatccttctgccttaatctcccaagtagctgggactcccaagtatgcgccactacacttggctaattttttattttttgttgagacagagtccaggtgggttttgaactcctggccttaggcgatcctcctgcctcgacctcccaaagtgccaggattacaggcatgagccgccgtgcccagccagatcttgcatgttttttgttaaatgttttcctaagtcttttattttttgatgccattgtcagtggaattatggttaaagttttccagttgtttgctgctagtatgtaaaaatacactgctagtaggtagaaataatttttgtatattaaccttgtcttctgagacctagctaaacttatttattctactagggtttcctcccttacaatttttgatgttagcaatgtattaactataaataggaacaatttttgttgttgtagttttgtatcatttatgtattttttcccccttattgctctggtgaggacaggcagttccaggctgagcaaaagtgagatagcacgcctccttgccatttgttcctgatcttaggaccagtctctgaccattaagtatgatgttaactttacatttttttgtagttccctttatcagattgagaaagctccctttggtttctggtttcccgagggtttttatcctgaatggggacaaattttgtcaaatgctttttgttttttctggtaattattgagataatcatatagtttctcactttatgaactgttatgtggtagattacattgcattttccaatagtaaatcaacgttgcttttttgggataaaccttacttggtcatgttggctttggtaattttctttaatgtttgtttctatttcattgttttctgttctttgttatttcctttttctacttattgtggatttagtttgctcatattgttaggcggaaacttagatgactgttttttaacctttttttccttctaatgtaaacattcaaagatataaatttctaagtacaactttagctgctcttcacaaattttgacactttgcattttaattatcatttaggttaaaattttttttttgttttttgttttttgttttttttttttgagacagagtcttgctctgttgcccaggctggagtgcagtggcgcaatctcagcagagcaacctcggcttcctgggttcaagctattaccctgcctcagcctcctgagtagttgggactacaggtgcacgccaccacacccagctaatttttgtatttttagtggagatggggtttcaccatgttggccaggatggttttgatctcttgaccttgtaatctgcctgccctggcctcccaaagtgctgggattacaggcgtgagccaccacgcccggcctaaaaaagttttttaagagacagggtcttggtcgggtgcagtggctcatgcctgtaatcccagcactttgggaggccgaggtgggtggatcaccttaggtcaggagtttgagaccaccctggccaacatggcgagacctgtctctactaaaaatacaaaaattaaccaggtatggtggcgggcacttttaatcccagctactctggaggctgaggcaggagaattgcttgaattcaggaggtggagtttgtagtgagctgagattgtgccactgcattccagcctgggcgacaagagcgaaactctgtctcaaaaaaaaaaaaaaaaagaaagaaagagacaaggtgtccctctgtcacccaggctggagtgcagtgatatgatcatagctcactgccacctcgaactcctgtgttcaagcagtctccccgcctcaaccttatgaggagctaggacttcagccacatgccaccacacctggcacattttttatttttatttttgtagagacagagtcttgctgtgttgcccagattggtcttgaactcccagtttcaagcaatcctcctgcttcagcctcccaaagtgctgggattacaagcgtgagccactgcacctggctgagattattttatttatggtttagaatatgatctatcctgtttaatttttcacgtgtacttgtgaagaatatatattctatagtttttttttattttattgttttagagatgggatctcagtatgttgcccgggctggtcttgagctcctggactcaagcaatcctcctgccttggcctcccaaagtgctgggattatagacatgagtcactgtacctggcctattctgtagttattgaatatagatttctatacatgttaataagctgaggtgattgatactttacttcagattttctctattaaaaactattggccaagtacagtcactcatgcctataagtctagctcttttggaggccgggatggcaaatcgcttgagctcaggagttcaagaccagcctgggcaacttagtgaaaccccgtgtctacaaaaaatacaaaaattagttgggtgtggtgttgtacacctgtagtcccacctacttggtggggctgaggtgggggaatcacttgagcccaggaggtgaaggctgcagtgagccaggttggcaccactgtgttctagcctaataaagactgtattaatacaggagaaaataggtgtatttagcttgcttgtggttcaagcttacatgtgtatcttttcagttgcctacatttacctgtgtgtatgtgtgtgtgcttgtgcattttaggcattacaacatatatcttttgtttattgcatgtttttatttttgagacagagtctctctccgttgcccaggctggagtgcagtgacacaatcttggctcactgcaacctctgcctcctgggttcaagcaattctcctgcctcagcctccagagtagctgggattacaggcacctgccatcatgcccggctaatttttgtatttttagtagagacaagtttcgccatgttagccaggctagtctcaaactcctgacctcaagtgatccacccgcctcagcctcccaaagtgttgggattacaggcatgagccactgcacctggcctattacatctttaatgttaatattatcacactgtctggggcatgatgttgaataagagtggtgagagtagacatccttgtcttgtttctgatcttagagggaaaacattgtcttccactgttaaaaatattaattgtggagtttttgggtaggtatgctttataaaattaagaaaattcccttctatacctagttttctaagagttttttttttttttaatcatggatggatgttgaattttgttaactgtctttcctgcaccagttgatacaatcatgtggcttttcttctttactctgttgatattatgagttacattgattgattttttttgaatgtcaaatcagccttgcattcttgagatgaacctcacttggtgatgatttattaccctttttacattttgctgggtttgagttgctcatattttgttgatgattttacatctatgtatttttatttttttagagacagggtgttactctgtcatccaggctggagtatagtggcacaatcatagctcactatacagccttaaatgacttggcttaagcagtcctcctgcctcagcctcccagttagctaggattacaggtgagagccaccacacctggttcatttattttcatgtttagtggatatgggctcttgctgtgtttcccagtctcgtctggagccactgggcccaaggagtcttcctaccttggcctcccaaagctctgggattgtaagtgtgagccactgcacatttacatctatattaataagggatattggtctgtagtttttttaattttattttttaaattttatatttatggttttttaccaactacctgcaaggatactggtctgtagttttcttttcctctctaataataacttcaggtttatcgggggaacccgcccccaatatttcaaagtaggttctttctattttccctaagtgtcagccagctgagaaatacagagaaagagtacaaagagtggaattttacagctgggcctccagggatgacatcacctatcagtaggaccgtgatgcccgcctgagccgcaaaagcagcaggtttttattaaggactttaaaaggggagggggtgtacgaagagggagtaggtcacaaagatcacatgcttcaaacagcaaaaaggagaacaaagatcacatgcttctgaggccagtaaagaccacaaggcaaagggcaaagcaaagatcacaaggccaagggcgaaatcaaaaactcctgataagggtctgtgttcagcagtgcacgtattgtcttgataaacatcttaaacaacagaaaacagggtttgagagcagagaaccggtctgacctcaaattcaccagggtggggttttttccccaccctaataaccctgagggtactgcaggagaccagggcatatttcagtccttatctcaaccacataagacagacacttccagagtggccatttatagacctcccccaaggaatgcattcctttcccagggtcttaaatattcattgctgggaaaagaatttagcgatatcttccctacttgcacatccatttatagactctctgcaacaagaaaaatatggctgtattctgcccaactccttaggcagtcacaccttatggttgtcttcccttgttccctaaaattgctgttattctgttctttttcaaggtgcactgatttcatattgttcaaacacacatgttttacaatcaatttatacagttagatacaattatcacagtggtcctgaggtgatgtacatcctcagcttaggaagataacaagattaagagattaaagtaagacaggcgtaagaagttataagagtacactgggcgtggtggcttatgcctgtaatcccagcaatttgggaggccgaggcgggcggatcacgaggtcaggagatcgaaaccatcctggctaacacggtgaaaccccgtctgtactaaaaataaaaaaaaaaaattagctgggtgtggtggcaggcacctgtagtcccagctacttgggaggctgaggcaggagaatggtgtgagcttgcagtgagctgagattgcaccactgtactccagcctgggtaacagagcaagactctgtctcaaaaaaaaaaagaaaagaaattgtaagagtattatttgggaactgataaatgtccatgaaatcttcacaatttatgttcagagattgcagtaaagacaggcatacgaaattataaaagtattaattttgggaactgtatgtgtccatattaaaatgaaatcttcacaatttatgttcctctgccgcgcctccagccggtccctccgttcagggtccctgacttcctgcaacacaggtttggtatcaggataatgctggtctcatagcatgagttgggacatgtcccattttcttctatattcaggaagagtctctgtagaatcaatgttgtttcttccttaaatgtttagtagaattcactaattaagccatctcagtctggaattttcttttttgaaagtcataaactatgaactcataaactttgatattggactattcaggttatttatttcttaacagtgttttattaagttatgtctctcaaagaatttcacttcatttaagttgtcaaatttatggacatgaagtttttcataacattcctttatgatcatctctaaattgctggaaagtctgtagtgatatcttctgtgtagtttctgacattggtagtttgtattctctctgtcttttttttttttgagatagggtctcactctgttgcctagtttgaagtgcaatagcacgatcactgctcactgcagccttgaactcctgagctcaagcaatcctcccaccttagcctcccaaagtgctgggattataggtatgagccaccatgccagccttagtgctttctttgagtttaatatatatatattttttttagtatcttaaggtggaaccttagatcatgaatttgagatcttttttctaaaataggcatttaaagctatcagtttcctctaaatactcctttagctgtatcccacaaatattaacttgtaattttattttcatttacttctattttctaatttcccttgtaattttctctactaactaagggttatttagaagtttgttgtttgattttttcaaaagtatttggggattttcccagatattgttctgaaattgcattctagtcgaattttgttattgatagagagcatcctttttaccagttcttttatgtcttaaagtttgttttatggcccaaaatatgatctagctaggtgaatgtcccacacgcactgaagcagaatgtacaacacaaaatattgagtgtttgctccagtgactacaatatatgtagtgtacttatggtatctatttaaaatagtcatgttaaatatgggacattttcaacagcataatttcattcattttgctgttgttgtaatataatattgtaaatatattaatatatgacttctttatatattttaaacctcacaattaggccagcacagtggctcatgcttgtaatcccagcactttgggaggccgaggctggcggatcacctgaggtcaggaattcaagaccagcctggccaacgtggtgaaaccctgtctctactaaaattacaaaagtacaaaaattagctgggcatggtggcaggtgtctgtaatccctgctactcaggaggctgaggcaggagaattgcttgaacccaggaggcggaggttgcagtgagccaagattgtaccactgcactccagcctgggcaatagagagagactgtctcaaaaaaacccaaaataaataaataaaataaataaaaaaaataaacttcacaattaaaaattttacaatttttgctttaaatatttatttgtctccaaagaaattaacagaagaaaagaagtgtgtataattgtgttgaggattcccaagaccactccaggtttggtgattgctaggtggcctcgctagattcagcttgtcgtcatactcacagctgagatttattacagtgaaggcatacaaagtaaaatcagcaaagggaaaaggatcatgggacaaagactagaggaaattaggcaaaaacttccaagagtcctctcctagtagagtcacttaggacctgcttaattccttcagcagtgagttgtgacagcgtgcacaaagtgtggtctaccagggaagattacctgattcttagagtccagggtttttattggaggctggtcacgtagacaaaatttcagccactgaaatttcagactccagaagcaagcaaatgttcaacataaaccatattgtttctgcaaatagtttagacacaatgagccatccttataacctagtgaagttttaaattacacttctagatgccagcaaaaggtcaaccttgcaagcaggacttcctacagagagcagcaatctctgacctgctgtgttgactcttctgcacaatagtctttcatatctattcacgtatttaccatttccaatagcttttatttcttcctacagaaacaggttacccttttgtgttatttccattcccacgaataacttcttttagcatttcctgtagtgtaggtctgctggtgatcagttttctcagatgtatgtgaaatgtctttatttcctcttcatttttgaagggtactttcattggatatagacttctgtgttgaatttctttattttagccctttcctgtttatttcattgtcttctgttctttattgttcttcacagaaagtcaatgccattcgtacttctcttcccttcctatgtataatgttgtattagttctcacactgctataaagatactacctgagactgggtaatttataaaggaaagtggtttacagttccacatggctggggaggcctcaggaaacttacaatcatggtggaagatgaaggagaagcaaggaccttctttacatggtggcaggagagagaagtacaagcaggggaaatgccagaggcttgcttataaaaccatcagatcttgtgagaactcactatcatgagaacagcatggggaaacacccccatgatccagtcacctccttcccttgacatgtgggattacaatttaagatgcaatttggctggggatgcagagccaaaccatataaaatgtgttgtttttctctcattgctttcaatattttatctttatttttagatgtcacaagtttgcctatgatgtacctggttgttgtttgtttgtttttggggacaaagtctcactctgttgcccaggctggagtgcagtggcacgatcttggctcactgaaacctccgcctcccgggttcaagtgattctcatgcctcagcttcctgaggagctgggattacaggcatgaaccaccacgcccagccttgtttgttttttatcctgcttgaggtttagtgaacttcttggatctgtaagttgatgtctttcaccaaatttgaaattttttagctgttatttctttcaaatatatattctgtctcatattttctcctgtccttataggactctaattacctatctgctagactgcttggtacccattctctgagtctctgttcttttttttttttttttttttttttagtctttttcatttctcttcttcggattggataatgtctagatctatcttcaagttcactgatgcttctgccatctccaatcttcttttaattctttctagtgaatttttttttttgagactgtcttgctctgtcacccaggctgtagggtgatggtgcagtcttggctcactgcaaccaccgtctcccgagttcaagcagttctcctgcctcagcctctggagtgctgggattacaggtgtgcaccaccacgcctggctaatttttgtatttttagtggagacagggtctcaccatgttggccaggctggtctggaactcctgacctcaagtgatccacccacctcagcctcccaaagtgctgggattacaggcatgagccaccgtgtccggccccaatgaatttttcattttaattgttatacttttaagctctagaatttccatttggctcttttttctttggttcttttcatagtgtctcttctgaggttcactatctgcttactcattatgtgtatgttttcttttaagttcctgaacacatttcagctgcattaaactagttgtttaaattcaggtcctcttagggtctgtttctattccctgctttttcccccattgtggatctcattttcccattttgttctcattgctgctgattttttattaaataatggacaccatagataatatattgtaaagtctggattctgttgtatttctctgaataatttttttttttttgtagctggcgtttaacttaactgtattcaaaattccaaactcttatctcctgttgttggcaacatttattctttgctgggttttatcgcatacatatgtaatttcgttgtcagccaaggaatttagtggtcagtcaaatatttgactgggtttcatatgcagattttggggtaccttctgtggcttcttctcttgcaagatttcctctctaacttctaattttctggtgatacaagttctgaacattttgctgtagctcctcaagccagtgaggctctgacttcctgccactccaagagacacagattaggtagtgctctcaagccaaagttagacttgcaaatctcagagatacaattcctgtattccaagagtagattcttccagattctgtctttctccctccccaaaatactgtcagacagtatattttgtccggactttgtaatgtgttatctgtggggaggttagtcatgtaatggattgctaaaatgtaccatatccatttgctgtgctcagacatttctgatttttttttttttttgagacggagtcttgctctgttgcccaggctggagtgcagtgacaaaatctcggctcactgcaagctccacctcctgggttctagcaattctcctgcctcaccctcccaagtagctgggactacaggcgcctgccaccatgcccggctaatttttttgtatttttagtagagatggggtttcaccatgttagccaggatggtctcagtctcctgaccttgtgatctgcctgcctcggcctcccaaagtcccaaagtgctgggattacaggcgtgagccaccgtgtctggcctctgatggttttttaagggccataaaataatctgttacctggagataggttggaatggaatgagtaaaatactggaagtagggtgtcaggccatcatagcagagcaggcaatacgtattgtgaaaatctgtgactgttactatgttatattaatagatcaaacgtagttttctacaaaatatagaattctgttttcttgtatacatctgcagaaatagtataaaaataaaaatgtggttgtccattgctggaattatatgagtgagatagtatacagcttacttttagttaagctaacacaattttttcttttgtacatcaagagtttcctaaagtgttgatactgctgagacctttcttgacttcttttattcatccctgaaaaaatcatgtaaatagtaaatgagaactggagaaaaaattcaaaatggaaacctctttcataaataaatttttgtcctcttttaaagtaattgaagatacttttggtctcttcctgtcattttctcaagactcaaaattggctaaactagaaattatgtaagatcactacaaataagtgacagagaaccctaaaagctttttggcagctactgtatccataatgatttagtcatgtgacttgaatttatggttcttgccttccaaatggcagcccttgcttgggagagctttgaggttcaagaatgctgacacagtggaatatgggtcacagaactttttctctgggtattacacttgaaatttagttcattaattttaagtttggattgcagtgggttaatctgtatgtcttaaacagttttcaaatccgttccttttttcaggtcataaataaagttcatcttaaggcaaatcatgtggtcaagagagatgttgatgagcatttaagaatcaagactgtctatgataaaagtgttgaagagtaagtacaccattgtattgtcatctttttcattattaatctaaatgttaaagatatttttgtctgttacctgaagttctaagaatccatagataaaacttaaggactagtgtagcttcaaaatggaattaagctgaaaatgcattttagtctgaaaatatgaaagccatgggatatgattaaagtctttatgaataattttcttttaccatcttcctttcctggtcaatcatgaataatttaaacagaacaaatgtggatctacttggatgtggacagtaacagacctggaaggtactcttcaataagtactagtgttaccagaaagaggtctggcccagattccaggagagggttcttggatctctcatgagaaagaattagaagcaaatccatagagtaaagtgaaagcaaggttattagaaaagtaaaggaataaaagaatggctgctccataggcagagcaggcccaaggcctgctggttgcccatttttatggttatttcttgattacatgtgctatgcctctgagagataatccttatgtttttatgtcattattttcaggttgctccctgagaaaaagaatcttgtaaaggtatgtaataaatactcataacttgaattggacacttaaaattttattgcatggaaattctacttcagtaaagaaaaatatatacatgacttttgtgactgaatgaaaggtgttggtagtgaaagtgctgatcatttcacaaaaggtgtctttgtgatgctctcatgaaaactttgttggtattgggcattaaattagtctttttttgtaatttgataatcagttttctcatttttctgcttgctttctcaagtttttggggagcaaatcatgcagagaatagggtgaaaaacaatttttgaaacacattgacaacactgttctcttggtggaaatgtttattttcctgaggattgatttacctgataaccacatcagatttttaactgtgtggagacacacacacatgcacgcatgcacacacacgcgcacgtgcacgcacacacatgcgcacatgcacgcacacatgcacacacacaaagccagttcactatgggcgacagaaattgatgactttaattaaaggtaagattttcttaacataaactatcttagtgttggaatcatctaagttagtccatcattcatagtaatctagattaatagttgagatatatcacagttttgttaaaggtgtagtatcgaaggaaattaatatttaattaaaaataaaaaatagttgagatatatgttttctggctttctatttaaatggggctagggaaggaaatttctgcctaatgctgttttcccaagctgaactagaaaatgggggaaattcttttcctcctagacttactctcttcctaccccttgccatacaaccttgactaactaatatctgtattccagaattataaagctttttttcattactatcctgtgtttgcttcttttaaatataatttatctcttccttataattctgtttctttttttttttaacttttatttagaacaagcttttcccacaagcgatttcttatttagagaagacttttcaggtccgtcgacctgcgggcactatcttacttagcaggtatgtcacatgaaacacagatcattttcttcagccgtttagtactctgcctttctcgttctatgaacatggcaaggtatgaaacttatactagaattttattatgcttgttcttagggacctaactgcaaggtatttaaaaagaataaaaaagcacctgctggataatcattctttccctgacctttcattgtgagatggtctactgaattttttctgggtgtagttgtcccctgttctccagatcacctttttccctctttcatgtggatacagtgttggctttatgaagtatttgggtgtttaaaaacccaaatcaagaggatttcctatagaacccaaattctttcttagctactttcctgactaaaatagtaacattattaatgaagtaatatagcagctaccagttggtttccatgtttttaactgctataaaatattctcttttttgtatttaaactttgatgtacaaatggactgaagacaatgtgcaacaaaccaatacctccggaaggaaaacgatcctcacaggtactgcaccggggagtgtgccgcacacacaaagtgcggccccgttattgttcctgaggaacatctccaggtatttcaccctgctcttggcagtgcttttacacctgaggagattttgaatttgtgagtgtcacagaatttttacagattcaagttcaaaggcttagtagcttccttggtctacaaaaagtaaccacagatatgctgattttattctttcattagctttcaagtgagtttaatggtattttctttcttcactcctccccacaggcctccttgcccctgtttatcttggtctgctgaatcactttagcttagaacattatcttgtcttccaaaatatcttttagcaaggcatatatctcagtttgttaaaggacagtctgacatctcttaagataaaaaatatgtatgcctcaacccaacctagaaatttattccacaaaatactaatggctacgtaatatatgtttaaaggtgttctttgcaaaactataaatatgcctatttagggtatatttatgttaagttatggtataaccacgtagtagaatactgtgcagttgttaaaaagtgaaggagatctctatgtactgacttggaaagatgtttaacctcttacatgaaaaaa

SEQ ID NO: 85 - DNA, 7820 bp, Homo sapiens
atgactcaaaagacaagatttgtatgactgtgaatcagcattataaaaacagcccttgcctcaaaaacctatactgagcaacacaaaacactgctttggggactggaagagatgataaaatgaggtgggaaacaaagggagtaagtgccttaagaaattttaagaatcatcctcaagaagactttacaaccaacctagaaaaatacaaaggtgcgaaccaacaatagaggtcgaagtgcagtgcaattagctgtccatcaggcagacagtaactactgtaactgttcatataaagatctggtttactataaagttttattaactttaatgttatgaaatgtctgtataaaatatgtagatgcgaatatcaaggcagggaacaacaaacttcagaaacatggttatttcaagagaaggatgcttggcaaaaagatatgaacaatttcacaaaactccaaatagtccctttaaaacacattttaatttgaaatttcttctgagaaatccttttttatcttaaggattaacagtaggcactgcacagtatctcactgcatcactgacaaggtattaacttcctgtttagtcgtaattataggtgaaacaagcatgcgtgttcattacacaaggtactaagaatggattgaatattactaattttctttcgatcaccactgaaggtaaagtcacttaacattattcaaagccattcttttgtaagcattatttaaaaatgggcaaagaaacccaaatttagatttgaagctctgctccatgaaagcaagaagggtgttttatggacattaaaacaaacaaaacaaacaaacaaacaaaaaaaacaaagattaacagccaaacagctgcccagtagtagaaaacattcgattacacattagccatgaaattacagcaaggttaggattaatgtaagtatttcatactgaaaaaggtacaagaaatcatgattcacaattgacaaacatttaaatacgacaaattcagctatgaaaagttgaaggtctcttttacaatagattatgttgaaagtatcattaggagataaaaatcagatgtttcaacaaagtataaaaatacttccctaaacttttcccttccctacataacaaggttgaggatacaattctgaataaatcttatctaataagagaaactgggcagtaagatatttggtgaatgcattcatttttaattatgaaataacactgctatggtagcaagctcaagaccacaacatttccaagaatggagagttttatttcattaatttcaaaatactggttttggcaaggggaattaagtcattataataaaagacaaaccacattgtaataatactagtacaaaaaatacagtatagaaaatttattttaaatacctcccctactagatctaatattcttgaaaggtaaattacaaagtgacaaacaactattcatgtgtttacatgcttattttcaccactgaacgcagagattaccatagataaggaccatcttcctcatttattccctgggactagaatactacgtctaatgcagattaggacctttactcccctgtatctgtggttcttaatcagagaggagcttcagaatcacctagaaaattttcaaaattatgtgtttccagggaaaatgatttagtaagtctaagacccccatgcagctgtatttttttttaaattctaaacaatctgacatttaaaaataagtaaacaagtataactggattgtaacacaaaggataaatgctcgaggtatataccccatttaccctgatgtgattatgcattgcatacctgtatcaaaatatttcatgcaacccataaatatatacaccaactatgtacccacaaaatttttttaaaaactccaaatgttctggaatataaatgtaattcatgtcacacccaacaatatataatattcagtaagctcttctatacgctaacagatacaagaaaactgctatttaaaaaaagaatgcaaaaaccaacctaggtttgagattttaatctgaaacatttttttatctcagtgttacgaacctagtttcttttttaatagatagattatagcaacatgctgtggagaatcctcaaagattgcctgtcttggataaaaagggtcacctaaactcaggggcaaagtttgacagagcaatctagtgacacagtagttcatcccagtgatggagcattcaactttttatttgtataaataacaaaaactagaatcaacactgcagatgagcatgatgaaagaaaagtatgcagtgtcagtaatgcatcctttttcaaattaaacaaatactgaggtcctattattatcagcatccttcagtcacaactatcctacacagaaagtgagctggctatcaacaagctttgaggaccatatatgaaacacatgcaagacagtttacccagcctatatactagttggggacaataaatatattttgttcactctaagacatcctaagcagttaactggcacatgttagttttcagtgcttgaagagactaccccaaaagaattaaatccacttctactttcaaaatattattagccaaaatcttaactcacaaattagctataacctaagagtaaagctaactcccaattacttagatgtataagtgggagagcaaagcagcttatttcaggtaacaaactaaaatcacatacattataaaacaggaattgaagggccaggccacgtggtggctcacgcctgtaatcccagcactttgggaggctgaggcgggtggatcacgaggtcaggagatcaagaccatcctggttaacacggtgaaaccctgcctctactaaaaaaacaaaaaaattagcctctactaaaaaaacaaaaaaattagccgggggtggtggtgggcgcctgtagtcccagctactcaggaggctgaggcaggagaatggcgtgaacccagaaggcagagcttgcagtgagctgagatcgcgccactgcactccagcctgggcaacacagtgagactccgtctccaacaacaacaaaaaaaggaattgaaatggttcaaaaaagagcttgagcttttggtgcctatctgatttgaatcccagtcacttactagttgtgtgactagacgactatttctctgagcctgttacttcatctataaaattctcacatctatcccacatggttgtcttgaggattaaatgagttagggtttagatgagactgcattgtcttaactactgtaatagataatactatatgcaaaagtaaaccgttctgaatgacaaaaaaaaactaaaggatgatatcaaactgtagttgttaagagcacatactctggaccaggctgcctaggttctaatcccaactgtcacaacatgaacctgggtcatcttcttaacctctatgcctaagtttttcaatttcgagatggagataatcttgaaattatctcagtggaagtggtggtaggagggaaacgaagatcaaatgagagttttttaaccctttacccatggtttccctgctagccgcttgcttataatcatatataaacactaaagtcatacttccagaaataaaaacccttacgaaaacttaacagggtgtatacaatgaaaacatgagctattcttttaggcttggttcacatatttatcttcaaacgtccctaaaacacatatattgtagtccctgtttaatgggagtggtaaaattgtctacagctctcaataccaatcaacttggagtgccacttttaactcctgttgtttaatagccctatttaagaccatattacagctcgttcaaataaagaatacaggaaaaaagttgattggtctaacagtcaaaaaacttactccaagaacacagctgaagcaaagtatacattcaaaagctcgatcaaatggactaaaggttaaaactattccaataatcatttcagtaaaatattaacgaggaatacagatatatcataatacttgaaatgtgggaccttcagacaagaataaattcgaaataggtacgtaacacaagcataccatactgacatcaatggctacttgaccccatatttctagaagaggtgcctaaaccgaagagcattccagttcagagctgtccactcactaaaattgttggatgtggaatgtttgaaagttgcctcatgtgattctaacattaacagctgaaaaaccaaaccacatgcacacgtcaaagtttctgtaagttgaatcaataatgttcacataaacactggtttttccaatatgccaagtttttatgttgtgtctatattacataaatcttcaaaatatttacaaaaggagacaacctggttaactaagagtactaaactagaaatcaaagttcttaaacaaaaacggtttttaaaaattataaattgtgatattaaaatagcagtaataactaggagtgtcatgtgccaagagcctgttcaaatttgcacattaatccatttaatcgtcaaaacaaatctaggaacttaaaatttgttttgttcactgctgccaccccaatgtctaaaacagtgcctggtacatattaggcacacagtcatttattgttcatattacaacagatacccttcttatagaggcacataaacttgcccagagctagaattctaactggagcatttctgctccaatgtttacactcttagccactgttatattgtctctctaaagcttttaaatcatttaagtggtgtcacagcagctgggtatgacctgtaagagaaaaaaaatcagaggccttcctttaacgtgttctgttccacatgcacaaaaagctatggatctggtactattccacattttagtggcctgaactaattccaacagaaaagatttttatttgtactgaatgttatgctctttgtgtaaaccacactgtaacatacaactaggcttctccaatatgttcctggcctttaaagtggtcacaaaaagaggtaattatttcaaaataatttttactttaatccttaactcctaaaaagcgtttcttcctcttttctttcatttcacaaagatttaaatttgtatttcgcataacccaaaatgacgatgttatgaaggcccaaaacaaaattcacgatttcatatcaatacatactaagagtgaagatttaaaccttcctctttcatgaaacaccaatcttgccaaataaactccagtcataattaaatacaggcaaatgtagtatcaggtctattttagtaaaggcaaattcttgccattcctctcagaactctttttaaaaaagtaatctattaaaaccaaagtttctaacactcaccgacactccacaatttttctagtaaggctgaatttattccatgacatttttttcaagttagctgtaaacactccaccctcttcgattgtgcaacaaccaaacacatcacacaaatacaagtcacaaaaaagggaaatacagtttaagagtttgaatttaggtaagttttgagcagaggatcttagagcagtgcacaacgcgatataaaagttaacatttaacaaatcatattaattcacattattacgaaaggagatgccggaaagagcctgaaccagttaaagcagccgccatcttaaaatgcgggatagaagttagagcaagaaaatgagactaaaccaccggaggtggaggttccgctcactcccagagctccgaaaaatcctagttttttttcaacttaaatcgataatatactatcaaaccacatttcaagtaacgaaacaagggtgttattaaatagaatgaggcaaaaataggtacattagctttcccttactgccatcgcaccccttatccacccccactctccagccaaaaggaaaagggagcttccagaatgccttttacatcagttcccggtgtccctcggataaatagcttcgggtgaaaagctgcaactacaaaatacaggaagtggcaacactgtgtcattccatctcctcccaaacccacttattcggtgtaacctgcccagagtcgactaagagtttctactagactcactgactgaccttcaatacgcaagacttcttctacccgaccctcagtcaagttcgggactcgccagattttttttctctcctccgagttttctttcttacccctagaaggcctagataaccttgatctcacaactaaactaagttttcaagcaccaagaataggaagcgccatgacatctgctggagcgtctctccgcaattcggacccccaaaaaaactccttcttaagcagcaaaaaaataaaataataaaggcgccttaagtcactctcctccacccctaatttgcaccgattccactgaagcactcaggataacacctcacttgccacaagtgttctccgtttcctagctttaaacttcatttcttcaagaagtatatctgcgttctccatccccccatggaagaagtgatccaagaggtattttcagaattatgcttccttcccacccccacgctttcctcttggcccgagccttccttttctcctaccaccccatgcccttgtccccgcgggttaccttattaatccgtttcagcgccatagtgtgtgcttgtcgtctggctcctcactctctcggtgtatgctcaaaggtccggccaaaactcttgattatcccggcggcggggcaggattgtctcgtctcacaccagctctgccagacacaggcgccttttgcaaaaacggagcagatcagcactcgcacaggccccgaagagcccctgatgaatccaggtcccttaagacagccgcgatccggggtgggtggggtggcgtggcaaagccaccaacagcctctgtaccgtgctttcggcccgaagtgggggcgagggtgacgggaagagcggaggtggtggctacaagtttaacttcccggcctctagaaaggaagagacccgggtgggagaggaagaggcgtaggagaaaggggtgggtgcggggcagggtccggagcccagcagaggaggagccggggcctagtcggcgctataccggcgtcactagggcaaagaaaggcaaggggggagggggaagcataagactccggacggacgccgggctgctttcggtttctgtccaaaggtgcggccgggaaaaggaaagaaataaaggaagggagacttgatgtgtattgctatcctcgcagcgagctattctgtgtcacccctgacgccaccgtacactcactccgccttccagcgcgctcccgcgcgcgcccgcccagccacctccaccacgcgcccgcgctgtccctgaggctccggcttaggcgcgaggacgcgcccattccccctcctcctccagcaggagaggccgcggcttccccaaccttcccaccctaacccaccgcacccaataggctggccgctcaagccgcccaggtcccgcactgcccctcttacccggccggccactgggccggcctcccttccctgccctagccgtccacacccacgcgtacagaggggccggggcctccctcaagctgcggcctcggcctcctccccgcgcggcagctggtgcctccccggccctacggggctcacgcgcacgacacagccacaagatgtccgctctgacggaactactgccagctgccacgctccgcccctccccctcctcctgcctcttcaccgccgcggatcagtccgccaacgccgccgtcccgagcacaggaccgatgtgaggccgaagccagacggcttgcttcccacgtccggggccgagtgaatacgtgtcaagccct

SEQ ID NO: 86 - DNA, 2030 bp, Homo sapiens
tggcctaaagtatcacctatcctagtgtcatctattaattttaaagatgaagccatagcctctcagtgaaaatgacaaagctgtgatttaagagcaagaataggacttggagatcattctgacccagtgatcattcactttatagaaaagggaatagcctgagctcaaactcagatatccacttccctgtccacgtcacccctgtactctgtggctgagttctgggccctaaagtgagtctgactggcaaggggtccactttggccaacacaggagcctggtactccttaaaccaaaacatgtagaaagtctttttcctgacaactctggtggctacctgggactccttgcctctctgtccttcataatttttcttcctcctattcctaagaattaagaattcttatatctagtattaaaattcagctctgcttaacagctcttggctaacagatctttgcagaggaaggagggtcccctactgcaattcagggtgacactctctcaagtcgtgacactctctctagtcatgacactctagaggaaagagaaggactagacactctgtgggccaggatccataacatgatgttccagaatcacttgcttttgatgggctctgtattaatggctggaagaaaacatgactaaatcttaacagtggttacttctgctatgataattattatttctctccttttttaaaaaaataatttttgcactttccaacttttcttgaagtgaagaaataattattattccatatatatgtgcatatgtagtgtgtgtatatgtgtgtgtgtgtatcaataaaagtaaaagatgggacttttaagaataccaatgcataggattatccctactaagagaggcagaaagaatagatgatctcagcttcctgaagcaaatattttaaagtgtttagatatttaatatcactgtttaatgacaataacaacaaagaaaaagattagttttgtggtcttaacacataaggtttaaaaattcacctgcagatacagtttttcctggaatccattacaaagatatgtatataaaaatattagtagctacatgtgttaattctcacaataagtgaaattcatatcctttactcagttttgcagatgtcaaaacagaaacccagagaggtgaaattaacttggctaaggacacattcctaagagtgatgacgttcaaatttattccctggtggatttggacgaagttggcacttaaaccactatactcccctaagtgatgcaggaaagaatagctacaaccagttttaaaaatacttagcacgtatagcaactagagcttctgttgaggaaaagttaataataatattattatatcattactctgtgaagctgggagtgggatgaagacagaactgggaaaattttatccaggtattttgctttctggtagcaaaactcggtgcagaggtggaatctgaagaatcaaataatcctaatatcaaccctaaaataaccctaaccctaacccacaaagtgctatctcagtctctctagctgttaaaattccctgatagacacaggatctcattctacttaccccttttttaatgactaaatgctgaggaggcttcagggaacgtcgcgtgacttgccctttttttttcctgttgcccctgagcccggtgccctcagcagccctccgctgcagcaaatctccctgaagccctcagatgcccatgatgatttgtggaggcaacaggccctcatcacagctggctttaagctggcgcaaagaaccacagcggtggcttcaagcctcggctgccctgtagccccaaacctccctaaagggtgagggcctgaaaccgcatgagagttttctaggaaacaggcagctccccgctgcaggaggtcttgtgaaagacatttgcatgacctgaccactcaggcccccgagttcggtaattcctaatctaaccctgtaggtagctttggaacttgacaaatgcagccaaacgattgatttcgaatgactgaaccctcatt

SEQ ID NO: 87 - DNA, 22806 bp, Homo sapiens
tactggaccgactgggaaacaaagtccattaaccgagcccacaagaccacgggcaccaacaaaacgctcctcatcagcacgctgcaccggcccatggacctgcatgtcttccatgccctgcgccagccagacggtgagcaggcaaggggtgggagcaggcgaacggtgagccaggcaccggggtccctgggagttcctgctcatcccttctctagcattgaccaagccctcctggccagacactgggagactccaggagggtctagacaggggatggtctggctcccgggagcttcagcccggcctggatccagccctggagtctggcagcagcaagtccctgaggccagtcaagtgggggtctgggtgcccagcccccagaaggaaggcaggccggcccctgggagggaagcacagaggaggtggggagctggccttcaggcctggcctgatcctgggaccttagaatcctctcctatctccagcttcagctccctcctaaaagaggcagggttcagacccacccgcctctgtccaggatagagtgagtgaggcagcctttggtaggccagaaaatgtcaccatatttcacgacgttttctctggcagtgcccaatcacccctgcaaggtcaacaatggtggctgcagcaacctgtgcctgctgtcccccgggggagggcacaaatgtgcctgccccaccaacttctacctgggcagcgatgggcgcacctgtgtgtccaactgcacggctagccaggtgaggctgtcccccagaccccatcaccagtgcccgctccccaacccccaaatcctccttggaccccaacacctgctctgtcctaatgtcctcatgcatctggttttcccacactaacacccccacatttcttgcctacctcttgtctccccacagcaatacttttacccccgtcacctcacacagacacctccacaccctaaccttgaccctccttgccatgcttcagtgctgccttccccaccctatcccacgcagccccatacctggcctttccgaactcaccatagcccaacctgccccataacaccctgacccctgcctcaacttctttgaaacatccaagcccctcaaaagaaagacttctgagtcccccagacccccaccaacccctcttgcccccacctgccctccagtttgtatgcaagaacgacaagtgcatccccttctggtggaagtgtgacaccgaggacgactgcggggaccactcagacgagcccccggactgccgtgagtgcctgctgggggtgacaggagggcccccagctgtgtcggaggcctgactcctgaggctttgaatggccactggagaggctggggctgtggtgccctgcaagtggacctggccgtgtccaccccagccgctctgactctgagcctccctctctggcagctgagttcaagtgccggcccggacagttccagtgctccacaggtatctgcacaaaccctgccttcatctgcgatggcgacaatgactgccaggacaacagtgacgaggccaactgtggtaaggcgctgcccgcccaccctccctccttccccagcatcttccctgccccaggatttggggctttcaagtgcagggaagttgcagcccacggcagcttgctctccaggctggattcctatggctcaagcctgtgtcctccctgctgagggatgggcaccctctccctgcccctgagtcctcccttcgccacgaatcacctcctcctccctccacagacatccacgtctgcttgcccagtcagttcaaatgcaccaacaccaaccgctgtattcccggcatcttccgctgcaatgggcaggacaactgcggagatggggaggatgagagggactgccgtgagtgtcagaggtggtggtgggccggtggtgggagatgacacggaagcagggcaggcagaatctccccacagctttgagaggctctcaaataactttagtagatgggcaacacaaattatattgggtgtaacttgctttgctcataaaaatcatcatgcatgatatagagacatagagatccagaaaacaaaaagcaccaaaactggggataaactgttccttcctccgaagaagttgctggcaggaccaaggccagggcttggaagagagagaagacagtgatggtgaactggagtggcaggtgtaagggagggccctcattctcttgcccaccccacagccgaggtgacctgcgcccccaaccagttccagtgctccattaccaaacggtgcatcccccgggtctgggtctgcgaccgggacaatgactgtgtggatggcagtgatgagcccgccaactgcagtgagttgcctggcctggagcccagcttccctccccagtgtctgctgctcacaccaccccgacgtgtgaccccctcagtggctgctccctcactctccccaccctcccggcacactcctggaaggagtctcatcctcaccccatgcccacccgcttgcagcccagatgacctgtggtgtggacgagttccgctgcaaggattcgggccgctgcatcccagcgcgttggaagtgtgacggagaggatgactgtggggatggctcggatgagcccaaggaagagtgtggtgagccgagaccccactccaggaggaagacagtctacctgggtgggaggcatggcacccctggcaggtggagggctgggggccgcctgcttaccggtctcagcgtggccctgctgctgggcttcctgggcctgctgtggggctggggaaggaggcctggctggagctcacttccccacatccacccgtgccccatgtctcccagtttccctatccctgcccctgcccacgcctcatccacacatacctgtgtggagttttccctgcccaccctatgggatctgttcatctccttcccaaggcagctgcccacacacacacccccaaccatgtctcctgtccccaaacctccttatagaccccacgtctcaaaacaccgcctgggctccccgcggctgacccttcccaagctgggatgcccaccctccctgccaggccagcctgaccatgcctgcttggaccctaatgtctgccccagccctttccctgactgccctgacacttgcctcctccagatgaacgcacctgtgagccataccagttccgctgcaagaacaaccgctgcgtgcccggccgctggcagtgcgactacgacaacgattgcggtgacaactccgatgaagagagctgcagtacgtccccacccacccagccccgcatgagcccctcccaggcctggcccttgtctcgcggccctcctgccacaggccgcgccagagctggtggccacctcccagggtgggggcaggagccgccctcctcacccatcccactccatgtcgtgtatttgagtttgtgccatttcacctcatctcatgtttctctccattttcacactgtcctctcggggttgcagaggtaggtgtctctgatgtgcccgtgctcccaccatacccccacctctgtcccagagccccccatccctgtgctgtgcctctacccatcatccttgattgacctctccccaaaccctggtgcttgtctcagtggtcttgcccccgctcccctccccaaacacagtctgttctgagggcaaggccagggacctgtgtcctctctggtgtctgtcccatggggtaagtgcgagcccgcctgtgcccagctgttccataggagcagccagtgggctctgccaggactggctcggcctctgggtcagtcagctgtggccttcagagacacggggatgggccttgggctcgggactgtggcactactgaggcctggagtccttgtgcccaccctcctgggcctgtctccccctgtccttcccagcccctcggccctgctccgagagtgagttctcctgtgccaacggccgctgcatcgcggggcgctggaaatgcgatggagaccacgactgcgcggacggctcggacgaggtgggcagggagatgagaaggaagcagatggcctcagaggagttcaggcagggcttggggagtgccgagaggtgaccggctgcctgtgcccatgcccacagaaagactgcaccccccgctgtgacatggaccagttccagtgcaagagcggccactgcatccccctgcgctggcgctgtgacgcagacgccgactgcatggacggcagcgacgaggaggcctgcggcactggcggtgcgccccttggcttggtctccctgggtcctccctctgctgcccaccccgccacatggcccagtcattcactcattctttctcttctgtattcattcttcatgcaacaaatatttattaagcatttaccatgtaccaggcactgccataggtgttagggacgtagtagtaaacaagacacagggcccctgaatacacatttttgtgcgggttgtgcccagctcaatgccccctagtctaggggaccagttgagctgaaatccagcaaaccctgagggctgtgcccatctaggccccaccccacaagtccctccgagacagtctgctgccacaagaagaaaagccctgcctattttcccttcctgggggcagtgagacagtgcctgtccctcgctgacctgcctgggctctgcagtacagagggggcaggtgaagcccgggatgagaaaagactgggccttggagcggaaatcccaactgtgcgggcagatgtcttggctctgccttggtaggccaggcacagggatgggaacccggtcttccattcccagcccagtgctgttcccgcgtccccgctgtggaactacacagcccagtgctgttcccacgtccccgctgtggaactacacagcacagtgccctgccacataccagagaaggagtgccctctgaactcctccagacacccctgaaaaatggcctcttctcccctaaataccagagggggcagtttggccccaccaagtagaaatttaagagacctggttccaatttggctgtgccactgcttgcctggtgacccctctgagcctggaacccccacctgtggagacaggggtctgggtgggctcatggctcattctatctcttggctccccctggcaccagtgcggacctgccccctggacgagttccagtgcaacaacaccttgtgcaagccgctggcctggaagtgcgatggcgaggatgactgtggggacaactcagatgagaaccccgaggagtgtggtgagatttggggcggggctcccaggcttcccagtggccagcaaccacccccactcccaagactaattctggctctgtgtccccctggctgctgcagcccggttcgtgtgccctcccaaccggcccttccgttgcaagaatgaccgcgtctgtctgtggatcgggcgccaatgcgatggcacggacaactgtggggatgggactgatgaagaggactgtggtgagcagggggccgacgagaggcctgcaggggacgggtagtgcacagtggggtgagtctggtcctcgtgggagctgcactggggttagggttaaccaggaggactcgcccaggaaggggaggatccattgctaggagcctgggggcttttcgttaggaaagagaagcccctggggaaggctctgggggctgcctgatgccttaggtcttggaggtggggctgggaacccaaatgtttgacctgctccccctgcaagccttgtcacttaggaattgggagccactgttatctatggggttgccgtgggaggaggaggcaggggagaatacccagggcctaaagcctctgccctcctcagagccccccacagcccacaccacccactgcaaagacaagaaggagtttctgtgccggaaccagcgctgcctctcctcctccctgcgctgcaacatgttcgatgactgcggggacggctctgacgaggaggactgcagcatcggtgaggcccggcagcggaccggacgctggtggggagtggggagagccaagccctggcctggggtggctcaagggagggcatccactctctgtcccccacagaccccaagctgaccagctgcgccaccaatgccagcatctgtggggacgaggcacgctgcgtgcgcaccgagaaagcggcctactgtgcctgccgctcgggcttccacaccgtgcccggccagcccggatgccaaggtaggaaagcggggcagagcaggggtggacaccccaactgtggactctcatgaccctccctgtaacccttagacatcaacgagtgcctgcgcttcggcacctgctcccagctctgcaacaacaccaagggcggccacctctgcagctgcgctcggaacttcatgaagacgcacaacacctgcaaggccgaaggtgccggagccaccagagggcagaaaggctgggtggggcagggcgaccaggatatcaaacggggccgacttggaatggaatgtcttcctgcggacatcttgcccagacaagaagccccagactcatagttgcagctgcctgagcacagtgctggcccagcagtgggggcaggtcctggggctggctgactgaaggagtctggggtgtggcagtgctctgaattgcacacacacctcctcacccaccactgccaggacgagagtacactcagacacgcattgcacactcacagtcatgggggcctcacctgcacattccccacatgctttgatgcccaccttgccttccacatgcctgtacacagacattcacacacacccctggcacacacacccccaccatgcactcccatgcacaccctcgtgctccatgccaagcacacacaccccatgtgcctatgcacccccgagcatgtgccaggcagtttgtagcagagagcgtggtgatgccatccagcagccgtgaggaggtggaagtctctgggtctggaggggcagggacagctttctgactgaaaggagcgggtcacagtggatcagctcaggggaggagaggaggaggtccagaggctgaggttggagcctgcaaccctgagcagggagggtaagcagcagcttctggccggagcagatggtcctaccaggagatgggacagtgttcatgtgaaaggagctgagctgggtggggtgcacacctgcatcccacagccccagccctggcctcttgcttctccaggctctgagtaccaggtcctgtacatcgctgatgacaatgagatccgcagcctgttccccggccacccccattcggcttacgagcaggcattccagggtgacgagagtgtccgcattgatgctatggatgtccatgtcaaggctggccgtgtctattggaccaactggcacacgggcaccatctcctaccgcagcctgccacctgctgcgcctcctaccacttccaaccgccaccggcgacagattgaccggggtgtcacccacctcaacgtgagtgcccaacctggcgtggatggagtggaagagctccatagagcaggcggttcagagcaggatttgaaaagggcagtgctggctaggcgcagtggctcacgcctataatcccagcactttgggaggccaaggcgggcagatcacctgagatcaggagtttgagaccagcgtggcaacatggtgaaaccctgtctctactaaaaatacaaaaatttggctgagcgcggtggctcatgcctgtaatcccagcactttgggaggcagaggtgggtggatcacgaggtcaggagatccagaccaacctggctaacacagtgaaaccccgtctctattaaaaaatacaaaaaaattagccgggcatggtggcgggcgcctgtagtcccagctacttgggaagctggggcaggagaatggcatgaacccgggaggcggagcttgcagtgagccgagatcgcgccactgcactccagcctgggcgagagagtgagactcggtctctaaataaataaataaataaataaataaataaataaataaatagagactcggtctctaaataaataaataaataaataaataaaataaaataaaataaaaatacaaagattagccaggcgtggtggcgggcgcctgtaatcccagctactcaggaggctgaagcaggagaatcctttgaacccagaaggtggaagttgcagtgagccgagtgccactcggttgcagtggcaccaaggttgcagaatagcactgcactccagcctggatgatagagcgagactccgtctcaaaaaaaaaaaaaagaaaaagaaaacaaaagggcagtgcgaggggcaaaggttgagagtggggcagggggcagtcttaggattgtgttctgaggcatggccagcgggaagacagagcagtgggaatggtcagcagctggctgtgctgcaggcagcccagggcacagggcatgatgggcaggcagacagccctccggcaccaatcccccatccttgccacttcccactgtgtacgtcttagctacctcatttaacctctttgggtttcactttgtttatcaataaaattaggtgatcatcgccattgcacaggcttcagggagggctcaccagccacgtgtgagagctgcgagtctggcgcataagctccatgccggttgaatctctttaaagccagggtcctggctgtgagcctggggtgacgttccagcaggctggcagagtggtggcggggggataatggcaggaagacaaagcagtggcccctgaacctgtggcttccattcagatttcagggctgaagatgcccagaggcatcgccatcgactgggtggccggaaacgtgtactggaccgactcgggccgagatgtgattgaggtggcgcagatgaagggcgagaaccgcaagacgctcatctcgggcatgattgacgagccccacgccattgtggtggacccactgagggggtgggcaagggccctggggggaggcctctgggctggtggtaggaagcccccgggacagggttgggggctgcacccacatgcgtgcccttccctcccaggccagcctgaggacagagtccttttcagtcccttgggtcttctcggccacccctgcctggccctccccatgctgcctctgcccagggcccccagctgggcctgcttgggcagggatctgacctctgcttggccggctgtcatgcacagccacactctgccctggggaacagctctgccagcgtcggtggctctgaatgagcacactgtggttttagaggaaaagcccctcaacctgctcagaagcagactcccgcctgcttctctgtagaaggacagaatgccctcctcccagtccccagcagtccctgtccccagaccaagaagctggtgtcctgcctgggcctgcctcctctggccctccggcctgcccacactcaccccttctccctccccaggaccatgtactggtcagactggggcaaccaccccaagattgagacggcagcgatggatgggacgcttcgggagacactggtgcaggacaacattcagtggcccacaggtttgtggggcagggtgcaggagggacgggcatggagggggcccggctcgcagagcccagctgctgctgaagtcacacaaaagcaagggatgggatggggcttggactggggcagggcagattggccgtggaggcttttcccgaaagaggtgactgtgagtggcgtatgaacagggtggagctgtcccgggcatggaggcagttctttccaccccgagcctgggttggggaggccaagctctcacagtgctctctctctccccaggcctggccgtggattatcacaatgagcggctgtactgggcagacgccaagctttcagtcatcggcagcatccggctcaatggcacggaccccattgtggctgctgacagcaaacgaggtcagagcccggcataagtcgcagtccccagccctgtccccagccttgccatcctccctactgagccaaaggcctcacttcaatgcctcccatcctttgtcactgacccccagcaatgctgcagcgccttccaggcctctccagctggcctccccctgaaccagccctgcaggcctgagacccaccctgaccctctggcctacttgtccattcattggttgggttgcacggaggcagcataggtacattaggaacgtagcaaattgggggagaaggaatagaagtcagtcatgactgaccccagaagtctgggggtgatgggaccttttgccagtagtggccacaggaggaggaaccggtgtggggagagagaatttggtctggatgtgttgagtttgaggtgtctgggaaccacaggtgccagtgtcgtggacagcatggccagggcctgagtgcccctcaggtcccctctgactccacctcctcccccaggcctaagtcaccccttcagcatcgacgtctttgaggattacatctatggtgtcacctacatcaataatcgtgtcttcaagatccataagtttggccacagccccttggtcaacctgacagggggcctgagccacgcctctgacgtggtcctttaccatcagcacaagcagcccgaaggtgggggcagaggggagcctgggctggggaagggaggcctgtgggcattgagtctccaagctgtggccctgggacctggtggagagggggtcaccctgggctcacagggctcagagaagggtcctgctcagcatcctccccaccccacccatacctgcagtgaccaacccatgtgaccgcaagaaatgcgagtggctctgcctgctgagccccagtgggcctgtctgcacctgtcccaatgggaagcggctggacaacggcacatgcgtgcctgtgccctctccaacgccccccccagatggtatgcttatgccctcccagtcccagccatgcctcaggaccatctccttcctgtggctcctgacttcccctgaccttgttgcctgtccctctcctcctattcccctggctctgccccttgacgggcccttcctgcagctccccggcctggaacctgtaacctgcagtgcttcaacggtggcagctgtttcctcaatgcacggaggcagcccaagtgccgctgccaaccccgctacacgggtgacaagtgtgaactggaccagtgctgggagcactgtcgcaatgggggcacctgtgctgcctccccctctggtatgccccctcatcccgccacgcctgctccttgcccctgggccccagccccgccacccaccaccccacctcaggcaaatgcccagcccctgcctcgcctccagcctcctttccacaacccagcatccagtcactccagtctctgcttctcgcccaggtccccccagcccattcctctgctatagggccaggtggtctcgagggccacagtcgcgctcacacatcctctcccaccaggcatgcccacgtgccggtgccccacgggcttcacgggccccaaatgcacccagcaggtgtgtgcgggctactgtgccaacaacagcacctgcactgtcaaccagggcaaccagccccagtgccgatgcctacccggcttcctgggcgaccgctgccagtaccgtgagtgagccatccctgggccccagggcatgcgggagggtgacgggggaccccagagcatggggtgatgttcaacctgtgcctgggacccacaggggcaagttcaggaaagaaggccttatgcagctgagccaggcccaagctgctggcgcttccccacaaaggtgctggcacacttcccctgaggcagtgcaccccctgcaccaagattatgcaaacagaaaagctctgttcaacctatggagagccctcatgagggtggggcttgaggcacttctctccctccccaaccacagggcagtgctctggctactgtgagaactttggcacatgccagatggctgctgatggctcccgacaatgccgctgcactgcctactttgagggatcgaggtgtgaggtgaacaagtgcagccgctgtctcgaaggggcctgtgtggtcaacaagcagagtggggatgtcacctgcaagtgagtggggccctcctccacagttccacccagctgggcccctgccctgtcctagccctgccctgcccctcccttcctcagcatcccaggcacgcctctgccagccccagccccagcctctgattccttcctgcagctgcacggatggccgggtggcccccagctgtctgacctgcgtcggccactgcagcaatggcggctcctgtaccatgaacagcaaaatgatgcctgagtgccagtgagttgggcccgggcttcacccaggcatagatcatcgctcccttccccagatttgagcaggaggaccgtcaggcctcagtgcccaccccccgccctgttttcctggcagcagtggctatggaggttatacctactcagccgtgtccctcctttctgcaggtgcccaccccacatgacagggccccggtgtgaggagcacgtcttcagccagcagcagccaggacgtaggtggcaggggttggggcaggcagggccaccgggacctagagcagggggaccgtgtgcctcctgcttccctgagccttggtgactcagtgtcccacctcttccctccagatatagcctccatcctaatccctctgctgttgctgctgctgctggttctggtggccggagtggtattctggtataagcggcgagtccaagggtgagtcacagggattctggaacattctggtcattattttgccatcctagccttcccccccaataatctctgtctccttatactcctgcctttccccagggctaagggcttccagcaccaacggatgaccaacggggccatgaacgtggagattggaaaccccacctacaagatgtacgaaggcggagagcctgatgatgtgggaggcctactggacgctgactttgccctggaccctgacaaggtgggctgggaggcgggcagggtcgagtgccaagaggccgtgggtggcctaaccaaaggtgttgggttaggtgagggacggaggtgggggtggggtaacctgggctacaggcccagctcctgagccctacctgaaccctctgtcaccctgcagcccaccaacttcaccaaccccgtgtatgccacactctacatggggggccatggcagtcgccactccctggccagcacggacgagaagcgagaactcctgggccggggccctgaggacgagataggggaccccttggcatagggccctgccccgtcggactgcccccagaaagcctcctgccccctgccagtgaagtccttcagtgagcccctccccagccagcccttccctggccccgccggatgtataaatgtaaaaatgaaggaattacattttatatgtgagcgagcaagccggcaagcgagcacagtattatttctccatcccctccctgcctgctccttggcacccccatgctgccttcagggagacaggcagggagggcttggggctgcacctcctaccctcccaccagaacgcaccccactgggagagctggtggtgcagccttcccctccctgtataagacactttgccaaggctctcccctctcgccccatccctgcttgcccgctcccacagcttcctgagggctaattctgggaagggagagttctttgctgcccctgtctggaagacgtggctctgggtgaggtaggcgggaaaggatggagtgttttagttcttgggggaggccaccccaaaccccagccccaactccaggggcacctatgagatggccatgctcaacccccctcccagacaggccctccctgtctccagggcccccaccgaggttcccagggctggagacttcctctggtaaacattcctccagcctcccctcccctggggacgccaaggaggtgggccacacccaggaagggaaagcgggcagccccgttttggggacgtgaacgttttaataatttttgctgaattcctttacaactaaataacacagatattgttataaataaaattgtaaaaaaaaaaaaaaaaaaaaaggccaaaaaaaaaaaaaagaaagaaaaaaagccgctggtgtctgcctgtgtgtgagagacgctgggagctggggctgcgctttcctgcttcggccaccagagggagacctgccccgtgctggaggcaggctggcgcgtggtttttagtgcccttctcccagggccctccccctctccatcttactgtgcccgggaagcgggtggcactggacttgacatggaagatctgcttctcctggctgtgtgaccttcagccatgacttcgagtctccagattttgtgttccctctgggtctaggacactaactcagatctgtttctctgcattcacttctaccagacaccacccccctacccaaaatgatcacccacagtgagaagccccactataagaagtgaatacactgaggctgcaaaggttttctcatccttcagggtcctcccatgcggttctctctgcctgagtctgctcttgaagcactgacgtctcactttgtggagactaatgaatcaaatgcgaagtaaaatgctgcattccagagccaggtgtctcctgcggtaaaggagagctgggaagaccagtttgccaggccctctaggcccccagcagctccagctcaccaatcatttcagtcattccagggggtaacaggaaaaaactgtcaatcaaaagtgtccaggtccatttcaacccctgcctagagggggaaacttcttgcagaaagttgcacagtttacactgcccaggactagagagggtttgagtcccagtacagcaaatatgagctcaggaagggtggctgcaaatgtctgaagatcccttacccaactcccaaccaggaagtgctgcctttcattcctcctccctcactggttcaactccaggagattcctcccaggcttccttctgccttggggaagctacaagtctaggcacctgtggaaagaggagccctccccttcccttcttagccttcagaagctctctccaacctcatcctccaagccaactctgagatcctcccctgccttcaaaagggccctggatgggcaactgcggggaaacagaatccgtggttgccgagtaggaggtctgtgtcccaatctggccaccaggtggtgtctgtacgcctggagcaccgcctatcctgaagccccacacagcccccgcctcagcactcattatgcacctgcgggggaccccagcccagtctctcgcttccttctctccggctattttgccacacccctccaccctctgccagccagctcccctccctgccccagcgcctgcctgctcccaccaccaccagccccaaccctgcccctctgccatcggtgcatctggtgccccccgggagccactgatctctgcctgtcacctcaagatcctgggcagagcgacaagggacccccgctgcagcttggaaggcatacccctccagtcagcatcccccactccgcctgtcaggacctgctaggagaaggtccaccaggaggcagtttctcaaactacccacccgggaggcaggtgggaagccctcaccttggcctgagagatgggaagaaccagggacagaggctgagaaccagggacagaagctgataccgaatgagaggcagaaacccagaggcggagagacagggggacagaggcaaagacccagagacagggcgagtagtgtgcatgtgtgtgtttgcacttgtgtttgtgcgagcgcgcacacatgtgtgtgtgtaactggagagagaacaggtggcctgagactgtagctaaaggaggagagatgcagtgggttcggcccccagaagaccaggaccctggtaatgggcttctgtcctggacagcctacgcctaggtgtgcccactgttcccacctactactgaagcagcccccgtgcctggaacgtgggctcagggttctggctcaaggccttttggccttgagcctgaacatttctgccccttcctgcctctctcctctccacccccaccccggcacccaggttcctgcctcctggcttctgcctgtctccctgggtgtctctgaatctgcctcgtcctctcagcaccggtccttttcctgactcgtgtgtgtggctgtcacgtcccatatctatctgtccatttctttgtatgtgcccccacttgtcttctgggctgccagtgacagcatacacctgtgtatgtctcagtgtgtgtgtccacctctgtgggtgtttgctctctgccaagacaaagagagggtgagcgcactgagcaactgtctgggtgtgctcgtctgggtgcaggtgtgctcacctctgttgctgtgctcctctgtgtgttggggtgccgctaggtgtgcgcctgtctctgtatttcgctctgtgtgccctgtccccgtgaaggcatctgcgtgcatccctggggtgggctctcaagggatgtgtctgtctctcagtctctttgcttgtccctatctctgtctaggtgttggtcataccacaacctcagccacagcctcagtgcatagcaacagctgacagctgaaaccacccgggcaggagagagagaggcagtggggaggagggaaccgaggaagaaacagagaagaggatgggggcagagagctggggctggggacagagacaaggacagagatagggaatggggacaaggatctagaagagctggtggtgaaagatgggacggcgggaggggaggaacagagactgcaccaagaggccaggcaggcggcgctgagagggatttcctgcccagcccccatgcagaggcgcactgggcctcgtgggggtcagtggtgggggccaggggcaaaggtgaacagccggtctagccgaggggtcctgagaccgcagaggtgcggtgaggcggggacggggcggagggcgccgtttgtcagccctattgacagacgtgatggggtttccgtccgtgatcaatgattctcatctccgggccgaatgagccgcggggcgcccatccatccccgtcagcatcgcgcggcggcagccgcccgaggccccgcccgtccccacctcggcccctgccctgcgcctgccccgacacaccttggccctgaacagggcagaggcccggggcttggagagcgtcgtccggctgggctccgcggcgcccccactccaggtgcacgggcccggagcccagagccccacgccctgccccgttcctcctgggcgcacagacgcggcctctcgggggaccagtgcctgagcccctcgaccccctccgcttcgcacctgggccaggggcgtgtccggggcgtgccggtgtgaaagtcaccttcggtgcccccagctgggcgggagggggcgcgcggggcgcggccgggattggagcgccgcggagccccgccccccgcccgcggagtcagacccaactttctcccccgcccgcgccccgcccccagcgccggctccgcgcctcgcgcccagtccgcgggccgcgccgccgctcccgccgctcccgccgctcccgccgctcccgcagccgccccgccgcccgcccggagccccgcgtccctaggcctggctcccgcctgcccgagacccgcccagcctgccccgctcagccgccagagaagatgcggctgctcccggaatggttcctcttgctctttggcccgtggctccttaggaaggtaagagtggcagggctggggcgctagcgcgggcgcggggttccgggacgcgaaggtcccagtgtgcgaggggctccgtgcgcccgccccgcccccagctccgagcgtcccaactttgcgcggcgcgggggaagcggacagacagactgcccgattcaggacgggcactctcctagcgcaagttggctgaggcttggagagggtgccgggcggaggtcccccttgcagccgacttcaggcgcggcgggggaggggacgaagcccgacccgcgagtgcgccagacagagcgggagtgcgagacagacagacaagccagcagggtgtcagccttgccgtctttccgcgccagtctcgctcgcctgcctcactgtctgtctgtccttccacccctccacccccgccttcccatttctcttctctgcacttgtcaccatgccaggtgggctctgtgtcgggagcatccatggcccgagcacacacgcacacacggactcaggcagacacggctgaacttggctacagccagcctcccatcacatttcccacggagacaccatctcccctgcacgacctcacagacacacccccctctcgtgccccactgaagggggaggctgtctggaaggggagtctctcctcccatgccctccctgcctccaaccccactccaaggcctctttccctgaggctctcgggcgaagagccagaggctaagggagctcagacttgatctgcctccttcctgacttggaggcttcaacctgcgaacatgctgtgctcatatgtgctgggtggagggcgtgggtcaccgtgtgcacctgtgtgcatgtgtccagggaagccaggcttggtccagtactggggccgagggtacatgtgtatactggtgtggtgtgtggtgttggctttgcatgagtgagtgtcagtgcctgcctcacagtgcagccatctgcctatgcccctggtgtgtgcccgcaatgggggcccaggccccagtcccccattttccttctaccagcctcccctgcctatggcttccctgttttctgacccccaactgtgacctacctagtttgggggcaggcaggtcattccccaaaccctcattctctgtaccctcagcccctgtagagtctagaaggggtgtatttcttcccccaacacttggacctctgcctgctcagccaaatcacatttggcaaaccccagcagggcaggggctgccccagtgaagctagcattagagctccctggccctcccagccccacctggtgaccttgaggggctgcacggtaggcagaggagcccctccatgaaaactgcttccactagcaggagcttcttagggacttgctgcccaactctgtccttagtgaactggaggagtggggggggtctgtgccctaccacccacccacccatgtgtgaaggcctggggtcaagaggtggtaggtatggcattctcttgcccctcctttccacttcctcccacctcatctccactctcccaggcaaataaactcccctgtggacagatctggtttaatttcctttgccccctgagggggaatgaaacatctggtggagacttgagtgagagtgagcgtgaggatatgagcaatgggatctatctgagtgtgtgtgtgtgagctgcagctgtggggcctccgtgttggagtcaacagggagagtggatctgctggttagcccagcttatgtgcatgtgagaatgtgtttacatgtgtacacactgcgggtgtgtgaatatgtataactgcacggggaggtgtgggtatatgagtgtttgtgtgtccaaatacctgtgtgtgcttctgtgcacttgtgagtgtggcgtatgcacatgtataccccggggtttctggtgcatctgtgtgctggggcccatgtgttgtctgtatgagtctctggggtttgtgagtgtgtttctgtgtgcttgtgattgtgagtgcatttgagtgtgctatgagattgtgagcctcaggatgtgtttatgtatctgagtgtggcttatgtgtgtgggtgctcaagggtgtcttggtgccagcactgggagtgggcaaaaggtgaggctgatcctgggtaagaggtggctaggggacagtttacagggcaactttttggcaaccctaaccatgaacggctgacacctctgcctctcccgtcctgcttgctcaccctcctccaggtttctctcccttcctcctcactccaggcttcccatttctcagagcctgggactcctggcttccactgcctctggggttctggcctctcagccagggattcttgaggatctttctcatacagtctctgactcctttccctctctctctgtctccccgaccccttgccaaagcagctgcctactgggagaagcagcaggcgatcaatagtcactaatcactaatcactaattactaattagctgggggagggcaggggcggggccctgtgggacctgccagctctatcccgcctcaggaaaggattaggtctgattctcttagagctggctggccgaagcccctcagccagctaccccctcctgcctccacaccctcctctagccccccagctaatctctgcctgggccacttaggcacgcacagcctgggctagggcccagagctgctgccggggatttgggggtaatcaggggccgcagctgggccagggggacaggggagggcctgctgtgacagctcccttgggccagagcctgcagtggaagcctcacattcctaataggaggggcatgcgtcagaaaggagaatttagagtgtcagggttgggatgggtagaggagctggagacccaggagcggggtgactggcgaagaggtgaggtaataaggacagaagcaaggcaaagaggggtcagggacgaggtaattggagagagacaacacaaacgtctaaagaaaacaggtaagtggggggacctcacaggggtcagagatggagtaattggcaaggagatggggaactttggacctagccctgcaactcaagatgtgtgggatccgtgagggacagggcaacagagagggggcagggtcataggagagggtcccagggctcaggcgcaggaggagtcgcagggcgtggggtgggaagcagctgcccagtggggatggggagcagggagcgctgccttgagcgctggaaattggcgcggctccccctctcccccgcctgcccctcctccacctccaccccgcccactccccctccggctccggcttcgggaaattacatccccgctccgcggctccccccaacccccaccgcgccccggagccggcgcctttataggcacatttattgcaataataaagtgaggcgcggggcggggggcgggggggcagtcgttcccgcggggaccgcgctggctccaggaagcagggaaataaaataaaataaaataaaataaaataaaaattcagataacggtgagccttgcgcggcaggccaagagaagtcaggcaggcaggggtagagggagggggcgtccagcccaagggcagagcctaccccaccccaccagcggtccccgccccctcatgcagtggtagggtctggaaagaggtgtcttcgcttcaacctgcctggccccctcccacagcctgatcctgcctggtctttgccttgccctctggctcctctcccatacctgtcctcagcccctgtctctgtccccgtctcctgtgtcttcccttgtcccccatttcccattccagtctccctttgagtcttccatccccatctcctgggtctctgcatccatcactgtttctgcccagtaaccatccccatcccccatctctgttttgccccaccctgaccccatccctgcctgtcccctgtgcttatccctcatccaccattcctgtccccatgctgcttcctggactgttctgtagcccatcttcatttctctggtccttaccccatccacatctctgtctctgccccacgcctggccaccatttctattctgcttctcatccctgtccccaggcctatcctcattgtatcctcatccctgtactctatatctgtgcctgccagtccccaatcccagtccccctccctctctgtctcagtcctcaccccaggctgtcctgtccaccccacctctctcctcacccacatctctatccctcgttcccagccagactccaccggcccctattgcagcacccctgcctctttctaggtgcaggggctcaggatgctcttttctccccttccccagcccaggcctggactgtcccttcctccggccagatcctgggagcaccctgcctgacccaggtggtaggggaaaagcaacgggccagcctggaggcccaggggaggtgcaccctgcaatgcggctggggggctgacagcctgatcctcccccaatcccagcagtgtcatccccaaagagccactccccgaagtggagtttgttgcccccagcagcaggaggccacctcaactccctgcaggtgcgtgggcccgctgcctcgggggtaaagccctcctggtgcagctctccccgctccccgaatgggcctgaaggagcctgctgaaccccccagctgccgcgcacctccgccccgcccccgcgccgacagcagcgctagcctctcccctccgcaaatgtcaccgcgcccaattagcttaattaagccagctctggagcaagggggacccctcctcggacaacatcctgctcccaccctcagccatggaggtgggcgacaagagctctgggcagaggagctccttaccacctgccttcccaactcccccacctccccccatgttgctggagacagacaacctgaaggacagcaggagagaaccacagacagagggagaaaatcagaatcatgggaggaggaaatttgagacagagacagtgagaaaagagactgagagacaaaagagactgagagaatggggagggagagatggaaaaacagcacaagagagggagagagagcacgagcaatcaagggagccagagggagg

SEQ ID NO: 88 - DNA, 21726 bp, Homo sapiens
ctcaacttctttgaaacatccaagcccctcaaaagaaagacttctgagtcccccagacccccaccaacccctcttgcccccacctgccctccagtttgtatgcaagaacgacaagtgcatccccttctggtggaagtgtgacaccgaggacgactgcggggaccactcagacgagcccccggactgccgtgagtgcctgctgggggtgacaggagggcccccagctgtgtcggaggcctgactcctgaggctttgaatggccactggagaggctggggctgtggtgccctgcaagtggacctggccgtgtccaccccagccgctctgactctgagcctccctctctggcagctgagttcaagtgccggcccggacagttccagtgctccacaggtatctgcacaaaccctgccttcatctgcgatggcgacaatgactgccaggacaacagtgacgaggccaactgtggtaaggcgctgcccgcccaccctccctccttccccagcatcttccctgccccaggatttggggctttcaagtgcagggaagttgcagcccacggcagcttgctctccaggctggattcctatggctcaagcctgtgtcctccctgctgagggatgggcaccctctccctgcccctgagtcctcccttcgccacgaatcacctcctcctccctccacagacatccacgtctgcttgcccagtcagttcaaatgcaccaacaccaaccgctgtattcccggcatcttccgctgcaatgggcaggacaactgcggagatggggaggatgagagggactgccgtgagtgtcagaggtggtggtgggccggtggtgggagatgacacggaagcagggcaggcagaatctccccacagctttgagaggctctcaaataactttagtagatgggcaacacaaattatattgggtgtaacttgctttgctcataaaaatcatcatgcatgatatagagacatagagatccagaaaacaaaaagcaccaaaactggggataaactgttccttcctccgaagaagttgctggcaggaccaaggccagggcttggaagagagagaagacagtgatggtgaactggagtggcaggtgtaagggagggccctcattctcttgcccaccccacagccgaggtgacctgcgcccccaaccagttccagtgctccattaccaaacggtgcatcccccgggtctgggtctgcgaccgggacaatgactgtgtggatggcagtgatgagcccgccaactgcagtgagttgcctggcctggagcccagcttccctccccagtgtctgctgctcacaccaccccgacgtgtgaccccctcagtggctgctccctcactctccccaccctcccggcacactcctggaaggagtctcatcctcaccccatgcccacccgcttgcagcccagatgacctgtggtgtggacgagttccgctgcaaggattcgggccgctgcatcccagcgcgttggaagtgtgacggagaggatgactgtggggatggctcggatgagcccaaggaagagtgtggtgagccgagaccccactccaggaggaagacagtctacctgggtgggaggcatggcacccctggcaggtggagggctgggggccgcctgcttaccggtctcagcgtggccctgctgctgggcttcctgggcctgctgtggggctggggaaggaggcctggctggagctcacttccccacatccacccgtgccccatgtctcccagtttccctatccctgcccctgcccacgcctcatccacacatacctgtgtggagttttccctgcccaccctatgggatctgttcatctccttcccaaggcagctgcccacacacacacccccaaccatgtctcctgtccccaaacctccttatagaccccacgtctcaaaacaccgcctgggctccccgcggctgacccttcccaagctgggatgcccaccctccctgccaggccagcctgaccatgcctgcttggaccctaatgtctgccccagccctttccctgactgccctgacacttgcctcctccagatgaacgcacctgtgagccataccagttccgctgcaagaacaaccgctgcgtgcccggccgctggcagtgcgactacgacaacgattgcggtgacaactccgatgaagagagctgcagtacgtccccacccacccagccccgcatgagcccctcccaggcctggcccttgtctcgcggccctcctgccacaggccgcgccagagctggtggccacctcccagggtgggggcaggagccgccctcctcacccatcccactccatgtcgtgtatttgagtttgtgccatttcacctcatctcatgtttctctccattttcacactgtcctctcggggttgcagaggtaggtgtctctgatgtgcccgtgctcccaccatacccccacctctgtcccagagccccccatccctgtgctgtgcctctacccatcatccttgattgacctctccccaaaccctggtgcttgtctcagtggtcttgcccccgctcccctccccaaacacagtctgttctgagggcaaggccagggacctgtgtcctctctggtgtctgtcccatggggtaagtgcgagcccgcctgtgcccagctgttccataggagcagccagtgggctctgccaggactggctcggcctctgggtcagtcagctgtggccttcagagacacggggatgggccttgggctcgggactgtggcactactgaggcctggagtccttgtgcccaccctcctgggcctgtctccccctgtccttcccagcccctcggccctgctccgagagtgagttctcctgtgccaacggccgctgcatcgcggggcgctggaaatgcgatggagaccacgactgcgcggacggctcggacgaggtgggcagggagatgagaaggaagcagatggcctcagaggagttcaggcagggcttggggagtgccgagaggtgaccggctgcctgtgcccatgcccacagaaagactgcaccccccgctgtgacatggaccagttccagtgcaagagcggccactgcatccccctgcgctggcgctgtgacgcagacgccgactgcatggacggcagcgacgaggaggcctgcggcactggcggtgcgccccttggcttggtctccctgggtcctccctctgctgcccaccccgccacatggcccagtcattcactcattctttctcttctgtattcattcttcatgcaacaaatatttattaagcatttaccatgtaccaggcactgccataggtgttagggacgtagtagtaaacaagacacagggcccctgaatacacatttttgtgcgggttgtgcccagctcaatgccccctagtctaggggaccagttgagctgaaatccagcaaaccctgagggctgtgcccatctaggccccaccccacaagtccctccgagacagtctgctgccacaagaagaaaagccctgcctattttcccttcctgggggcagtgagacagtgcctgtccctcgctgacctgcctgggctctgcagtacagagggggcaggtgaagcccgggatgagaaaagactgggccttggagcggaaatcccaactgtgcgggcagatgtcttggctctgccttggtaggccaggcacagggatgggaacccggtcttccattcccagcccagtgctgttcccgcgtccccgctgtggaactacacagcccagtgctgttcccacgtccccgctgtggaactacacagcacagtgccctgccacataccagagaaggagtgccctctgaactcctccagacacccctgaaaaatggcctcttctcccctaaataccagagggggcagtttggccccaccaagtagaaatttaagagacctggttccaatttggctgtgccactgcttgcctggtgacccctctgagcctggaacccccacctgtggagacaggggtctgggtgggctcatggctcattctatctcttggctccccctggcaccagtgcggacctgccccctggacgagttccagtgcaacaacaccttgtgcaagccgctggcctggaagtgcgatggcgaggatgactgtggggacaactcagatgagaaccccgaggagtgtggtgagatttggggcggggctcccaggcttcccagtggccagcaaccacccccactcccaagactaattctggctctgtgtccccctggctgctgcagcccggttcgtgtgccctcccaaccggcccttccgttgcaagaatgaccgcgtctgtctgtggatcgggcgccaatgcgatggcacggacaactgtggggatgggactgatgaagaggactgtggtgagcagggggccgacgagaggcctgcaggggacgggtagtgcacagtggggtgagtctggtcctcgtgggagctgcactggggttagggttaaccaggaggactcgcccaggaaggggaggatccattgctaggagcctgggggcttttcgttaggaaagagaagcccctggggaaggctctgggggctgcctgatgccttaggtcttggaggtggggctgggaacccaaatgtttgacctgctccccctgcaagccttgtcacttaggaattgggagccactgttatctatggggttgccgtgggaggaggaggcaggggagaatacccagggcctaaagcctctgccctcctcagagccccccacagcccacaccacccactgcaaagacaagaaggagtttctgtgccggaaccagcgctgcctctcctcctccctgcgctgcaacatgttcgatgactgcggggacggctctgacgaggaggactgcagcatcggtgaggcccggcagcggaccggacgctggtggggagtggggagagccaagccctggcctggggtggctcaagggagggcatccactctctgtcccccacagaccccaagctgaccagctgcgccaccaatgccagcatctgtggggacgaggcacgctgcgtgcgcaccgagaaagcggcctactgtgcctgccgctcgggcttccacaccgtgcccggccagcccggatgccaaggtaggaaagcggggcagagcaggggtggacaccccaactgtggactctcatgaccctccctgtaacccttagacatcaacgagtgcctgcgcttcggcacctgctcccagctctgcaacaacaccaagggcggccacctctgcagctgcgctcggaacttcatgaagacgcacaacacctgcaaggccgaaggtgccggagccaccagagggcagaaaggctgggtggggcagggcgaccaggatatcaaacggggccgacttggaatggaatgtcttcctgcggacatcttgcccagacaagaagccccagactcatagttgcagctgcctgagcacagtgctggcccagcagtgggggcaggtcctggggctggctgactgaaggagtctggggtgtggcagtgctctgaattgcacacacacctcctcacccaccactgccaggacgagagtacactcagacacgcattgcacactcacagtcatgggggcctcacctgcacattccccacatgctttgatgcccaccttgccttccacatgcctgtacacagacattcacacacacccctggcacacacacccccaccatgcactcccatgcacaccctcgtgctccatgccaagcacacacaccccatgtgcctatgcacccccgagcatgtgccaggcagtttgtagcagagagcgtggtgatgccatccagcagccgtgaggaggtggaagtctctgggtctggaggggcagggacagctttctgactgaaaggagcgggtcacagtggatcagctcaggggaggagaggaggaggtccagaggctgaggttggagcctgcaaccctgagcagggagggtaagcagcagcttctggccggagcagatggtcctaccaggagatgggacagtgttcatgtgaaaggagctgagctgggtggggtgcacacctgcatcccacagccccagccctggcctcttgcttctccaggctctgagtaccaggtcctgtacatcgctgatgacaatgagatccgcagcctgttccccggccacccccattcggcttacgagcaggcattccagggtgacgagagtgtccgcattgatgctatggatgtccatgtcaaggctggccgtgtctattggaccaactggcacacgggcaccatctcctaccgcagcctgccacctgctgcgcctcctaccacttccaaccgccaccggcgacagattgaccggggtgtcacccacctcaacgtgagtgcccaacctggcgtggatggagtggaagagctccatagagcaggcggttcagagcaggatttgaaaagggcagtgctggctaggcgcagtggctcacgcctataatcccagcactttgggaggccaaggcgggcagatcacctgagatcaggagtttgagaccagcgtggcaacatggtgaaaccctgtctctactaaaaatacaaaaatttggctgagcgcggtggctcatgcctgtaatcccagcactttgggaggcagaggtgggtggatcacgaggtcaggagatccagaccaacctggctaacacagtgaaaccccgtctctattaaaaaatacaaaaaaattagccgggcatggtggcgggcgcctgtagtcccagctacttgggaagctggggcaggagaatggcatgaacccgggaggcggagcttgcagtgagccgagatcgcgccactgcactccagcctgggcgagagagtgagactcggtctctaaataaataaataaataaataaataaataaataaataaatagagactcggtctctaaataaataaataaataaataaataaaataaaataaaataaaaatacaaagattagccaggcgtggtggcgggcgcctgtaatcccagctactcaggaggctgaagcaggagaatcctttgaacccagaaggtggaagttgcagtgagccgagtgccactcggttgcagtggcaccaaggttgcagaatagcactgcactccagcctggatgatagagcgagactccgtctcaaaaaaaaaaaaaagaaaaagaaaacaaaagggcagtgcgaggggcaaaggttgagagtggggcagggggcagtcttaggattgtgttctgaggcatggccagcgggaagacagagcagtgggaatggtcagcagctggctgtgctgcaggcagcccagggcacagggcatgatgggcaggcagacagccctccggcaccaatcccccatccttgccacttcccactgtgtacgtcttagctacctcatttaacctctttgggtttcactttgtttatcaataaaattaggtgatcatcgccattgcacaggcttcagggagggctcaccagccacgtgtgagagctgcgagtctggcgcataagctccatgccggttgaatctctttaaagccagggtcctggctgtgagcctggggtgacgttccagcaggctggcagagtggtggcggggggataatggcaggaagacaaagcagtggcccctgaacctgtggcttccattcagatttcagggctgaagatgcccagaggcatcgccatcgactgggtggccggaaacgtgtactggaccgactcgggccgagatgtgattgaggtggcgcagatgaagggcgagaaccgcaagacgctcatctcgggcatgattgacgagccccacgccattgtggtggacccactgagggggtgggcaagggccctggggggaggcctctgggctggtggtaggaagcccccgggacagggttgggggctgcacccacatgcgtgcccttccctcccaggccagcctgaggacagagtccttttcagtcccttgggtcttctcggccacccctgcctggccctccccatgctgcctctgcccagggcccccagctgggcctgcttgggcagggatctgacctctgcttggccggctgtcatgcacagccacactctgccctggggaacagctctgccagcgtcggtggctctgaatgagcacactgtggttttagaggaaaagcccctcaacctgctcagaagcagactcccgcctgcttctctgtagaaggacagaatgccctcctcccagtccccagcagtccctgtccccagaccaagaagctggtgtcctgcctgggcctgcctcctctggccctccggcctgcccacactcaccccttctccctccccaggaccatgtactggtcagactggggcaaccaccccaagattgagacggcagcgatggatgggacgcttcgggagacactggtgcaggacaacattcagtggcccacaggtttgtggggcagggtgcaggagggacgggcatggagggggcccggctcgcagagcccagctgctgctgaagtcacacaaaagcaagggatgggatggggcttggactggggcagggcagattggccgtggaggcttttcccgaaagaggtgactgtgagtggcgtatgaacagggtggagctgtcccgggcatggaggcagttctttccaccccgagcctgggttggggaggccaagctctcacagtgctctctctctccccaggcctggccgtggattatcacaatgagcggctgtactgggcagacgccaagctttcagtcatcggcagcatccggctcaatggcacggaccccattgtggctgctgacagcaaacgaggtcagagcccggcataagtcgcagtccccagccctgtccccagccttgccatcctccctactgagccaaaggcctcacttcaatgcctcccatcctttgtcactgacccccagcaatgctgcagcgccttccaggcctctccagctggcctccccctgaaccagccctgcaggcctgagacccaccctgaccctctggcctacttgtccattcattggttgggttgcacggaggcagcataggtacattaggaacgtagcaaattgggggagaaggaatagaagtcagtcatgactgaccccagaagtctgggggtgatgggaccttttgccagtagtggccacaggaggaggaaccggtgtggggagagagaatttggtctggatgtgttgagtttgaggtgtctgggaaccacaggtgccagtgtcgtggacagcatggccagggcctgagtgcccctcaggtcccctctgactccacctcctcccccaggcctaagtcaccccttcagcatcgacgtctttgaggattacatctatggtgtcacctacatcaataatcgtgtcttcaagatccataagtttggccacagccccttggtcaacctgacagggggcctgagccacgcctctgacgtggtcctttaccatcagcacaagcagcccgaaggtgggggcagaggggagcctgggctggggaagggaggcctgtgggcattgagtctccaagctgtggccctgggacctggtggagagggggtcaccctgggctcacagggctcagagaagggtcctgctcagcatcctccccaccccacccatacctgcagtgaccaacccatgtgaccgcaagaaatgcgagtggctctgcctgctgagccccagtgggcctgtctgcacctgtcccaatgggaagcggctggacaacggcacatgcgtgcctgtgccctctccaacgccccccccagatggtatgcttatgccctcccagtcccagccatgcctcaggaccatctccttcctgtggctcctgacttcccctgaccttgttgcctgtccctctcctcctattcccctggctctgccccttgacgggcccttcctgcagctccccggcctggaacctgtaacctgcagtgcttcaacggtggcagctgtttcctcaatgcacggaggcagcccaagtgccgctgccaaccccgctacacgggtgacaagtgtgaactggaccagtgctgggagcactgtcgcaatgggggcacctgtgctgcctccccctctggtatgccccctcatcccgccacgcctgctccttgcccctgggccccagccccgccacccaccaccccacctcaggcaaatgcccagcccctgcctcgcctccagcctcctttccacaacccagcatccagtcactccagtctctgcttctcgcccaggtccccccagcccattcctctgctatagggccaggtggtctcgagggccacagtcgcgctcacacatcctctcccaccaggcatgcccacgtgccggtgccccacgggcttcacgggccccaaatgcacccagcaggtgtgtgcgggctactgtgccaacaacagcacctgcactgtcaaccagggcaaccagccccagtgccgatgcctacccggcttcctgggcgaccgctgccagtaccgtgagtgagccatccctgggccccagggcatgcgggagggtgacgggggaccccagagcatggggtgatgttcaacctgtgcctgggacccacaggggcaagttcaggaaagaaggccttatgcagctgagccaggcccaagctgctggcgcttccccacaaaggtgctggcacacttcccctgaggcagtgcaccccctgcaccaagattatgcaaacagaaaagctctgttcaacctatggagagccctcatgagggtggggcttgaggcacttctctccctccccaaccacagggcagtgctctggctactgtgagaactttggcacatgccagatggctgctgatggctcccgacaatgccgctgcactgcctactttgagggatcgaggtgtgaggtgaacaagtgcagccgctgtctcgaaggggcctgtgtggtcaacaagcagagtggggatgtcacctgcaagtgagtggggccctcctccacagttccacccagctgggcccctgccctgtcctagccctgccctgcccctcccttcctcagcatcccaggcacgcctctgccagccccagccccagcctctgattccttcctgcagctgcacggatggccgggtggcccccagctgtctgacctgcgtcggccactgcagcaatggcggctcctgtaccatgaacagcaaaatgatgcctgagtgccagtgagttgggcccgggcttcacccaggcatagatcatcgctcccttccccagatttgagcaggaggaccgtcaggcctcagtgcccaccccccgccctgttttcctggcagcagtggctatggaggttatacctactcagccgtgtccctcctttctgcaggtgcccaccccacatgacagggccccggtgtgaggagcacgtcttcagccagcagcagccaggacgtaggtggcaggggttggggcaggcagggccaccgggacctagagcagggggaccgtgtgcctcctgcttccctgagccttggtgactcagtgtcccacctcttccctccagatatagcctccatcctaatccctctgctgttgctgctgctgctggttctggtggccggagtggtattctggtataagcggcgagtccaagggtgagtcacagggattctggaacattctggtcattattttgccatcctagccttcccccccaataatctctgtctccttatactcctgcctttccccagggctaagggcttccagcaccaacggatgaccaacggggccatgaacgtggagattggaaaccccacctacaagatgtacgaaggcggagagcctgatgatgtgggaggcctactggacgctgactttgccctggaccctgacaaggtgggctgggaggcgggcagggtcgagtgccaagaggccgtgggtggcctaaccaaaggtgttgggttaggtgagggacggaggtgggggtggggtaacctgggctacaggcccagctcctgagccctacctgaaccctctgtcaccctgcagcccaccaacttcaccaaccccgtgtatgccacactctacatggggggccatggcagtcgccactccctggccagcacggacgagaagcgagaactcctgggccggggccctgaggacgagataggggaccccttggcatagggccctgccccgtcggactgcccccagaaagcctcctgccccctgccagtgaagtccttcagtgagcccctccccagccagcccttccctggccccgccggatgtataaatgtaaaaatgaaggaattacattttatatgtgagcgagcaagccggcaagcgagcacagtattatttctccatcccctccctgcctgctccttggcacccccatgctgccttcagggagacaggcagggagggcttggggctgcacctcctaccctcccaccagaacgcaccccactgggagagctggtggtgcagccttcccctccctgtataagacactttgccaaggctctcccctctcgccccatccctgcttgcccgctcccacagcttcctgagggctaattctgggaagggagagttctttgctgcccctgtctggaagacgtggctctgggtgaggtaggcgggaaaggatggagtgttttagttcttgggggaggccaccccaaaccccagccccaactccaggggcacctatgagatggccatgctcaacccccctcccagacaggccctccctgtctccagggcccccaccgaggttcccagggctggagacttcctctggtaaacattcctccagcctcccctcccctggggacgccaaggaggtgggccacacccaggaagggaaagcgggcagccccgttttggggacgtgaacgttttaataatttttgctgaattcctttacaactaaataacacagatattgttataaataaaattgtaaaaaaaaaaaaaaaaaaaaaggccaaaaaaaaaaaaaagaaagaaaaaaagccgctggtgtctgcctgtgtgtgagagacgctgggagctggggctgcgctttcctgcttcggccaccagagggagacctgccccgtgctggaggcaggctggcgcgtggtttttagtgcccttctcccagggccctccccctctccatcttactgtgcccgggaagcgggtggcactggacttgacatggaagatctgcttctcctggctgtgtgaccttcagccatgacttcgagtctccagattttgtgttccctctgggtctaggacactaactcagatctgtttctctgcattcacttctaccagacaccacccccctacccaaaatgatcacccacagtgagaagccccactataagaagtgaatacactgaggctgcaaaggttttctcatccttcagggtcctcccatgcggttctctctgcctgagtctgctcttgaagcactgacgtctcactttgtggagactaatgaatcaaatgcgaagtaaaatgctgcattccagagccaggtgtctcctgcggtaaaggagagctgggaagaccagtttgccaggccctctaggcccccagcagctccagctcaccaatcatttcagtcattccagggggtaacaggaaaaaactgtcaatcaaaagtgtccaggtccatttcaacccctgcctagagggggaaacttcttgcagaaagttgcacagtttacactgcccaggactagagagggtttgagtcccagtacagcaaatatgagctcaggaagggtggctgcaaatgtctgaagatcccttacccaactcccaaccaggaagtgctgcctttcattcctcctccctcactggttcaactccaggagattcctcccaggcttccttctgccttggggaagctacaagtctaggcacctgtggaaagaggagccctccccttcccttcttagccttcagaagctctctccaacctcatcctccaagccaactctgagatcctcccctgccttcaaaagggccctggatgggcaactgcggggaaacagaatccgtggttgccgagtaggaggtctgtgtcccaatctggccaccaggtggtgtctgtacgcctggagcaccgcctatcctgaagccccacacagcccccgcctcagcactcattatgcacctgcgggggaccccagcccagtctctcgcttccttctctccggctattttgccacacccctccaccctctgccagccagctcccctccctgccccagcgcctgcctgctcccaccaccaccagccccaaccctgcccctctgccatcggtgcatctggtgccccccgggagccactgatctctgcctgtcacctcaagatcctgggcagagcgacaagggacccccgctgcagcttggaaggcatacccctccagtcagcatcccccactccgcctgtcaggacctgctaggagaaggtccaccaggaggcagtttctcaaactacccacccgggaggcaggtgggaagccctcaccttggcctgagagatgggaagaaccagggacagaggctgagaaccagggacagaagctgataccgaatgagaggcagaaacccagaggcggagagacagggggacagaggcaaagacccagagacagggcgagtagtgtgcatgtgtgtgtttgcacttgtgtttgtgcgagcgcgcacacatgtgtgtgtgtaactggagagagaacaggtggcctgagactgtagctaaaggaggagagatgcagtgggttcggcccccagaagaccaggaccctggtaatgggcttctgtcctggacagcctacgcctaggtgtgcccactgttcccacctactactgaagcagcccccgtgcctggaacgtgggctcagggttctggctcaaggccttttggccttgagcctgaacatttctgccccttcctgcctctctcctctccacccccaccccggcacccaggttcctgcctcctggcttctgcctgtctccctgggtgtctctgaatctgcctcgtcctctcagcaccggtccttttcctgactcgtgtgtgtggctgtcacgtcccatatctatctgtccatttctttgtatgtgcccccacttgtcttctgggctgccagtgacagcatacacctgtgtatgtctcagtgtgtgtgtccacctctgtgggtgtttgctctctgccaagacaaagagagggtgagcgcactgagcaactgtctgggtgtgctcgtctgggtgcaggtgtgctcacctctgttgctgtgctcctctgtgtgttggggtgccgctaggtgtgcgcctgtctctgtatttcgctctgtgtgccctgtccccgtgaaggcatctgcgtgcatccctggggtgggctctcaagggatgtgtctgtctctcagtctctttgcttgtccctatctctgtctaggtgttggtcataccacaacctcagccacagcctcagtgcatagcaacagctgacagctgaaaccacccgggcaggagagagagaggcagtggggaggagggaaccgaggaagaaacagagaagaggatgggggcagagagctggggctggggacagagacaaggacagagatagggaatggggacaaggatctagaagagctggtggtgaaagatgggacggcgggaggggaggaacagagactgcaccaagaggccaggcaggcggcgctgagagggatttcctgcccagcccccatgcagaggcgcactgggcctcgtgggggtcagtggtgggggccaggggcaaaggtgaacagccggtctagccgaggggtcctgagaccgcagaggtgcggtgaggcggggacggggcggagggcgccgtttgtcagccctattgacagacgtgatggggtttccgtccgtgatcaatgattctcatctccgggccgaatgagccgcggggcgcccatccatccccgtcagcatcgcgcggcggcagccgcccgaggccccgcccgtccccacctcggcccctgccctgcgcctgccccgacacaccttggccctgaacagggcagaggcccggggcttggagagcgtcgtccggctgggctccgcggcgcccccactccaggtgcacgggcccggagcccagagccccacgccctgccccgttcctcctgggcgcacagacgcggcctctcgggggaccagtgcctgagcccctcgaccccctccgcttcgcacctgggccaggggcgtgtccggggcgtgccggtgtgaaagtcaccttcggtgcccccagctgggcgggagggggcgcgcggggcgcggccgggattggagcgccgcggagccccgccccccgcccgcggagtcagacccaactttctcccccgcccgcgccccgcccccagcgccggctccgcgcctcgcgcccagtccgcgggccgcgccgccgctcccgccgctcccgccgctcccgccgctcccgcagccgccccgccgcccgcccggagccccgcgtccctaggcctggctcccgcctgcccgagacccgcccagcctgccccgctcagccgccagagaagatgcggctgctcccggaatggttcctcttgctctttggcccgtggctccttaggaaggtaagagtggcagggctggggcgctagcgcgggcgcggggttccgggacgcgaaggtcccagtgtgcgaggggctccgtgcgcccgccccgcccccagctccgagcgtcccaactttgcgcggcgcgggggaagcggacagacagactgcccgattcaggacgggcactctcctagcgcaagttggctgaggcttggagagggtgccgggcggaggtcccccttgcagccgacttcaggcgcggcgggggaggggacgaagcccgacccgcgagtgcgccagacagagcgggagtgcgagacagacagacaagccagcagggtgtcagccttgccgtctttccgcgccagtctcgctcgcctgcctcactgtctgtctgtccttccacccctccacccccgccttcccatttctcttctctgcacttgtcaccatgccaggtgggctctgtgtcgggagcatccatggcccgagcacacacgcacacacggactcaggcagacacggctgaacttggctacagccagcctcccatcacatttcccacggagacaccatctcccctgcacgacctcacagacacacccccctctcgtgccccactgaagggggaggctgtctggaaggggagtctctcctcccatgccctccctgcctccaaccccactccaaggcctctttccctgaggctctcgggcgaagagccagaggctaagggagctcagacttgatctgcctccttcctgacttggaggcttcaacctgcgaacatgctgtgctcatatgtgctgggtggagggcgtgggtcaccgtgtgcacctgtgtgcatgtgtccagggaagccaggcttggtccagtactggggccgagggtacatgtgtatactggtgtggtgtgtggtgttggctttgcatgagtgagtgtcagtgcctgcctcacagtgcagccatctgcctatgcccctggtgtgtgcccgcaatgggggcccaggccccagtcccccattttccttctaccagcctcccctgcctatggcttccctgttttctgacccccaactgtgacctacctagtttgggggcaggcaggtcattccccaaaccctcattctctgtaccctcagcccctgtagagtctagaaggggtgtatttcttcccccaacacttggacctctgcctgctcagccaaatcacatttggcaaaccccagcagggcaggggctgccccagtgaagctagcattagagctccctggccctcccagccccacctggtgaccttgaggggctgcacggtaggcagaggagcccctccatgaaaactgcttccactagcaggagcttcttagggacttgctgcccaactctgtccttagtgaactggaggagtggggggggtctgtgccctaccacccacccacccatgtgtgaaggcctggggtcaagaggtggtaggtatggcattctcttgcccctcctttccacttcctcccacctcatctccactctcccaggcaaataaactcccctgtggacagatctggtttaatttcctttgccccctgagggggaatgaaacatctggtggagacttgagtgagagtgagcgtgaggatatgagcaatgggatctatctgagtgtgtgtgtgtgagctgcagctgtggggcctccgtgttggagtcaacagggagagtggatctgctggttagcccagcttatgtgcatgtgagaatgtgtttacatgtgtacacactgcgggtgtgtgaatatgtataactgcacggggaggtgtgggtatatgagtgtttgtgtgtccaaatacctgtgtgtgcttctgtgcacttgtgagtgtggcgtatgcacatgtataccccggggtttctggtgcatctgtgtgctggggcccatgtgttgtctgtatgagtctctggggtttgtgagtgtgtttctgtgtgcttgtgattgtgagtgcatttgagtgtgctatgagattgtgagcctcaggatgtgtttatgtatctgagtgtggcttatgtgtgtgggtgctcaagggtgtcttggtgccagcactgggagtgggcaaaaggtgaggctgatcctgggtaagaggtggctaggggacagtttacagggcaactttttggcaaccctaaccatgaacggctgacacctctgcctctcccgtcctgcttgctcaccctcctccaggtttctctcccttcctcctcactccaggcttcccatttctcagagcctgggactcctggcttccactgcctctggggttctggcctctcagccagggattcttgaggatctttctcatacagtctctgactcctttccctctctctctgtctccccgaccccttgccaaagcagctgcctactgggagaagcagcaggcgatcaatagtcactaatcactaatcactaattactaattagctgggggagggcaggggcggggccctgtgggacctgccagctctatcccgcctcaggaaaggattaggtctgattctcttagagctggctggccgaagcccctcagccagctaccccctcctgcctccacaccctcctctagccccccagctaatctctgcctgggccacttaggcacgcacagcctgggctagggcccagagctgctgccggggatttgggggtaatcaggggccgcagctgggccagggggacaggggagggcctgctgtgacagctcccttgggccagagcctgcagtggaagcctcacattcctaataggaggggcatgcgtcagaaaggagaatttagagtgtcagggttgggatgggtagaggagctggagacccaggagcggggtgactggcgaagaggtgaggtaataaggacagaagcaaggcaaagaggggtcagggacgaggtaattggagagagacaacacaaacgtctaaagaaaacaggtaagtggggggacctcacaggggtcagagatggagtaattggcaaggagatggggaactttggacctagccctgcaactcaagatgtgtgggatccgtgagggacagggcaacagagagggggcagggtcataggagagggtcccagggctcaggcgcaggaggagtcgcagggcgtggggtgggaagcagctgcccagtggggatggggagcagggagcgctgccttgagcgctggaaattggcgcggctccccctctcccccgcctgcccctcctccacctccaccccgcccactccccctccggctccggcttcgggaaattacatccccgctccgcggctccccccaacccccaccgcgccccggagccggcgcctttataggcacatttattgcaataataaagtgaggcgcggggcggggggcgggggggcagtcgttcccgcggggaccgcgctggctccaggaagcagggaaataaaataaaataaaataaaataaaataaaaattcagataacggtgagccttgcgcggcaggccaagagaagtcaggcaggcaggggtagagggagggggcgtccagcccaagggcagagcctaccccaccccaccagcggtccccgccccctcatgcagtggtagggtctggaaagaggtgtcttcgcttcaacctgcctggccccctcccacagcctgatcctgcctggtctttgccttgccctctggctcctctcccatacctgtcctcagcccctgtctctgtccccgtctcctgtgtcttcccttgtcccccatttcccattccagtctccctttgagtcttccatccccatctcctgggtctctgcatccatcactgtttctgcccagtaaccatccccatcccccatctctgttttgccccaccctgaccccatccctgcctgtcccctgtgcttatccctcatccaccattcctgtccccatgctgcttcctggactgttctgtagcccatcttcatttctctggtccttaccccatccacatctctgtctctgccccacgcctggccaccatttctattctgcttctcatccctgtccccaggcctatcctcattgtatcctcatccctgtactctatatctgtgcctgccagtccccaatcccagtccccctccctctctgtctcagtcctcaccccaggctgtcctgtccaccccacctctctcctcacccacatctctatccctcgttcccagccagactccaccggcccctattgcagcacccctgcctctttctaggtgcaggggctcaggatgctcttttctccccttccccagcccaggcctggactgtcccttcctccggccagatcctgggagcaccctgcctgacccaggtggtaggggaaaagcaacgggccagcctggaggcccaggggaggtgcaccctgcaatgcggctggggggctgacagcctgatcctcccccaatcccagcagtgtcatccccaaagagccactccccgaagtggagtttgttgcccccagcagcaggaggccacctcaactccctgcaggtgcgtgggcccgctgcctcgggggtaaagccctcctggtgcagctctccccgctccccgaatgggcctgaaggagcctgctgaaccccccagctgccgcgcacctccgccccgcccccgcgccgacagcagcgctagcctctcccctccgcaaatgtcaccgcgcccaattagcttaattaagccagctctggagcaagggggacccctcctcggacaacatcctgctcccaccctcagccatggaggtgggcgacaagagctctgggcagaggagctccttaccacctgccttcccaactcccccacctccccccatgttgctggagacagacaacctgaaggacagcaggagagaaccacagacagagggagaaaatcagaatcatgggaggaggaaatttgagacagagacagtgagaaaagagactgagagacaaaagagactgagagaatggggagggagagatggaaaaacagcacaagagagggagagagagcacgagcaatcaagggagccagagggagg

SEQ ID NO: 89 - DNA, 29826 bp, Homo sapiens
aaaatttataggaagaaccaaaagaataaaaacacaaccatttttataccccatgttcatcgaggagcagcctagcgacgtcgatgtgcccacactggattgcgtccatcaaggcggtgacgccacagttgtctctgtagtctggttcatattggcacctagagccaaaaccccaagtaagagctgagaaaattcaatacctcaaacccaggggacagttgacacctgatcacctgcaggtgaactgcgtgtgtgcaaatgacctgtgagcatggagctctctctattctcccccatctcagtgtccgaactgagcactaagccttcaggagcgtgatggtcttccctagcagacctgctgctcctctaaccttctccatcccatttgacagcacttggtctcttcagcttcctgcaccagagacctggaagccaccccttgccactgcctttcctgcatccttcataatcaattgattacccccatccttcaattccacagccaaaatatttaagacatctgtgtctgagctgggcacagtggctcacgactgtaatcccagcactttgggaggccgaggtgggtggatcacctgaggtcaggagttcaagaccagcctggccaatgtggtgaaaccccgtctctaccaaaaatataaaaaattagccaggtatggtggcatgcacctgcaatcccagctacttaggaggttgaggcaggagaatcgcttgaacctgggaggtggaggttgcagtgagctgagattgcaccattgcagtccagcctgggtgacaaaagcaaaactccatctcaaaaactaaaaaaaaaaaaaaaaaaaggaaaatcctcaatgtggctgatagcattcattctcccaccccttcactgttcaggctcagcatattctaggcgtcttttgttttcttaaatgtaccacagttgttcctggtttggagcatccgtgggtgctgttattgctgtctggaatggtcccttgcctcccgctttcagctaatttctttttctccttcaggtcacagcttaaacactggcgctgagattctttactcttaagccaaattgggtcttcccattatttgttctgtagggatcctgcaagtccttgtaatgcacaacagactttcgggactccttcatggtctgtctttcctgccagtctgttgagttccaggagggtagaaactacatgtgtcttctttctgttgtggcccttgcacctggtacagggctttatttattttttatttatttttttttgagacagagtcttgctctgttgccaaggctggactgcagtggcgcgatctcggctcactgcaagctccgcctcttgggttcacgccattctcctgcctcagcttcctgagtagctgggactacaggcgcccgccaccacgcccggctaattttttttgaatttttagtagagacagggtttcgctgtgttagccaggatggtctcgatcttctgaccttgtgatccgcccgcctcggcctcgcaaagtgctgggattacaggcgtgagccaccgagcactaaatgaatgtataaatgctcgttgaaaaaaatagagaaatggatgattttgccgctgaaaacattttccccagatatttgttatttttgtttcatattctttatctgctatgtcttttgttcatttttcttttgaaagcctaatttttttcttaaaaatgtgtctgagctctttatgtagcactgatatcaactctttgtcatagttagcaaatattttccctgacttgctgtattgttcttacctcttaagaagcaccttgactgcctccaaatggccatgcattgctgggaggagaaagaaagctgagaattagagctttttagtgcacacacaaaatgcttcctgcctcctggctttgctctctgccccgttctattagtgatagcttacaagaaggagtcattaaattgggtacactgttaccgccctacacgaataaatatttaactggataaagcggtaaacaataatgttttcactttatatgtacacagccaacacttgattatcttatcttcacgtgcactttcatgggaaactttcaatcctaaagttacacttctgtgctgtggatccccaagactagtccatttttgcccaggaaatgcaaaatattgtaacagtaatccatggcaaaatagcctggatttaattcccctactaaaagtaactatactcaaaggttatgactatttgtcttccactattttgggtgaatgatggagtgctgattgtttctccaggggagaaactggtcaaataattcatgagctaaaaaaaagttttctacttacttaagaagttttagaaatgattccttggtccctaattgccaactgtggctcatgcctgtaatcccagcactttgggaggccaaggtgggtggatcacttcaggtcaggagttcaagaccagcctggccaacaaggggaaaccccatctctactaaaaatatgaaaattagctgggcatggtggcatgcgccagtaatcccagcttctcgggagactgaggcacgtgaattgcttgaacctgcgaggcagaggttgcagtgagccgagatcgtgccactgtattccagcctgggtgacagagcaagactctgtctcaaaaaaaaacaaaagacaaaaagcaacactataaaacatcacaagtgatgatttttagagaaactaaaagccctctatcctaatcaatgtactacctagaaagctacaagttatattctgaatttcttaatctagactcttgagctccttaatatctaacttctgaaattacagtaattttactttttactaattgttttctttttactttcttcaaacaaatgagcaaattgaaactttttactaaaataatctacaaatagataattcagagttaagagtcactactccaaataataaaaactgtaacccaaatttacattagatgttattgggccaaggtatttaattatgagtatctatatttatttaaaagtatagcactatggtaggtgttactaaggctatgaggatatatatttccctcctgcctttaagagtaagaatgtaaacatgataaagaaaatagcactaaccagttattttgtgctatgtgccaagcattgtctaaaggatttacatacatcatgctctttaaactctacaacaaccctgagacataccatcactgacattattatttggttgatgaggaaacttgctcaagagagagactaatttccttacccaaggtcaaagactatgtgctacagaaccagctcatgggcaaataatctagggaggataacacagatacacacgaaaaataaattaataccacagcatgctagccaagttatgttaactttagaaattgattatatgccaaaaggcccctagatgctttttttttttttttgagatggagttttgctcttgttgcccaggctgtagtgtaatgtagtgcaatcttggcttagtacaacctctgcctcctgggttcaagccattctcctgcctcagactctggagctccccagtagctgggattacaagcagccgccaccacgcccggctaattttttgtatttttagtagagacggcgtttcaccatgttggccaggctggtcttgaacgcctgacctcaggtgatccacccgcctccggcctcccaaagtgctgggattacaggcgtgagccactgcacccgcgcccccgcccccaccccctcccccccagatgttcttattctctgccttctgttttccaaaatcctcctttcccctgaaggtgacctgaacaagatgcggttgggcagtgctgggtgaagcagccacatgtgtgtactgctcacctgcagagctgtaggctgtacctgcagtatgcagaggagtccttctaattttgctctctgtcttccaggcacctgggcaaacagtgagcaggtactggaggatcagagggtcgccttctcgactggcaatgtggaaactgttccagccatctttgttcttcaggagtggattggcgccatgttccaccagctcctggatcacccccaggttcttccttgtgcaggccatcatcagaggagtcctaaggccaaccaggagaagctgtcagatggaggcagctgagacattagaagccaggggccaggtcttcaaaacacacacatccttggcacagatggaaaacctagaggattcaggggtctggcaggcaggaaaacagctttgaccggcaacctctgtgccttctgtgaggaccctgggagaaataataaggggaaaatgattgtaacgaacgtgtacctagaggagagggtgcctgggagacaaagcagcttataagctagttcacaggatagcagtgaattggagcagagctaagaaaacccacagacaaccctcaacacataacgaagtctattcccctgccccagtggggaagatgtacttccctatgttcctaaagatgttcacgccctctaacgaacctgacctagtgagtactaaaatcagtgtcaatctaacaaacgaaatgcaattggcttgtgtgatggtggagcagagtatctctgactgtggtggttatgcaaggctgcacgtatgtgatacaactgcactgtgctctacacacacgagcgcgtgtataactcaggaattctggatattgattggagcaatgccacttgaaacaatgcattggtgcagaagtaacttagctaaatgtccccagaacatcgcatccggaggctatctgtatagtgcacacacttcattgtttggtaacattctctttggttatattctacactattccgtgctctagaaagggaggtgactgccccgaccagttaacccacaagggcaggaacgagggactctgcaggtcatctgcgttataagggaaagttgggcaggaggtccctgccgctgagcaggcctggggtgagaactaggagctgagaacagctacggtgtccaaggggacggagaagcacagggaactcgctacgactctgcgagtagaggggaggcggggtgtctttccgctccacacctaccagtcggccttcttcaggcagtcgaccgctgccccccggcccagcaggtagcgcacgcagtctcggtggcccatggaggccgcctcgtgcagaggccgcttgtagtctcggttggtggcctcgatgtccatgccccaggcctcggccagataggccagcacgtcccgatgcccgtggcgcgcggcgcagtgcaggagggtatccccggccggccccgggcagcccccggccgcctgcagctcctccttcagggcgcgcagccggccctcctgcaccagcctgcagaggcgccgcgggtccccgggctgggccatcgccgcgggtcgggccgggctgcgcggggaggcggcgggcgggacaccggcggccgggcagggagaagccgagggcgagtgggactttccgcctcttcacgcaacctgccccgcgcgccccgaacccggcagaaccgcccctcacgcccccggctttgtccccggcagagccgcctcctcaaacccccggcctagtccgcaggcgggctgccccctcacagccccggcctgccccgcgtgggagaagccgcggttccgggcacggggcggtttttcctcagggacggagcggtccgggatgagcacggaggggcctggggatccgagagcgctggcgtccgccgtcctggagctgcagcggcccgtacgtgattcgggactgaacacgtaagggagtggggcgcgccgctacaccgcaaagccccaaagtggagggtccgggagggcgcgcacagcctcgcccggcgccgtgcagggtggctcctgaggcagccaggcccaagcgtgacctgccccgcacgcgtcctcagggccgccccagcctccagcccctgggggccggcgttcctgggctccgcccccgtccccgcccctcgaccgccgctgctccgcggggactcggggagctcgaaggaactctgggaaagtttcccgctccgccccggcccgagcggaagcgcggatggggcgtggcccggtagctgtggccgcgcccccaccgattgcgcatttcgattggcgttagtggccgtccgtcagcacgccccctccggtctcgcgtcccgattggtcgcgggggccgtcagtccggctccggcggcgggcgcttcccggggctgcggcggggcggagctcgcggaggaagtcggcgggcgtctcgggctccaggtcccggccagaggaggagctcgctgccgggggacgctgggctgagcggccggcggcgcgggcccggcggcggcggcagcggggtccgggtccggagcgccacagtgcgtgaggccgcagacgtggcagggagtgtgggaggggctccgccgtgtggaaaacttaacctccggggtcctgcgcggggggtccgggcccggggtggggcagcgggggccccgggggcgcgaggctgggctcgggcaagcgcgggcgtgggggctcggccgtccgggccgtgggcaggtggagggcgcggcgggggtgcgcgggggaggccagggcgctcactgaactcggtcgggagcggcccccgcgctgccccccgaggccaggaaggcgcagcgtgtgggtcctcggggctgaaggggcaagcgcggggacgtggcctcggctgctaggaggccaggctttcccgtctactctgacgttttgaccttgggcaagtcatttttcgctgccctctgcccctgtgtcatcggtagcttctctgcccctcctctgagcatgggaagcctaaggcgatgtgggaggcctggcgctggtggagggcacggcgagagctgggcaggctgtgggtgatggaagagatcagtaggtgttgggttccttacccgatctgattaggtgccagtcacttaacctctccatgttttcgattcctttagggagtagaatgggagtagctcctatttgccaggcctaaaaacgagtgccgtttacattttttattgcagtctgtggtccgaagacaaccctatgaggcatcagtagggttttacaggtggggaagtggaggcctaaccaagtcagtgactttcttacagaattacaggtaataaagtcttctggaaggcaggatggtagcatgtgttgagtgtccgccagcgtctgccgctgtggtaaaatgagcggagataaatgaaaagacttctggaatgggcccatgaagataagtccgttttactcatgagcagattgagtttggttaaggtaacagtgatgtggatagcctctggagacagaactagtccaagtaccagctttgctcaggttattgttctgtcgtgccttgtcactccagcaaaagaaaaaaaggaaggcataaaagttgtttgaaatgcacaaaagtgtagggcgtgccaagcagtgttctgctgccgttgaagttagtgcaaattggaagttgaggcatctggtagcttcatgctttttgcttttacccctgcccctctcccagtttcagatgactatcttctcttgcattatgtctctagtttccctgttttttaaacataattgggacacacgggttcacagtaggttggaatatatatatatattttgagacagagtctcgctctgttgctccgggtggagtgcagtggcacgatctcggctcactgcaacctccccctcccgggttcaagcaattctcctgcctcagcctcccgagtagctgggattacaggcgtgtgccaccatgctcggctaatttttttgtatttttagtagagacggggtttcaccatgttggccaggctggtctttaaactcctggcctcaagtaattcacccagctcggcctcccaaatgctgggattacaggcgtgagccaccgtgcctagccaggttggaatatttgaacccaggataattggttacttcattggtgttgcacattcgattctgcctcttgtgtcttctctatgaaccttctttgctctgtatccccctttggataactaaatgataatgtatgtgaatctgtcccgcagctcctgtgattttctgggcaaaagcttggtctagaggggcgggatctgaacagtaagctaatggatggagctgtttcctgggtcttgctgttttccggttgggctgctcatttctttcgtgcagacttttggaggttgtggtctggcctttacagtcacgtcacatgtagtcgtcattggcaccgacttgctccttggctgcccttccttttcctcctgtttttcatgggtatgctgttgagcatgcccattggtacactgatcatttgacaggtttcgtgatttgtgagtgtgtgtagacaccactattggtattagatttagaattctaattttgggtttgttgacatcatctttttgctgcttatctcattcctctatccctcctaggctgattttatttggaaactgaatttggattccatctttgcctttctggctgtgaaattacctacttttagaaagcatctcaaatcttatatctgtaactgtcattcacatgccttttgaagaccagtctcagatttcagaggacctcctggagcataaacatggtattccacagataacttaaagccagaaattatttttaaaactaggactttcagcctccctctcactccgggggaaaaagtgattaaaacacaaacactgtttctcttttattccttaacatggttaatgacattaacatctctttgaatgttctactagaaatgccagttatccttgttgctctttatcttttatctttctgtcttgtcaaacaaagccatgttcttatgcacctgcagggtctgctactctcaggcctttgccaattctcacataggttgatatggtggctttctgagttgttttcctgacaatctccatgtctctccaccttctatcctctctcccgagtcactgtcctaaagtgtaaatttgattgtgtaatgaccctgctttaaaaattggatgaggccgggcgcggtggctgacgcctgtaatcctaccactttgggaggccgaggcaggtgtattgcctgagctcaggagttctagaccagcctgggcaacacggtgaaatcctatctctactaaaatacaaaaaattagctggctgtggcggtgtgcacctgtagtcccagctactcggaagactgaggcaggagaatcacttgaacctgggaggcggaggttgcaatgagccgagactgtgccattgtaccccagcctggaccacagacagagtgagactctgtctgaaaacaaaaaacaaacaaacaaacaaaattggatgataccttgaagcccctacctgataaagtccaatttctttttttgaagcccaatttctttatcattatgtgtaaggacctttgtagtctgtggctccaaattccttttccagccttatctcctgtcattcctcatcagggaacctcttgttttgatgaagcccagctttcctgccactctagtgcattgttaatgcctctgtatttttgcacacattgtttccttccgccttactgaatcccatgattctttcaagactcaactcttcgtgaagcctttttcaacttgcctaactctatttatgtttctttactatcataacacttcatgcatgcatttatgtagttgttatattactttatctttagtaacttgtgtttgttttggtagctgccttatgggtaggcttattcacttttgtatcactaatgtctaaaatagcatttaacaccaaggataccataagacaaagctctcatggagtttaaaatgaatctgggacatagcagatacgtaaaagtagttgtggaatgaattgactgtagaaaaagcctttcaaatatataaaattatattctagaccataagtagtgatctttctcttgtttttcaaacattcctttctttctttaggaaaaacatagaacggaaagcccagcccatccttgttggctgtcatacacgagtgctgtctccaagggagtcacaggtgtctcagatgtgagaggatcccggggagattgagcttactgcctgggaacttttggatttctggagaagcaggctgtggtagcctggctctgcgtcagtgaatacctgggaaaggagctggagctctattttgcttgctttctgcattcgtttcttttagagctaatggggacacaatattttgaagtttttccatttcgggtctacagcatttagtggtattttccttatagttatgttttccaaatacttctcaatttctttggttctgacatttcacaatgattttaaaaaaatgtaatatggaaattaaacttgaggttttcagaagctgctttcaaggtgtctagatacagagtgaagaatgtcacagtaggaagtgcactggactaggggagtcaggagacccgggttcttgtgttggcaccatcactcatgagctacgaggtgacttcaggcaagtcctctctgagccccagcttaatcatggcacaattgtaggattgctttgagggtcagacgagaatataggaaagaactgcaaaagctgtaaagcacttaggagctctgggagagttgagagcttcaaagccaaggaagacagcccacacttcagaagaagtgctgcagctgcacatttgttcgtttaatcaggaattgtttatgaagcaatgtgtgttacatgctgggtgtgagtacctctctactccttcccactagagcagagagcttttagtctgggatggaagacgtattaaatacagacttatacaaataattgttattaatataatatgtaatacagtgcaattaaaaacaataattcatataagacacatgttaaatgcacacttacacaaagaattgttacaagtatctcgggtgtacagggcggttttattcctgcgaagtgcttcctggcttgagtgaatacttttatggtgctggagttgagagataacacagttaactgttgaaattgggccattcccgtttcacaggctgccattggacctgtcaagtgcctgagtcatgtgataatgggctacattgcgcagggcccctgggccatctccacaggagatgccagaggacgagtgcccacttgctggtcttcacagagcacgctgaaagtaagaggcatgtgggaaactgaccagggcggttagctgactccaaaattgtccagattagcaaaactgccctctgtggatctttgttaaagttgggtatggtattgtagcagtttctccagtcaggtaccttgtactagcgagtcaacttgatttttttttgaaaaagcaattatttaataataatatttacttccaggaattctaggtacttattgtcttcatcttgtccatttaggtctgtaacctaaaagttttaaaggactttttggtatgaattctgattagtaaaggtagaggaagaaaggaaattatttggtatccatttcaaatgatcctgaatggttagggtaagctttgctgcagtgacaaatagatccagacatgtaatggcctcacaatagacgtttatttttcaatcccataacaatctaaggaggctacaggtcatggtggtggttggagtttgtgtgtgtaggtgtggggagggagggttctttttaaagcagtagtccgaggattgaggctgctggaggctcttctattttgaacacccggcttctaaggatgtcctgggaatcagcttcccagttaaggggaagaggagaagagtggagggcaggtctggaagaggcgtgtgctgctgctgttcccattgcattggctggcacccagcggtaaggcgacatccacctgcacgcaggactgggaagtatagcccagctgtgtgctcagggagaagagcaacaacattctttgcagcaaaacctgaaacactcagtttcactttctgtgacttgttttgtaagttgttttcaataaagaagattaaaaaaagaagccaggcaaatgaaagcataggggaggagtggcagacacgcagttctcactctgcgactgcaggagtgtctcttgtttcccccttgtgcactttgaggaatgaggggatagacgtggtcccttccttttagttccccgtagcagagttcttgtaaggactcgttcaggggagactgataagggtctcatctccatcgggggacctcaccagggcatggagtgggtcagagtgggctgggaggggatagactgtcatcaaggtgaagagatttgaggggtggtggagggctaaactccagatctgaccacttcaaagtcagcaaaggccaggaattgctggggtagggctaaaagctgagggttagcaaagagaggtgggtcctggaatggggacccctggggtggaggacagagaagtcacactgttagaaagccgtcacagaaaaggcagtgtgggaatgagcttacttaagcctagggaatattcatttgacaaaatggtttgtgtacattctggtttttctaccctgacacctgagggctctaacacatttctgttggttattgtggaagagagtgtccaagggtgggagcacagatgccgaatttggtgtgtaggagaccaatttcaacaactctgggggccttgtagagtttgcaaagccccgtaagtgattctaatctctctgcacccacaagaacccctagtttagacacagcttccctttatctgtggtcattcaccacagataatttcattccctaaagaatcacaagcagcttctaacagtaaatgccctttacaggaggtgtaaagtgcacttgctgtgtagagagggaggcataccatgagctttgcgtgactcagggaaggaggatttttatggaagaagtagcatttgagcattcttattttgataaagttatttttgaactgctttttaaaaaggtatattaataagaatagaagggtgattagaattctagtgtagtgttttggttttatttttaaccatttagcaagaacattaatgctattaaaactgatgtgccttaggagaccctcagattggtgtggtagtcacatatttcttctgacgtttctgttgctaggtgttgacatagatttagagataggtgttgtcaccctcaatgtgggtggcttgagtacttacatatatattgtctcattctctgaattcagcatggcaggttattataatcctcgttttcataagcaaggctttggcgatgaatatacctgccaagtgtgggtcttctcctgcaccccacagcctcggaggggctttaagggaacattaagtgtaaagcgtgtaattgcagaggaggtggacacagggctcctgcggaggaggtggacacagggctcctggctcccagttcagagcatcacagcacctctctctgagaccagagatacaggttagttttcctgacctccagctgacgttagaaaagttatttttgatacatatatccaataagtccaaggggtggggaatccaataaaagtgttaataaaaatccaataaaagtaccagctctcccgccagccaaactatggctggtaacgccattccagttatataggttacttatcttagtgcacagaggccagatcaccagtctaagcgcccctcccccggtaccgaacctcagttcctcccagggtggcttcatgccagaacatattggaatataccgggactcccttgaagcagaacacagtgttccaacactcccattagcactttctgttactcctgtgtctttgttagatttctgcaaacacttaatcttcgcaacaagcattttggattcagacgtattttctgagataaatacataaataaaaatctatcctgttcatattaccttttccaaagcagttccctttgggactgaacatttttgatgttctgtcatcagtctgttgtgagctaccagggaggtctccctgtgggagcagttctgtagtatattcctagggattagagtgtaggctcctggacctcccagccgaattcttctccctgctcctcatccttcttgacccactcagtattcacagaacgtgtgctgcctcagtccatttgggctggtataacaaaataccataactgggccgcttataagcagaagtctctctcactcacagatctggaggctggaagtctaagatcgaggtgccagcagatttggtgtctggtgagggccgcttcctggttcatagacggcaccttctctttgtgtcctcacatggtggcaggagtaagggagctctctgagacctctcttataagggcactaatcccatttgtggggactccacccttgtgaccttatcacttcctagaaccgcattttttttttttcttttgagacacaatctctctccattgtccaggctggagtgcagtggcacaatcttggctcacagcaacctccacctcccgggttcaagtgattcttgggcctcagcctcctgagtagctggggttacaggtgcccgccaccacacctggctaatttttatatttttagtagagatggggtttcactatgttgccaggctggtcttgaactctagacctcaagtgatccacccaccttggcctctcaaagtgctgggattacaggcatgagccactgtgcctggcccagagccccaccacttcataccgtcaccttgcgggtgaggatttcagtgtgtgaatttcagggacatgaacgttgagtacatggcacagactatatgtctggccccacgctatctacatacagagttacagcagtgaaccaggtgggctagctgcttaccttggggcatgcttactgtcttttcgactctcaggcatgtgatgagacatctccatctcattgatggtcattatcaatgcaccgttgttacagtgaggtggctgcagaaggcttcgataaagccattcttacatacttcacaaaaaacgttccagggttcaccctgcatgtgtaggtacctcttctatacaaatctgccagcctctgtttgtagctgtttccaaaagccaaatgtagaaggccatcatagatttgggtgggcatcagacccttcaactgagcctgattttctcactggttatgtgccttttcgttgactttcagaagccttcggtacctgacacaccattcagctaagcaggcctgcagctggcctgaggtcctgggtctcagatatgagtggtttgatgttgatcttgctcctttgtgattttttgttttgtttgttttgttttgttttgtttttttccttcatgattttatccatgaaagcttttcttctccaggccattgtggcagtagatgttcacctcctatttaagtgagatattcactcttggtaactttctttagtgagtgtctccagttatttattttatttttttccttttttccttacccttcatcaggacacatagtgtctccagttctaattgtagatactgtactgaccagctctgaagcaattgggactgtttgaggagagagaaaagcaggcatgagtccactctgttggatctatagggcctgtggatttgctgcccggagtcctgcagctgctcctgctgttgagcattgtgtggggcacctcacccaggattttcgggtgttctggaagccatgttgccgctctacctgtctcttttgcagatatgcccagaggtccccattcaggcaaaatagtccttgcgttatatttgtaatatgaagggttttgaacacaggaaataaaatttcatcttattttttaaaaagagaacaacaagactttgttttctttccaatgtagaaaacttcaaatttagtttttaatgtagagaaacttcacattcatattttgtttctgtgtgaataagatgatttgctgttgttttcctctaaataaactggtcagcaacattacagaaccagcacaaaccagcacaaaaccatcaaagtggagggggtgtttgcttttctgttcataataagcgagacatgttactggttagtttagaaggtatttccagtaatacagaattggctgtatttgggctgctaatacacttcctgctttgccattaggtggcatctttataatttgaaggatatttcaatgtcttaggcaggctactcacataagccttgttaaatagaggaaacaggtaagtttgtatgcatgcagttggataatttgacagacagttttgagcatattttctcatctgttcctgatgacacttatcagacttagatgagattgggcgcgttcagggtggtatggccgtagacctatcagacttagagacctgaggtgccctgaagccatagagcaaccaagtggccagctgagggtgccagcccagccctcccgccaggccctcgccggctcaccacgctgcgctgtgctgcttcgtgagagtgagcgcatctgtgattgctgaggcctggcgctcatggggttgcacccagcttctgagttcaggtagttagacgatttccagcgtcctttcagaggggctctcagaactgcttttgtttgtagaattgattttggaaaagtcttaaaatattcatgaagtttttttttaaaaaagctggtattaaaccttgaaaaagttaactgaaatttggaagggtgatttctgaattagctagggaggaataatgaaaaaatattgtaaactatatcagctaaatcactggggtcttggctttatgtattttcaagcttaaaggaaatgtcaagctgggcacagtggctcacatctgtaatcccagcactttgggaggccgaggtggacggatcacttgaggccaggagttcgagaccagcctggccaacatagtaaaaccccgtctctactaaagatacaaaagttagctgggtgtggtggagggggcctgtagtcccagctacttgggaggccaaggcaagaaaatcacttgaacccaagaggtgaatgttgcagtgagccaagattgtgtcactgtgctccagcctaagcaacagagggagactctgtctcaaaaaaagaaaaaagaaaaaaaaagaaatgttgagtgagattctggcatttgataccatagtttagtggtggagtattctttattttctttttgagatggagtttcactcttgttgcccaggctggagtgcaatggtgcgacctcggctcactgcaacctctgcctcccacgttcaagcgatactcctgcctcagcctccggggcatatgccaccatgcccagctaattttttctatttttaatagagacggggtttcactatgttggccaggctggtcttgaactcctgacctcaggtgatccacccgcctcggcctcccaaagtgctgggattacaggtgtgagacactgcgcccgacctactggagtgttttttaggatctgtgaaaatatgatactggtagaacctgattttattctcttttgaccatctcctataaaggctaactttaattcttttttttctttttcttttttttttttttttgagatggagttgtactctcgtccaggctggagtgcaatggcacaatcttgggtcactacaacctccgcctcccgggttcaagtgattcttgggcctcagcctcctgagtagctggggttacaggtgcccaccaccacacctggctgatttttatatttttagtagagatggggtttcaccatgttgccaggctggtcttgagctctagacctcaagtgatccacccatcttggcctctcaaagtgctgggattacaggcgtgagccactgcacctgacctaattcttattttttaagaagtgtatctttacattttagtgtttcatgccataaggaggtagctagatcttacatgcagtaacagatgcagaagcatggagagtcttggttacacatggataagaattacctgaaagaagatgagtaatacaaaaccaagtatttcagtaccgttgaaacaaaattctaggcgcaattgttgctgtagtgttttgctaagggaagatatgaagttttctcctctaaaggtcctgaaaaggaattggcttctcttccatttgggggctgggggagtcgctcctgtcctttcaagtcagttctcaataccaaggggctcggggggctgagacatgtgtgccctttggtccttctttcaaggaaactgcagcctgttttattatcatgatgttttgcttctagttatgtgcttttcatgttatgtgctttttactacaattaaaaaaaatttaaccatttaacaaaaaagaaagttataaaagttttttgttatttaaaaaaatatatagccgattcttaaatacttttgattataatagaaatataaatggcctggagaaagttaaggaacagatgccaaacctcagtatatccactagtgacaacttctttttttgctgtgtcgcccagattggagtgcagtggtgcgatctcagctcactgcaacctccacctcttgggttcaagcgattgtcttgcctcggtctcctaagtagctgggattgcaggtctgcaccaccacgcccagctaatttttgtatttttagtagacttactaaaaatgtcttgccccctcctccacctcccaaagttctgggattacagacgtgagccagcgcgcccagccacaacgttttcttaaatgagcatttcatgaccaagtcttctagaaagtataagtagaaaaaaaaacttaagatcttaaaatgtcacttaggattcttcaattctaaggaagaaaaatgcgaagaaattgaaaggacaaagttggggggcaaggggaggggggaacggttggctggggtgttgacaaaatcgtgtcactatgcagaaacttgagtataatgtgctggctagcttgtagaatcggtgataactaatgaatatcccctttcttctacctgctggtatgaaacagtgagacggtttaagcggaagcatcttactgccattgactgccagcatttggctcggagtcacttggctgtgacccagcccttcggtcaaagatggacaaacagagatccgaaccatggtctctatcctaaaccgagaacaaaaagagggagtaggggtatgtctcctctaaaactcttgcatttcaaaacctgtagtgtgtgggtcctttgactatctcctagtttaaaagtatttgtaaatgttgctgctgtgagtttgtagtcttcatgcaatagcttgacactttttttattgtgagttttccatgaagttttttttttttttttgagacggagtttcaatcttgttgccctggctggagtgcaatggcgcaatctcggctcactgcaacctctgccttttgggttcaagtgattctcctgcctccgcctcctgagtagctgggattgcaggtgcgtgccaccacccccagctaattttgttttttagtagagacggggtttctccatgttggtcaggctggtctcgaactcctgacgtcaggtgatccacccgcctcggcctcccaaactgctgggattacaggtgtgagccaccgcgccccgccgagttttccatgaaaattctatcctattatcatagtttgtaaaagctgtggacaagtgtgatggaatgaatcctattagcttgtgtaattataaagtgatagaagacatgagccagtgtcactcttattccaatccagaaacactgagattagttgactcttcattcatcttctctgtccaatctgtcactaggtccatgtgtcattgtttttcctccaaaatattccttcatcctgagctctttgtcacctaggacctggactactacagtaaccttgctccttgacttcagattttatctctgctaaatcaactggaatgtccccactatgtaccaaatgaattcccactttagttaataaatctagattgccttatttccctttgatacaactaatttcagaattcaactcaaatattatctggttgtcttttttttttttgaggcagggtcttgctctgtcatccaggagtgcagtggcaccatttcagctcactgcagctctgcctcccagctcagcctcccaagtagctgggacttacaggcgcgcgccaccatgcctagctaatttttgtatttttttgtagagacagggttttgctacgttgcccaggctggtctcaaactcctgggctcaagagacccacctgcttccgcctctcaaactgccaggattacaggtgcgagccacctctcccagcctggttgtctttaactattgtatgtttcctgctgtgggaactactataaccaactgtatgaggcagtttgaaacttacttatatcctgtctgatactgagtttgttccatatatagaagtctgtttcttctctattttgagttttttactgacaaggacttgtgaggtggccctgaccacgtggtgacatctcagtgactgtgggtgtgactggattcaacagttggaagataccaggatttggctgggagcagtagctcatgccttatttgtaatcccagcagtttgggaggttgaagtgggagaattgcttgagcccagaagtgccagcccagcctgggcaacataatgagaccccgtctctattttaaaataataataatattttttaaaaaagaaaatgctaggatttaaccctgatcatatggatttaacctgtagtaatagtgaagtcaaaactctgggtttctatcagattgcccaagaaacagttaaccgttataattttttttttaaattttactaatatagaaaaatatctgtttcagtttcataaattttgttaaaggctaaaccgagtttcagtccattctcttccaaagtgaatattttggatacagccatttagaaaggaactatgtattattgataaagtgtttacttctttggcatttaaaaataatttttaggagtttgaaaatgttccctatgttcctgaaaagtctgtgaggtttttcactttacatttgtctcagaatcattggtgcttagtaaatgttcactgaacaaacatgtagaagagattaggtaccactctaacactataaagagaattctgagtcccgactttttattttaaaaataaattaatgtgtcaccttcacaggaagaaatacaaataaaagctgggcgcaggggctcacgcctgtaatgccagcactttgcgggaggccgaggtgagtggattacttgaggtcaggagttctaggccagcctggccaacacggcgaaaccccatctctactaaaatacaaaaatgagctaggcatggtggcatacgcctgtagtcccagctacttgggaggctgaggcaggagaatcacttgaacctgggaggtggtggttgcagtgagccaagatcacaccactgcactccagcctgggcgacagagtgggattccatctaaaaaataaataaatacataaataaaaaagaaataaaaataaaagttttagcactgtcaaatgagaagagtgagattttccgaatcctgatgaccccaagcatgtgaatttctgcttaagcacatgtagacttgctgttgtagagttagtgggagcggggcactttgtgagtggcggtgtggttgtgagcagtcacctcctttttgtctgtccattcagatgttccctgtgcagcgtgtttctctgtacttgtttttactgcagggagtattgctggccatcacatcatgtgaagactggtctctgtctctttgcaaatgtgtgtctggtaatatgatagagccaaatataaatattgtttggattagttatttatataatcagttggcccataaatgtgtttttatctctttccactattaacatagataattgaaaattagtgtgtcttatatggattaacagcaggtcaacagtcatcgttcatttcttgtccatcctgtttgggttctctctacaggtcagggaagtcaaagatgcatccctgagttcttcctagcaggcaagcagccgtgcaccaatgacatggccaaaagcaattctgttggccaggacagctgtcaggactctgagggtgacatgatctttcctgcagagagcagctgtgcactgcctcaggaaggcagtgcagggccgggctcaccagggtctgccccgccctccaggaagcggtcttggtcctctgaggaagagagtaaccaggctaccgggaccagccggtgggatggagtttctaagaaagctccacggcaccatttgtctgtgccatgcacaaggcctagggaggccaggcaagaagcagaggacagtacgtctcggctctctgcggagtctggtgaaaccgaccaagatgctggggacgtgggtcctgatcccattcctgactcatactatgggcttcttgggaccttgccctgccaggaagcactgagccacatttgcagcctgcctagtgaggtcctgaggcacgtgtttgccttcctcccggtggaagacctctattggaacctgagcttggtgtgccacttgtggagggagatcatcagtgacccgctggtgagtgagtgctggagtcgggagatgtttcctctaaaagcacgtaactttgcttaatgcacgcttataatcagaggatcttttcagaaatggtttccatttgccttcagaagacattcagactccttagaggcatttaaggccttccgtgtctgccccaccctatgactctagcctctttgttcacttccactcaacacagcttccctgagttctgtctacagctcatctgctgtgccctgaccacagactgcacattccttcccctccctgggttgctctcatcctcccaccttccccacctggagggttcctcatatctcccttgacttctttttttttttttttgagacagagtttcccactgttgcccaggctggagtgcagtggcacgatcctgactcactgcaacctctgcctcccaggttcaagtgattctcctgcctcagcctccccagtagctgggattacaggcgtgcgccaccacacccggctaatttttgtattttcagtagacatggggttttaccatgttggccaggatggtctctgaaactcctaacttcaagtgatctgcctgccatcagcctcccaagtgctggggttacaggcgtgagccaccatgtctggcccattttttgtttgtttgtttgtttgagtgtaagcatttatagcaataaacccctctcttaaaacagcccaacagcattcattgcatttcataagttttggtatgttatgttttcattttcatttgtctcaagatattttctacttttctttgtgatttcttctttgacccattggttgttttaagaatgtgttttttgttgttgttggtttttttttttttttttttgagacagagtcttgctctgtcacccaggctggagtgcagtggctcgactttggctcactgcaacctccacctcccaagttcaagtgattcttgtgccttagcctcccaagtagctgggattacagacatgtgccaccatgcctggctaatttttgtatttttaggagagatagggtttcaccatgtaatccaggatggtctcaaagtcctggccttaagtgatccgcctgtctcagctgcccaaagtgcagggattacaggcataaaccactgtgcctgggcaagggtatgttgtttaatatccatatatttgtggatttttcagttttccttctgctattgatttctggttacattccattgtgatttaaaaagatacttcatataataacttaagtggtttttaagtttgttgaaacttgttttgtggcctaacaggtgatctatcctggagaatgtttcatgtgcccttgagaggaatgtatattttgctgttgttgggtggagtattctgtatatgttcgttcagcccgcttagtccatagtgttgttcagatcctctgttttccttatttatcttctgtctggttgttccatccatcattgaaatagcagtgttgaaatctccttctattattgtgttgctgttggtttctaccttcagttctgtcaggggttgtttcctatatttaggagctctaatgtgtggtgcatatatatttatagttattatatcttcttggtgaattgacccttttatcattatgtccttcgtctcttataacagtatttaacagacagaattgacttaaagtctgttttgtctgatattagtatagccacagctctcatattattttgttcccattgaaaccctgagttacgtgtactaatgtttcagacagggaaactgaagctatagtttttcccagattctttaactataacaagttagtgttagaaccaagaccaagacccagttctcctagtttccaacaaaaatttgtgtaacatttctgcctgattttcctggcttttgaattgtgagctgtgattgcttttcactggtaaaaggttatctatgtgtttgtggcttaatctgctttttttctttctttttttttttttgagatggagtctcactctgtcacccaggctagcgtgcactgcagtggcttgatctcggctcactgcaacctccgcctcccaggttcaagtgattctcctgcctcagcttcctgagtagctgggactacaggcatgtgccatcatgcctggctaatttttgtattttttttcagtagagacggggcttcaccatgttggccatgctagtctcaaactcctgacctcaggcgatctgcccgcctcattaatctgctttctaatggccctttgcctcatgttattttgtttgttttttaactgcatagttcattccttggaagaagctgtaccatcgatacctgatgaatgaagagcaagctgtcagcaaagtggacggcatcctgtctaactgtggcatagaaaaggagtcagacctgtgtgtgctgaacctcatacggtgagctttgcctgtgctgtaaagaaggcgtctttgaagtcttccttgtacatcagtgcttatggtcaccctactcatggcctctcctgtgaatgtcttacagatacacagccaccactaagtgctctccgagtgtggatcccgagagggtgctgtggagtctgagggaccaccccctcctccccgaggctgaggcgtgtgtgcggcaacacctccccgacctctacgctgctgccggggtaggtctggaggctgcgggagaaggcggcatgttatttcactggaggaaagtgtactggtgattcagttcaattgaggatgactttatatttatttttaatgtctgtatttaatctctgaatgctttgaagcattcatgttgtcattgtccccagtggagaaataaaaggccatataattgtagagtcttagatgtagatgaaattttaacaaatcatttagtctgatttcccatttggttgaggaatcttctctgaaatatttctgaaaagtggtcatctagcctctgaacacttttaataataggatttctttacaagacagcccaccccattatcaacaagtttgcttatttgaaagggacagaaaaattaggggtcttgctatagtcacacaatgaggtaatgagaagctggaaataaccctcagtctccttgaatctcagccctgttgctccttttccagttcagggattcccagattttatcttcgaagctacgtgcaacctctgcgtgtgttttactggccacagagggctgggaacccaggcaactgcatttctgtttctcttgaagaagatgattgctgatggtggtggagtgggtcttctttcacaggatggttgaagtgagaggggatgggatgttcctttcttggaatgcattctttaacacagagacgtgtagtaacttaagaatggtaaaggctgggcgtggtggctcacgcctgttatcccagcactttgtgaggccaaggcgggtggatcacctgaggtcaggagttcgagaccagcctggccaacatggtgaaaccctgtctctaccaaaaatacaaaaattagccgagcatggtggcatgtgcctgtagtactggctactctggaggctgagacaagcaaattgcttgaacctggcaagcagaggttgcggtgagctgagatcgcgccactgcactccagcctgtgtgacagagtcagactttgtctcaaaaaaaaaaaaagatgaagatctgtgtccactattgactgtttctgtgtaagcgaacatttacagagacattgctaagaggagcatgctgtcttcacaaaataaactttccataatttcatatttatttaacttacaatgaacagttattactaataataaatagcaagttaacaccgtcatgctggagaactgccagattttattttccccacagcctgcgtgcggccctctcctgtgtctgcgtctctcatgcctcttgggtgggcgccccttgctggctgttttgctctggccctgccaagcacatatggacctgagagcccccatggcctggagagtagggtggggagatgacagggagctcatatttttagactgtctctctgtccaaggttctatgttagatacttcatccgtgttatttaattaaagaaaactaagatctcaaatccaaaagtgatgagaaggagtccagggcgaacagaagggctcccctgtttcccaaatacaacttggaaagtttggattcagtccagacagtctgtagccagcagctggacccgtggctcggctttcctgactccttcctgctgtgattcgtattaaccatggcctgtgggctgtccctccctccctgtgcacctggcttgcagggtgtcaacatctgggccctggtggcggctgtggtgctcctctccagcagtgtgaatgacatccagcgactgctcttctgcctccggagacccagctccacggtgaccatgccagatgtcaccgagaccctgtactgcatagccgtgcttctctacgccatgagggagaaggggattaacatcagcaataggtaatgccccgggaggaggggaggggatgctgtgataatgggagagtcccagacacagcagcaggtccagccctgccacttagcagtgttagcacctggcaggctgtgggacccacctgctccacctcagtgtcatcttctgcaggagccaggggctgagagtttgatgtggaaaggctggtaagagcgccttatgaacgtgcagttctgagcggctgcgagataccactaaggctgattttaccatcatgggtcctgcagccttaggggaagcccctcgccaagagaagcctttcttattcacccgtggcctcgcttccctaggaaaatgttaggctctacttcctccatatcccacttgtgggatggaaaagactcatccaccttatcctccatgcgggagaggctatggcgtgtcggctgctgattcacaggggccccgatggtttcctcagcagggtggggagtgcctggggggttgtgcatttgacaaacactgaacacctgtgtgtgtccgacagttgtccacgagccggtccactgtgaccggcttagaggagttagaggagattcctgatctagtgagggaagacaggtcctatgtaagtaaatgtgtgaaatggcattttagtgagtaatgagcattgcagagaaaatagaacagagagctgtggggtgaatgctgctttagaggggtggaaaaagcttctctgagcaggtagtgtctgagtgaaacctgagtgtggaggaggaaccgccgtttcacaactgtggggagagcagttcagagaaggtatagatgccttaagggcctgaagatgggaatgaatttgggacatgtgaggaagagaaaaagtgcagtgtggcaagggtgggagggaacacaagattgtgaaggatggacagggacagttgagggatcttacaggccccgattagaaggtagaataaggccaggcttggtggctcacacctgtaatccagcactttgggaggcgaggcgggcagttcgcttgaggccaggagctggagaccagcctggccaacaaggggaaaccccatctctattaaaaatacaaaaattagccagaaatttctggtggtgcgtgtctctaatcccagctactcgggaagctgaggcatgaaaattacttgaacccaggaggcagaggctgcagtgagccgagatatgccactgtactccagcctgggcaacagagtgaggctctgtctaaaaaaaaaaaaaaaatgtagaataaaactcagggtttgctgggcagctgggaagggccttgtccctgagctggagtgatggggacaggtagatcaactgtgcagccatcctggagaagcagagaccgtgggggctgggggccgggggaggggggtcccttccccagggagactggcccctggaagttgcaagcccttaaaggaaggtggctagtggcaccaggggagtgagtggtggccaggcatcggtggcaaggtaccaggaggggacaggattccccagaaatgtccaagagtttgctgatggctgccttcttgccgcatccccacagggtggagagaacactggcgtctcctcttaggaggaccccaattcttgtgtatcagggccctgcccttgtactctcacctaacattaactacttccttattccacacaccacattggggtagcgcttcaacacaggaatttcaagggacacacttcagtccatggcagtatgtatgttgatttttgttgcgtttctttgtttcttcctgttttttctgggagataatataatcacatctgaaatgttggattattaaaggtatttgttgcattggagaggtcgaggcttggagatgggctcttttcgctctggggatggggggcagtgcactcgattgttgggggagcgagtccaagctcacccccggtctcccccacagtccaggggagacttggagaggctttggaacggcgtgtgccagctgagtctgacgagtctgacgatgtcctgtgcctctgctgattgaactttgtcatctttggtccctcttggtgacttggagcctactgttttcaggtccttagtagtcagatcttgttatccatagtgtagtcccttttcttgggaccttaaaagatagaatgtgttcatgcgtctaaagcaatgtcatgtcataagaggtagacagtggagcgaccgaggctcagaaagaggctggtgttttatccacaggtgtagtaagtatcattcaaacaagagtctcagtgctaggagcagtgtttccctttgccttccactggtccttacagtttttcaggttgtttgtctcttcaagtcacagctggcgcccctcattccctgaagagcccgtcctggtctcttcctcctcttggagatatacatagaaactacacctttcccaggactgtgttatctgagaatgctttgccagccatagatatatttaaatccttttctttcttttttccattaaatggtggtaggtattttctttttagaaatgggaaggagtttaaatccatctgaggaaaaataagatgcagattgtgacttgaatttgagactttctaaatctacttttttttctggta

SEQ ID NO: 90 - DNA, 3559 bp, Homo sapiens
agaaggaacaagacaataccttactagagcaaaatgacttcccattatagaacatggtctggcactttcaagataaatgaagctgtaaagttaagttgtgcaattagtggacagagacaggtaatttgtgggcatggaggaggtttccaaatattcacagcaccaagtgatcaaaagctgtaagtagcatttgtgcacttttcttcatacattttacattaagaaaaaaaccatataggttgatattaagcagctaactgaaaatgaactgtccttaaaaagtaagtaaataaaaaacagcacttttcctgatgaatgaaggactgtgaaaaagctgttatgggcttagcctatgtagttcccagcattattttaaaaagatgaagaaaagaatgttgaagtctttgcattttcaatgcctaccaggtgcacctgccactcctgcatttctgggtttcacttttgtccattgctagctctcatttggtctgcaaatgtctgagtatctttcatgttccaggaactgtttgtgtgagatagatgcaatggtaaataagtcaaggtcgtcaccttttaggacctcatcctaccaacttaataggtgctagcagagactcgttgtgtgtctattataggataagtgagtgaaagtcctccttaggtaggtttcatcatctgcacttggatggaatgaatttatgaatgttcttagagacacttatagatctgagaaataaaaaacacataccaagaacttattgttgggatgaagaagagtaaataggggaattttttgggttcctcttctcctcatcctccttacaactcctcctgctgataagatatttagtcctatgattgacccagactgtcattttttggggcccttctctccatgcctgtggccaagccctgcctgggcttgtattaccagggatgactccacatgcttcttgcctgctattcacagaaggccctcttgtcttccgtgctcactgcgtggatggaacacccaggcaatgggacaccaggggtctgtatgtgctgcctgtgccagtgttctgagaagctccctgagactggtttggtgtaagggctgtcagtctgctccacaaacccagaataaattggattggaaaagtaggaaacctcatttagcttttgtgcctaaactttgtatacccaagcactgtttaccaaaaaagttctggatttggaagtagttaagtattcaaaacatattcaactatttatgaaaatgatgcttattattctatgtttatttctctcagcagggaagcccaaagagtaggggagatgaggagtaggttgtggaatcaacacccttcctcctgcctccaaaccacctgcactgcccaaggaggggccattcttttttgggagcccattatgtacttagctgtggatgagggtgtatgtgtgtcttatattcctgcttacattatggatagaagattgaaggtcacacttctgtgggtgtcctactgcacccaaaagggtattttacataaagcatgaataattgcaccttttcccccaaatgtcatatactttgatataacattttgtagagttaggagtcaggctttcatggggaagagggctgggttatgtccagttaatgggcaggcatgtagattatactttgcttttgataggtgagggactctttcaagtactattctacttcctctgtggttagtttttttctcccattcttctattctttttcatctttggggctgtacatcaggggaggagggtgctgcagtttgctattataatgggaaaaaatgagagagaaagcaaagagagtaggtaactgtactcagctttatttattttatccacacctcaagctcttattaggaaagggtgggttcttcttttctttttttttaggggggcggttttcttatagaataattactggtattctctggttgataagctaagagaaaagagagtcagggaaaagtactttactgtttttctatgttgtgttcattggttgtttttgtctgtctagtaccaaactttccaccaaccacataccctcttcacggttcccctccttccttctccaacagggaaaggcaggcaccagtggattcctctgtagtcaagacttaacataaccaggaattcttcctaaaggaagaagctatcaattagctaattatacttttcccatcccaaatttgttggacttctttgaagacaggatgatttaaatgagtggagaaggcttacctgggtggagggaagcagggagtaccaacgcatagagtgggaggaaggttggaaatatgagtgagagaaggtgttgatagtggaaggttgcagagaagttgtctgagaacttattcagagccagatggaggaattgttctactgattctcaagaagaattgagagttcttgcagcaattgttattatgtggttttgcaacttctctataatctcttataagagtagtttctcttagaagcctagtcagtatacctgaaactttaattccacttaccattataatgagaaaataaattgtcttattagattctgtgcaccaaggggcaagacctgaaaggaggatggaacggtgtgtagcggggatggcagttgatctgcaaaatcaggcatggaaattctgaactgttattggagagggaaaaggaacaagctacagttaactggtaaaactcagtcatattataggttaatcaaggccatagactgtgtgcttggtactatggaagataaagtgatatggaaagcatgatcagtgaccagtgggcttgtaatctaaatgtggagacacccagaccttagaaaataactatcccataggattatttttggcaaaatgtcaaatgaacaggtcatagataaatgatttaagaattcagaggaggtagagctcacttctacctggaagggtaagaataagcttttgttgacggggagaggctggaggtggaccttcaagggtgggtgggacagagatttgtcagcagacatgaatatggggtgctgggttgggcactttacacatcacagtgtggatacaacaccctggaaaaaccctatcactcccattttagagtaaggaagcataggctcagaaagtataaatatatgacccaaacttccttaaccattgacaggacaagttatagctgaatttcagacttaagccctctggctccaaacccatcctattccagtaccagtttgcctttatgaccttctatacacagaaatgctctgagaacaagaaagcaagtattttgcacccaggatggaaaccacatcattttggtaagggtacaggtcatttgggaaaaaatgagtgatgagtttaaacagtggtctaggtttggaaaaatagtctagaactattgaaggaatttcaggcagagaatgaggtcagccaaactatgttttagagagaagagctgcaaaaggaatgattttgtagatatggcaaatgtttatttaacttgtagcattttaaactagattacttttagctta

SEQ ID NO: 91 - DNA, 3893 bp, Homo sapiens
agtaaccaaatggtttaacaacctcagtgattgtgttgttctgtagtttgatgacttttatcttgctccttctcattgccattgattgtaccaggttatttcctggagcatgttgtatatcaaggtttatgcaactgtacatttaacctttcagtgcctagctttccccttttcctatagaatcacaagaatttgaaggcaacacaatatgttttctatcttatagtctgaagttaatgcatattaatggcatgctgctattactagttaatactgatgccatgaggattagataatcattgtaaaaaatgtttaatagagcattttttacaatacttagtggatgccagtatactaaatcctttatatatgcttaggtcttttatttcccacaaatctgtgaactaggaattatgaacgcattttacaaaacaggactcgttgcataacttgccaagtcacacagctaatgaacaggagagtcagaacttgaactcagggttgcctgcctctaaagtcctccactaattctcattcattctgtaaaaatagaacatggcctctagaatctcgtcatttagaaaagaacagccttttggagattggttagctggtttgagaacatgtagtttgtttatctgtgtctttgactagtaataacgttcagcctcattaaatctagtaagctaaaaggaagcaggaaatggctgtagtatagacgcttgatatttcagcgatgataatgatggataataatgtgatttcacagcttgggttatcagacccaggtgagtggataagtggattcagattcattaaaatcaccgggcctagtttgtggccttcctttcacaaaccccttaggctgcatattaccctttaatagcatatttttcccattatagttgcccttgctattcatttcaaccacattacaagtataaacatgtacaagggagaggacagatgtccttcccttctgtattaactctcttgttgtatgaaataatgttatgtattaaattattgtctcagtttatagagtctgctagactgtgctgttcagtagaactttttgggatgatggaaatgttcaatgtctgtactgttcactaaggtagcaactagttacctgtgttagttgagcgagcacttgagatatggatgatgaaactaaagaacagatgtttaagtttatttaacccatctaaatttaaatgtaaatacccacatggctggtggctaccttattggacagcagagatttagaatagtaaagctgaatggaccttagagtacatgtaaggcaacacattctttttattttagaggaatgtaggactcagagcatgaaaaggagtaaaaccaagcctaggatcctggtctcttgacttctagttcataatttcttccactaaacttaaaattgttaaaaatgttactttgaactttagtatttgaagattatcgtggtaagactttgcttatatttacaaaagcattgtaacagaaaataaattttgaattacaactgtgactttatcatatttattttacattttatgattgctaaataggtcatatattgacgtctttacatatttgttgggagcaaaagagttgaaagtaaagttttcttcccatctatgttatttagccattgattcccctctccaaagggatcagtaatagtttctttgtgtatctttttaaacattcagatatattaagtatttaaaactgtgtattgttctctcatctttttaaacaactggtaggatatgtacactacacattcatatttttgcattaaacttatatgtggagatcttttgatgtgagtacacaaaaagggtactttaaaacagatacataagcttctattgcacgtaccaactgtagtttaatgcatccctatcgatgaatatttacttcctttccaaagttttctcttaaaagtaatgctgtagagaataactttggacacataactttcatgtgtgcaaatacattataagataattcctagaaatgaatgcactaggtcaaatagtatatacacattttaaattttgataaatattataaattgctctccatagagtcacagcattttatattctcactgacaatctgtaatctctatgccttcatcaacctagtgtgttaccaaactgatcaattcataccattctgacaggtggaataaaatctcagtgtagtttaaatgtacatttttaaaaattgtgaatgagctgggcatcttacatatatgtaagggccatttgtattttatttattgtgaaatatgtttgtatgctttgtccatttccatcagtttttaaaattgacttagaggagcttttatatataagacaaaatatgacatatatggtaaacaaaatgcaaacattttcttcagttgtttgcctttttcactttgtttttcatggtgtttgctatggagaaaatataaatttttacataaacagatatgccaatctttccttttatagcttctggttttttgagtcaaaaattgagagaccttcctcattctgagagtataaaatagtaattatttttaattttaattaatttatttttattgacacctaataattttgcatgtttatggtttaccatgtgatgtcctaatacatgtacatattgtgaaataatcaaatcatggtaattagcatatcaatcaccttaaacatttatcattcctttgttgtgagaacatccaaaattctctcttctggctgcttgttggcagtagtcaccttactgttcaacagagtactagaacttattcctttctatgtaactatatctgctgaccaacctcttcccatctcccactccctcctattctccctagtctctggtaactactgtcctactttcaacttctatgagatcagtttttctagattctacatgagtgagatcatgttgtatttttctttccatgactggtttatttcatttatcataatgtcctctagcctcattcacattgttgcaaatggcaggattttatcctttttgtggctgaatagtattccattgtgtatatgtactgtgttttctttatccattcatcccctgatggacacttaggtggattctgtatttcactattgaaaatactgctgcaataacatgagcatgcagatgtctcttctatatactgatttcctttcctttggatatatacccagtaatgggattgctggttcatatatttttaacattttgaggagcttccatactgttttccacaatggtagtactgatttacattcccacgagcagtgtataggagttccctttcctttacatcctcgccagcataataacgattttaatatatttggaatttattctaaagatgtaaagtatgactcagacatcatttattaagcaatccatctttttcccagttatttgagatcccacctttatcacataaaaattttaatatatctttgagtcaacatctcactttgtagtctcttccatggaatctgcctattcttgcctgtaccacctgttttaattattttagattttatagtgtactttaatatattgaagaactattctctcattgctgcatttcttttttaggctgttcttcaccactgttacttgtttatattttgtatgaaatttagattcagcttgtctatttcaaaaacaatttctgttggtatttttagtaggatcatattaaagttcaagattgatttagagactttcgaaaagcattgaatctttctatctgggaacatgatatgcctttccatttgtttaagcattcttttatgttttctgtcagtgtttaatggttttcctccaataacttttaccatctataatttagc

SEQ ID NO: 92 - DNA, 1488 bp, Homo sapiens
gcaaacattttcttcagttgtttgcctttttcactttgtttttcatggtgtttgctatggagaaaatataaatttttacataaacagatatgccaatctttccttttatagcttctggttttttgagtcaaaaattgagagaccttcctcattctgagagtataaaatagtaattatttttaattttaattaatttatttttattgacacctaataattttgcatgtttatggtttaccatgtgatgtcctaatacatgtacatattgtgaaataatcaaatcatggtaattagcatatcaatcaccttaaacatttatcattcctttgttgtgagaacatccaaaattctctcttctggctgcttgttggcagtagtcaccttactgttcaacagagtactagaacttattcctttctatgtaactatatctgctgaccaacctcttcccatctcccactccctcctattctccctagtctctggtaactactgtcctactttcaacttctatgagatcagtttttctagattctacatgagtgagatcatgttgtatttttctttccatgactggtttatttcatttatcataatgtcctctagcctcattcacattgttgcaaatggcaggattttatcctttttgtggctgaatagtattccattgtgtatatgtactgtgttttctttatccattcatcccctgatggacacttaggtggattctgtatttcactattgaaaatactgctgcaataacatgagcatgcagatgtctcttctatatactgatttcctttcctttggatatatacccagtaatgggattgctggttcatatatttttaacattttgaggagcttccatactgttttccacaatggtagtactgatttacattcccacgagcagtgtataggagttccctttcctttacatcctcgccagcataataacgattttaatatatttggaatttattctaaagatgtaaagtatgactcagacatcatttattaagcaatccatctttttcccagttatttgagatcccacctttatcacataaaaattttaatatatctttgagtcaacatctcactttgtagtctcttccatggaatctgcctattcttgcctgtaccacctgttttaattattttagattttatagtgtactttaatatattgaagaactattctctcattgctgcatttcttttttaggctgttcttcaccactgttacttgtttatattttgtatgaaatttagattcagcttgtctatttcaaaaacaatttctgttggtatttttagtaggatcatattaaagttcaagattgatttagagactttcgaaaagcattgaatctttctatctgggaacatgatatgcctttccatttgtttaagcattcttttatgttttctgtcagtgtttaatggttttcctccaataacttttaccatctataatttagc

SEQ ID NO: 93 - DNA, 1474 bp, Homo sapiens
ttcaatcctgttcagaatgccagattgtgagagaatcagttatgcttcaaccttgaaagcatggagttctctgctttcagggaactccagatgactcaggaacagaagtaaaccctagacaaatctaaagccaaacatagaataaagctgaacagcagatcataaatcccattccttgctccctaggaatacctcttcttctaactccagcttcagatttttccccaggtttcacaattgacctttgtcttagtgtccatactggttggacatacccctctggcatagacattcatgataggcattgccattcttcatgatatgtcattcttggctacttcctctttttctaggatgcatgttttagctcacttcatgttcaattgccttgtggttggcctacttcttctttctcttctttcctacttttgtggttgctttatagttgactaattactagttcatcggctctgcttattgcctaatactataaaagttcccttcctggaagggttggggatgggaaagtgggggtgggtggtagtaaaattaactaaactttgtagtgggctggagatagggcatgagtaaaggaaaagttgtattttaggactgctcaactgcatggatatttatactttttaagacaagcaacattaacaaagtctggatcttaaagtagagatctacactggagataataatatccctgtgggcatttaatgctcatggttacctagaaaataagtataaagtaggaaattttgagagagtattcttgtaaagattaaatggtgacaccaatgtaaggcttgaatgttctaataagggtgaaacttggtctgggaatggcagttcttacaccttttataattcttaactgttattttttagatctggtcatttaaatctgaggacccagatatgctagtcttatagaaagcacaaatttaaaatgggttctttgtcttacatagctctaaagtttaggaaaaaagtatcttcaagcaaccttcataggaattctccaaaataaatgtgttcctgattaatatgtgttttattttttaaaatttatttttaattaatttttaaattgacaaaattgtatgtatttatggtatacaacgtgatgttttgaaatatgcatacactgtggaatggctaaagcaagctatttagcatacgtgtcatcatctcacataccatttgtttgtggtgaggacatttaaaatctactctcttagcaattttcaaataatgtaattattttaaatcagttgtttaaatattatgaaattactttcagcccttagagaatagtccatctcacatgacacataaaaatggaaggaggtgtctagctcaggagaaactttttggaatatttgattctctttccctcattttctcttctttttttgttttttaaaaaataatttttaaaccctgtattgactcctggctattattt

SEQ ID NO: 94 - DNA, 5404 bp, Homo sapiens
acttttcactcatttttggcatacacagttgtgtattcagataattgtcagtgcaatgctaaatgtgttatgttaaaaaatgatgaacatattacctctcagttcttgttatagataatttcttgcaaattttaagctagagatagtcaatatttaatcagagaacatcttcccaggattcaaagtataccacatcagctgttgaatgcagttaatttgcattaatgtgttacaaatcaatgttctgtagtattttaggaactgtaaaacatacctttcaagacaaagtccaaactctttagtatgcaatatgtagttaacctattctggaatgtctcttctaactgagagccaccctgtagggaattaccttagtcttttaattcctgtttgtatcaggtgacttagcaaccacctgcatagcaggaagacggcaccaaggaatatattcatccccttacatagtttgaactatgtgaccaagaaattacagtccatttgtatagagtgccaagctctgaaggctggaagacatgtaagttcatgtataagcataagaaggttgtccatagaatgaaaagagaggaggagagagttaagggccatctgggctcccagagaaagtgagctcaggtcccctttgggccctaaggatgaaacaactgccctttgcctggattcacttgactgggttctttgctgtcattggtagacacatagagccctcctgtctgctttagtcttgttctaccttctcagcctcatatagcaatacctcttatattctgcccccacccaccctgaccatctcagtgatttttgaataaatcttgtctttcactcgcctctgcctttgcgtagaggatacctgctgtgcaaaggtgatgtgagaaagtcaggtctaaattcacctccagactctgcctttggtgggctgtgtaatattatgcacatcacttcaatccttagatttctcatgtctagtatggaggaaatagtacttaacatggagacttttcaggaaaattaagtgaggtattatccacacagccctcataatggtgcccaacactgtggttatcaatagattttagtaccatttttgccagaaagttgaggcagattctaatccaacttttaatatccagatctatccattattccctgattcagtccccaaggtcactcattctttcccttcagctccacaaaaaatccacttacaaatattttatacactaaatcacatcataatcattatggatttctccaaaattaaagtaacaactttttctggttctctgaaaatatgaataaaagaggctgataatgctgcatgcccagaggtgaacatggttcaataagagagagagaccttgtggaagtgatgctggaattgaaatccaaggattgagtagtggcaatggaagaagagaatagtattccaggcaaaatacatggatatagattccaggggaattatgtatgaagaaggagcatagtgaaacttaggccctgcaaggccagtgcagcagagataagcctgtttccttgggtaatggtagggactgtagggcacagtgaacagtgtttatgtcattctataaataatactgataggaccacttattgagtacttcttacatgccagaagttctttggtgctttcattacattaacttatgctattgtccacagtattctaaggtggttgctattagatttccaattttacagaaggggaaactgaggcacggggcggtgaagtaactcccagaatgttcacagtcagcgaaatggtggattctgaatacaaatgaacacaatgaggctccaggtttcctgcttattatcaccgcgaagcccagcctcagcgagcaagggaaggagctagagagcgggctcccaggcacatctgcatgtgtgcactggccttgtaacatcagtctggctcttaagagctgatcagaaagaggacagaaggggagctggcacactggttaggtgaaatgagaaagctcaatgagtgatgatggtaattcagactagaatagttagtgttattttgtgaaaggaaatttcaatttaaccagagcaccttgaagtgaaggctttgaattggaaagaaggttttaaattgctatcagaatttgccattttagtgattgaaacattttagggccaaatgtgccatgctgcacctttccagaaggaactatttgagggaaataactgtcagctcctatagtaccagtgtttaaaatgtaagtttagggagaaaggcagttcaccttctctccaggtggggactgactgaggtgttgaacaaccagatttggggatggtattttttgaatttaattaactgctacatgtgaactagtaagatcaaatcacccacaaggtagatatttgagaaactcagtgtaaatgtggaaaagttgatgttatgttccaaagatgtaataaaaaattaaccagtttatgcaaatgtttatgcaaattaaccagtttatgcaaatgtttatgcaaattaaccagtttatgcaaatgaaaagaggaggtaagaaggtataagatgctatgtttgcatcattcactgggaacatttgaactttgcagattaatgtccttggtggaagaagttatgacattatgttatttgttggggaaaaaccctccagtgtaaagacttttatttatttatttattaaaggcaggatctcactctgttgcctaggctggagtgcagcagtttgatcatagcttactgtagcctcaaattccagggctcaagcaatcctgcctcctcagcctcctgagtagctagtacaatacatgccaccatgccctgctaatatttttttcttttttttttggagacagagtctccctatgttgcctaagctggtctcaaactcctggtcttaggcaatcctcgcacctcaggctccctcagcactggattacagaatacttaaaaataacataaatcagtcagatatttaagcctcacaaacttttcctgaagatttactgagctacttcttcagatgaaaaagacattttgtaataaatggtttctgaaaaaccaaaccctcaaaattgtaactgggatggatatgattagtgaaacacattaaacttaaccctacagggataaaccaagagcgctactgatgtttataaggaaatacaagcattacatcttaaactagacaagtttccactgctgagctaccctgagcttagtgaaattaactattttcacaaaatggaaatccattaatggaaatgacatcataaattcagaaaagattcttagattttaatatacttttcctaatttaaggcaaattgagccaccaagaattgaaagagaacatatttggataattgaaaggcagagtttaaacattccggaaataactatctgcactttcaaatgcaaggtcttgcttaggtttggaacaacacaggttttcttgatcacttgtctaaaacagtaactgagagccacacaacacaacctcgttttataaaggttgtctctgatacttagaaaaatctaaatgtttctgtacttttgcaagttactaaagtctttccattaaattatttgacttttttttctcccgcccaaaaagtgattagcgcacaacaaaatgtgtgtgatttgttaatggagtattctttcattgcagatttatatgttcttaaaacagtgcaagccttttgtggaaataatgtattttgaaatcatatattcttatatacatgtctctaaaagttcatcaaataaaacgtaggaatagacatttttacaaacagaaaacagtcatgtggttctgctatccaaacacagtgacatgatcttttagagtttattttcagtcttttacatattgaccctgtttttcctccatatttgtattcttttaggtttgtttacagagttgtaatagagcatttgtgtgaagcagtttatatggtaagtgacagaaattcagctcagagacactaatatactcacaggatgtattggtctatattgttcctctaggaaggtgtgatccagaaactcaagagaagtcatcaaggactcagtctctctacatatttttcttcctttataagtaaatggcctgcaaatcttttctcatttctgccgctctccctgaaggacctggtagagtacttccttttgaaatatctggctgcagttggcctatagctcagtctgggtttctggcttgttctgtgcatttgtttttcgtgcttcaattagccattgtgtcctggtaatggaaggaaacaatcctcagagatcttgtcacactaagtctgtggcacaatttgaaacattcagtaataccagctgttctaagcagaacagaagtcataattagggatgcaatgatttcacactaaactgtagttacagaatatataactacattttaatgctcatcaatttttatcttatactgtatttatcttcaaagaacaaatgaaccaagtgaattggatttcagatacacagagctggatttatctaatattccctttctcatcttctgctgtaaaaaaattatttcttcttatgtaaactacctaagaagtatcttttcctcccagaatactgtagctttgtctgctcaaatccaaattatataaaatggcaaagctgctctggaacacattttggctgtttaatacacagttaaacatacaatttccatgtgacctcatcatcccacatccaggaaattatcctaaagaaataaaattgatgttcatgtataaacctgcttaataattttttagaaaagtaccattgccaagaactggaaacaacccaaatttccttcagtgggagaatggacaaaaactatggtatatgcataaaatggacaataaaaagggaaaaattattgatatgtgcaatctggataaatctgtagaggcatcagtataagtgactgtagctagattaaatactttgtaattccatttatgacattctgaaaatgtaaaagtatagggacagattggagattgccagggattggcagtgacagaagggtgtgttaattacaggggcagcatgaggcatttctttatggtgctgggatcatcagtatctgtttgtgctggtggttgcaagaatcttcatatgggctaaaactcatacaactgtatagcaataatgtgaatattactgactgttaaataagatatctatgagtgaaccttcactaggcaaataaaataaataagtattaacacctgtgactcatatctgttgtcattttccaaagcttgaagcccagcataacatcatgcttggttttccaattcatcatgcttttgatctttgtatgacacatgcagaatttgggaa

SEQ ID NO: 95 - DNA, 1552 bp, Homo sapiens
acattaacttctactatacctttgtgtttatttatgaaatgcttacttgtttcttagggcttatttgtccaattctaggtcaatatactattatttgtaatgttttaaagtcaagaaagagtgtttctcatctttttctccagcatttttttagttcttagatatctgttctaccatatcacaccaaagtcatttgctgggtttttgtaaaatcaagattttgtttgaaattgtattaaatgcatatattagttgtgaaaataattcatttataaatatatgatatctcctgcatgagcacaggatattctctgtttgtttgtggttcttttatgtaattttcaataaattttatactttaaaacaaattatgaccttcaactattttattaaatgtgtctttctttcttcttttgagagggggacaatgatgataagcaaaaattgcccccatatgtataacttacatgttttattaaattaccttaggattttttaactctttagtaatttctagggtttttcaaagtgtatcatcataatatctgtagagtttacttttatgtttcttatggaaaattgatatttattacttaatttacatatcctattacattagttaaatcattaaagcaattctgagtaattgtgaatgggaagtcctgatttctattttactttttaaaattaattaattaattagttatatatttaatgttgtgttcttggaataaaattaatttggtcatggtgttttattcttgtaatacactactggattcactttgctagtatttcactttcaattttatatccatgtataaaagtagtatgtatatcatgtttttatggtattatgtttattagctttagctattgataggttttattgttgttactttagctaataatatgttttgttgttgctttgttttgttttaggtttcataaaataagttttagaacattgtacgttattcagctgtttaatattattgatgtaaaataggtataatctcttatattaaggtaagtagagcatatctggaaagccatgtgggcattaggacattttctaatggcagattatgtttcccatcttttctatgatcactggactctacaggttctctatattttggtatttaatttgagaacatgattttctgttgaaaatcatcctttctctagatttgtattattttcattaccaaatttgcccatattttttgaaatttttgtaaatatctcctctgtgtacatacttacatctcatttattatatataatgtacatttttacttctctcatttaaaaaaaaaatcctttctactagtttgcctgtttgattttttttttttttgaacagccttcttttagttttatttatatgtatgctatacttttgggctttttgcttcattaatgatagttttttacttctttaattctccatcctgttattttggttgattttgatgtttcctgtgtctcggaggctttgcagtgaaacttgattgttaatgtaattgagattcagaagctatgagat

SEQ ID NO: 96 - DNA, 24488 bp, Homo sapiens
agtggttttcccagatatacatatctcccgttttacttaattaaaggaacattttcttttattaacaaattattgaagtctaatagtcatgcagagaggtaccccaatcacaaatgtattacttggtaaatcttcaaaaagtaaacattcctatgtaactatcacccagatcaagaaatgagtaccagtacctgagaagtccttattctacctccctctaaacacctcttttctcctcttcaaaggtaatcactgtcataacttcaaaaaccacagactagtttggcttcttatagaaatttattaaaaatgaaattgtatatatgtatatctttgcatgcatatatatatatatatacacacatacttgtatgtatacatatttctgtttttaatatgtgtatatatgcatgtgtgtatatgtacatgtatatatgtgtgtttgtatatacacacacatatatacacacacacatagatatgtattatatataatatagggtctcactatgtggtgcaggctggagtgcagtggccaccgtaatcatagtgcactgtagcctcaaagccctggcctcaaatgatcgccctacctcagcttcctgagtagctaggactacaggcatgtgccaccacacctggctttttgaagttagatattatgtaatcttttgtgcctggcttttgtgtttcaacatattggtagtcagatttatctaagtttgttgcatgcagcagtaattcattaactcatttgctgtagagtattccattgtatgaatacactgcaatgtattcattcattctacagttgagagcatttagattgtttccaaaatactgctactacaaacattttttgcatattttttgtgtggaagtataacatatttctgttgagaatatattttggaagggattgctgtgtcaaagataagtgtatgttcagctttaataaatactgataaaatagttttctaaaatgctgtgccaatttatattcacaccagtagtgcatgacagttccagttgctctacatctttatcaacacttgctattgtcagtctttttatttttagccattctgatttgggtgcaagtgtattgcattgtagttttaatttgcattcccattttggctattgaggtagagcagctttatatttagataattctatttagtgaagtgctggttcaagtcttttgcccaccccctttttttttgctggatcatcttacttttttctgatttatttgtagtagttatttatatgctctggacacaagcccttggtttataacatgtattgcaaatagcttctctcactttgggaattactctttcactttcttaatggtaggtacctttatataaacatttttaagttaatacagtccagtttgtcaatctttttatgtttagtgctttccttttatcctaagaaatattctcttatctcagggtcataagtaaattttcccaatatgttatatatgctttattattttacctcttacatttaggtttaccattcacctgtagttagtttctgtatatagggtgaggtaggagcaagattcatattttttcacgtgggatatatactttactcaacccaatttagtttaaaaatgtatcctttcccctttctctgcagagtcataagtgcccacatactatgtgtttgctctggattccttacactggtccattagtctattagcctattcttgtgcaaatgccacagtctcaatcaatgtagcttcatattgattcagaatatcgggtagtgaaagtcacataactttgctattttacaagatcgacttggcttaacttggtggttttcagaataaatttaatagtataaattttagaatcggctcatcaatttcatacctcaatgcacatacacatacaaaaaccttcctgtgatttttgtttggcattgtaatgaatgcataaatcagtttgggaagaactgacgtatttaagatattgagtcttccaatttatgaacatgttgtatctcttatttatcttctttgatttctttaaataatactttgtactcttccaggtagaggtgctgtacttcctttattaaaattattcttagatacaaaatgtttttattctgttgaaatggcatatttttagatttaattttctaatcatttgctgctaataaataaagctgatttttgtgtgattactttgtatgcagtgatcttactaaattcactctctaaatacattatcaggagattcttttgacagctttatatccatgaataatggcaagattatttcttccttttcaaccaatttatcatataggttggtgcaaaagtaattgcgggttttgccattatttttaattacttttgcaccaactaatatttcatttattttgccttttcatcctgactaggatctctaggttagccgatgtccttgtcttgttaccattctcaagacaaaagctcccaatacttcatctttaagtaagatgtttgctgtaggtttgtaggtgttgtgtgggaggtggtatgtatgtgtgtgtgtgtgtgtgtgtgtgtgtgtgtgtgtgtgtgagtagatacactttatcagacttgggagacttttttctgtttttaatttgctgagtttgctagttttatgatgaatgagaatttaatttcaccaaataatttttctgcatctattaagatgatcatatgcttgctttcttttgtgctcttcatgtgctgaattaaactgattttttcaatgttcaatcaatcatgcatttctggaataaacacaaattgaacgttattttattctttcttgtgtctcggattttgcctactaataatgaaaaattttgcaactacatttataagagagactggtatgtaattttctcttcttgtatgttttacaggttttagcttcataaataatttggaatgtattccctcattttattccctaatagactgtgtgtaaggctgatgttatttcttcattaaatacttataagaattcattggggaagttatctaggctagggaatttatttcaagaggattttaattacagactcaatttccttaaaagtaatttatgtcatttttaagaattaatggttgttttctaggaatttgtacactttatacacatttttaaatatgatataattttgttcccagtatccttttatatatccttatttaaagtctttaggatctgtgattcccctttttttattcctgatattgttaatttgtgccttctatatttttattgattagcattgccaagatcaattatgtttaatatcaattatattagtcatttataaagacatctgaaaaatgttaaaatttgtgaattcctctatgctgtttgttttctctttcattaatttctgctcttctgtgcagtgttttcttactgttgttttctttgcattcaataagttctttatttgctaaattttttgtgtgtgatgaggacagactcttgctctattgcccagactggaatgctgtgacatgatcatcactcactgcaaccttgaactcctgagtccaagcaatcctcccacctcagcctcccaaagtgctaggattacactgtgcctggccaatttgctaactttttgagatggtatttagttaaataatttttagcttttatttttttctaatatatacattcaaggacataccattttctttaatcatggttttagttgtatgtcacaagtttttttatatcatatttcattatcacccagtatgaaatgttatttaccttgtaattctttaacttatgcattatataaaaatgtattgcttaatatccaaacacttaggaatttgattgcttagtttaactcaactgtagtcaaattaaatattttatatgattttaaactgtagaaaagttttgatgcttgctttatgaaccagtctgcggtcagttctattaattgtcacttgtgcacttgaaaatgattgtgagattctatattagtcagcttgggctgccataacaaagtaccatagactgggtggcttaagaaacagaaatttattttctcacagttctggagactcaaagtctcagatcagggtgccagcatggtcaggttttggggagagtgttcttgtttgctcacatagccgagagacagagcgagagtgagacagcaagagagagcgagagtgagagagcgagcaagagagagaggagtgcaaggtctctgttgtctcttcttacaagggcactaataccgttccaagggccccccctcataaggtcatctaaacataatgtctccatcagtccactttttgctgctagaacaaaatatcacagacttggtaatttatgtagacaagaagttaatttggtttatgattctggaagcttggaaatccaagagcaggcaccagtatctggtgaggatcattccatggcagaaaagcaacacctagcaagcaagcctaagttatcttttcatcagaaatccattcctgtgataactatttcactcccaggataacagcattaatccacccctgagggaggagctctcatgagctattcaccttttaatggatccacttcccaatactattacaatggcaattaaatatcaacgtgagttttggtgggaaaattcaaaccctagcccctaattaactcccaaaggcctcatctccaagtaccatcacattgggtgttaggaattcaacatatgaatttgagggcaccttaggttagtccatagaagttgcagtattttaaatatttgtcatcaataagttcaactttatttatcatattgtacaaatattttataatgttattaatttttttctacttgatctgttagttacagagaagtgtatattaaaatcccccactatcattagggattttcctattcttgaatgtgtgtctattatatcatatatgtaaaacatatgcatgttactaggtagatgcatatttagattttaagtgtattgaaacttattgttattaaatagtcttcatttctagtaatgagatttgtcttactattgattttacctgttatcagtatagttgtaccacctttttaaatttatgttttaatggtatatgttttacaaacctcttgccttcaacctttctttatgtaatgaccatgtagtagtctttttaaaaactcagtttgtatgctttaattgagttatttaattactttatttctttatatttattcattaatatatacataactaatatgtttgggtttaattctctactactttattattgattttgtatgtgcttcatctgtaccatattcaattctcactcttttctggccttctgtggaattaattaatattttctcatctcccacattagcatcttaaataaacattcttttaccatttattttgtggttatcacagagactacaacatgctaccttgaattttttaagtctactatatattagtatttttattacttcccaaagaatgaaaggtccttagactccttttcctacttacaaattactgccttttgtgctatttctgtcattaattaattctacaatatatttagtgattttgtaaagttaatattcatgcatatttgccacatatttaacctttctgttgctttctgttgctttatttctcatttccatacttttatattaaattatttttcttatgcaggaataactctttgtaatatttcctttagtgcacatcttccaataaaagttacctcaaattttaatgatctgaaaataactttatttgagatatttttaaagaacattttactggatgaagaatttgaaattaacagttattttcttttgcactttgacattctcttgtcttttgacttccacaatttctgttaaaaagtcattagtcttgttgcaattgaaagtaatgtgttttttcccctctggtaattttttttttggttttgtctttattttcagcagatttattgtgactcatcagatttagtgtggttttctatctatttatcctgtttcaggcatgctgagcttcttgaaaatctgggttagtatctttcatcaattttcaaaaattcttcacattatctcttcactgattgctactcattattcgctcccttttttcctggaatgctaattatatatgtattataacttttttatgtatcatatgtctcacattcttttatgcattttccattatttttcactccacatttctgcctagatattttctactaatctatcttccggcctagtaatctcttcagttgcatttaacctgaattcttaagtttgttgtaggtttttagttctaacatttacatttgagtcttttaaatatattgttagtctttcatgaaattattccttttgctatgtatatattgaacatagtgattagttatttaaaagtctgtgtctaataacttcaatatatggatattcttggattttctttctattgtctgatttttttcatttgtttctcaatcatttggacatatttcctcataatttattattgaatgatggagatactgtatggagcattgtacaaataacttgatgcatggtatactctttcttcatctttccttttcttctgtcaggctaagaaaaaatcatcttaaacctattgattgagttgattgaaaaattttttttattattgcaaaagtgattctatttttggttctctcttactcctaagaagtagccatttgattgtttgcagccaaacaatccaaatggaaagcccttctccttcagtgaatcttgagatccaatttttgtctctgaagcctggaaagattactaaaagttcatctccattttttatcctctcagcttccacttacaaatcagcatatgcctcaataggaacatggagctgaagatcagtctcactcctctgtacttccctttttctctgggatcttatcctcacttattcatgctgctatggatgaattacttcaaaagtatgttttcctttttactcaccattttattatgggaactttcagatataaaaaataggttaaagtgtgttacagtgaacagccttatacccacagatcagattctataatttaaatttcatcctgattgacttattatatgtctctccctctatctgtccctctgtccatctgtcaattaatcttactttttgatgaatttcaaaatacattaaggatatgaggacattcccttttaaatctttcagcctgcatttcattaactagtgttttacattgttttacaaatatttttcattagatataaaatttaaataaacaatttgcatgaatcttaaatgaacatagacagacaagggtatacgctgtacaatccaagcctctatcattccaggaagtcccctagtgcttctttcccattattcctcactcctgccccatccccacagaggcaactgttattataattttttgtacaataggttagttttgcctgttgtaaaacttcataaaatggaatcacataaaatgtataattttttgtaagtcttcttgaactcaacataacatttttgaagttcatccatagtactctgtgtatccatagtttattcctatttcattctaaggaatattctattatacaaatacacgacagcttgtttactcattctcctttgagggatacctgagatatttgtatcctttgccctgtttctgatcttaggggcaatgaattcaacatttcactagtaaatattatgtcagttttatggatgctttttatcagattgcaccttttatcagattgtggaagttccctttgcatcctgctttgctgtgtgtgtgtgtgtgtgtgtgtgtgtgtgtgtgtgtgtttatcatgaataggtactgaatattatcaaatgcttctcctgaatctattgaaaagatttttcacccttatcctatcaatacggtgaactacattgattgattttcaatgttaactgactgcattgctgggataaacccaacttggtccatatatatatatatatatatatatatatatatatatatattctattcatgatattcatgaatattttgtgatacagttcaattgtgtcccctcccaaatctcatcttgaattgtagcttccataattcctatatgtggtgggagggacctagtgggaggtaattgaatcatggaggtgggattttctcatgctgttcccatgatagtgaataagtctcacgagatctgatggttttataaatgggagttcccctgcacatgctctcatgcctgttgccatgtaagacgtgactatgctcctcattcgacttccaccatgattgtgaggcctccccagccatgtggaactgtgagtcaattaaacccctttcctttataaattacccagtcagtctcaggtatgtctttattagcattgtgagaacagacaaatatagaatttcagcatttgtttataaagatgttggtctgcaactttatttttcacttatttttcttaaggagagtaatgtctttgtctctttgccaggttttggtattaggattatactcgccacatataacaacatgggagttgtttcaagactgatgctatttcttccttaaatttttggcagaattcaacagtgaaaacatctttttctactgtttaattaatgggaaagtttttgatgataaattaattttttctaatagataaaggctattcagattttctacttgatcatgcataagtgtaagttgtatttttcaaattatgcttccattccacctaatttgtcaaatttattgcctgaaatttttcatggaagtcccgttttccttttaacctctgtaggatctgaggttttagatcttttattgctaagttttttctccttcatatttgtagaccagtctagctaggagactatcaattttgttgatctatctaaagaacaaattttagttcctattttctatttcattaatttcatctttgttatttctttgctctacttgatttggtttgctctgttcttttctatttataagcattgaaagctaaaacttttcctctaagcactgctttagctggatcacatagatttttcttttctttttttgtggagacagggtctcactacatggcccaggctggtcttgaactctgacctcaagcagtcatcccacctcgacctctcaaagctctaggattacaggcatgagctaccatgcttcacctgaatcccatagatttagctatattgtattttcattttcatacaggtcaggatattttctaatttcctatgtgaattcttctttcacctatgtaatgcctacatgtgttgtttaatttccaattacgttgggatttccagatctcttgttctcattggtaagtaatttaactccattgtagtcagagaatatactctgtgtgatttcattttttcaatgtactggggcttgttttgtggcccagcatatggtctatcttggtaaatatataccaggggtccttgataataaagtgtatgccacatttaattactattctacaaatagtgattaagtcaaggtggtcaatagtgttgtctttaccttaactgatattttgatcatttttttctactaacttcttaaagagagctattaaaatgtcaagctttattgtaaattgtctacttctccttctatatctgtaagtttttgttctctcatgtggtaccaactgtggtctgccctcaagctaaaaaatatttttaaagcaataaaatcatctctatacccctccctgttttgaaaagccaactcccctccagaacctgcctgcatttgttcacttttgggccccagcatatagtttttctttgaaagttttgttttggtctagaagagctcactcagctgtactataagtggaaccttcgcatggtttttaaagatattgtttccaggctgagcatgatgactcacacctgcaatcccagcactttgggaggctgaggggcatattacttgagctcatgagttcaagagcagcctgaaaaatatggaaatacaaaaaaattagctggatgcggtggcatgcacctggggaaccagctactcaggaggctgaagtgggaggatcacttgagcccaggaggttgaggatgcagagagccacgattgcaccactgcactccagcctgggtgacacagggagaccctgtctcaaaaaaatttttttccagctttttaaggcgtttctgttggaagaattgatatattacaaattggcctgtataaccataagtaagaatccctaataaatatatttttaaatgaatttttgtatctccataaataaacttgataaagtaaaacaaattaaatacaactattaaaatgtaaaatgtttatccatgtaccaccaaaaatagttttccatgtcagtggcagaaacattatgctttgggaaagtacatacttgctaaagtgaccagatcactgatatgtgcaatctcatgtttggaaggaatcttgactaccacttatccaaatctgaaacccctacacaacaatgtttcaaagtggtctcatacctaagctcatccagtgacagagaacagctcctcagctgtggaggcaaaggattctatttttggaaattctgtatatcagaaccatcaactttgtcttaacttgaaatctgcacccctgtaaattccatccatcaatcctagctttactccttggaatcttgcagattagtcacactttccatttacttcatgaccctatagatacctggatcttttctactccgatttgttggatgttcctaggctcctgggatccacaatgctaatgctagatattggtgtcggtttgtttatgaaaaagtaattagcaggtagatacaagagttaagaatttatcccaggacttactgatagctttatcacaggaaaattaaaattaaaagttctgggggccaggcgcagtgacttacgcctataatcccagcactttgggaggccaaggcggccagatcacttgaggccaggagtttgagactagcctggctaacgtggcaaaacttcatctctacaaagaaaaaaaagaagaaaaatacaaaaaattagttgggcatggtggtgcacgcctgtaatcccagctactcgggagactaaggcacgagaatatctttaatccaggaggtggagggtgcagtgagccaagatcatgccactgcactccaatgtgggcaacacagtgagatgaatccgtctcaaaaaaaaaaaagttatatcaaagaaacatttcctcagcaaaatagatcctttcattatctttactacaaagcaaagaagataaaaaagcaagaaagatgtggagaaaaaagatttcctcagttgggaaccttaaaaggtcatctataataatattattgaaaaagagatagagttcatctatttaatcctgtttcttcagaaaagaccaaccttatgtcatcagaaataagaaagtagtaattacacttttaaagctgtcttttaatcccacctgtgattaaaattcttttctagctcctactaaaaccttgccttcttcattttaagttaattttcccttgtgtgaccagttgttcacaacaggaacaaaataaaggaaatattaaaatacactgaaataagaaagagaggaaagaagaaatggaagggaggaattggagggaaatgaaacgcttccagaaggaaagcagatgtgcctatttcttgggggctgtatgaacacagtagacaaacagcagcatcctgggaatcaggtgagtgggctccacactctcactgatgagtctgattgtctgtgtggtctctggcaggtgtgctcattttcctgggttacaattacttcctctgtaaaatgaggggattgactaggggaatctgagttaccccccattgaacgcatgtcattcattcattgcgtctacctggcagctagtctgttttccaacttgagatatggggtgtggaccagagttcacactgggcatctcctaccagttgtgatttcattctcaacttaaccacagactccttgctaaccatgggcaaaatcattgtttttagttcattaatttcttatgtctggaaggttatctgcaactttcttgtgcacctcttttattttctttatttttaaggtatccatacagtcagttaggggagatgaacataggtggaaagataatagttgtcatcatttgtaaagttattctctctactcactccaatggaactaatttctagcttttagactcattgttgaaaacttctgatgaaaattattttatatagtgagaaaaggaccaatggaattttctaatctttgtttggaggcagaggcagatatgctggagtagtaaaatgcaaatccgggctgggcgcagtggctcccgcctgtaatcccagcactttgggagtctgaggcgggcggatcacgaggtcaggagatcgagaccatcctggctaacacggtgaaaccccgtctctactaaaaatacaaaaaattagccgggcctggtggtgggcacctgtagtcccagctactggggaggctgaggcaggagaatggcgtgaacccgggaggcggagcttgcagtgagcagagatcgcgccactgcactcctgctggggcggcagagagagactccgtctcaaaaaaaaaaagcaaatccgatgcccatagatactatcttgacagcagctccagattttaaaactcattcaatggcaggttttgaacgctggcttgcctttggagtctgaggtctaaatgacagttaagtctatgtctgtgttaaaggaagagacatctgcatgagtagacatttgtgcctggatgggattcaaatgaaacataggtaacagaacatcaattgcccataatgttctaatccaacatcctgtagtttctgagcaggcatttacagagttaatacttattagagactcaaggctcaacttttttcctgtatatcttgatattgcaaaccctggtagttttaattagtggccttttaatctctggagcaaagccaatggcctgttcccttggacaaatttcttaacaacctggcactgagtggctttgtctgcttgtgggagctctcgtacccaaggctgtcataaagagttacataggttatgtctgcatgaaggaaccagctgaagagatgggtgggtgttggaatcagttcttcttccatgtgccaagtgagtgtcctggtgtgagctacattcacctagaaaggtgtgcacacctagcgcacacaaaggcctatggtttcacctgatcctatcctactttcagtctccatttccttcctcgtttcatgccctaggacaacctggggtccaggagggctggctctgtgggtattgcaaccttcctactgcaggtcttggcactggactaaggaacaagagacctgcctcatgtctgagctcctctgtgtaatcttaggcaagttgcttatctcctcctatgactcagtttcttcatatgtataaagagaaaaatgtcactctatcaaggttagatggtgcagagggacagacagctggggttcaaacctctgtttgccacccattcactacctatgtatccttggccaagttatataagctttttatacctcgattttcttaatctgtacagtggagctaataatagcacctacctatatatcatgagtccttacaaaaaagcctacaaagtaggtgccattattatttccacttgacatatttaataaattgaagcctaggagaagacacgtaacttgcctaagatcacacagaggagctcagacatgaaccaggtttctgcctcttagtctagtgctaaaaccagtgcatgtgtgcatgtgtgcatgcttgtatagctacagatatagatatgtatgctggcatggataatacagatataggtatagatatagatatctatatgtacgtgtgtgtgtgctggtttatgtatatatatgtatatgtatctgtatgcacacacatatgtgtttgcatgtgtgtgtatagatacctttatatatacatatacacacacatgcacatgctgcttaaaacagtgcctggcctataatgctaagattattaagtacccaatgctcagtaagtactcaataaatgttacctattgctattatctgtagagaaagtttccacgtgctaacgttccctccctcctgtgctgggagtttgtggtttgaacagacgagagcccagcatgggcacccttggctttttgagcattatttgcattctgaactggggcctgacgacagcctgctctcagggtggggacaggagcagaaccatcagcgaactgactggtaaatatagcaaatcatccgatgggttggctgcatggggtgtgtctgtctgtatatgtttgtgtgtgttggagatagtagtggtatgtaagcttattttaactggaactcatattttctagcccctccaagaactaatacctctttttaatgtttcatgggaacactggacagagggtctttaaagtaaaaactcagtgactcattctctctcttcagtttttctgaactgctgagtagagagaggaatattttcaaggaaacacgaggagattaggatgaaccttctttgcccctcaccccacctcacctgctttgtacctatcagtggaaggtgagggctggtcttgggggcaggaagatggatgaagtgacatttgcaggatcccctgggggcaggtgtataggaggtgagtactcgaggggcatttcatcacgcattgctcttaggcatggctagcctggatgggtctcaattaggagtaaggagacctaggttcccatcctgcttggtctcaaatccctgcaaaggctgcaccttgagttgctaggcatttacttcccagacattccctgccccttactaccagtaaaagtggtaaatgcagggtgtggccagaatgcttttctaatccctagtgccactccaagtccccctacagagttaaagcctaaaatgacttcaaacccaatggaagacattgtgtgatggaaacagttctagttttccagttggctttctagccatgaatttgtgtcctgtgtcctttctccagcaggtcagggaaagtgcaaaaggcaggctttactctacattgactgcccagtgctaatgggtaggagcacgtcagccatgggactcgcagggaaacttgccacactttgaatataggagtcacctggctgtgtcttgtaaccagttggagacttcactcacagatgtcactctggggctactgaaaatagaagaaatcagataatacaaaatttctaactgtattcacattagtgtgttctttgttttcttatttatattcacagtcatgaaagaaaatgaggttaagtacctttacacatggtaaaaccaagaaactgaaaagtttagttacttccctgagctcacaaaacagtgacaagactctggatctcatttccctatctccctgtctctaacccaggataattctctggattgcattgcgtgtcagaatttctctgttcctacagtgtaaatttcagccttaagctccacctacaacttgccattttcgcccaaagcattcaagatgttcttttgcatccagaccctcctccaaatgaagaaagctgcagtgaaaatgccactgagttgaggggttgcaaaccaaacctccattcccataattcaattctcaggccccagccttctgctaaggctaacagatccactccaaaattttaagagtccacagtgatcaaaagcatctgtatattctgaaacatgcaaatcaaccctgtttttcacattcatctcaacatttggtggagggcacaagagtcagctggctgctgagtggacgcagcttagcagatgaatggaagggtcaaatccctctcaagatttgtagaactggatctgaaatatgaaatgccagcatacgtgatgagagggatagtctatcgagtgttttatcatccaaagatggaattaatggctatgccatatctgtgtcagaccccggcagtaaaactttatgggttcttccccgtgaaatattttgtttatgtcacgtgggtctcatcggatgtttttttctcttttcttcacttcccctccccacccttttccctgccctctttgtctcctgagacctattccctttggaaatgcattagttacctaggaaaccttaatgtcatttttttatgagtggagtttggtgcagcataaagttaatttatagggtggttaggaattcatgtcatgactggtgaaataggagactttattatgatttctacatccacctgtgtggtaggaatacataccttccctctatcattacgggtaatttcttgaaacgtaattatgaatatgtatgccatgtcacagaataagttgattcaccgttgttcaatgcaattcattatattgttcaatgtaagccctagaacataattagcaataacaacaaaccaataatataccaggcaatctgttaagagttgaaggatatggtggaatttccttttaaatgatgaggtggttctgggtgaaaggcagagaatgaataagacgagattttgaaatccttcaattctgtctttcatgcacattgaggtccacgttgggaagctatataaattctaaatatgtccactacttcattctgctgatttatttctgtatttgtccaaaggggaaaatatacatccataaaattacattaatgaaatgtgtagtggcatacaaataataatacacaggccattccagagccaagcttctttctaaagatagctcattcccccagtggtgtgacagtgtttcctgtgtaaggactagcagatcgggactggcattcacattgtgccaggcactgtgttgaatgttttaaattaattagttcctttggtcctcatattacttctatgagattggtgttgtcttcaccaattgcagatgggttctaagaagttaagaaacctgtacaaaagcacatggctactgagtggagaaggtagaggggaacctgcttttctcaggcaccaaaatctactctggcagtaaattctaggtcgtggtctgtcattatgtttttgtttttgttttttgttattctgagtttcctcagttattaaatgcagagtgggggacataggggctgatagaagtttatctctgatgtctgtattctgtgtagagagatcaatgctagtccttagagcaaagctgtgctttcttaaaatgacagaaatttgggggaagacctggtcttgttaaataaacataaacaagccactcagtttctgtggacaagtgcatgcgaattgaaagaaaagaagaatgtctcacaggtgactccaggtcatctgagaggaattgctatatggcttgacagcctgtagctcttggtgaataatgctgttgccagtatatagaaacgggtgggcagccaggaatctttcaagtgcggaggcacaaaggtagcatgaagccgcctttcctgacccttaagctcccagtccctgtgcaaacaccttttgcattcactttaattgtttgaaaaacgaagacttccagactccatcagctctagcagctgtctgggtggatgggggtggggatggagggggtagggcgagacctccccacagcgccctccagcagcagaagatgcaacttgcaaatacttcaggatcagtgagaagtgtggtgtttattttagtaacctcaaaagagagaaaaagaaaagcagtggaagaggacagacattcaaggctagctacacgatcatggggaaaaaaaacaagcttgtctttgacacggaaagggtccttggaggccattcggtccacttctctcatttcctgggtcaacatgtcacaatgaattaaccacatactgccactgcacaagaccccctccctcaccacacgctgagcccccaccaccagcattcagtccactgagctcaaacatagggagataagtgctgttttcacaagataaaggcaaaattcaatcccacgttgccgttttgtttctgttcagtgttccaaccacagagtggtgctattgcaaaagataagggtaaccagaaggcacgctctggaaatttgctttaggagagagttttaaagggggttttcaaaaacaagatctgattcctgctctcagaaatcacttccaggagtcagggccttactctcagatgcagcagggagaagaagaaagttcagcaacctaaaaatacagtcgacagatgggcagccaaagtcatggccacgaagtcaacttggagaggagcacctacctagtgaatcctaaaagatctcatcctggatgcttccttaaccaggcctatgtacagggcacaagctcgcagccagcttactttccagtcctgatctttgcttttgctatccataccaatggtatttctatagaaaagaaaaatctctatttagaaacacggatttacttagaagtcacaatattctagtttaaaaatggctctacatagtagagaatgatctttttattctgtcttcttaaaaatacacctttctaattctttttttcttcccaccttcttcattcagcaccttgccactcccttggaagccacaacagcgagctggggggtcagtccctagtcttagagggaagaaatctttaggtctgaagtctaaagaaaaacagtaaaggaaaaggcagttggcggtgctcaaggtagactgtctgaaagaggtcttctactcagaaaagggctaaggctctccctttgggaaaccaatccttctgagaaaaagtgcatctttcaccctctgctcctgtctgggtctctccctcttcctccctccttccctcagtccctcctcccctctctccacaaagacacagcacatatttggcaagattaaggtgtcacctctcatattacaaggcctgttgattgcaagcaaagacagacccaccagcttaggacaaaaccccttggagttggaaataagacaaactctgggatccccgaaagtcccggcaaaatgacgcggccagccagtgcaaggcatctgcagaacaaatccaagtcctaaacgcactgcttgctgccttttcttctccttcctttcttctgatttttcaagtttgtttgccccccttcccctcctccctccagactgccagggacctgggagctgcctgcagatcagcccgcacatgtatttaaccccttccctgctgcagcaggagccaaccacctctttccttgcaatcttcaggttcccagaggacctggagcttgagaaaagaactctgccagtggatctgaaactggggcctgaatccctcctttgaccagggcgagaagctggaggaggggggcaagtgcgggaagtgggggagggcagggaggcgggccagatgagagggagaaaagcagaacccgacagagcacgcccaatccaaaccttcatggtgctgtgtggctgggtggagggaacgactcggcagcctcttctggccctgaggaagacgtcgatattttggcacgaggggagccactgaaggactaccctacccttgcgagggaccgcaggaggtgacgcccctgggcctcggtgggcgcttctggcggttttcgatgtggcaacccccatcagccaggataatgatgaggcaggtacaatctatctagtacgcagcccccagactcccccctcccttcccacctccccatccaaccccccagctactctctgcggccggttggtcctgaactggtgggtgcagttccgatgtttaaccaaattctcaagcaatttcaaggtatttggattttttgaacctgggccctaaccgaaacgcggaacggcttgcttattagacacctcgaacgacagggcagggaggaaacgggatactcgctgcccttcccagtcgcgcgtgagtcaaaaggtcctggcaggagatgatgtgaggagcggctgaagtggcagggaggaagggatgaggggcttggagcggaggtccaccacgcaaggactcgggaagcgggcaagtgggcaaaactctgcttccgggctctcgatttctcgttgatcactaagtggtatttttcccccttctctcgatggcaaatgggcgaaatcaagatgacttaacttggtaaatttagagagaacggctcggagcaagtgaggtctaacgggcagctaaaattatctccaaataagagattttgaccccctccccctatcctctcctcgaatgtatccaccggtggggaagtgagcgtcattactttcggggcgccacgaacaggtttgtttgttgctcgcctttcctgcttctcgcgctgtccccgcgtgcagactggtgggtgctgggcgagtgattagctgcagggccccatcctagtttggaaggaaggggtttagaagttggaggatgggtgaaatgggaggctgcgatccatctccctctcccttccacactcaagctcccgcaaacacgcgcgcgcacacacagcccctccctagtccctcggaccacccgcccccacgcccctctaccttgacctcccttgaccgccgacacagcgtcctgggtgcgggtccccgggagcggggagttcgccggggagcgattgtccttgggcgtgttcgtgctgtggggtggggggaggagtggcgggtgggcttggtagggggtggggagagatctggagctggaagggtctaaggtttggaggaggagtttacgcctcagacctgatcctcctgaggaaaaaggcaggaaaaggccctgatgccttgtaaagaaaatcttgaaagaaaaaagatcaaaaagaaaaatttcaagaaaaagaaccactaagaaaggctgaagacactaacatgtaacctgttacgatacatttaacgtttcgttttttcctggatctctaaaagggaactcaagggtgggggttactgaagaatactacagatttggaagtttttgttgctgttgttgtttggtttggttttgtttttcaagaggggccaggagaaatgaccccttccccgccacgggtcccgaagtgagggcggggggggggctctggggcgcgggcgcgcgcggcgcggcgcgggccggcgggggagggcggcgcggcgcggaaggggttaaggcgctgagcgcggagccatctggccgggttggctggttataaccgcgcagattctgttcacgggactcagagttgaagctcctctcccttccgaacagctccgcgcaccgccccgcgacgcagcccggcgcaactactttcttctctctcctttctttcttcctctcctttttcccctgctgggtagtggctgcggcggggtgggggagactttgaatgaccgagctcgcgtccacctttctcttcatgtcgacgtccctggaaacggccacacggatgccatggttacttttgccacggtaaggggaggcggcgggcaccttgggtgggcaggtttggggatgggggtccacgtggggagggattttccagtggactggtgcggggggccccagatccgcatcccgccccacccccatcgcgccgcgctcactcactttcccgggcttgtgtcttccccaaagtttgcgctgggatctgctcaggccgaagcgcaaccgcagccaccccgctacacacacacacacacacacacacacacacacacacacacacacacacacagacacggacacccttctccacctcctcccctcttgtccctcggctgcccaagaagcttccctcaatctgggaaagtgatcaggtttaagggacctggattggaaagggtgggggcagaagaggggaaatggggacgacgaaagagcaggaaagagattcaacagaatcaaccacccaccactcccaaccgacccgcctgctcctccgagaaagctcctagcgcatcctataacaaaagggggtggcagacagaactccgggcggggaggtgccgcggcagctcccctgcacacgccctgcactctgccggccgctgagcctgattctcagctcgccccagcaccactctggcccgggcgtgggctggggggaggggacgcgcagctcaggacccggaacctcgcgttccagttttgggagttgggactcactgccacgcgccgcgtacctgcgttggagttccccgaaagggttttttcagaaaagacctcgcgccccgggctcctcttggccagcgcccacccggtggccaccccaccctgggcctttgcgcagatgttggagctccgtacgcagcccgcacatctgggacccctccggggagcggcgggcacccgggcccggccatcccaggggatctccttgcggtatcgtccagcctgttctcggactttgagcggtggcgtgggaggccgggagacctgggcacccgcgcagccagccaggtcggagtttaaaggtcccacgacggaccgaactgtcccattgccccagagctttactcagtggtggatgctcctgatgaaatttgggacgcttgggagttgaaggttagggacaggaggggcgagggccgagggcatgggatgggggagtaggattctgcttgttgctctccgcgggagtgggtgcgcgtccaggaggcgctgcttctttgcgggagtttggctgctgcgttcattcgtcgtctgcgcttcagatgcacggcactgagacccttgcgtccgacggtgtcggggctgtggactagaaaggatcccttttgctggaatcgaggctggggtgggattgccggtgggggaaacaccgaaaagatcgtctggcctcggcctctggcggcgggcggcaggttctgagtccgaatggaggttgctcccgggagcgccgggctcagagctagagagctcgggagactgtgcgcctgtggacttgtttatgtgtgtgaagaggcgggggcgagggcctgctgagaggggaggggagcctggaaggggtgggtgtttctcctggagcctgatgtttgtaactcagctgattatggagtgcactgagcgacctgctttttaaataaagaggtgcccgctcctaccccgcaaaacagcgaacgaggagaacatggaagcgctctgtcctaaacgtcaggatgggagaaagttgtaacatagaggagacttttccagaggtcctgttttcacaacactcagaagttctccagcgtactcagcctgcctcccgcctgccctcaattcctttttgacatgtcacacaaagaaagctgaaaggtagaatgtggaggataaactccaaccccctctgccttgggcgcaaacacacagacttaggtatcgtgttaggaggtaagggggttggaaaataatgcaggctccggtagacagtgttgaagggagatagaaagtctggggtatttcccctagggagagtgtgtgggattttgtgttggtgaggactggagtgtagctggacttagagggtttggttgtgtgtgaatgggatatgcttatctatggagtgagattgtgaccattgagtgagtggtcagggagggatggggatgtttttccaaagtgtgtgtgtgtgtgtgtgtgtgtgtgtgtgtgtaggggaaggtggcaaaagagctggagtcctatccctctttggtgcctgggaggtgtgtgtttctggggagtctgtcggatgggcatctgtgtgcttagcgggagacaagagcttgcaggaacataggtgtagctaatgcgaaatctgtgcctatgaagggtgtcagagcaggaggagaggtgcagcctgttgaagacagatggcttgtgcatgcctgcacaaacacatggagtgggtgtggtgtaggagggcggctgtgtgtgtgagggaaaggtggatgcatgtggaaggttgggcgcctgaggattaccaaagggatgtgtgtggggggtgggggaagattatctgaggagcacggggtttgaacttcatgagggtgcactgggaaatttggctggaatggcactggggcatgtagggggtagaaaagtgtgagctcagatcctctttatggaaagacaaagcatttgcagggaaggacaccgggttggtgttggtgtttgcctcccccctccttcctccccagagagaagagaattggaggaggcttagaatgagggatgtacatttaaggggaaaagtccttgtgcattggcactgggtgggaacaggaagagatgtgtgcataagactgaagtaagtagaggaatgcactatctgtgcctggtgtcagggatgcatgttgtata

SEQ ID NO: 97 - DNA, 16803 bp, Homo sapiens
cggtttgtttatgaaaaagtaattagcaggtagatacaagagttaagaatttatcccaggacttactgatagctttatcacaggaaaattaaaattaaaagttctgggggccaggcgcagtgacttacgcctataatcccagcactttgggaggccaaggcggccagatcacttgaggccaggagtttgagactagcctggctaacgtggcaaaacttcatctctacaaagaaaaaaaagaagaaaaatacaaaaaattagttgggcatggtggtgcacgcctgtaatcccagctactcgggagactaaggcacgagaatatctttaatccaggaggtggagggtgcagtgagccaagatcatgccactgcactccaatgtgggcaacacagtgagatgaatccgtctcaaaaaaaaaaaagttatatcaaagaaacatttcctcagcaaaatagatcctttcattatctttactacaaagcaaagaagataaaaaagcaagaaagatgtggagaaaaaagatttcctcagttgggaaccttaaaaggtcatctataataatattattgaaaaagagatagagttcatctatttaatcctgtttcttcagaaaagaccaaccttatgtcatcagaaataagaaagtagtaattacacttttaaagctgtcttttaatcccacctgtgattaaaattcttttctagctcctactaaaaccttgccttcttcattttaagttaattttcccttgtgtgaccagttgttcacaacaggaacaaaataaaggaaatattaaaatacactgaaataagaaagagaggaaagaagaaatggaagggaggaattggagggaaatgaaacgcttccagaaggaaagcagatgtgcctatttcttgggggctgtatgaacacagtagacaaacagcagcatcctgggaatcaggtgagtgggctccacactctcactgatgagtctgattgtctgtgtggtctctggcaggtgtgctcattttcctgggttacaattacttcctctgtaaaatgaggggattgactaggggaatctgagttaccccccattgaacgcatgtcattcattcattgcgtctacctggcagctagtctgttttccaacttgagatatggggtgtggaccagagttcacactgggcatctcctaccagttgtgatttcattctcaacttaaccacagactccttgctaaccatgggcaaaatcattgtttttagttcattaatttcttatgtctggaaggttatctgcaactttcttgtgcacctcttttattttctttatttttaaggtatccatacagtcagttaggggagatgaacataggtggaaagataatagttgtcatcatttgtaaagttattctctctactcactccaatggaactaatttctagcttttagactcattgttgaaaacttctgatgaaaattattttatatagtgagaaaaggaccaatggaattttctaatctttgtttggaggcagaggcagatatgctggagtagtaaaatgcaaatccgggctgggcgcagtggctcccgcctgtaatcccagcactttgggagtctgaggcgggcggatcacgaggtcaggagatcgagaccatcctggctaacacggtgaaaccccgtctctactaaaaatacaaaaaattagccgggcctggtggtgggcacctgtagtcccagctactggggaggctgaggcaggagaatggcgtgaacccgggaggcggagcttgcagtgagcagagatcgcgccactgcactcctgctggggcggcagagagagactccgtctcaaaaaaaaaaagcaaatccgatgcccatagatactatcttgacagcagctccagattttaaaactcattcaatggcaggttttgaacgctggcttgcctttggagtctgaggtctaaatgacagttaagtctatgtctgtgttaaaggaagagacatctgcatgagtagacatttgtgcctggatgggattcaaatgaaacataggtaacagaacatcaattgcccataatgttctaatccaacatcctgtagtttctgagcaggcatttacagagttaatacttattagagactcaaggctcaacttttttcctgtatatcttgatattgcaaaccctggtagttttaattagtggccttttaatctctggagcaaagccaatggcctgttcccttggacaaatttcttaacaacctggcactgagtggctttgtctgcttgtgggagctctcgtacccaaggctgtcataaagagttacataggttatgtctgcatgaaggaaccagctgaagagatgggtgggtgttggaatcagttcttcttccatgtgccaagtgagtgtcctggtgtgagctacattcacctagaaaggtgtgcacacctagcgcacacaaaggcctatggtttcacctgatcctatcctactttcagtctccatttccttcctcgtttcatgccctaggacaacctggggtccaggagggctggctctgtgggtattgcaaccttcctactgcaggtcttggcactggactaaggaacaagagacctgcctcatgtctgagctcctctgtgtaatcttaggcaagttgcttatctcctcctatgactcagtttcttcatatgtataaagagaaaaatgtcactctatcaaggttagatggtgcagagggacagacagctggggttcaaacctctgtttgccacccattcactacctatgtatccttggccaagttatataagctttttatacctcgattttcttaatctgtacagtggagctaataatagcacctacctatatatcatgagtccttacaaaaaagcctacaaagtaggtgccattattatttccacttgacatatttaataaattgaagcctaggagaagacacgtaacttgcctaagatcacacagaggagctcagacatgaaccaggtttctgcctcttagtctagtgctaaaaccagtgcatgtgtgcatgtgtgcatgcttgtatagctacagatatagatatgtatgctggcatggataatacagatataggtatagatatagatatctatatgtacgtgtgtgtgtgctggtttatgtatatatatgtatatgtatctgtatgcacacacatatgtgtttgcatgtgtgtgtatagatacctttatatatacatatacacacacatgcacatgctgcttaaaacagtgcctggcctataatgctaagattattaagtacccaatgctcagtaagtactcaataaatgttacctattgctattatctgtagagaaagtttccacgtgctaacgttccctccctcctgtgctgggagtttgtggtttgaacagacgagagcccagcatgggcacccttggctttttgagcattatttgcattctgaactggggcctgacgacagcctgctctcagggtggggacaggagcagaaccatcagcgaactgactggtaaatatagcaaatcatccgatgggttggctgcatggggtgtgtctgtctgtatatgtttgtgtgtgttggagatagtagtggtatgtaagcttattttaactggaactcatattttctagcccctccaagaactaatacctctttttaatgtttcatgggaacactggacagagggtctttaaagtaaaaactcagtgactcattctctctcttcagtttttctgaactgctgagtagagagaggaatattttcaaggaaacacgaggagattaggatgaaccttctttgcccctcaccccacctcacctgctttgtacctatcagtggaaggtgagggctggtcttgggggcaggaagatggatgaagtgacatttgcaggatcccctgggggcaggtgtataggaggtgagtactcgaggggcatttcatcacgcattgctcttaggcatggctagcctggatgggtctcaattaggagtaaggagacctaggttcccatcctgcttggtctcaaatccctgcaaaggctgcaccttgagttgctaggcatttacttcccagacattccctgccccttactaccagtaaaagtggtaaatgcagggtgtggccagaatgcttttctaatccctagtgccactccaagtccccctacagagttaaagcctaaaatgacttcaaacccaatggaagacattgtgtgatggaaacagttctagttttccagttggctttctagccatgaatttgtgtcctgtgtcctttctccagcaggtcagggaaagtgcaaaaggcaggctttactctacattgactgcccagtgctaatgggtaggagcacgtcagccatgggactcgcagggaaacttgccacactttgaatataggagtcacctggctgtgtcttgtaaccagttggagacttcactcacagatgtcactctggggctactgaaaatagaagaaatcagataatacaaaatttctaactgtattcacattagtgtgttctttgttttcttatttatattcacagtcatgaaagaaaatgaggttaagtacctttacacatggtaaaaccaagaaactgaaaagtttagttacttccctgagctcacaaaacagtgacaagactctggatctcatttccctatctccctgtctctaacccaggataattctctggattgcattgcgtgtcagaatttctctgttcctacagtgtaaatttcagccttaagctccacctacaacttgccattttcgcccaaagcattcaagatgttcttttgcatccagaccctcctccaaatgaagaaagctgcagtgaaaatgccactgagttgaggggttgcaaaccaaacctccattcccataattcaattctcaggccccagccttctgctaaggctaacagatccactccaaaattttaagagtccacagtgatcaaaagcatctgtatattctgaaacatgcaaatcaaccctgtttttcacattcatctcaacatttggtggagggcacaagagtcagctggctgctgagtggacgcagcttagcagatgaatggaagggtcaaatccctctcaagatttgtagaactggatctgaaatatgaaatgccagcatacgtgatgagagggatagtctatcgagtgttttatcatccaaagatggaattaatggctatgccatatctgtgtcagaccccggcagtaaaactttatgggttcttccccgtgaaatattttgtttatgtcacgtgggtctcatcggatgtttttttctcttttcttcacttcccctccccacccttttccctgccctctttgtctcctgagacctattccctttggaaatgcattagttacctaggaaaccttaatgtcatttttttatgagtggagtttggtgcagcataaagttaatttatagggtggttaggaattcatgtcatgactggtgaaataggagactttattatgatttctacatccacctgtgtggtaggaatacataccttccctctatcattacgggtaatttcttgaaacgtaattatgaatatgtatgccatgtcacagaataagttgattcaccgttgttcaatgcaattcattatattgttcaatgtaagccctagaacataattagcaataacaacaaaccaataatataccaggcaatctgttaagagttgaaggatatggtggaatttccttttaaatgatgaggtggttctgggtgaaaggcagagaatgaataagacgagattttgaaatccttcaattctgtctttcatgcacattgaggtccacgttgggaagctatataaattctaaatatgtccactacttcattctgctgatttatttctgtatttgtccaaaggggaaaatatacatccataaaattacattaatgaaatgtgtagtggcatacaaataataatacacaggccattccagagccaagcttctttctaaagatagctcattcccccagtggtgtgacagtgtttcctgtgtaaggactagcagatcgggactggcattcacattgtgccaggcactgtgttgaatgttttaaattaattagttcctttggtcctcatattacttctatgagattggtgttgtcttcaccaattgcagatgggttctaagaagttaagaaacctgtacaaaagcacatggctactgagtggagaaggtagaggggaacctgcttttctcaggcaccaaaatctactctggcagtaaattctaggtcgtggtctgtcattatgtttttgtttttgttttttgttattctgagtttcctcagttattaaatgcagagtgggggacataggggctgatagaagtttatctctgatgtctgtattctgtgtagagagatcaatgctagtccttagagcaaagctgtgctttcttaaaatgacagaaatttgggggaagacctggtcttgttaaataaacataaacaagccactcagtttctgtggacaagtgcatgcgaattgaaagaaaagaagaatgtctcacaggtgactccaggtcatctgagaggaattgctatatggcttgacagcctgtagctcttggtgaataatgctgttgccagtatatagaaacgggtgggcagccaggaatctttcaagtgcggaggcacaaaggtagcatgaagccgcctttcctgacccttaagctcccagtccctgtgcaaacaccttttgcattcactttaattgtttgaaaaacgaagacttccagactccatcagctctagcagctgtctgggtggatgggggtggggatggagggggtagggcgagacctccccacagcgccctccagcagcagaagatgcaacttgcaaatacttcaggatcagtgagaagtgtggtgtttattttagtaacctcaaaagagagaaaaagaaaagcagtggaagaggacagacattcaaggctagctacacgatcatggggaaaaaaaacaagcttgtctttgacacggaaagggtccttggaggccattcggtccacttctctcatttcctgggtcaacatgtcacaatgaattaaccacatactgccactgcacaagaccccctccctcaccacacgctgagcccccaccaccagcattcagtccactgagctcaaacatagggagataagtgctgttttcacaagataaaggcaaaattcaatcccacgttgccgttttgtttctgttcagtgttccaaccacagagtggtgctattgcaaaagataagggtaaccagaaggcacgctctggaaatttgctttaggagagagttttaaagggggttttcaaaaacaagatctgattcctgctctcagaaatcacttccaggagtcagggccttactctcagatgcagcagggagaagaagaaagttcagcaacctaaaaatacagtcgacagatgggcagccaaagtcatggccacgaagtcaacttggagaggagcacctacctagtgaatcctaaaagatctcatcctggatgcttccttaaccaggcctatgtacagggcacaagctcgcagccagcttactttccagtcctgatctttgcttttgctatccataccaatggtatttctatagaaaagaaaaatctctatttagaaacacggatttacttagaagtcacaatattctagtttaaaaatggctctacatagtagagaatgatctttttattctgtcttcttaaaaatacacctttctaattctttttttcttcccaccttcttcattcagcaccttgccactcccttggaagccacaacagcgagctggggggtcagtccctagtcttagagggaagaaatctttaggtctgaagtctaaagaaaaacagtaaaggaaaaggcagttggcggtgctcaaggtagactgtctgaaagaggtcttctactcagaaaagggctaaggctctccctttgggaaaccaatccttctgagaaaaagtgcatctttcaccctctgctcctgtctgggtctctccctcttcctccctccttccctcagtccctcctcccctctctccacaaagacacagcacatatttggcaagattaaggtgtcacctctcatattacaaggcctgttgattgcaagcaaagacagacccaccagcttaggacaaaaccccttggagttggaaataagacaaactctgggatccccgaaagtcccggcaaaatgacgcggccagccagtgcaaggcatctgcagaacaaatccaagtcctaaacgcactgcttgctgccttttcttctccttcctttcttctgatttttcaagtttgtttgccccccttcccctcctccctccagactgccagggacctgggagctgcctgcagatcagcccgcacatgtatttaaccccttccctgctgcagcaggagccaaccacctctttccttgcaatcttcaggttcccagaggacctggagcttgagaaaagaactctgccagtggatctgaaactggggcctgaatccctcctttgaccagggcgagaagctggaggaggggggcaagtgcgggaagtgggggagggcagggaggcgggccagatgagagggagaaaagcagaacccgacagagcacgcccaatccaaaccttcatggtgctgtgtggctgggtggagggaacgactcggcagcctcttctggccctgaggaagacgtcgatattttggcacgaggggagccactgaaggactaccctacccttgcgagggaccgcaggaggtgacgcccctgggcctcggtgggcgcttctggcggttttcgatgtggcaacccccatcagccaggataatgatgaggcaggtacaatctatctagtacgcagcccccagactcccccctcccttcccacctccccatccaaccccccagctactctctgcggccggttggtcctgaactggtgggtgcagttccgatgtttaaccaaattctcaagcaatttcaaggtatttggattttttgaacctgggccctaaccgaaacgcggaacggcttgcttattagacacctcgaacgacagggcagggaggaaacgggatactcgctgcccttcccagtcgcgcgtgagtcaaaaggtcctggcaggagatgatgtgaggagcggctgaagtggcagggaggaagggatgaggggcttggagcggaggtccaccacgcaaggactcgggaagcgggcaagtgggcaaaactctgcttccgggctctcgatttctcgttgatcactaagtggtatttttcccccttctctcgatggcaaatgggcgaaatcaagatgacttaacttggtaaatttagagagaacggctcggagcaagtgaggtctaacgggcagctaaaattatctccaaataagagattttgaccccctccccctatcctctcctcgaatgtatccaccggtggggaagtgagcgtcattactttcggggcgccacgaacaggtttgtttgttgctcgcctttcctgcttctcgcgctgtccccgcgtgcagactggtgggtgctgggcgagtgattagctgcagggccccatcctagtttggaaggaaggggtttagaagttggaggatgggtgaaatgggaggctgcgatccatctccctctcccttccacactcaagctcccgcaaacacgcgcgcgcacacacagcccctccctagtccctcggaccacccgcccccacgcccctctaccttgacctcccttgaccgccgacacagcgtcctgggtgcgggtccccgggagcggggagttcgccggggagcgattgtccttgggcgtgttcgtgctgtggggtggggggaggagtggcgggtgggcttggtagggggtggggagagatctggagctggaagggtctaaggtttggaggaggagtttacgcctcagacctgatcctcctgaggaaaaaggcaggaaaaggccctgatgccttgtaaagaaaatcttgaaagaaaaaagatcaaaaagaaaaatttcaagaaaaagaaccactaagaaaggctgaagacactaacatgtaacctgttacgatacatttaacgtttcgttttttcctggatctctaaaagggaactcaagggtgggggttactgaagaatactacagatttggaagtttttgttgctgttgttgtttggtttggttttgtttttcaagaggggccaggagaaatgaccccttccccgccacgggtcccgaagtgagggcggggggggggctctggggcgcgggcgcgcgcggcgcggcgcgggccggcgggggagggcggcgcggcgcggaaggggttaaggcgctgagcgcggagccatctggccgggttggctggttataaccgcgcagattctgttcacgggactcagagttgaagctcctctcccttccgaacagctccgcgcaccgccccgcgacgcagcccggcgcaactactttcttctctctcctttctttcttcctctcctttttcccctgctgggtagtggctgcggcggggtgggggagactttgaatgaccgagctcgcgtccacctttctcttcatgtcgacgtccctggaaacggccacacggatgccatggttacttttgccacggtaaggggaggcggcgggcaccttgggtgggcaggtttggggatgggggtccacgtggggagggattttccagtggactggtgcggggggccccagatccgcatcccgccccacccccatcgcgccgcgctcactcactttcccgggcttgtgtcttccccaaagtttgcgctgggatctgctcaggccgaagcgcaaccgcagccaccccgctacacacacacacacacacacacacacacacacacacacacacacacacacagacacggacacccttctccacctcctcccctcttgtccctcggctgcccaagaagcttccctcaatctgggaaagtgatcaggtttaagggacctggattggaaagggtgggggcagaagaggggaaatggggacgacgaaagagcaggaaagagattcaacagaatcaaccacccaccactcccaaccgacccgcctgctcctccgagaaagctcctagcgcatcctataacaaaagggggtggcagacagaactccgggcggggaggtgccgcggcagctcccctgcacacgccctgcactctgccggccgctgagcctgattctcagctcgccccagcaccactctggcccgggcgtgggctggggggaggggacgcgcagctcaggacccggaacctcgcgttccagttttgggagttgggactcactgccacgcgccgcgtacctgcgttggagttccccgaaagggttttttcagaaaagacctcgcgccccgggctcctcttggccagcgcccacccggtggccaccccaccctgggcctttgcgcagatgttggagctccgtacgcagcccgcacatctgggacccctccggggagcggcgggcacccgggcccggccatcccaggggatctccttgcggtatcgtccagcctgttctcggactttgagcggtggcgtgggaggccgggagacctgggcacccgcgcagccagccaggtcggagtttaaaggtcccacgacggaccgaactgtcccattgccccagagctttactcagtggtggatgctcctgatgaaatttgggacgcttgggagttgaaggttagggacaggaggggcgagggccgagggcatgggatgggggagtaggattctgcttgttgctctccgcgggagtgggtgcgcgtccaggaggcgctgcttctttgcgggagtttggctgctgcgttcattcgtcgtctgcgcttcagatgcacggcactgagacccttgcgtccgacggtgtcggggctgtggactagaaaggatcccttttgctggaatcgaggctggggtgggattgccggtgggggaaacaccgaaaagatcgtctggcctcggcctctggcggcgggcggcaggttctgagtccgaatggaggttgctcccgggagcgccgggctcagagctagagagctcgggagactgtgcgcctgtggacttgtttatgtgtgtgaagaggcgggggcgagggcctgctgagaggggaggggagcctggaaggggtgggtgtttctcctggagcctgatgtttgtaactcagctgattatggagtgcactgagcgacctgctttttaaataaagaggtgcccgctcctaccccgcaaaacagcgaacgaggagaacatggaagcgctctgtcctaaacgtcaggatgggagaaagttgtaacatagaggagacttttccagaggtcctgttttcacaacactcagaagttctccagcgtactcagcctgcctcccgcctgccctcaattcctttttgacatgtcacacaaagaaagctgaaaggtagaatgtggaggataaactccaaccccctctgccttgggcgcaaacacacagacttaggtatcgtgttaggaggtaagggggttggaaaataatgcaggctccggtagacagtgttgaagggagatagaaagtctggggtatttcccctagggagagtgtgtgggattttgtgttggtgaggactggagtgtagctggacttagagggtttggttgtgtgtgaatgggatatgcttatctatggagtgagattgtgaccattgagtgagtggtcagggagggatggggatgtttttccaaagtgtgtgtgtgtgtgtgtgtgtgtgtgtgtgtgtaggggaaggtggcaaaagagctggagtcctatccctctttggtgcctgggaggtgtgtgtttctggggagtctgtcggatgggcatctgtgtgcttagcgggagacaagagcttgcaggaacataggtgtagctaatgcgaaatctgtgcctatgaagggtgtcagagcaggaggagaggtgcagcctgttgaagacagatggcttgtgcatgcctgcacaaacacatggagtgggtgtggtgtaggagggcggctgtgtgtgtgagggaaaggtggatgcatgtggaaggttgggcgcctgaggattaccaaagggatgtgtgtggggggtgggggaagattatctgaggagcacggggtttgaacttcatgagggtgcactgggaaatttggctggaatggcactggggcatgtagggggtagaaaagtgtgagctcagatcctctttatggaaagacaaagcatttgcagggaaggacaccgggttggtgttggtgtttgcctcccccctccttcctccccagagagaagagaattggaggaggcttagaatgagggatgtacatttaaggggaaaagtccttgtgcattggcactgggtgggaacaggaagagatgtgtgcataagactgaagtaagtagaggaatgcactatctgtgcctggtgtcagggatgcatgttgtataatgttttgtaatgggtttcttatgtaataggagaattcactatcaccagttcatattgataatcaattaaagctaatggagtgcctactggatgctcagcccattgctgggtactggggcatggcacactgccctggaaaaattccttctccaggctcagtaaaactgatgcaattttgccagaaatagacagagctcgacgcttgttgaggtttcttcaaggtctataattcagtttctagagatgtttatggatcttgggggccaaagggaagctgacttgaaatatatctctggttttgtaaaaagtggggcataaagagagggatgatgtagacttttgtgtattgggaagggagctggacggtgttgttgtttcttgtgtggggtgtgggctgggaattggagggtgctgcacttcaggtcagaatgcaggtccagatccctctaaggattgagtttctaagagtacacagagcctccttcatagctggaatgagacctgttatgtggagctggagaatggtgaagtcatgatcaaggaagagatggactgggagtgtttgttcatctttgatgttttctgggctacgagtgtaaagctaacctgagtgtgtgttgggggggtgggtatgcatgcaggtgcgtgcacatgcactttggcctggagtaacgtaactgggagaaaactagcgaggtggataggaggggtggatattctggctcttgtgaagggggtgccagtatgtgtttttgcaggaattctgtgtgtctggggaaggataaaaattgtcttggatactcagatgtgcatctttagcgaaaaaaggtgtacacaaaagaagggccgtagactttggggaatgagacaaaggtgtcgttgatcgggtccataccctgagatggctggtgaggcaactgggtaggaacagagtgaaggctgtgcttttgtgatgcacacatctgcctgtctggagcagacgatggggatccccatttgattaggttctgaccaccgttgggcatatgtttgggaggactttatttgactcatgacatttttgaattcatgaagttacagctgtgccattttaagggtctaccttatttttgagagggaaactcatctgtgtaagagatagtttatatagggcttgactattggtcagaagatccggggcagatatttctgagagcagggtggtgaagtgcaagactggattgggaatgtcttagttctagtccagttctaccacttgggaaaagtgtgactttggggacatttttaatctctataactcttctgtttctctttttgtaaaggggcaatataatgactcaaggagaaggaaagttcactcctcttttcccccatcaaaacttgatgtgtttagttgtatacagccatacaaagatgaaatgtaattaaatacaggtgctagcacgtatgtaggtcattgtgaaaataggatctggacccctttctctttacaatgcaacttaatcagtaatcatgatgcccacagcatctctactgctcactcattgtgtaaataaaactttttataactgcctcagtttactcatccagaagctggaggcagccaaacctagattatagatgatggaaatctttaagatctttgagctattcagaggaaaggtagtctaagaatcaatgttattaatgatcagagacagacatttctttattttttaacatcagctatgcagaccacagcaccaaaagaaatgtgacgtggagaacagcaaaaataataattgcccttgacataggcaccatttgaataaaagaagagcaaagtctagcctgcctggtaagaggaaagcctgggctttgggtctttgaaattctttgtgcccagtgcagcaagttgggtacagccactttccccagagatgaagatggagtcgtagaggggcatggaaacacactgaaacctccgattcctcccagaagtcagtacatgctgtcaactcctggctcagagtcaggctcccatccttgagttcagtggccataaatagtcaggagctaagctatttccaagaggcactaaactaattctgttgcttttcttggcgagattgggccaattaagttgattggaagaggtcactgctgatgggtctcacattccccaggcgggacaggccagcagagtttaattacataacatttcccatgtcttcacttccactcccagatgtatcagatgttcaggcctctcctctttccctacattcaggatgcctgacggagcaggcggcttctgctacaagcttctccagaccttttcctgagcagttacagcactcccaccccaactggagggaatgcaagtctgtgcattgcctggaagtgagagaggggatgcaggctgacacagaagatctttagagcccaccaccctgcctcaagcctcacccgcggctgttttactctttaacgaggcaggcagtttctggcgttggggatgttgaactaatgaccgttgctagggttttagatttagttttatttaaaaatgagtttgttggaaaaggaccaaatcttctactggagacaagcctaagccccgtgtggtgctgctgataaggtctgtggatgtactttgtgcatggacaggcatgtgtggagtaagaggagagcacaggatgtgcgtgcgtgcgtgctgggggacacgtgagcgtaggagatgccctgggtagatggggcatttgtagagcttatgttatgggtggcaggtatctggatgcttggctcagattggattgtcattggattgcttcttacaggtgggacagcctgagaaaaaagttggggacaccttccttcagatcatttttatatgggcatgttgaaccttgaagtatgaggccagtgtagatattacctcattcttgcctggatggatttctaacaagattgaggctggacaaaaaaaaaaaaagtctttcagaggactcattttagaacctgtgagaacacatgtagatggccccagagcgttaaagtattttttgttgttgttaatagttttccataactcagtcttttgttttacctaaaaatactgagaggctagaggttgcacacacccccacatggtcagaatgcatttgctgttcatgtccccatctgtgccatggtccttctcaaataggattaattgggaactacggagagcttgccgcagctttggttgtcctcacagg

SEQ ID NO: 98 - DNA, 1442774 bp, Homo sapiens
ttttcttggtctattcttcgtattccttctcgaacatattatattctttgccccgctacccaccccagtcctccaggtagttagattcctagataaattcactcacagatcatgggaaggtaaaagagaataacacattagaaattttaaaagttgctctttttcatttatattcccagtttttctatatatatattaagagctgaccaaataatcaacagtgtccaaatttttctgccctacccagtctaacatttgtgtaacatgccctccagtttaaaatttagcaaactgcaacttcatccatgcatatattagaaattacctcttgcttttttcacaaaatattgtctcagtataattaaatgttttgttaaagtgacctattcaaaataaattatcaaagaatagcaaaagatctcaacagattaccatatactatgatgatttaacttttgctaaaagaagtaaatctaattgcttataatattaactcaaagagaaacagtacaaaatccccaaatctgtcatgtaagctaaaactcaagtgtaaattgtaatgagcagtgaacatcaccatatattgaccaccaatattaatttacaggagccttgattaactacatttatgatataatgtagttatatcataactacatactatactgtatatataactacatactatatatatactgtatatataactacatactgtatatataactacatactataatgtagttataactacattatatctaattatatatataattatatataactacattatataatatatataatatatataactacattatatatatataatatataatataaccatcaaacccgagtcatgtttgtttagaatgctgaaggttgaatggcaatgtgtactgctaaatgttaaattattacagaatatgcattattgaagtaaatcactttcctcatatcctttggaagagactggccataaaatgtagttggcctacttcagggcagtttacccatccatgaatcctgagggtgcattaagctacatcataacagtctgtgctgatacaaccaacgttctcatgttccatttactcagtcaacaggcccaatcagaatagcttaacgtaatggtgacggtaattgtcactatggagcaaatttggatttctttattcaatactatatacagaaacaaggagcacagaaggtgagggatggggtggggtagggtgggggaagattcaggaaacccataaattcatcaaaggcttggaaaataaagacttaaaaagaaatgggccgggcatggtggctcacgcctgtaatcccagcactttgggaggctgaggcaggtggatcacgaggtcaggagttcaagatcaacctggccaagatggtgaaaccctgtctctactaaaaatacaaaaaattagccaggcgtggtggtgggcgcctgtaatcccagctactcaggaggctgaggcagagaatggcgtgaacctggaaggaggtggaggttgctatgagctgagatcatgtcactgcactccagcctgggtcacagagtgaaacttcatctcaaaaaataaaaattaaaaaaatgttattcagtctgtagaaaaggatcctaagagcatttttaacagttgcaaatttcagcgtaaactcctttggaaccacaaaaacttgaacttaaattctggcacctctgcttaccagctctatgggttggggaaaattacataaacatgctaagcctcgatttcctcaactgtaatatagaatacgtatctcattgaagaatgaaatgaaataatatagacatagcagtattatctgtgcccccattattccagctcagagagctcctgtcagcatcctcctgtatgtctgaggtcctatcttaccatcctggggctttgtggtgattagctgcatagcacagctaagtggtaaacaatgaagactagtcacactcaccaggcattgctcccttttcaagagacttagctgtgaagggttcttagactagggaaatgcaaatttaaaccacaatgagataccactctacccctactagattgatgaaaatttaaaaaatttaaaaagtctcaacaatatcaaatgataccaagaatgcaaaggaactagaattctcgcacactgctggtaggagtacagaatggtattgtttttggaaaacagtttgacagttacttttggaattaaatctacctttattaaatgatgcacaagttctgctcatgggtatttacctaggattaattaaaacatatgccaacaaaagacctgtatgctaatgttacggcagctatattcataatagcccaaactgaaaagtagccaaacatccatcaaatggagaaatgataaaaatcttgtggtgtgttcatacaatctaatactactcaaaaacaaacaaacaaacaaacaaacaaacaaaactcactcttgtaaaaaataacatgtttgaaagcattatggtaaatgaaggaagccagaatgaaaaagctacatactacacgttccatttatatagagttcagaaaaatacaaagtcttagggacagaaatcaggcaaacattgctacagtctgggggactgaaaagggattgattccattggggcacaaggaatattttaggggcaatgggaatgttctatatcatagttgtggtagtcgtggtggttatatgaatatatatttatttctaaaaatgcaccaaattatacatttaaagttgtgtaattttgtcttatatagcttaggtctctataaacctgacttaaaaaatatttcataccaaaaaaaggcaagtaaaaaaagcacaagacagaaattaataagttatatatctaaacctaaacttttaccaccctgagcaatgtggcaaaaccccatttctagtaaaaaaaaaaaaaaaaaaaaaaaaaaaaaaacctatgctggatatggtggcacagcacctgtagtcccagctacttgggaggttaatgtgggagaatcacgtgagtttgggaggttgaagctgcagtgagccataaccacaccactgcactccagcctggacaaccagagtgagaacttgtctcaaataataaaataaaatgaatctaaactttgcaaaagacatacctaaaacatagttatataggaacttgaaatgtaaaaggattttaaaaaaagatattttatacaaataccaaaaaggcacaaatttaaaaagaaaatttaaaaatgaaaatacagaccaatgtagccaataactgattcttagaaaagaataataaaactcataaacttttcacaggattgatcaaggaaaagtgaaagaaagcacgaataatcagcgtcagaaataaacaagtggacatcactacatatcctgcaatcaatatcaaaagaagatattataaagagctgtaggctaatagattcaaacctgtagatggaattgtcaagatctttgaaaagcagcctttaacaaaactgaccaaagaagaaatctaatatttctttttctttttctttttttttcttttttttttttgagatggaatctcgcactgtcacccaggctggagtgcagtggcgcgatcttggctcactgcaacctctgcctcacgggttcaagcgattctcctgcctcagcctcctgagtagctgggattacaggtgcacaccaccacacccagctacttttgtattttgacggggtttcaccttgttggtcaggctggcctggaatccctgacaagtgatccactcgcttcagcctcccaaagtgctgggattacaggcgtgagccacctcacccggctgtaatatttctttcactactaagaaatggagtctaaaaatcttcctatgatttaaaaatttttaattaaattatcttgtaccagataacttgaaatacataggaagaaataacaccaatattgcacaaaatgttccagagaatggaaaaagaggtgtgtttggaagcttctgaagtgactctcaatgatcctcacctcctggtattcatgcttttgtgtaacctcctctccttgagtgtggactggacctggtgacttgcttctaatgaacaaaagacagcaaaatcatgggagatcaattccaagattaagttgcaaaagaccatgacttctgtcatgcgagcaggctttctctccttactcacttagataaagcaagctctcttgttgtaagctgccctaaggagaggctcacagggccaggatactgagagtgtccttgtgccaacaggtcatgagacactgaggtcttaatctaaaagccactgacaaactgcgtgtcactaacaaccttgtgagtgagcctgaggtggatctttctcagtggagccttgagatgactgcagacttgtgagagccaaaagatccaactaagcctttcctgacccacagaaaccatgagattataaacattgttttaaaacactaagttttgttgttgcacaggattagatgactaacacaaggaggaatgtctgcagttttattttgggagccaacataaccttattactaaaataaagtgatgtgatgatgaagaaaagtataagccaatctcactcatggacatagatgaaaaaatgctaagcaaaaaaatagccaacaaatccatttttacacaaaaaagattatgcaaaatcactaatttgggttattcctcaggaatacaagcttgtgttaacatttgaacagtaatgacatatttcattacattaagagaataaaggaagactatattatgatgatttaaacaaatgcaggaaaaatatttcataatatttaatacccattcatgaaaaaatatcctgcaaactagggacaaagtgaagtaatccttccttgagaatccttaatccaatagattattgaaaacaaaacctacatcaaaccttacttaatattgatatgttgcaagcttccctagagttcaaaatgagataaagagtcccactaataccaggtctatccaaatatacgaaaggtcctacacttttcttcacttttcttttttttttttttttttttgagatggagtcttgctctgttgcccaggctggagtgcagtggtgcaatctcagctcactgcaatctccgcctcctgggttcatgccattctcctgccccagcctccccagtagctgggactacaggcacccgccaccacacctggctaatttttttgtatttttagtagagacagggtttcactatgttagccaggatggtcttgatctcctgacatcgtggacatcatgatccgcctgcctcggcctcccaaagtgctaggattacaggtgtgagccactgcgcctggcctagacttttcaataaggaaaaataaagaaataaaacacacagttaacccttgaacaacatgggtttgaactgcatggattcgcttctaggtggattttttccagcaagcacagagggaaaatacagtacttgcagcatgcgaaactcacacatgttaaggatggacactgcagaactttaagtatttgagaattttggtcctggaaccaattcccagcctatactgagggatgactatataatgtctagtaaggaagaggaaaaaaaaggtcactcacagaaaatatgtttgcatatgtagaaaaccaaaaccatacagataaaacttgaaaatatattaagttagcaactttgataaatgcaagctcattgtacaaaatccaattgcatttccataaatcaggaaaaaaacaattttaaaaatttaaattttataaaaatactgcaactatttgaattttctaggaagcagattctgagaaagatatttccataacttactgggatgtattctcaaaaccaacatatggagagtgaagaaagtaggattgagcaaagggaaaattaaatttcaatgcagtgacaacaaggactcagccaatcaatcctacaggaggctctgaagttgggatggtgcttcaaagggtctcaaattgggataaggggacctctcaggcttttatattcttacattgaatcctctttggaaggtgggagtggtgcgaggtgaccttaggccaggtgactctcttcaactgaaggcaagctccagggagactcagctgaatgctgttaacccctaacactcccagcagctccaagaggagggtttaggtggtacaccatgacatccactacagatgacacacgcataagcatcataaatctagcaaaagtgtggaaggacttaatgcagaaaactataaaatgttattgaaagaaatcaaaacaacctcagtaaatgagaagatataccctgaacatgaacaaaaggctcaatatcataaagttgccaaatctcactaatagattgaatacaatcctaataaaaattccaatgttaagtatgtgtgtgtgtgtgtgtgtgtgtgtgtgtgtaacttgacaaaccaatactaaaaaatgtctacgaaaatgtagaaatgtaaaggctatgcctagccaagacattcttaaagaaaaaaatgagtgaaagaacttgccccactgaatattaggttttattataaaagtacaattattaagaaattaggtgctggcataagaaaagaaaaaaagctgaaagtgatataactgcctctcagttcctccatcctcctctcctatgatgactatatcttcctagctcagtcattctctcccactgtcctgcttacagtctatataccttgtcatagccagtactaagcatcacactcttggaccaccatgcctatatttcctctagtgctctcactccaacagttccttatttcaccaagatctaaaattcatgaatcaaatacatcttgtactgcccctcaccttcctgtcctcacttccctacttgcccttcttaaattcagtagcccatcattatagccctcactcacttatagcctctctcttatacttctctcccattcctctctcacttcatcacatgtaattggcaagatctcaaactccagaaaaactgataatagccataattttgcctatgccatgtctgttcccaggcacttaatgtaagctggagaaacataaaacaatgctgactcccttcactataagttatctaatagaaatggtaaaacaagacttgcaggtgacaggttaggacacagtaagcaagtaatttgcccttagtgcagaccaattatccttctatgttttactagttcgctaaattttgaagcctcttaaaaaactatctccctcctctaatctccaatatcttttcccccatcctcactcttagatgcagaatgtatttccatttcagaaaataacaaaagaatttccagtggtgcccacactgcatttattcacaaaccagcatctgcacccacatagtctgccttcccaccaattacttcagatggattgtacctgctcctgtctaaaggcaatccctcttgtgcactaaatcccattgtctctcacctacacaaacacatcagttaagttattctctcatctgtcttccattattaattttccactttgcagtgtgacattcccatcagtgtacaaacaaaaactgctataatttccaccatctgcaaaacatgaaaaaaccctctccttgacctcatatccccttccggttatcctccatgtggctgctcctttttgttgcaaagctcctttaaaattttcctatacttactacctccaacttattctcattttttcttaagctctctgtaatataataaggctttcactctccatcaccatttcacttaaaactcctcttatcaaggacaccaatgaacgcctctttgaccaaatcactggtcaactcattgagggaagttttccaagggagcatggctgagcagtccgggagttgactggtcagccatggagttgaccggtcagccatgctcccttggaaaacgtccctcatttaatttctaaataatacacggtcttgattttcctccagcttcactggccatttcctatcttctttgctgcctcatgcgcacttcccaagtctaaatagactctcttaggatgcaatctttatccatgctcactttctagattttatttagatttatccacatgattgtctaaaagactacttaaacttaacacattcaaggcagaacttccttttaacctgcccctcccactccctgccccatttcaataaggaacacttcttccatcctgccaattcctcagaccaaaaaccttggagccatttttgaatgttctctttttctcatatgccatgtccaatgaatcagcaaatcttattagatctttcttcaacatatatccagttatcaccaccccaaccactccccaccctgctcagagccatcacaatcgtttccccagattattataatgccatggactcctagccagttttctgtcccttaggcaatttattctcaactcagaaaccagagtgacccttccaaaactatgatcaagctcttatcactctctactcaagcccctcaatggctttatccctctcagggaaaaactctcatgccttaccatggcctatgaggttctatgtcatctgcatcactgtgacctctctgtcctcatctatcaccactgtcctctctctctctctcagccatatcatacttgcctcttttcttttcttttcgtttttagaagtgaagtttcactacgttgcccaggctagcctcgaactcctggactcaagcaatcctcctgcctcagcctcctgagtagcttggactacaagcatacaacatcacacccagctctgaccccttttctatccaccaagcataatattcacttgcttcttcctttacctagaaacctctttcaccagaaattacgatgtctaactctcgcacttccttcagatatttaatcagtggcttaattaatgaggaattccaggaccactctatttaaaatgacttcctcttcctttcttccacttccttggagataagagttttatagaacttatcactatatgaatatgaatatagataaaatacatagagatcattatgtctatttgtacatatatagatgtacatacatatacaatgcacatcaatacatatacataaaattttttatatttactacctatttctgcactctagaatgtaaactacgtgaatacatgatgttttgtatattttgctcattattctattcccggcatctacaactgtggctggcaaatatctggggttcaaaaattatcagttgaataagttaatatacacattcatatttttaacagatgtaaagtctttagcatttaaagactgactctgctttatctaggcattccaacaaagcctcctcctgcactttgatccctcacacttagatttaaaaagaaaacatttttatattattttctacagttggtggtttaatgaatgtcctctgtgcagttggttcattttaaagccacattatttccctgtctaatcattggcagtggcaggaagtagaattaatctaatctttcagaaggattcccctgaagcctgaagcactattgcattagacagcagaggtttttccttactaggacagattttcatgtcctagtgtatatttagacactgaatccctttaaaactaatgggaggtctgtgggccaaacacacttacaggaaatgaaaggaaatggcacagtaaaagcaagctgtgaagaaagatcttcacgcttgctgttacctaatctgtcacatgaaagatttattttaaaatttctattagataaaatgaacagaaaaataccatgtacagtattctttcagtattcctgctcttgtttccacaagtgcctcctcttcatgtgagtcatgtattgaggtaaagaaaaaagagtagaataggatattttacttatctcaaatcagaaatgtcatcctatatttgaagaataattgcaaaacaaccaaaatgaaaaaagcaatgcaattttggaaaagttgaagctataaattgtcagtaaataactaagttatttctattttcaatgaaaaataacatttggtcaaataggctgtagtttggtttattttgctgttgttattgctatgctttgttttttaagagacctaaagattagttctaatattgggtactttcttagcttcaaaatatattaatatttagttgtgcatctactactttatattgctgccatattcacgcttttattattctctattctttaacatattcttacctatataggagtttaccaaaagaagtaaacttcttcacttttttctccagcctttctgactaatactgtctgttgcaaacttcctttgcttttctaagataatattccaggcatatcccaagcctttttggtctctttcagtgacaagaacaatttcatttaagtaattgtaattcactctcagatgctaaaaaaaaaaaaaaaaatccagactaaatcagaagttcaatctaacttccattccaaatcttcactcctccgcagaactgaaacttgatctttggatgtgatagctgcaataatgaagtagtcttagtctgtttctcaccttcctttctccatctacattacctctgctacacgttctcccagggtcaagatagcaaacaggggagattaggaaaataaggatatcttatatgacagatattttataatttgccatagcacatgcccaaaggcagatgcccaaatgttagttctctcatagggcacattgtatactctttggtggttcccctttgccctctacttgtcctgccattgcaggttgttccagccagcttcatggcttgagaattctccatactaggggctgggcagggtggttcacacctgtagctcacactagcactttcagaggcagaggtggatggatcacttgagtccaggagttcaagaccagccaggccaacatggtgaatgaagcctcatctctactaaaaatacaaaaattagcctggcatggtggcatgtacctgtaatcccagctactccaggggttaagaaacaaaaaaaacacttgaacccaggagacagaggtcgcagtgagccgagattgcgccactgcactccagcctcggtggcagagcaagactctatctcaaaaaaaaaaaaaaaaaaaaaaaaaaaaaaaaaaaaaaaaaaattctccatactagaaacaggcaggaagcaggcatcagtttctttgtttatgtatgtctctgctctactgggtttatcaaggcctctgaagaattttcccaccaaaccccatctggtgagattaggcaagagttaaacatttctgtagctacataatcatccagtcagaaaacaagattccagtctcttctactttcctggcatctccagattttaaaacttaaattcttggagactcatcaaatgacttgagatgagtgctggcatctcagtctctattcccttggttggggagaatttccatggtactcctaattacaacagagacacacctattataactattctctctccaatcacactttaaagtgcctgttcttatataaaataaaagttggtagctggattaatagtttctagagagattctgctatctctcagtaatttggtcatgaatatgtttaccatctttctttataatatatgtgtacttaccacctaccattctcaggtttatgactcagttcacattctaagacattagaaaaaagttacagtctacatcctatgtcacctatcttaccattgcagaatctttgtcattctgcactatagtcaaaagcattgtgtagtagactgaaaaagagtcatcaaagacatccatagcctaatcttcagaaaccatgaatatgttaccttaaatgacaaaagggactttgcaaatgtggattgaggaccctgagatgggaagcttatcttgcattatctggtgagtcttaaatgtaatcacaaatgtcattataagagagaggcaggggtgaatattagattttagaagtaggagatgtgaaaacagaagcaagagattagaggagttcaaggaaggggccctgagccaagaaatgcaggagcccatcagaacctagaaaatgcaagaaaaggcatctcccctagagcctccagaaggagctagcctggccaacatcttgactttagcccagtgaaactgatttcagacttctggactccagaaccatgaaagaataaatttttgttcttttaacacaccaagttgtgataagttgttctagcaaccacagcaaatgaataaacattatctcatttaggatgcatttagctgaaaataataaaagtcctggactcaaatcaactgaagcaataagaaaacgtctcttttcacgtatcaagaagtgtggagttaaggctggtttaggtgtggtacaatgaagagtctagtttctttccaattctctgtgttatgcccactctgtgtgcaattttattcctgagcttgcttgtgtaaggctcatcagatgactaccagcaacagtaggacaatatattatgtcattcattgaaaaaaagaaaaactatcattttagtcatggtcctgctttttaatctcatttggccagattaggacctttactcactcctggaccaatcacaatccaagaatcctatgctctaattgacttgagcaagtgttgctgaaccaatttcaaacaagggtgaaattagcataattgtcattgcctaatcaggacccactcctgaagctgaggaatacctgggcaaaattggcaatagggagatggcaaaggataaggagaccatatatctaatttatcattcaactggaacacgactaagaatgaaagaagtcattatatgaaaaagatacttgctcacgcatgtttatagcagcacaattcacaatcgcaaaaaatgtagaaccaaccaaaatgcccatcgatcaaaaagtggataaagaaactgtggtatcaatacatacaatggaatactgctcagccataaaaaggaatgaattaatagcatttgcagcaacttagatgggattagagacgattattctaagttaagtaactcaggaatggaaaaccaaacatcgcatgttctcactcataagtgggagctaagatatgaggatgcaaaggcataagaatgacacagtggactttggggactcagggggaagagtgggagggggtaagggataaaagactacaaattaggttcagtgtatactgttgggatgatgggtgcaccacagtctcacaaatcaccactaaagaacttactcatgtaaccaaataccacctgttccccaaaatcctatgaaaataaaaaaattttaaaaataaaaattaaaaaaaaggtgccctattaagaattccaccaatataatagatataaacaggtactgtcccactcaccttgggacttatgctcatcctattggtaggaggccaatagtgtcacccacaagcattttgattagagctgactagaacactagtcaccagttcctaagaagaaaggattggctgggtgtcgtggctcacacctgtaatatcaacactctgggaggtggaggtgggcagatcatgaggtcaggagatcgagaccatcctggctaacacagtgaaaccctgtctgtactaaaaatacaaaaaattagctgggcatggtggcatgtgcctgtagtcccagctatttggtaggctgaggcaggagaattgcttgaacccaggaggcgagcttgcagtgagcagagatcatgccacttcctgccactgcactccagcctgggcgacagagtgggattccatctcaaaaaaaaaaaaaaaaaaaaaaagactgcaaaaatgaggaaacacttaatctgcaagggtagaggacttgacaaaagtcatctaattggaaagtggaaaaacaaatacctaaataaccaagcctttttaacctaattttacttttctttccatataccactcatgtaatgttaagtccaatacagaggtcaacctctaattagtttgctggggctacaataaccaagtaccatagattgggtggcttaaacaacggaactttctctcacatttccagaggctggaagtctaaaatcaaggtgttctcagtgttggttctttttgaggcctgtgagggagaatctgctccaggcctccctccttggctttagacggccatcttttctccatatctcttcacatcgtcttccctgcatgtgtctctgtctacaaatttcccctttttatgaagacaccagtcatattggattagggcctaccctgatgacctcactttaacttgattacctctgtaaaaacccttaattccaaataagtccacattatgaaatagtggggcttaggatgtcaacatctgatttggaagaggggctggggcacaattaaatccattacacaccaccaagggaaattcctaatgaggcagccagacaggggaaaggtctgtttatcaggccatatgaggaactgctaaggaagcagcaatgctgtttctcagggaaaacttgtgagagacaacttttgtctagtctcaatttcttcaaaagtcaaattagaatcaactgatataaattacatgaaaataaatttttattcacttctatatctattttcctctcttaccaagcactttctggctatgcatttgagcctttcagatgattattaaaaaaagaaggaggaagaaattattatggggtgcaaaaatactcaataaaggaaccaagctcaacattaaagacaaaaagtatcactgtcagggcttttatattcactatagtgagggtctcctccccaccaatgacttcagagaggtccctcaggcctttccctgctgtcacagtgtcctaggtgagcaatagccccgctctgtcgtttccgtgaaggttcatgaaaaaaactccaagcttaggatttcaatttgcattataaaacaatctataattaaactttgagtttcattttcaaaaactcagcaacatagccacaagagatatgcatgcatatacacacaacagacacacacacacacacacacacacacacacacacaccgttttctagccctagtgaagctgttaactgcagtaagccctcagagggccaattttaggtcaaaggaccatagcagtttgtgggaaagtgagggagaataccatttattttcgttctaaggactccatgatcaattagtgaagtccaaatgtgtctgaaaatcagactattctggtaactattttggcttctttgtgctttacagtaacaataactcgattgcctctgctgattaaatgccacacttagtccctgccacctagaaccccattgtctcattgaacaagggagttcattctgatggcagcagttactactgtcatttttggcctatagagaatagaccacggagctcttccacggtgatgctgaggggtccttcatgaaaggatttctcacaaccttggtaaagtcagtgtcctctggactgtctgaacataattaggggatgggtaagtatgtcttacatgataaattcactctagcattccaatttttctaagcctttgaatacctttctcttcagtattccacaaaagttctgatattttaacttcatttagtgtagggtgtcttggattcaggtttcagtgaaccaattataatttttaaaaaactgttaagagtcactctcagctgctcacattaacacatcgaatccaaatctgtgctcagtgcatcaacatgaatgaaatcagtcctgacataattcctgaaaatctattttgacatatattctccaaatttccatcatcattacaaattggcaaaattttgcaattcttttcatgtgtgtttaactgcttatggttcacatgctatgcctcacccctgggatcttttgaaacttaaatctgggtatagttctagaagtataacagatgtcaaggagaggtcttgaggaggatcagcaatctcccacaaggcaactaccccagggaaggctgttacaagtacttcaagaaagaggagacttggtgcgataactcagaaacagaaaatcaaataccacatgttctcacttgcaagtggaagctaaacactggatacacatggatatagagactggaataatagacactgtgagtacaaagggatggtgggggagagggctaaaaactatctattgggtacaatgttcattattcgggtgatgagtacactaaaagcccaggcttcacggctgtgcaatatatgcgtgtaagaatcctgcatttgtaccaactaaacatataaaaataattaaaaagaaaaaaaagaaaggggacgggcacggtggctcataatcctgcatttgtaccaactaaatgtataaaaataattaaaaagaaaaaaaaagaaaggggacgggcacggtggctcataatcctgcatttgtaccaactaaacgtataaaaataattaaaaagaaaaaaaaagaaaggggacgggcacggtggctcatgcctgtaatcccaacactttgggaggccgaggcgggcagattacttgaggtcaggagttcgagaccagcctggccaacatggtgaaaccccatctctacaaaaaataccaaaattagctgggtatggtggcatatgcctataatcccagctactcaggcggctgaggcaggagagtcttttgaactcaggaggcagaggttgccgtgagccgagatcgcaccactgtactccagcgtgggtgacagagcaagactccatctcaaaaaaaaaaaacaagaaagaaaagaaaagaaagaggagactaatctcttcagacaggggaagaagggctgcttctactaacaaagcagcttgatggaatatatgggttcaaggtcttcagcttcctcagaatctactgatgtctttatcccatttttcaggatcacactccttcccaaacaatgctctaacttttacataaaagagctttcaagtttaagaatttatttatttatttatgtattattttattttattttatttttttgagacagagtctcgctctgttgcccaggctggagtgcagagaggtgcaatcttggctcactgcaacccccacctcccaagttcaagtgattctcctgcctcagcctcccaagtagctgggattacaggtgtacaccaccacgtctgtctaatttttgtatttttagtagagacagggtttcacgatgttggtcaggctggtctcaaactcctgaccttgtgatccgcccacctcagcctcccaaagtgctgggaatacaggcgtgagccaccgcacccggcccaagtttaggaatttaatttgcattatagaacaacttttaattagactttgaacttgattttcagaaaacgcagtaacatagctacaagacatacacacaacagacacatacatcacacctgtatacaccaaaagtttcttttaaggaagtcatggaagtgttctggtctcttacccactttgagctgggaatttaaaagcttaagctcagaaattttctttccacaagttctccagtgcacttaaaagcaaccagtgaattccatcatattccttatttttttcctaagtggtctatactagcagctacttggtcacccaaagtgttgccttctttaggtacattaacacagttgattctacatccggtgttgggcctgaagttgtatgggtgggcctggctggcagttgggagaaaaagtgaatgttaagtgtggaagagtcgtgacaaacgggaacccacaaggacaaattgagttctgtgtctgctactgtctctaaccttgatggaattggtggtctgcaggagaagttggcatccttcatccctgggatgaacaggcacttgacccaggacttggagaagctgaaggagcagcccctgaaagccgaaaggaccacaggctctgctgatgctccaaggtggagcagcagatgccccccaaattatatgaacaacggcacctgttgtcttacataaacttttacaatgtaatagccactgctttaccaccaacttccatattgctctcaaatttctcttgtgtccaggtctaactctgaaccatacaggaagggaattctgggaaatatagtttccacttaggtaacccaatatgaagccaccatgttattcctccaatattcttttctcctccatttcttttctctgaccccgttgcccttgcatcagaatccttcctcttccttcagtgaaatgaacaaaagtctctatacattcagctcactcaaagaattatcttgggggtaagggattgtttacaggatctcacatgcctaatctctcctcaagctttaagctccctgattgtgtgtgtgtgtgcatacatgtgtctagatatacatatatatatagagtatatttgtgtataaatacaggtatagtatgtatgtgcatacatatgtgtgtatgtgtaagatcagatccttgtttattttgaaatatcatattcatattttataaataaaattttcctgtggagaaatgaataaactaatgctaaaattccaaataaacatgaaaatattaagtggtggttccattacaataatgtagacactaggatgcatttctgccagtaagaatcaattaaattaaatcagagatcaaaagatctcatattatagttctttactttcttcatttttctccactacggtataattatataaagtagaattccaagagtatgactgccaggaaaggtttattatcaaccttcgctgatgtctctttgttaaatcacttctaaagtgaagttcttattcattattgagattctattttattaaagattgattttgaaaaaggtttcagattcttataacattccatctttggtaatttcacctgcatttgacattttattaaaaagaaactaattttgcttcttgatgactcacggagttcttcatatcagacatttctttgtagaaatttgtttattttatgaactcatggccccacaccatcacccacacctgaacacacataaaaacttagtaaataaatatggtcttctgagtccttcactctccaccatactgccactgggcctatgggcaagtgtggcaaaaggtagaactctacaataattacagggcaagcgtcactccttttctgtgctcctacttgatttttctccgttttccccttctgcaacccccattgactctgacttcctaccagaaagagactatatcttctttctgtacatctttgtacttggcttaatgaggcactccccactccagagtcgtgtgatatggattcctagtgttactggcatttgaattgggagcacttaaaaaaaaattcaaaaccccaaatttctagacctgtaaatgtagctcccgggcagtgtgacaaaaaacactacaaggcccttgtacagtacagagctctgccttcccgcttactcataaagccgacccttcctattgtacttagcaggaattgtggaacacaactgcatggccagtgcccaatttccctagactgtgaaggtaaaataggacaattgtcttcataactctctctaatgaaataatccctgtccaccacagttttacatatatatatatacacacaaacatacatatataccaaaaagtttacttctatgctgttttataaagatgcgtgatttcgttcaatgcgcttaaaaatgtatatacaataacaatgcacaaccgtgaagatagataagcagaggataggtttatcctctacctttcaacatatgatgtaagatcagggcctggataaagtacccatggtaataatttgtaaaaagttctggcagcaacactagtctttgctgaaaatcgcaaaattgattcaagagagattgcaagggcaaaataaaatgtaaatttcaacccagtaaaagctgatttaacatcttttaacataaaacttgtgggacactctgcctcagcaggccataacaccagctgaacattctgcataattaaagtcgagtattcaaggtgagtgttaactactggatctgtttttaatgtaaatgaatctgggttttgttggaagcgagggccttactgaacatttatatcctctattagaaatatctatttattttaattttcactgttctttcctttttactatgttttatagaaaacattggtgtctgaagccatacaatgaagaattttcatagattatacttgcaaaagaaataccaaagtaccagaaagattctgtaagacaaacctaggatgcagacactctcttcatttcaaaaactagatatttccaggggcctgagaatctaaacactcctcaagcattcaagcagaccaaatcaagacgcttcacatctatgtcttattactattttacaaatgaatgcaacggtctcatttacagacatcctagtaaccacctcccctaccccattttttaaagattatttagctcctggttcactttctctttccccatcatgattttctatccatatctatcagtggttatcaaccttcactgcaaactgaatctcataaggagcttttaaaaagtgattataggctgggcacggtggctcacgcctgtaatcccagcactttgggaggcggaggcccccggatcacgaggtcaggagatcgacaccatcctggctaacatggtgaaaccccgtctctactaaaaatacaaaaaaattagccaggtgtggtggctggcgcctgtaatcccagctactcaggagactgaggcaggagaaaggcgtgaatccgggaggcggaggttgcagtgagccgcgatagcacccctgcactccagcctgggcgacagagcgagactccgtctcaaaaaaaaaaaaaaaagtgattataggtcccactctcagaaattctgttttaatttgtctgagatggtgactagactctggtatctttttatgaaaagctctccaggtaattttaatgagcaggcaggattgagaattgctgaggcagataattctctctacactggattccttattcctaatcttccatgctccagatatcacatactttacttacttcattcgtccactcccatggttattttaggttggtgcaaaagtaattgtggtcttttaatggcaaaaaccgcaattacttttgcaccaacctaatacaatagagcttagcattatctgcagtcctccataatgtcaattttaagcactcgacttcctttactagatctttttccaaaattcttagggcctactttggcactccattggccaccacctttaagccaaaactcccctcctcatgtcttcactgcccagaataataatcactcttctgtataaaccataactctcttctctgtctcaccttcccttgtttatgccttacaaaaccacaataatggataaatctttaagttcccgcgttgacctgtatctcgtgtggctggagaaaaacacaactatgtttgtctctctttaaatccttgaccgctaacaacaagtgagtccttagaactttctagcaatccaattttatttcccttcttaattcactctcctactgtcctagtcgattattttatacttttattctcctcacatttctaataccatttcaattttcttcattctcaagtaatggccttgcttgtcattttaataagcaattagaaaccatcaggaaatgaacttccacaatgattatatttgcctctgtatttgtgttcttcgattttttcttcttagtccttagcatctgatactgtcttttgcacataataggtgcctaaaaatcatttgagttgagctgaacctgactgaactatagtatagtctccttgaacacacacttcctgggcattgaggtgagagtagacaagaaacagagtagggagacatgggaagacagcccagggcttggagttttttaattgctgtgaacaatcaaacagtcaattaatgttaccttgagtgtttgttgaaggctgtctcaggaacatattagcaattgcagcataaacaggacacaatatcctctgctttttttttttttttttttttttttttttttttgagacagggttttgttctgttgcccaagctggagtgcaatggcacgatcttggctcactgcaacatttgtctcccgggctcaaatgattctgctgcctcagcctcctgagtagatggcactataggcacaggccactatgcccagataatacatatatatttcgtagacatggggtttcaccatttttgtccaggctggccttgaactcctaggctataatgatcctcctgcatcaaccttccaaagtgctgggattatagccatgagccattgcacccagcccatcatctgcttttgtgattgttcctagcaattaaaaattccaagtctttgatcatgtgctttacctgattccaagtttcagtagtgaaatcctctaagaattaaaacaagaagatttctgctttttgtttttgtcctgagagaatttcaccagtgaaactcagaatcagataaagcacatgaccaagagacatcattattatataagcttatacaaaactaattttgctgctgtcagcatgtgcttcagaacttcctctttcatgtgaaaacagggtgagcactccaccaaactcttaggcatctatttctgatcatcggggtcttttctcacaatgtactttctttcaatgttggtaaaatttctcaatccagtatttttcagaactctgagattaaagtagactgatatccttcacaatgtcttgttcttattttggagtagataatggtcttaaacctttctttaaaatgtgtgttgctaaaatttgaaccacttatcccaatgataatggtcaacatttatttcagagtcctaatttaatcttctcaacaaccttatgaagcagcttattattaccatcctcattaccatattataaataagaaaattgtgaatcaaagaacttatctaatgtgtctaagattacacaactgaaaactggtgaccctagaggtaaacccaggtagtttggctccagggataccacccttacccctaagtaataggtgtcccacatgtccaccccagttgtgcctatgtgagtaatgcgtgccagtggctaactaggacttgcactttcgctattttaaaagatgagagtagctatggaaagcctcttttagaaacactatgtgccactttactcaaatatctaggaaatcacttattttgtgcagatgctgaacctgcctgaacaattgctctgtctctgattcccagtaggataccaaagatgctcttgaaatagagaatcagatcccaagtgaaacagagatctagtagcccatgctgagtaagcaggatagccagtggaatgcacaaacataggagcagagatcataattcctgccttttgtgggagtccatcagacctatattgttaaatgcatgggatatctaaaaataaggaatagtaattgatgcgtccaggaagactcatctttctctcctttttaattgtgcttccaaattcatcttcctgaatattatgatattttcttcttcatttgtatttatttattgttgtttttattcctaaaggttttcaaaatggtgtcttattttggagcacccaagatgtcttctttttctcctttgatggatctctttggagaagagaccaaaaaaaaatagtttagcgctattgttggggacacacaatgcattctcatcaaaattctgaaaaatattagggcagctatgggaagttccactgtacaagctgctataataattatttttaaatatgtctcttaaaaatcacaaagaaagctttatggaagatgaatacaaaaatagcaaagaaaaaattttctagaatatttatctcaaacgaacatccccaggaggatgtagtaggaaggaagagtttaaccagaaccagtaactagaaatataaacctttttggttgtaaagaaaaccacaagatagaatttaatgcaaaatcacatgaattgaagcaggaagtttgacatgaaataatctctacctgggctgcaaacttcactttttaccttcatcttcacaggagatcaaattgacattgaaatcaaaagcagatttctctataattcaaaataatgtcagtgtatcacatttagcctaatgctataactctggtcaagaattattcagttatatacccaggaggtatacacaggagtacataaaagtattgttggttgatgcttgcctgcctgcataatccagatctcttactctaaatttctcattccaactataaaatgcaaatgttaatatggtttggtaaagataaaagtcagtataacctaaatccaaggatatcagcatctacattgtccagaaatatatccaggacatttctgaatttggctagttatgaaaaacaattagatactgctataattttcagtcagatgactttcatttctacttaaagagtgaaacatcttagaaattagaactgaagaaagtttgtactttatggtacatttgtaagacataagatgtgtaaaggatagcataaaagtattaggactttgcctctatgaaaaatagcgaattctttaatttttatatgcaatagttctgagtgttccttattgcaaaacaactttcagcaatgttgtctggattgtgaggtcctgaaaatagattccagaccaagttgatggcagtgaaagtattgagaagcaacaaattctagatatattttaaagacaaagccacagtatttcctaacagaaggaatatgagatgtaaagacaagaaaagactcaaaatcactataagatttttgtcctaagatcctagaaggatggagctgacatcaacagagatagggaaagccacaaatggaactggtttcaatgggaagagctggagttcagttttgaatatgttgactttgaaatgtttgtttgacattcaagtggagatgtggaggagacagttgaacatacaggtgtggaatttaagacgtctaggaatggaaataaaacttagaaacttgttggcatatgaacgaaggatatttaaagctatgagaatatgtgaagttaccaaggaagtgaacagagatgttgaaaagaaaagaacaaaaaactgaaccatgaaacactctaacatgaagtgctcaggaaaaccagaagcactcagcaatgagaatgagaaggcacagtatgtgagatagggaaagccaggagagtgagaactcttggaagccagctgaagaatgagtattatggagaagggagttggaggatagagaactatacattgtacctcgaaatgtggaagttattgatgacattgattaagttggaaaagcagaagaaaacgtttaacatttaaaatgctgactagttgtggtaggcagaaaaacaggctttcaaagatgtccatgttctaatccccagaacctataaatatgttatataacacagccaaggggaattaaagttgtagatggattctaatcagctaaccttaaaaggagagattatcctggattatccaagtgagccagtgtagccacgagcgtgcctaaaagtggaaaaggaaggtggaaaacgaggtcagagtgatgtagtgtgagagggatgtaacatgccattgatggttttgaatggaggaagtgggccatgagtcacagaatgtgagcagcctttggcagctggagaaggcagggagattaattcttctctagagccttttagaaaagtacacaaccctgccaacaccttgattttagcctaattaagacccttatcctacttctgacctatattcctataaaataataagttcatattattttaagctaccaaggatatggtaatttgttatagtagcaatagagaacgacaataagatgttcattgtatcacgtacttgccttaatttttagtctttaaggtcttatgactttcacagttcaattgtaaatacatttgtggtttaatgttgctgaggctactctttcataatcaatgtaaaaataagttacaaaaactaagcaacagatacataataacaataaaaactcaacatgaaataattattgctacacatttcaaagtccaaaatggataagaaatgtaaattcaaaacagagatttgagagagcagttaataatagtttttccatgttcatagggcatatgaaaagttaaaatgattaaaagtaacaacagaaaatgttttgacaagcaatattcttcagtagaataaaaacaaaacacatcggctgggcgcagtggctcatgcctgtaatcccagcactttgggaggccgaggcaggcagatcacgaggtcagtagttcaagaccagcctggccaatatggtgaaaccccatctctactaaaaatacaaaaattagccgggcatggtggcatgcgcctgtagtcccagctacttgggaggctgaagcaggagaattgcttgaacccaggaggcggaggttgcagtgagctgagatcatgccattgcactccagcctgggcgatagagtgagactccgtctcaaaaaacaaacaaacaaacaacaacaataacaaaaatcagaaggagacaaagtataggaaaataatggcaggaggtcttaaaatatgatccaaactgtggagtatgagggagaaagaatgagtccgtgaaacagaaggcaatgcaagcacaatgacaagcatataattctatttaaaaacgtctgtgagaccataatctcccttcacttctccctgtctcagagaatatcatcatcacccacagcttgcccaaataacaaatgctggcatcagcttcaatttctccttcttcctttgtcatcaactcccatccctccaatgccctaaaatctctctatcctcccagctgtgtatctagtttgggccaccaccacaatttacctgatttattgtaaagcttcccaacttctctcctggttcctggtcgtctcctttccatgttccattcttcaaacctcttccaaggtgatcattttaaagcacaaatcaaatcatatatccctagttaaatcctccagtgtcatcccaggcctttgtcatgaaatttaaactccttagtatggattataaagtaactcttaataatctaacctctttctctccttcctccaacccagtattttattcaattataataaactttttttttttttttaggtggagtcttgctctgtcgcccaggctggagtgcagtggcatgatctcagctcactgcaagctccgcctcccgggttcacgacattctcctgcctcagcctcccgagtagctgggactacaggcgtccgccaccacgcccggctaatttttgggtttttagtagagatggggtttcaccatattagccaggatggtctcgatctcctaccttgtgatccacctgcctcggcctcccaaagtgctgggattacaggcgtgagccaccgcacccagcctgtaataaacttcttacagctctctagatgcatcacaatttttctagccactgagcctggcacaggcagttttctttgcctggaatgctccctctgtctgtccttgtgggccttcacctggctaatcttatgcatgcttcagatcttagctaaaaataccactttgtctgagaattcttccttgatcaccaaatttaagtcaagtgacactcatgggctcccataacatcccataaccatatactattttgtaattgcctatttatttccctgtctccactactaaaatgttaattccttataaggcagtaacttgatcctgaacagtaaatgaactattacaccatgcaaaatgcctcatacatagtaggctctcaataaagatttttcaaacaacaagtaaaaaatgtataacatatttataaaaaaaagaagaagaaaaagaagagagtgtaaatctcactaattgtttccaactctgactagatgctgacattttctagaatgaatgtcttagtgtatttggcctgttatagcaaaatgtcataaactgcatggcttacgaataacagaatttattcctctcaattctagaggctgggaagtcctggaacaagttgccagcagagatgtctggtggggattcacttcctggttcatagacggctgtcttctcactgtgtcctcacatggcagaagggataaggaagttctctgtggtctctttcataagggcactcatcccattcatgagggctttgccttcccaatctaattactttccaaatgccacacctcctaataccatcacacaggggattaatatttccacatatggattttggtggggtgttggtggggacacaaacattcagtatatagcaatgaggtaagtaaagtttcgcttaagaaaccaacactaataaattttatagctttttatcctcagcggaatgccaagtagatgtgcaacacttaaagttacctttcttcaaatgagcctcagcaatattaacgaataatcacaagatttcctgcttttccttcaggaagcagtgctaaaatgttagtcatgtaaaaaagagggcctcgttatttctcccctcttcctctactgtgtaggtttaacacagcagatgcttttccctcccccagcccaccttctatttcttctctcctagcctaccatttccctaggttgaatctaactcattattgatgctgactatatagctgagcctaacatagatttggcttccgaattcttctaagaaatatacaaagtatattttcttttgccatttttactatgttaaccaataggaagagcttgacctgatttctagctaaatattctttggaaagttacaaaaccagatttcccctaattccctagctgtacattttcatgacattaaagtatttggaggtttaattatttgattgtggaaaccatttgcagataaacgagatactgaaatggttactattataatttgactattctctgaatgttatcttgttcttgcattaccagtacaaatgcagcagagtggtggaaattttgcagttctacaatgtaaacattctcagacattaaacaacactgtgaagggccaaagtggtgatcagtctcagtaaataccatttagaatggcttttgtttcacaagctccaacaaacagaaatgtgccccctatatgactttacattttagcactaagatacattattggaagtagatcttattgttaccggaaattagtaattattctccaaccacatagtgcccattgtgtattatggtttttaatcataaaaacagggaaagtgtttagttcttatggtctggttcaaaactattgtacatcatacccagtagttttcaacctaatgacaaaaagtcaagtagaacagaataaactttaggaaagaaatctaccaatactttatataagcagtcatgcaataaaggacttattggattatagcttctctgtgcttcctaattaactagtcaacttatatgcaaaatatgagactgaatttctctgtgactctacatacattgtcatcatctttgtatcacagctgacagctcttttatgacaaattttgttctgaaaaagttaatcaaaattccatttccaaaatcattaatatttagtattgttgcattaagtcttatttttagtaaggcagaaattttttccatgtaagagaatataaaagactcttttaaaaattatcccaagagttttatttcattcactaaatcatattaacaatttgctaagcaaagtcgctgctggaacagatcattaaatagaaggtaaaaccttagcatgcccacctctgattccaggatgttggacattactatgattctgaataattagctcaatacagaaaaaaaagcacagtaataactatcacttgacaactaccatgtcatgtctatgtttccatagagatacagtcatttaattcctttgcctaacagtcaccgttttaaagtctaatctgagcatctgtctttggatcaatcagatttatgcatttatatttattataattactggtacctttggatttatttctgacagactattttatatttctatttaccacattttctgattatttcccccctctccttttctatattccactggagagactattctgctgctgctctgtttatattcttccagtagttaccactagcttattgatagtacacatctgtttacttttccttaccattttaaagcctatccatagctaaactgtgctttttaaaaaatgatagctgctagctgagagggtaaatttctgttgattagaaaaaggcaacccttcctcaagaaaataatcatttaaaaattgtctagagggttttccagagccctggcaggcaatagccttacctagctaacgtgtccacacttgctagcatctcagcagctcaggcagcacacagcagaccatgcttcaccctcgccccattccacaagtaaggcagtaatgtgaggggcagaaacgaaggccccacttagctctttaagatgtgtctatctcagatgtgacactcttgttcagcatatgcagtagtatgcagtactcaagcataaactcacctctttggtctctcctcccacttgtgtggtcatcacataaaataattctttttattccgtatgtattttaacttgttttggtcctttattatttaaactgtaagcttgattaagttacttactcgtcctaatttcccttatctcaaagtatcctgcatgaatgtcttttcttgtttaagtactttgtcttagcagaaattgcttctccttattgcagctaggcttgatgttctccaactactcatcgccaatgctgcactggaagcaggttagcaacccaacaggcaggtcaagttgtgacaattctctggaattgttggaaaaccaacaatcacacaactgggaagctaaagaaaaagtaatgaacagggcaaatttaaaaacccagaaagttgagtgttcttaccaagtttcagttgagtaaatgctgaataaaactactcctcggattgttgcaagcttttagttaatgttcaatgtttggaaaaagttgattttgatattttttgccagtattgttgtttttatggaaaaataggtttttggaggtctttgctccatctttctggaagtgcttctcagtacatcatattctgaatttctttatataaaaacaaatgtaggtgttcccggtaacctatttttcttcaagtcaaagattattagcattacaatttgaaaaggttaagataaaataatttcaactatgttcaacagtaagcattaaaaaagaagcaaagaagaaaaccttcatgaatgaatacataatctagggtgcaacagtcatcttttgattttagtttccttagaacctttcactttggttttactaacatacaaggaattttagaattattcagattttattcaaaattattgtatctttgaagcaaaaacaaattttatatttaattctaaatatttaatatgatttatattgaagtacatttttataaagccctttacttttaccctaaaggggtatgaaattttttctaaaatattactgttaatattaatctgtagccaaaaaagtaggatatttgttagttcttattacacttttgtgaatccaagtattattaaattgttaaaatattttagacacttaaaagtgagtaaactacagaaaatcagatgaatttgtattttgaatacatgaaatagaaaaactaagaacaatacaactaatacgcaacaagttttctgaaaaatatatttgaatggtaagtgttaatcagaaagggaaatcttccttatagattctgggtattagaactttgtcagatgcatagttggcaaatatttttctcccattctgtaggttgtctgtttactctgtttatagtttcttttgttatgcagaagatccttagtttaattaggtcccaattgtcaattgtttttgttgcctttgtttttgaggacttagtcataaattctcaatgtagtccagtgtccagagaggaacttaaataaatcatggagaaaaaaatatatatatcaggaggctgaggtgagaggatgtcttgagccctggaggcggaggttgcagtcgagctgagattgtgccactgcactccaccctgggtgatagagccagaccttgtctcaaaataaaataaaataaccccattaaaactacacaaaggatatgaacagatacttctcaaaagaagatgtacaaccagctaactaacatattaaaaaatgctcaacatcactaattatcagagaaatgcaaatcaaaaccacaatgagataccaccttacgctagtcagaatggctatgaaatgactaaaaagtcaaaaaataacagatgtgggcaaggttgtaaacaaaagggaacactcatgtacactgttggtggaattgtaaattagttcagctcctgtgaaaagcagtttggagatatcttgaagaactaaaaacagaactactttttcacccagcaattccattactgagtatgtacccaaaagaaaataaatcattctacaaaaagacacccacactagtgtatttatcacagcaccatccacaatagcaaagacatagaatcaacctagatacccaccaacagtggactgaataaagaaaatgtggtacatgcacaccatgaaatactacacagtcataaaaaagaacaaaatcaagtcctttgcagcaacatggatgcaactgaagaccactgtcctaagaaaattaatgcagaaacagaaaaccaaacactacatgttctcacttaaaagtggaagcaaaattgggtacacatggacataaagatggtaacaatagacactggggactccaaaagaggctagggtgggaaaggtgcaagagctgaaaaactacctattgggtactatgtttactatttgggcgatgggtttaattgaaacccaaacctcagcattatgcaatatatccatataatatacttgcacatatactccctgaatctaaaatttttaaaaaattttaaagaaagggaaacttcactataggggaaggggaaaagcatcaactttaggaacagaataagttaaatcagtaactaagctggccagccataatttggactggaagatcaatactatgaagagaaaacttgtaaaactgtgaaatagtttatattctcatattcttttatgactgagagtgataaaggacaagaacacggaagaaatctgaccaaattaatggtcttagtcaagactgcattgcacacattccatttctactttttctaacaataggaaacctcaacttcttactatggcattataatgaaaaaagccacaagcaaatgtagcaatcagtaaataggtgctcagtgtgatgcagtctagttagcaatcttttagtggaaaatctggggaggaagtagagggatttgtaccccaggcaaagaatgacattacaatgagaaaaaatctgatttatatgtaagattatcatatatcctggtttgcctgtggcaaacctgtttaagcctgttaacttgatttaattatttatggttttacatttaattattaatagtttctcttttcactctcaaatacatcacaatttggacacaaattatatttgccaaatatacagtcactctatttacatgtgacaacttgagcctgacacctgttgcttctctggctggctgctgtttgaatcaaggtggctaaaattcctgtcacaagccatcctcaatgtcatatctggtctcatacaggctacttggaaggaattcccagatgctcagaaaacccagactgtattagaccattttcatgctgctgataaagacatacccgagactgagaagaaaaagaggtttaatggtcttacagttccacaggctagggatgcctcacaatcatggcagaaggcaaagagaagcaagtcacgtcttacatggatggcagcaggcaaagagagagaaagcttgtgcagggaaactcccatttttatttttttttattacttatttatttatttattttattattactattgttattatttttttttattatactttaagttttagggtacatgtgcacattgtgcaggttagttacatatgtatacatgtgccatgctggtgcgctgcacccactaactcgtcatctagccttaggtatatctcccaatgctatccctcccccctcccccctccccaccacagtccccagagtgtgatattccccttcatgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacacacgtgtgcatgtgtctttatagcagcatgatttatagtcatttgggtatatacccagtaatgggatggctgggtcaaatggtatttctagttctagatccctgaggaatcgccacactgacttccacaatggttgaactagtttacagtcccaccaacagtgtaaaaatgttcctatttctctacatcctctccagcacctgttgtttcctgactttttaatgattgccattctagctggtatgagatgatatctcatagtggttttgatttgcatttctctgatggccagtgatgatgagcatgttttcatgtgttttttggctgcataaatgtcttcttttgagaagtgtctgttcatgtccctcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttggctttggttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggttcgtcaaagatcagatagttgtaggtatgcggcattatttctgagggctctgttctgttccattgatctatatctctgttttggtaccagtaccatgctgttttggttactgtagctttgtagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatggggatggcattgaatctataaattaccttgggcagtatggccattttcacaatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtgtgttgttggtgtataggaatgcttgtgatttttctacattgattttgtatcctgagactttgctgaagttgcttatcagtttaaagagattttgggctgagacaatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgccagttttcaaagggaatgcttccagtttttgcccaatcagtatgatattggctgtgggtttgtcatagatagctcttattattttgagatacgtcccatcaatacctaatttattgagagtttttagcatgaagggttgttcaattttgtcaaaggccttttctgcatctattgagataatcatgtggtttttgtctttggctctgtttatatgctggattacatttattgatttgcgtatattgaaccagctttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccagctttgatatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagctcctgttattggtctattcagagattcaacttcttcctggtttagtcttgggagagtgtatgtgtcgaggaatgtatccatttcttctagattttctagtttatttgcatagaggtgtttgtagtattctctgatggtagtttgtatttttgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtacgcatttagtgctataaatttccctctacacactgctttgaatgcgtcccagagattctggtaagttgtgtctttgttctcgttggtttcaaagaacatctttatttctgccttcatttcgttatgtacccagtagtcattcaggagcaggttgttcagtttccatgtagttgagtggctttgagtgagattcttaatcctgagttctagtttgattgcactgtggtctgagagatagtttgttataatttctgttcttttacatttgctgaggagagctttacttccaagtatgtggtcaattttgaaataggtgtggtgtggtgctgaaaaaaatgtatattctgttgatttggggtggagagttctgtagatgcctattaggtccgcttggtgcagagttgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatacttaggatagttagctcctcttgttgaattgatccctttaccattatgtaatggccttctttgtcttttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattggagcatttagtccatttacatttaaagttaatattgttatgtgtgaatttgatcctgtcattatgatgttagctggtgattttgctcgttagttgatgcagtttcttcctagtctcgatggtctttacattttggcatgattttgcagtggctggtaccggttgttcctttccatgtttagcgcttccttcaggagctcttttagggcaggcctggtggtgacaaaatctctcagcatttgcttgtctgtaaagtattttatttctccttcacttatgaagcttagtttggctggatatgaaatcctgggttgaaaattcttttctttaagaatgttgaatattggcccccactctcttctggcttgtagggtttctgccgagagatccgctgttagtctgatgggcttccctttgagggtaactcgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccgcatcactttcaggtacaccaatcagacgtagattttgtcttttcacatagtcccatatttcttggaggctttgctcatttctttttattcttttttctctaaacttcccttctcacttcatttcattcatttcatcttccattgctgataccctttcttccagttgatcgcatcagctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcctctctcagctcgtcaaaatcattctccatccagctttgttccgttgctggtgaggaactgcgttcctttggaggaggagaggcgctctgcgttttagagtttccagtttttctgttctgttttttccccatctttgtggttttatttacttttggtctttgatgatggtaatgtacagatgggttttcggtgtggatgtcctttctgtttgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggcagtctgcccattctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcctggacaatggcgggcgcccctcccccagcctcgctgccgccttgcagtttgatctcagactgctgtgctagcaatcagcgagattccgtgggcgtaggaccctccgagccaggtgtgggatatagtctcgtggtgcgccgctttttaaaccggtctgaaaagcacaatattcgggtgggagtgacccgattttccaggtgcgtccatcacccctttctttgactcggaaagggaactccctgaccccttgggcttcccaggtgaggcaatgcctcgccctgcttcggctcgtgcatggtgcgtgcacccactggcctgagcccactgtctggcactccctagtgagatgaacccagtacctcagatggaaatgcagaaatcacccgtcttctgtgtcgctcacgctgggagctgtagaccggagctgttcctattcggccatcttggctcctcccccggaaactcccatttttaaaaccatcagatctcatgagacttattcactatcatgagaacagcaagagaaagacccacccccatgattcaattacttcccaccaggttcctcccacaacacttgggaattttgggagttacaactcaatatgagatttgggtggggacacagagccaaaccatatcacagactgaaagaagacagaagctaactccctcatgctttgagcaggggttcaaaaccatcaggaagctcactgctggacttcctttctcttctcagccctcccatcatcctggagactaagcaggagagacaggcagcaaagagatgggaggggaagccaagaggaagtcaatgagcacattctccaaaaatgcaatgctttagtttttcagacatctgagagagaaatggggacacatttcattctgagctgagacactgttttcaggtttaagtatatatgtgattaaatgatatttaatgattttgtactcctttccacttagttctcccatgggctccataaaattatttctttttctctttaacccactgttaaaaacctgtttggacacactctctcataagaacttatgtgtaggatgtgtaattttctttttctattttttttttttttttgagacagagtctcgcagttgcccaggctggagtgcagtggcacgatctaggctcactgcaacctccacctcctgggttcaagcaattctcctgcctcagccttctgagtagctggaattacagacacccatcaccatggtgagctaattttttgtatttttagtagagacagggtttcatcatgttggccaggctggtcttaaactcctcacatcgtgatttgcctgcctcagcctcccaaagtactgggattacaggcttgagccatcgcgccaggccaagacgtgtcattttcaataaatcattgaagttgtacggacttactggtaaaatgaggttctgtcttgtccccatttgccctgctgggtgcgtctatcgaagttactttgatctactttatgcttcctccttccttggtgcttttcagagtgcaacacaaaacacactgggttatcacagttcagctctaattctgtgagaatgccaataatgaggatgatcgattgatgggtaatagaacaaagccttgcatttgaaatgtaggagacaccttacaatagtaaaaacttaagaggactcaaaggtcctacaagatgaactcaagcactttttcttagaaaacataccatattatcatcagttttaattacaaaataataaatattagcgttattataaattgttcaaatttacaaccattctgttaacatgtgataacttgagcctgacacatagctgtagttttgcagcaacatagatgtggctggaggccattatcctaagtgaattactcagaaacagaaaaccaaatagtttataagtaaaagttttataaaatataaactattttatagatagtatacttcattgcaattacaacaaagagtatgttttctttaaatggagggaatatcattgcagttctcctttcaaaacaaaggcttcagagaaatgattaaccaaaagatctatataatagaaatcaattgtttcttaaaacactgagttgagttgattctgggcaatttggaagagaagctaccatagaaattcaaatttcccttaaaacaaaaaggcagggaatacataaagaaaaaattgtaatgaatatgtgaacaaagaaatattaatttcaattctagtacaaagtaaagaagtttttaaaacaattttttagcccactagtattgtgatgatcaatattttcctcattgtttatacactcttgtagtaacactgcatgcctgtatcttctacatgaatgaaacacaaatgctggaacttaaatattttagtaaatatttggtccaatctattattaaagcaaaaaaatagtcaataacacaaattttgggacaaatttggaaaagtctgagaggattaaattatctaatcaatcaagttctttccttatatatcgcttttattttgaagcaaaacctataattcaggatagaactttctctattaaaagccaaagctaaaaaatggtcatattcaacctaaaggaaggcatatgatctcattttgacagctgtctacagtacccttatgtgtaaggctccagtcaggacatcagcaagagtaaaatatgtacaacatttggccatgccttccagaaacccttgtgtgagagaggcaagtcatgggtaaaaatttcattgcatttgtagaatgttgacaaaatattgtaagtatatgaaagaaataaattttcttttgagcagatctagaaaaaattcttaaaagtggtggtagtcaaagtaaatcttatgcaataagtcagatgtcagcaattaaatgtgagccctgacattcaaagaagacacaggggcacacaaaggatacaagaaatactaagatatgctggtgttttcaagcataaacttctagaggtggaattttttcctaacacttatttcaacacaatgcacagatatgaacttaagacgttacttggtgatgatcattttcagtcactttgcccaaacaaccccacttcctactttatatgttcaagcagtagctaagaacaaagaaagtgttttcaaatatgaattccaaggatgaagtaaactggtataatgattaaatacacagcatttagaattaaaaccaagttcaatgcctttctataacaccaactatttgaccttggaaagatgactaaataatttttatgcctcattttcccttctattaaacaaaaataggataatagcatctgcttcatagcattgctgtaaatataaaaggaataacacgtaattttcacatccccatttcacagttaagaattcattgcatttctccaaacatatatatttgattacagtttttaccaagttacctgtgtttatatttttatactgatggtctccactatttaccttccagattatggtttcttaatataagaaaactatacacatgactctgcagaaaatagtagggggtatttctggtagaagggtcatgaaaaggggagatgatctagagctgtttgcaaggagctgatttgtgtgacagaaccaaaaattaaaacaaaactccacacaatgcacaaaggcagtgatgctgttcaccttgacgaagaggtacaggaacattttggggctacccagcaccactcatttcatgaaaatctgacaagtcaccaagtcacttcctagagggcaactcagaaaactcccactctgcaccgggtcctgagcacacctcctttcccacagctttacaacagccctagtgcctcttcctctcagtcacaaattctcaggcttctccccttttttccttttcctttttttttcttttttttttttttttttgagacggagtctcactctatcacccaggctggagtgcagtggcatgatcttggctcactgcaaactccgcctcccaggttcaagcaattctcctgtctcagcctccctagtagccaggactacaggtgcacaccaccaagtctggctaattttgtgtatttttagtagagacagggattcaccatattggtcaggctggtctcaaactcctgacctcaggtgattcacctgtctcagcctcccgaagtgctgggattacaggcgtgagccactgcgccccacttaggtttctcccttataaccagtcactaaagctagtctttccaaggaaggaggatactgatgtgtgtgagattttaaaggaagaataaatattccaaataaaggtaagatgtactgggcacccaagttcaaaaatgttgtatataacaaaccctgcttgaccaaccagtattcctctcccttttcatttgtctttaggcagagcctttgtgacagttaatttattctccaaggacattttgaaaccctgttaatcttagctaaaaggaattaaaagactacaagatcagtaactgatacctccaaagataaacttgtatttgaacatgaaggaaatattcataaatttgcccttcttcactctttttggcatctccagataacactccaagtctgagtatttattatgaaacataaatttgttgttggagccggagaggtgtcagatattattcttcttcctggatacacagaccagacttcccaaccccattccagttaggagagggcactgaatgtgaacgcatgttatccaggcgtgccccataaaaacccactaagcagtcctcctcacttctcactcccctcctcactcaaatggagacactctcagtgaacttggaagccactctttaaggaaagtagggcatccatcacctcaagtctgaggatgagtaggtggctgtgtctctgatctgtcaactctctaaggactattacatgaatcagtaacactgttttattgtatttaagccattattcatttggaagtgtatttacgacagcagttggaccctaactatagagaaagactcaattagggaagaatagggaagtatgttacaatgtgaatagatgcttcacctgtataaatggttgttattattgttgttgtttgttaacttctttgagttaggcttataacaacacagctcatctcataatgtaggaaaacatgttaaggtcagtaaactatcctaagattctagcagctaaactcctttctgaattcacaacattagcatagaacatcagcaagcctataacaattgaaaggagactctggtacgattaataatttgtttacttgactctgtcaaaattttaggtgagtcataaaaaggatatgatctcataaaatttaatatcacattttacacacacactgaataaaaccaagcaaacagtagcaaccacagctctgggataagaggggctacaaatctatctacaggaggtgctacatattatcaactgatatatctaaacacttagtttgtgtccaacattgccagaaattaggaagaaacaaaggactcataacatacatttataaatttcaccttcacagaagttataatctattaatagctgaagaggaaagattctcatacatgaagtagtacaaaaagagttatttaagtaccatgtgggttgctctgagaactaaatgatgtgagaattcaagaaagacatatttgtgggtataggtatcttctgaaagatttcatggagggattgtcctgcagaaaaagaatttgaggtttagataaagacagaagtaaaagacacggtagaggggagtggatccgtgtacagcacctgagcatctgagctctcaatagcaccatcaggatttctttcaggttcgagagaagctgacacccagcttctttatcccctccaggatatctctgggctgtgacttagcagaatgggaaaggttttgcaaacattccaggaatctagtcccagtttaattacttactatttgtgggtccttgaacaaatccctctgtgcctcagtattctcctctgtgatactgggatagtataaggccaaggctgtctttcttacaggatcaaattggccaattaatataaaatgccttgaaaatgtaagaatgtaagagctataaacatgtaagtattattaccatccccaccgtttgtcctgctatttgcaaaagcagaggaaagaactgcagcttagatgagttctgctatcctcagggccacatagctgggtatgcaaggtaacttttctcttactctcacttttatttggggtttcacagtgggcacagtgcaccagctatggtaatgcagttcaattatacagtcagagggcctttgggggcaatttgaagacttcctggatgaacactctctcgactgattggttgcacctactgtttccgtagcaactttagatcgattccacactcactgactttctgctcccatttgctataacatcactttaacatcaagagacataaggtagaaggattttaacaaatggaagtataatttaaattgaagttttggggttttttttttggaggtcccagagttctctacatgttacccatagttatagtagactcatagctctttcctttaagggaggtggatgaaagcagatgcttctttaataaaattccttgtaataatattgagaaaacattgcccagcacatcctctcccacatttgcatgaacaaagacctctagccaacctttagtttaccttcttcaccaagacttgtatgtcaaggttccaagcaggctcacaacaaccccataaggtagtatttttcccaggttatttaggtttaaaatatttgactaagtggcagtgctgtaaggtatataagtgacagagccaggatccaaacacatacataagtgtgtcttgaccatgtgaacgtgaccacaccattggtggttgtactctcagtacagcataatcatcatacttctgaatgttggtaaataactctggttcttagtttggatttccttagaaaacagagcctgaggcaaagactcgggtgcaggcagtgtattttggagctgatcccagaaagcaggaggaagtaagtggagagagcaagacaagaaagaggaaaaactgttattcggtgtgttataaaggttactgatggatggattctgggttctactttaaacctctgaggaatatataggatgtcttctaggattatccaggtggcaatggaagactggagtatttatgtgctagtctcacccgtaacccctttggatgagtgttattcctgggcatttttaacacccccacactttctggctgttcttgtgcacaggataaggagctaccaggacaccagagaagaccttgggctaaatcacagaaagacccataactgggctccaagtggaacattagctgtgttgagctaagactgaatcatcaggtaactgtccactatagctgctgctgaaattgaagctggacccagtgactgtggtgcaggcaccaggggtgtctgcctcaccctacttctaagatattttacagcttgctgaaataattattagttcagccttgtgacttgcacagtcacatgtgacatgaacgtaaccttaattctggctacagagcagcactgtcacaagacacacagttgattcatctgtgtgtctggagtagtaatcatagtccaagtgtgggctctggggcaagactgcttagttctactctgagtttcatcatggtaagtctaagtgcacaagtcacttaaatacaatgtgtttcagtttcctcatctgtaaaatggacataatagaatctaccttatagtttgctgttgggttaaattagataattagatgtaaagcactcagaagagcatctgaacatagtaagtatttaaaggagtcaatagaattttttcaaattatttgcaatttactaacatatccattttttctctcatagcaggaagggaatgtattataagcactctgtgccttcccactcatgattataaaatgctaaccaaaagcttaacataaaataactacaagccccaaaaccaaacatcacagtggcaggaaatttcaccacccaaagcccaccactttcttagcactttgtcttaaaataatgaaaactgtttggtagctttcctctctcacacgtactaaaactaaagggaacatttttaaagtttaatatttttcacttggtaaaaatccttattctgatagaataacatctggccagagagggggaaaaaagcaaccagcacaggagccgagtagcttctggtctccatggtaacagtgtcccatattctgacccctttaatcacctgatcctctcaggataatgaaaggagcaaggagacaaaaaccttaagacaaaaaaagtagccattcttggagccgatgatgacaagccagcaaatgcagcccagaggtgattctaactacctctacttatgtgacattcccttagaattatattttcagtaggagtgataggttaacattgatcaagcagagcttagtcaaaattgctcattacccccttgtaagcgacagcacataagcaagatggcaccctggggatagtgggcagtttgctgccaagctgcaagataattggtctccacagaaatgaaatttgtgatatttttctccttaccttatgcctttacctgatttctaggaaagatattgaacattttttgaaacattagagcaatgcttctcaaagcaagaaccacggagctcctgcatcaggatccctgggggcattgttaaatgcgcattcccagggttcatcttcggtagattctaatagagcaaacctggaatgcagccaaggaagttgtatttaacaagcagctccagggggttcttatgcaccctatagtttgaaaccactcacttagaacgtgagagttactccctccactctgcaatttatgttggcattcagatcatttatgaatgtgacagattcttcttttctacagatgacctatggagataatcaatttttgagaccaaaaaaaatatatagggaagcatttagaactactgaagtgaaaggaaaaaacatctatgtttaggaaaacaagtataaattaacaatgaaaagtataacctattgcttgactaattttatttgcctatattgtctcaccagttataatgtctgtataattatcatacagagttccttttactttttataagagagaattcctatgttaaaggacagaaacctaatgctataaattactaatctatttcatagctcctgaaaaattatataagctgtatttagatggcatctgattttattcatatattcacatattcaaatgtttactgagcatctgctatgtgctggacttaaagaagccaaaagcccccactaccacagagtgcattctaggaaggaataaacaataaacaactaagtaaaatacctgctgtgtcagatggcgaaaagcactatagaaaaatataaagcaagggatgaggtggttgcagttttaaataactgttatgggaagacctcaaaaggaaatggcatttgagtaaaacctgaatatgataagggaacaaatattacaagtatctggtgaaagaatgttcaaggcagaggaaatatcaagtgcagaaggcctgaggcagaacatcccagagagtagtgtggccagaacagagtaaatgaggtacaaagtagtagataaggtgaaatataacactcctggtgggagaaggtgggacatattgtgacctttgactttcattccaaataagaccagaagaagccataggaagattttgaactgagaaattataggaacttacttacatttaaaaggatcagtctgcacctgagttgagaatagacaaggacagagaaagggagaccaataaaatggcattctagtactttagatgttgaataagactatattgtcagcttttgtagtagcaagaaatgttaagagtctaaaaaagttttgaaggcagagtcaaagagatttattgacgaattgaatgttggatcaagaaagagaggaatcatgttttttatctgaggaagtggaaagatggagctgccttttcctagatatgaaagagtgtgggcaaagcagcgttctaaatgtgttaagattaaaagacaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggctagggacatgaacagacacttctcaaaagaagacatttatgcagccaaaaaacacatgaaaacatgctcatcatcactggccatcagagaaatgcaaatcaaaaccactatgagatatcatctcacaccagttagaatggcaatcattaaaaagtcaggaaacaacaggtgctcaagaggatgtggagaaataggaacacttttacactgttggtgggactgtaaactagttcaaccattgtggaagtcagtgtggcgattcctcagggatctagaactagaaataccatttgacccagccatcccattactgggtatatacccaaatgactataaatcatgctgctataaagacacatgcacacgtgtgtttactgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactatcgcaagaacaaaaaaccaaacaccgcatattctcactcataggtgggaattgaacaatgagatcacatggacacatgaaggggaatatcacactctggggactgtggtggggtggggggagcggggagggatagcattgggagatatacctaaggctagatgacgagttagtgggtgcagcgcaccagcatgacacatgtatacatatgtaactaacctgcacaatgtgcacatgtaccctaaaacttaaagtataataaaaaaaaaagaaaaaaagaaaaaaaaagattaaaatatctgttagacatccaggtagcaacgtcaagtagacagttggatccatgaatctgaaattcaggaaagatatctggtctggatgtatgaatcagtgaatcaccagcctcgacgttatttccaagggagttagtgtaaatggaaagagaaaaagttcaatgtctaagtgctggggtacttcaacatttaaaggtccaagagatgaatagaagctatcagaggaactgagatggagaagccagtgaggtaggaggaaaaagcactaaagtggaatatcctacacattaaatcagcatgtttcaaagagattggagtgatcaacaatgtcaaatgcttgaaggtccataagatgaagactaggaagtgaccattggatttagcaactggaggtgaatgacaatcttcattagagcagttagatgtactggtggtatcagaattctgatttaattggattaatgaaggaatataagagaaattggagaaagccagtattaaaaaattcattcaagatctcaacactaaagaggaggtgagaaatgggtgataatgaagaaaaatgatgaggtcgagagaagtcaggttttcttttcttttatctttttttcttttcccttttttccttcctgtttttttattcttcttttttcaaaatatgagaatctaaagaatgcttgaaatctaaaagaatattcaagtaggaagaggtgctttgattacaaagactagagggaaaaattgttgagccaatgcccttgaataaaggagaagtgatgggagctagcagaagacatgtggagggagtagtctcagaatgtttttttcctttagcaataaattgttaatctataacatcaggggagaaagcagttgcgtacagctgtatagaagtcatggtggcagcttataaaagtccttcctcttctatttgctttttttctcattgaaatgagaaacaaattcattaacaagaggaggaatggtgaaaaggttttggaagtttgaaggagatgacggtaagaactatgtcgtgatccagaagactgggcagtgaatggacttgggaaatgcggtatgtttgccagcagcattaatgggtcatcttcatgaatataaggtgagactagtgcagaaattctggcctaaatgtctaaggaaaagtataatttttaatcaaagcaaaaaaatctcaatttagtcaccataaaaagttttccaattcacttaagaaatttttcctcttaattttgtcaaagatcagtctgagtatttctcagtctctcttaagagtgctgagtcatgattattacccctgcctgttagaggtaaattttagagggttagttactgaacctactgggctttcactttataaaaagggaggtaaattttttaaataccccactatttccaaacctcatactgtactctctggcataaaaatctctgtggcataatttatgctgaaatgctttctaagtttattcattccaacaatatggtaaattctactcacaggaaataattctcagtcatgagcttttgaggtcgtgggtatttgtaccagagactgatataaaatttctcaaaacagaaataacattagttcaaagccacatggcatattacatatcatttatcaatgtcattagagataatattcaaaattaattaacaaaggattttgtagttcaaaaaaattaggatattttatataaatcccaggaattcttatagccagtcctgcttctgagttcttcacatatcatgagttttcattcattgctaactaattaacacttcacttcacaccttactgcattttccatttatccattggtttctgggcagtgactcaagtaagctatgagaaagaggtatcactgacatttagaaagaaaaaaaattgagatttatagctgcattgtgatttcatagacaccacccacctgccatcaccaggaatgatttcttctccctcatcttttccatagtcacacatagtcacacatcagtcacacatcagatgcctattatcacttttttttgaaactttagagtgtgttaaagctggcgagaaaggtgaggggcattatatcagttcccattttatgggacttaaatacattgtggtttttttcattttaagataccttacatgtttatatgcaaagggatctgtctctgttttgtggcatactttggtcacatgtgtgagtatttgataatgagttcttgctgccagagctctaattatagcatgttcctatggaaagagagaattcaccactctgttcacatggtgccatttcagccactgcctctttctcttttgttgaccctttgattgactaactgattaaaagactagtctataagctctaacagaaaacaaataattccaattgctagtatcataaatattatttcatattttccatttaaaaatcccttcaagatccattcaccaattaatacatcattgaatttacatttctgatctactatgggtgctccatgtaattttgacctgtgctttacatcataaacctttcctccttttgattcattcaagtagaaagtagtctagatgatggataaaagagaactctctagagtcagattatccaggcttcagtccacactggtacctgtgtgattttggggagtcaacttaaagtctgcaaaccttgtctgtaatatagagaataataatagtacatatgtctgaatgtcattgtgaggttgaacacactaattcgtgtaagatgtttagcacacaactcctgacaaataggaaaaattcaattagattagtttttactaaatgtatcatatgtcagaaacatactttatccaggctgcatagtatttagagtgcattgattctcaattcttctattccatgttatttaacctctctgagactcagtttctgtttttaaaaagataatttccacctccggggggcggttcataaagaacttctaacacatctctgacactgcattaggccgaggtgggcagatcacgaggtcaggagatagagaccatcctggctaacacggtgaaaccccatctctactaaaaatacaaaaaattagccaggtgtggtggtgggcgcttatagtcccagctactctggaggctgaggcaggagaatggcatgaacccaggaggcagagagactctgtctcaaaaaaaaaaaaaaaaaaattacataattactatctgcattagtttggaggccaccaaaacaaaataccacagagtgaatgacttaaacaacagaaatttattttctcttagttttggaggcgagaagtccaagatcaagatgtcagcaggtttagtttcttctgaggcctctctccttggcttgcagatggccgcgttctcactatatcctcacatggtttttcctcagtgtgcatccctgaggtctctcagtgtgtactattctcttcttataagaacaccagtcagattgaatttgagcctgccctaagggcctcattttaaacttaattatctctttaaaggccctatcttcaaacatagtcacattctgaggtcttggaagttaaggcttcagcatttttaggtgacacacattggcccttagcactacacttcagctttcttgttccttttcatttcacataatccaactaccttgaaaaatgcatctaaagaaataggtatttcaatgctctaggtaccataacctgaagaagtgtagaagtttgtatataaatacttccttttcccttcaatacactgttaacttttcttacctttcccctgcttcatttgtaggtactgaattttccagatagtgattccaaaaatacatccactttaataaaatgtcattacaataaaaattacatatcaagagtatttattttaaaatatcttaatattttaaaatgttaaatattttaaaaattaaaatactccatttgtgaattttggcttttgttgcaaatgcttttggtgttttagtcatgaagtctttgcccatgcctatatcctgaatagtatcctaggttttcttctggggtttttatggttttaggttttacatttaagtctttaatccaccttgagttaacttttgtataaagtgtaaggaatgagtccagttactgttttctgcacacggttaaccagttttcccagcaccatttattaaataggggatcctttccccattgcttgtttttgtcaggtttgtcgaagatcagatggttgtagatgtgtggtgttatttctgaggcctccgttccattctattggtctatatatctgttttggtaccagtaccatgctgttttggttactgtagccttgtagtatagtttaaagtcaggtagcatgatgcctccagcttcattctttttgcttaggattgtcttggctatacagactcttttttggttccatatgaaatattttaaattttttctaattctgtgaaaaaagtcaatagtagcttgatgggaatagcattgagtccacaaattactttgggcagtatggccattttcatgctattgattcttcctatccatgagcatggaatgtttttccatttgtttgtgtcctctcttatttccttgagcagtggtttgtagttctccttgaagaggtccttcacatttcttgtaagttgtattcctacatattttattctctttgtagcaattgtgaaagggagttcactcataatttggctctctgcttgtctattattggtttatagaaagaaagagcttcttcaaacaaaagaaactatcatcagagtgaacaggcaatctacagaatgggagaaaattttggcaatctatccatctgacaaagctctaatatccagaattcacaaggaacttaaacaaatttgcaagaaaaaaaaaaaaacccatcgaaatgtgggcaaaggatatgaagagatacttctcaaaagaagacattcatgcagtcaacaaacatgaaaacaagctcatcatcactggtcattagagaaatgcaaaccaaaaccacagtgagataccatctcatgcgtgttagaatggcaattattaaaaagtcaggaaacaacagatgttggcgaggctgtggagaaataggaatgcttttacactgttggtgggagtgtaaattagttcaaccattgtggaagacagtgtggtgattcctcaaggatctagaaccagaaataccatttcacccagcgatcctattactgggaatatacccaaagaattataaatcattgtattataaagacacatgcacatgtatgtttattgcagcactatttacaatagcaaagacttggaaccaacccaaatgcccatcaatgatagactgaataaagaaagtgtggcacatatatacaccatggaatactatgcagccataaaaaagaataagttcatgtcctttgcagggctatggatgaagttggaaaccatcatcctcagcaaactaacacaggaacagaaaaccaaacactgcatgttcttactcataagtgggatttgaacagtgagaacacatggacacagggaggggaacatcacacactgggtcctgtcagggggttggggggaaggggagagagagcattagggcaaatacctaatgcatgcatgacttaaaacctagatgacaggattgtaggtgcagcaaaccaccatggcacatgtatacctatgtaacaaacctacatgttctgcacatgtattccagaacttaaagtaaaatttttaaaaattaaaatattttaaaatgttattaaaatatttaataatttaaatatttaaatttaaataaaatatttaatagtttgaatatttaaatttaaataaaatatttaataatttaaatatttaaacttaaaatattttaaaatattgtatttcatttattttaaaatacgtaatattttaaaacatagaacaatgagttttatgagaaaattaataatgtgaaaaagaatcagaatactgtgaggtaagaaaaaaaatcttaactaacgtaagaggaaaaaatctttaaccaaaattgataacattaacttgcaaaaagcaactttggcaaacatcatagcttgcctatccaacagtcattcgctcttcctttgtgccagtagtaaccaaattgtgcccatccttttgcaagaagacattggccaaaggggagcttgaggctctccagaccctgtagaagaatcacgattgacctcagtcattccattcccctttgccagggattggcttaggtgcagctcagtgaatcataaggagagtcttcaaagagctctggaaacggaatacaggaaagggatagttttttccaaatctcaggatattaggatatgattcttggggcttctgcagccatcttgtccttcaaaacaaattccttttttcctgagactatgaatgaatgaaaaaaaggaagtatggtaaaatatgctaccccaaaatatgctaccttggcataaggattcttttgcactaaaggcacttgagaaacagatgatacaagagacactctgacctccccttttctcctagtatcagcaaaaaagaaacattcttgtcaccagagatggggagttgaggcagagaaaaatctatataaacaatttgtttaaaataattcttatcttccttagcttctccatgcattttcgttacttttccgtaactttcacactttcttcaccctactatgtaagcatatagacttagacacttctttgagtcttgtttttcctgtaggggctcccagttatatgcaaaatctatatgcttttctcctgttaatctatcttatgccagtttaattctcaggcccagctggtgacactaagagggtagaaataaaattttgtctcccttgcaagaataaaggttctaaaaccaaatactaactgttcctaatgttatcaaaatgccaggggtttggtgtaggtcctgctgctcaccacacagagagccagtcaccgagacaaccgctattgccagagaagaaggctttaattgggtgctatagccaaagatatgggagatcagtgtcaaatccatctttttgactggctaaaattaggggtttatatagcagggaagaaatgtaactacctgtgggaaaacaggaactcgagaagagtaaggaagtaatcatgattaatgagggacctagagtttcattgtctggatgccatgatctaatgagtttcagttcttcgatactttttgggaggcctagaggtcctttcctaaggaagaaactcagataaacaaatgtaaatttcaagctttaagaccaaaagtgtccatttctgtgtgcgtgtgttgctgttgttgttgtttaaaaaaaaactacttacgggactattgggtcagtttactaatacagaaaataatttaaagaactgctaaataacaaacagcatacattactttgacagtcaactagatgaaggtcaaggacaaattactgggggacacttataattccagaccagaattcttgaagattcaataaagaaaatgtttatattagtgggaaagacaagtttttctcagttcttttaaaaaacattatttttcaaaattaatcttttgttttgtttaatggtattttacattacacaaatacactgaacttgaaaaattgactgcttaaacaaagaggatctagcagtaagccactacctatgggcacaggcaaaaccggcagaaaggatagctctgctattgtcagcatttgacgtcacctcttgagaatgaaaaccctaaagatattgtgaaaagaacaattatgagagcagtgttctccctttggtctatatcagtgacactggagtatttttaaaatatcaatcaatctaagttttgtatagtcagaaatgtcaaccctttatactgccctctctctttcatttttgtggtaccataattacctgtctatgtagttaaggggtgggagagttatacatcatcatgccttatgaaaattgccaagtcagatgacactacaagatactcagcatccaaccaggaaactctaggttccatgagaatggaaattgggtctgctttgttcagctctctatcttcattgcctgtggagcttaataaatatttgctaaatgaatgcatgaatgactgggaactaaaaagataacagtgtatactaggttccacccccccccacccctgattactatacataactatttattatccttcatggtacaatatgatttttgcctgctccaagatgattcagaaccaataattaccattaaatttccaattcaatatctagattttatttataatcacttttaatcttccagtatttcaaaatttttcatgtgtctcctataatcaccttgtatgaccttatctacctgtgatgtgccatcatttcacaacagaccactttaactgcattcagtaagtaaaactatggctcttcacaactcctaagaaagaagaatttacccccattttgtttttaaggaggtaggaacagaagatgtgacaaaacaggccagaaaaaaaaaattgatcatgttgactatgcactgtaatccagtaatcacacaaatctaagtggcaagatgatcacagtcttttggtgacaggcctcattatcttaaagagcaatttagcaggagtgagcaattcatcttgttcagtgaatggaaaatgttggagtttaagagttgtcatttttataccatctgtagacttgcatgcagagaaaaaaaactcatgaagtttaaatctaggtaataatttatttgtggtagacacatcattatgtaagcacataaagttttaatttgaacaagttaaccctcccttgctggaccaatatccctattctcttttgagggaatgtggtaaggaacaaggagtggtggagatggtggtgaagggtgaggaagtttctgctccgctctcgcttcctgcactgactctaaaaagtgagtcagattgtctctgggagcaaagaaatttaccttaaaaaagtatggaagattgctcatcttggaaaaagccaaaatgtttttggctagattataggcttagaaacaactagaatacccaactcttcacagaaggctgagtaatgatttctgcctttccaaatctctgtggaagcctcttgggctagtataaagggtaaataaatgagtgttcctagaaacagcagtaaaggaacaagaaatagttaaatcttctacatggtaattcagtgcttttaatatacttacacccaatattctcattttcaacttttaaagaaacatgaattaatacttgacagcaagattagaaatacaaattagcctgaaaaatgtaagagaattagtgtggtgtgaaagacagcagtacaaattctggagtcagacacatctgagtccaaaacccagaccctccatttctaactgtgccaactggacaagctatttaacttctctaagcctcagtgtccctgtcattagaagagataagaatgtttatttcatagcattgatttaaagattatatgagattatttatgtaaagcacttcccagagtgcctgaagttactaaacattcaagaaatagtacctattattatgctactaataataatgatctatattcacatctcacaaataagtgctgttaacattttagcatgtagtctttcattttgttttctctaagtatatttgcatgtatttttaatacaataaagtgattgtactatgcataatgtctgtagctttttttaagcagttaataatatattgtgaccatcttgacaataaagaaagtgtcataatcaattggcaatggctacactgtcatcttttttatgcctttacaataatgtattttactgatccccttatagctgaccatttaggatgtgcgtacatttttttctatgataaacaacgcctcccacagtaagggaggaacaatggaatgaaaaactctgcacataaacactttgatataaattctcatttggttaaattcctgcaagtgaaatcactgggttaaacaaagtatatgtgcacttttttttagatttcttgacacattttgacaaattcccttccagaaaagactcccacagagaagttgtgagattctcttttacaggaactttatccacattgggtattagaatttccctgtcaaagaggaaaaaaaaaaaaagttgccaaagtgcttcattgctgtcattgtgaaatgaaagcacattaaaggatcattgaaatctaattgctgttttccagttgaagtttattctagagcaggagtccacaaactatggcccattggtcaaatctcccctgccatctggttttgtacgtcttacaagttcagaattgtttttacagatgaacatttgcaatatatttgatcatcggaaacactaatttgtaccccaattaattaatatgttatttttaaaataagaattcaatttttctcattagctagcctgtagtacaaaatcttgaactcgatgattatgatttactttaaattttgtcaaagaatgttatgaaaatttgttttctcccttgttataataagtatctacgtaatattctcgattttgcatcttgacctacaaaggctaaaacatttacatctgtttacagaaaaacacaatttgccaaaccctcttcaaaagtattaattaaaaacataaaaattttaaaatattttaaagtatttcacctaagatactagagtaacaaacttacaaggatcgccctttattccacatctcagtgattttcaaacctgaagttctcagtttccccagagataattttgggagaaaaatgagggcaaacaaaagtcaacaaatcttcacacttcaaccatttttattgcctcttgttttagatttgggttccaaataagatttcatgtaaataatttgccccacaattttagaaagtgtctgaaaactgcttgctaatgtgtaacagggcattgcttaggccagggcttcttctacatgtcttcaaccagtgcctgtcaatagtagagttcacaatagttaccagcccacctgctttcaaatcaaactgacctacttttttaagggtcatagttctaacagatgaaacatggctaaagaccaattttaataaatctaaattggtataggtaatgttttcgtctttcaagagaaatataaccttgattcatacaaactatttcacacttaaaatggttgaacaagtatttccacagtaagggaggaacactagaatctgaaaggaacaaataagcatagaaccaaaaacgtaagccttactttcctttgtttttctgagccatttattcaggttgtcagagcaaacttaaaatgaagctatcccttgactctgtagccatgtaatgaaatggttaggagcaaaaaaataaacacagaaataggacttggttgtttttccattaactgtggctttcttgatgattgtgcatttccagaaggttaaacataattgcctcttctcccttcctgaagctcgtttagatacatcctgacacattcccacacacatagctcttctaacctaaggttcagtttggcagggaaattctttcaaatcagcaggaaagaaaatagtctgttatttactgggtatatgctattcaaaatcaacaaaataatagatcaattccataacagaaactttggacactagaattaaaatttctagaaacagttaatactaaaattattctcattctggaatcaggtagctcaagacaatgagaatataatcaatagaattactgaaagagtaatagtgatgacagcaatagctaacatttgggtgcttgctgtgtagcaaggccagtaagtcatgaggatcaaactggctttcaatagttataacactcatttattatcaaccaagccctcttctaattccatgatatgtattcactgcctcaggtcaatggcacctatgaggtaggcaccattattacccacattttatagatgaagcttagtggactgccatgctcaaggagctggttcagtacacagtggacctgggacttgacctagggctcttggtcacagagccacttctccctctcaaacctgcctgatgatggaatgtgggaatattctagcaggataatctctattcaaccatcatggaaatagtgaataacacggttttaagaaaaaaggggttcgagaccagcctgaccaatatgatgaaaccccgtctctactaaaaatacaaaaattggccaggcgtggtggcacaaacctgtaatcccagctactcgggatgctgagacaggagaatcatttgaacctgggaggcagaggttgcagtgagctgagatcacgctgagaggtgacagtgtgctggcagcccttgcttgctctcggcgcccctcagccttggcgcccactctggccacacttgaggagcacttcagcccacctctgcactgtgggagcccctctctgggctggtcgaggccagagctggctccctctgcttgtggcgaggttggagggaggggcgcaggtgggaactggggctgcacacggagcttgcgggcaagtgtgagttccgggtgggcaagggctcagcaggccctgcactcagagtggctggcctgcgccaccaaccccaggcagtgagggccttagcacccaggccagcagctgcggagggtgcgcagggtcccccagcctgccagcccacctatgccacgcttaaattctcactgggcctcagctgcctccccatgaggcagggctggggacctgtagcctgccatggctgagcatcccccaaccccccatgggctcctgcatggcctgagcctcccagacgggtactgccccctgctccacaacacccagtaccatcaactgcctaagggatgaggagcgcgggcacgtggtgcaggactggtgggcagttccacctgctgcccctgcatgggatccactaggcgaagccagctgggatcctgagtcaggtgaggacttggagagcttttatgtctagctaaaggtttgtaaatgcaccaatcagcactttgtgtctagctcaaggtttgtaaatgcaccaatcatcaacctgtgtctagctcaaggtttgtaaatgcaccaatcagtgctctgtgtctagctaatctagtggggacttggagaacttttatgtctagctcagggattgtaaatgcaccaatcagcactctgtgtctagctaaaagtttgtaaatgcaccaatcagtgctctgtgtctaactaatctagtggggacttggagaacttttatgtctagctagaggattgtaaatgcaccaatcagcactctgtgtctagctcagggattgtaaacgcaccaatcagcaccctgtcaaaacagaccaatcagctctctgtaaaatgcacccatcagctctctgtaaaatggaccaatccgcaggatgtgggtggagccagataagggaataaaagtaggctgcccgagccagcagtggcaacctgctcggctccccttccacattgtggaagctttgttcttttgctgtttgcaataaatctcgccactgctcactctttgggtccacactgcctttatgagctgtaacactcaacgcaaaggtctgcagcttcactcctgaggccagcaagaccacgaatccaccaggaggaatgaacaactccagacgggaggaatgaacaactccagatacgccgccttaagagctgtaacactcactgcgaaggtctgcagcttcactcctgaagccagcgagaccaccaacccaccagaaggaagaaactgtgaacacatccgaacatcagaaggaaaaaactccagacacaccatcctcaagagctgtaacactcaccacgtgggcccatggcttcattcttgaagtcagtgagaccaataacccaccaaatcaggacacattttggtgacccagatgggactattgcttatcagcaagcagtaagactatcgcctatcgccaagcagtgagtaccatcggacacctttcacttgctattctgtcctatttttccttagaattctggggctaaataccaggcacctgtcagccagttaaaagcaactagcgtggccgctggactaaagacatgggtgtcaggctttctggaaaagggctctctaacaacccccaactctttggagttgggggcgttggtttgcctggaaccagcttccacttttcctgtgcttctgggctgagccgagggtcgacagagaggaaagccattcagctctggggtcccaacaagttggttgaccctgaggccatgagtggaactctcaaaggcatgttgcccaagcgagacgtgcccatctattctctctatcctgacccttgtcccctgggtcctaaagtctgccagacaaacttcctctcgcccctcttctccaaggctagtcttgcttctaaaaatcgctccctgtctctggtgcttttctaatttctcctataagaataatttctggtataaactccaggactctgttatgtaatttaggcacctgggctcgccaatcagaaagacataatttttgcccaaagccctgatgtagggggtactatctggaattttaagatccctcctcagacaagcaggcctaacaaaaactattcctgaagctaggatatggggagcctcagaaattgtatcctcctattcatataagtgaggacaaaacgtgtcactcttccaaccctggatatcccttccctccctcagggtatggccctccacttcatttttggtgcatgacatctttacaggacatgggtaaggtcccaatactaacaggagaatgcttaggactctaacagattttcaagaatgcgttggtaagagccactaactcggatttttctcagtcctctttgtggtctaggagggcaggcaagggtgcatgtttttgacaatgcattggtaagggccactaaatccgaccttccttggttctccttgtggtctgggaggaaaactagcgtttctgctgctgcgtcggtgagcacaactattccgatcagcagggtccaggtatcattgcaggttcctggcaggggttgtttctgctgctacatcagtgagcacaactgttctaatcagcagggtccagggactgtcacgggttcttgggcaaggggagaaacaaaacaaaccaaaactgcggatggttttgtctttcagatgggaaacactcaggcatcaacaggctcacccttgaaatgcatcccaagccattgggaccaatttgacccacaaaccctgaaaaagaagcagctcatttttttctgcactgcagcttggccccagtattctctctctgatggggaaaaatggccacctgagggaagtacaaattataatactatccagcagcttgaccttttctgtaagagggaaggcaaatggagtgaaataccttatgtccaagctttctttttattgaaggagaacacacaactatgaaaagcttgcaatttacatcccacaggaggacctctcagcttacccccatatcctagcctccctatagctccccttcctattaatgataatcctcctctaatctccccggcccagaggaaataagcaaagaaatctccaaagcaccaaaacccctcaggctatgtccccttcaagctgtagggggaggggaatttggcccaacccaggtacatgtccccttctccctcactgatttaaagtagatcaaggcagacctggggaagttttcagatgatcctgatagatacatagatgtcctacagggtagagggcaaacctttgacctcacttggagagatgtcgtgctactcttagatcaaaccctggcctttaatgaaaagaatgcagctttagctgcagcccgagagtttggagatacatggtatcttcatcaagtaaatgatagaatgacagccgaaggaagggacaaattctctaccagtcagcaagccatccccagtatggatccccactgtaaccttgactcacatcatggggactggagtcgtaaacatctgttgatctgtgatctagaaggactaaggagaattaggaaaaagcccataaattattcaatgatgtccaccacaactcagagaaatgaagaaaatccttctgccttcctcgagtggctacgagaggccttaagaaaatatactcccttgtcacccgaatcactcaagggtcaattgattctaaaagataagtttattacccaatcagctgcagatatcaggagaaagctccaaaagcaagccctgggccctgaacaaaatctggaggcattattaaacttggcaacctcagtgttctataatagggaccaagaggaacaggcccaaaaggaaaagcgagatcagagaaaggccacagccttagtcatggccttcagacaaacaaaccttggtggttcagaaaggacagaaaatggagcaggccaatcacgcagtagggcttgttatcagtgtggtttactaggacactttaaaaaagattgtacaatgagaaacaagctgccccctcatccatgtccactgtgccaaggcaatcactggaaggtgcactgccccagaggatgaagtttctctgggtcagaagcccccaaccagatgatccaacaacaggactgagggttcctggggcaagtgctagctcatgtcatcaccctcactgagccctgtgtaagtttaaccattgagggctaggaaattgacttcctcctggacactagcgtggccttctcagtgttaatctcctgtcctggacaactgtccgcaaggtccgttaccattcgaggaatcctgggacagcctgtaaccaggtatttctcccacctcctcagttgtaattgggagactttgctcttttcacatgcccttcttgttatgcctaagagtcccacacccttattagggaggcatatattagccaaggctggagctattatctacatgaatatggggaacaagttacccatttattttcccctacttgaggagggaatcaaccctgaagtctgggcattggaaggacaattcggaagggcaaaaaagcccacccagtccaaatcaggttaaaagatcccaccacttttccttttcaaaggcaatatctcttaaggcctgaagctcataaaggattacaggatattgttaaatatttaaaagctcaagccttagtaaggaattgcagcagtccctgcaacactccaattctaggagtacaaaaacctaatggtcagtggagactactgcaagatcttagactcatcaatgaggcagatattcctctatatccagttgtacccaacccctataccctgctctctcaaatacaagaggaagcagaatggttcacagttctggacctcaaggatgccttcttctgtattcccctgcactctgactcccagtttctctttgcctttgaggatcccacagaccactcatcccaacttacggggatggtcttgccccaagggtttagggatagccctcacctgtttggtcaggcactggcccaagatctaggccacttctcaagtccaggcactctggttcttcagcatgtggatgatttgcttttggctaccagttcagaagcctcattccaggaggctactctagatctcttgaactttctagctaatcaagggtacaaaatgtctaggtctaaggcccagctttgcctacagcaggtcaaatatctagacctaatcttagccagagggaccaggaccctcagcaaggaatgaacacaatctatactggcttatcctcactgtaagatattaaaacagttgtgggcgtttcttggaattaccagcttttgccgactgtggatccccagatacagtgagatagccaggcccctctgtactctaatcaaggaaacttagagtgcaaatactcatctagtagaatgggaatctgaggcagaaacagccttcaaaaccttaaagcaggccctagtacaagctcgagcttattatttttctttttgtttttttttaattatactttacgttctagggtacatgtgcacaatgtgcaggtttgttacatatgtacatgtggcatgttggtgtgctgcacccattaactcatcatttacattaggtatgtctcctaatgctatccctcccccctacccccaccccacaacaggccctggggtgtgatgttccccttcctgtgtccaagtgttctcattgatgaattcccacctatgagtgagaacatgcggtgtttggtttttcatccttgcaatagtttgctgagaatgatggtttccagcttcatccatgtccctaaaaaggacatgaactcatccttttttatggctgcatagtattccatggtgtttatgtgccacattttcttaatccaggctatcattgatggacatttgggttggttccaagtctttgctactgtgaaagtgctgcaataaacatatgtgtgcatgtgtctttatagcagcatgatttataatcctttgggtatatacccagtaatgggatggctgggtcaaatggtatttctagttctagatccccgaggaatcgccacactgtcttccacaatggttgaactagtttacagtcccaccaacagtgtaaaagtgttcctatttctccacatcctctccagcacctgttgtttcctgactttttaatgattgccattctaaatggtgtgagataatatctcattgtggctttgatttgcatttctctgatggccagtgatgatgcaagctccagctttaagccttctgacaggacaaaacttctctttgtacatcacagagagagcagggatagctcttggagtccttactcagactcatggtacaaccccacaaccagtggcatacctaagtaagaaaattgatgtagtagcaaaaggctggcctcattgtttaagggcagttgcagtggtggccatcttagtgtcagaggctatcaagataatacaaggaaaggatctcactgtctggactactcatgatgtaaatggcatactaggtgccaaaggaagtttatggctatcagacaaccgcctacttagaaactaggcactactccttgagggaccaaccagtacttcacatatgcatgtgcatggccctcaaccctgccacttttctcccagaggagggggaaccaatcgagcataactgccaacaaattacagtccagacttatgccccccgagatgatttcttagaagtccccttagctaaacctgaccttaacctatataccgacgggagttcatttgtggagaatggcatacgaagggcaggttacgccatagttagtgatgtaaccatacttgaaagtaagcctcttcccccagggaccagtgcccagttagcagaactagtggcacttacctgagccttagaactgggaaagggaaaaagaataagctggtatgcagatagcacatatgcttatctaatcctacatgcccatgctgcaatatggaaagaaagggagttcctaacctctgggggaacccccattaaataccacaaggaaattatacagttattgcatgcagtgcaaaaacccaaggaggtggcagtcttacactgccaaggccatcagaaaggtgaaggagaaaagtcagaaggaaactgccgggcagatgctgaggccaaaattgctgtgaggcggaaccctccattagaaatacctacggaaggacccttggtatggaacaaccccctccaagagattaagccccagtattcccaaaccgaagcagagtggggactttcacgggggcatagttttctccccttggggtggttggtgacagaagaaggaaaggtacttatacccgaagccagccagtggaaaatacttaaaaccctccaccaaacttttcatatgggtattgaaaacactaatcaaatggccaaatccctatttacagggccaaatctcctccgtaccatccgacaggtagtcaaaacctgtgaggtgtgccaaaagagtaatcccttggttcatctgaagtcccctttggagaaacaaagaataggtcactatcctggagaggactggcagttagacttcacccatatgcctaagtcaaagggatttcaatacttgttggtctgtatcctttacaaattggatagaagctttcccctgcaggacagagaagactcaggaagtgattaaagtcctaattcatgaaataattcctagatttgggcttccccaaagcttacagagtgacaatcatctggctttaaagccacaataactcagggaatttccagggcgctagggatacaatgtcaccttcactgctcctggaggccacaatcctcagggaaggttgagaaggcaaatgaaacactcaagaggcacttaaggaaactaacacaagaaactcatctcccatggcctactcttttgcccatggccctgttgagaatccaaaattctcctcacaaaatagggctcagtccatatgaaatgctgtatggacaacattttctcacaaatcacctcctacttcatcaggaaacggccaaattggtcaaagatacaacttctttggcaaaatatcaaaaaagcttaaaaacctactggaaggatgtcacagagaaaagggaacagagttgtttcaaccaagagatctagtgttggtcaattctctcccctctacctccccatctatggactctttgtaggaaggaacatactcggtaatcctctctactcccactgcagttaaggtggcaggagtggaatctcagattcaccaaaccagagttaaactttggacatcccctgaggaacctgcaggaccatcagctcaggagtcccaagatcagccagaccagcctcgatacacctgcgaaccactggaggacttgcacttcctattttggaaggaaacctcccagactaaaagggtccctaccactgatcctgaggaaagatcccttcctccttaaaaaagataagtgaaaacaacgtactaaccatactctttgtgataggactatatactctagctcctgccaggacaaaaatcctaatcacatcaaccttttttctatcttccttccttttgacagcaatttactcctacctttaattcagactagataaaatgatctcgttttccagagcaccctctttaccttcctatttccgctttgcctatgtatccctcctgcttccttggatacctcatacaatcacccctccccttccactaggtcctaattacctctacaagactctcaacttaactcactctctgttgaaccagtccaatccttccctggcaaatgactgttggctttgtatctctctaccaacctctgcctacgttgccactcccattcccgcagaaaaactgggactttaccaacttaacctaccaccctcattatgaaggaaaagaccctttccgatttctaaatatgcaatcattagccgacttccccatatctgataggaccaagaatacccccaggacgtgcaatctaacttttacattcttacatttccaacctcatctattacacaagcaatgaaaagcccatacaaggccctgtaaccacgaatactatcttaactttccaagcccctttatgcatccagcacaacctgttatcaggcttgcccctggggcacctactaccacatcagtgtaattacaccctacaacttcaagccccagctgatcatagtaacttccgagtcacccaaacagctccattcagatggcttgtccacttctcagggccccccaaaatcatcacctcctccctgcttaacaaaaagtccaggttttgtaatggcaaacatactccctgcatgaccattcaccccagaccccctgcagcagcgcccccaccactagtgaatgcctcctcatcccctctttcaatcactctctcgaatggttcctagtggatacaaaatgtttttttctacaatgggaaaatagaacacagggagccacacagtttgctcccaacacccctttccagtcgcccactggagctatcttggcaagtactctaggagtatgggaaaatgaaaacaacaaactcacacacctttttaacatgcataaccagttctgtctacccagccaaggtatattcttcttatgtggaacatcgacctatatctgcctccccactaactggacaggcacctgcaccttagtctttctaagtcccaacattaacattgccccaggaaatcagaccttatcagtactcctcaaagctcaagtccatcagcgcagagccatacaactaatacccctacttatagggtcaggaatggctactgctacaggaacgagaatagctggtttatctacttcattatcctactaccacacactctcaaaggatttctcagacagtttgcaagaaataatgaaatctatccttactttacaatcccgaatagactttctggcagcagtgactctccaaaaccgccgaggcctagacgtcctcactgctgagaaaggaggactctataccttcttagggaagagtgttgtttttacactaaccagtcagggatagtacgagatgccacccagcatttacaggaaaaggcttctgaaatcagacaacgcctttcaaactcttataccaacctctggagttgggcaacttggcttctcccctttctaggtcccgtggcagccatcttgctgttacttgcctttaggccctgtatttttaacctccttgtcaaattttgtttcctctagaatcgaggccatcaagctacagatggtcttacaaatggaaccccaaatgagttcaactaacaacttctactgaccacccctggaccaacctgctggcactttcaccggcctagagagctcctctctggagaacactacaactgcagggccccttcatcacccctaggaagtagctagagtggtcatcggccaaactcccaacagcagttggggtgtcctgtttagaggggggattgagaggtgacaatgtgctagcagcccttgcttgctctcagcacctcctcagcctcggcgtctgcactggccatgcttgaggagcccttcagcccaccactgcactatgggagcccctctctgggctggctgaggccggagccagttccctttgcttgtggggaggcgtggagggagaggcatgggtgggaactggggctgcacgcgttgctcacaggccagcgtgagttccgggtgggcacgggctcagtgggcatgtactcagaacggccggctggcaccgctggccctgggccgtgaggggcttagcacccaggccagcaggtgcagagggtgctccaggtcccccagcactgctggcccacccataccacactcgaattctcaccaggcctcagctgcctccctgcaaggaagggctcgggacctgcagcctgccatgcccgagacccacccccggtggactcccacacagcccaggcctccccaacaggtgctgccccctgctctgtggcaccaggtcccatcgaccgcccaagggctgaggagtgcaggcacacagcacgagactggtgggaagctctgcccacgaccctggcacgcgatctgctaggtgaagccagctgggctcctgagtctagtggggacttgcagaacttttatgtctagctggaggattgtatatgcaccagtcagcactctgggtctagctcagggattgtaaatgcaccaatcagcaccctgtcaaaatggaccaatcagctctctgtaaaatggaccaattagctctctgtaaaatgggccaatcagcaggatgtgggtggggtcagataagggaataaaagcaggccacccgagccagcagtggcaacccgctcgggtccccttccacactgtggaagctttgttctttcgctctttgcaataaatcttgctgctgctcactctttgggtctgcactgcctttatgagctgtaacactcactgcaaaggtctgcagcttcactcctgaggccagcgagacaatgaacccactggaaggaatgaacaattccagatgcaccgcctttaagagctgtaacactcaccacgaaggtctgcagcttcactcctgaagtcagcgagaccaagaacccaccagaaggaagaaactctggacacatctgaacatctgaaggaacaaactccagacacaccatctttaaggattgtaacactcacggtgagggtccgcggcttcattcttgaaatcagcaagaccaagaacccaccaattccagacacagtgatgcaaccacaacattgtcagctggttgcaagaagaatggcagatgttaaggatcacaagattgaatgaaagtggtcatcatttccaaaattgtattctaggtgatgctaataagaataccccaaataggagggggtatatggctatgtggtttgatgatatggggagaagctgggtcaaaaagagttacacaatttttgtcaatgcaggacttctagagtctttcatatgctaaagtgaacctctatgaggagactatgatatgcaacattccctaatcttgtttgaacacaatattcttttttcttaaagatggtaacatttgtagattattcgtttttcatgtaacacagtttgaatgaattactcaatctgcggtgaaaattatcagagtgcattgctgacagaagggtttgcctcgggtgttcacacttacagctagaacagtgtcataaaccagcaaaaccaggttgtcttgttaggcgaattgcaatgtcatccatagcagggctactaaactgaagttcactttactagctgagttgggaaggtaggatgaacagtagacaaatgtgtgtagatatttttatttctgctgttacatggaggaagacaccatcacattcatcagagattgaaataatttcagggtccaaacaagcttaagaaccaactgttccttacacagtaaaaaataatcttgcaaaggtaatattaacactgaattccagaacctgcttttaatttcagacaaatctcagcttctctggagcttggttccctcatctaaattatgaagacgatattctttgtcttatgtaccatgcagagttaatatgaatatgaaattacatgagataaagagatgcttagctccaagtgctatgcaaatattagaattattattgctacagtaacattaaatcatattttctccaacagatgcaatataggaaaggaaaaacatctgtggcatttggagattagtaatgtgtgctttaaaaccacaaactacaaagaaattggaagtcatcaaagaaggagaactaaaatcaaaacaaatctctctgttggaaaagctcaagatgacaagtcatgtaatgaatccatctgactccaggcaggaatcctactgatcttacatacttgtggacaccaacattttcagtgaaaatggcatttcagtgtattagtaatattcctactatacacacacacatacgttaaaaggaaacaaatctagggtagtggtggcactgtaaaaatagcatcaattaatattgtttataattgttaatagctctatggccttataaccacgaaatatcaaccattcacacttcctaagtgcctatattcgagaatataggggttttaaaagttgagtgtttactacataccaggtgtctcatccatggtcacatttaattcagtgagacagaaattattatccttatgttacacatgaggaaactgaggtccagagagatgtgatccagttcacacagcaagtagtcatcagaggtagaatttaatgtctggtctctctgattccaaaacacttttcaacacatctgctgttactccaatttcaaataaataaataaacaaactgtaaagaactgttttcagtgatgtaagatccaatgtaaaagtttaaataactgaaaataaatttacatttaataactgaaaataattttaagtaggaaaatatttctatgatcatcccagaaatgtatttttataattatatacatagaagaaatttcaaaaagaaaattaggtttttttctttagagacagagtctctctctgtctcccaggtggagtgcagtggtgctatcatagctcactgcagcctagaacctggactcaggtgatcctctcatctcagcctcctgagtagctgagactacaggtgagcaccaccacactcggccaagtttttaaaaaattttttgtacagacaggcccttgctatgttgcccaggcttctttgaactcctggcctcaagtgatcctcccacctctgcctcccaaagtgctgggattacaggcatgagtcatcacacccagcctggaaaattacttttaacagaagtaatacttacttagtaagtgacagtataagtggtaaatgaaataaataatataatttaaatagaagaagcacttagtggctaatacttattgattgacaataagtcagcactaaaaagcatgtgttatatttaataaaatgttctctgatcaatattacctatttttatactcatctggaaatagcaagttctgtatgttataactgggctgaggaatgacctagtttctttgcatacttttaagaaacatttttactctcacaagttttgtaaggatacttcacaatcattaatttcaactttgataaccacagcattcaaggaagatatttcccactctttattcatcagcagagaaacaccagcttcaaaaatacctttctctgaatatcaatccatcaccatttcttttttttttttttttgagacagagtctcgctctgtcgccccagctggagtgcagtagcgctatcgcggctcaccgcaagctccgcctcctgggttcacgtcattctcctgtctcagcctcccaagtaactgggactacaagagcccgccaccatgcccgactaatttttttttgtattattagtagagacggggtttcaccatgttagccaggatggtctcgatctcctgaccttgtgatccaccagccttggcctcccaaagtgctgggattacaggcgtgagccactgcacctggccaatccatcacccttttttttttttttgagacggagtcttgctctgtagcccagactggagtgcagtagcgcgatctcggctcactacaagctccacctaccaggttcactccatcctccggcctcagcctcccaagtagctgggactacaggcacccgccaccgcgcccagctaattttcttttattttttaatagattaatagagatggggtttcaccatggtctcgatctcctgacctcatgatccacccgccttggcctcccaaagtgctgggattacaggtgcaggccaccgcgcccggccattcatcaccatttcttaaatgaatgagtaaataagatgagaacccagaccagcattcctgggtaaaagctccaaagttttttcaggagatccctcaaacccattatgtccagaattggtgggttcttggtctcattgacttcaagaatgaaaccgtggaccctcacagtgagtgttgcagtttttaaaggtggtgtgtccagagtttgttccttctgatgttcggatgtgttcggagtttcttccttctggtgggttcctgctctcgctggcttcaggagtgaagctgcagaccttcgcagtgagtgttacagctcataaaggcagtgcagacccgaagagtgagcagcagcaagctgtattgcaaagagcgaagaacaaagcttccacaacacagaaggagacaacagcaggttaccactgctgccttcggcagcctgcttttattcccttatctggccccacccacatcctgctgattggtccattttacagagagcagattggtccattttacagagagctgattggtccgttttgacagggtgctgattggtgcatttacaatccctgagctagacacaaaagttctcctggtccccactagattagctagatatagagtgctgaatggtgtatttacaaaccctgagctagacacagagtgctgattagtgcatttacaaatcttgagctagacacagagtgctgattggtgtactggtgtattcacaatcccttagctagacataaaggttctccaagtccccaccagatcagctagacacagagtgctgattggtgcatttacaaaccttgagctagacacagggtgcagattggtgtgtttacaaaccttgagctatatacagagtgctgattgatgtatttacaatcccttagctagacataaaggttctccaagtccccactagactcaggagcccaggtggcttcacccagtggatcctgcaccggggcgcaggtggagctgcctgccagtcctgagccttgtgcccacaatcctcagcccttgggcggtgatgggactggtgccatggagcagggggcggcaatcattggggaggctagtgcagcgcaggagcccgcggctgcggggaggctgaagtatggcgggctgcaggtcctcctgcccggcagggaggcagctaaggcctggcaagaaattgagccccgcgcgggtgggccggcactgctggggtacccggcgcaccctctgcagctgctggcccaggtgctaagctcctgactgcccagggccagtgtggctggccggccactctgagtgaggggcccgccgagcccacgcccaccgggaactcggctggccccgcaagcaccacgcagacctggttcccacccgcgcctctgcctccacacctccccgcaagctgagggagctggctccggcctcggccagcccagaaaggggctcccacagtgcagcagcaggctgaagggcgcctcaagcacggccacagtgggcgccgaggccgaggaggcacccagagcgagccagggctgcgagggctgccagcacactgtcacctctcaccatgacctgcaacacaaatggaaggagaataccagttaggagttctgcctggtgatcaggggctggagagttcatgtgagtacaaataattattctctccccacaaatccatttcctctgtggaagcgtgagttactttagcccctgaaaagacacagggaagccacatgaaaatgagaaaagcataggaatgtttgtttaaatttatttgtttaattgacaataattgcacatatttatggggtacatagtgatgttatacatataatgtatgtatatgtgatgcatataatgtataggaatcagattaaggttattagcatatccatcatctcaaatagttgtcatttctttgtgttgggaacattcatatgttccttctagctacttgaaactaaataatatattattgttagctatagccatcctactgttatgtcaacaaaagggaaattcctttaatgtcccagccctgagccagtgcaagggcaactcacattagcagctgggatgtccaggaacaggaagtttcagagggccaggttcagacacagtgcccacttcaaagcctgggaaatcaaagatttcccaggcctggtggtctgggcatctctcttttctcttgcagaggtggcaaaactcgacctctgtcctcttagggtcctacctgggcccaagaattaaattgatgtaagacaggttaacgggagaaaagcatacaaatttatttaatacatgttttacaggacataagagcccatatgggaaaagagcccatatagggaaaagaagacccaaggatgcagtgagagtcaatcgcttctatactggttgcacaaaggacagtagttttgaaaaggcagctaaattatgtggggaggtttaaaatagaagaattacttgaacaaggtctatacagaattctctcagttccaatttctcatcattgatagggagaatggtattccttctgtgacagggaggccatctcccatgtgggaatttcatctcctgctgttaagacacagaattaagatcagagtgacctcttcatatctgatgtttttaaaatatctgtaattcaaatagtcaatatgccagagcagcacattttgatggcataattcttaacctcttcactctcttcctcttggagattgcatgtagcctcctaagagtacgaagtttaactctaccataagtaaagtataaaaatggcttcctttcctcactccaagagactccaggcccaaaagataactccagaaagtgaggaactagagcataggccagaacctgcttcttttccatctcccctgcaataatcaaacactctctaaggtacagtcaaagaaagaatgcaaaggatgaaagaatttacagacaggtctgtctgtttgggcttttctcataaaatgtggccatcaaaatgtcataacgggagtcacggccaggcttgacttctaatgatgagaaaagttagataatgcccttctttgtgcttttcacaaaagcagggagatctcttgggagaaaaaggatttatccttctttttcttctttagatatacaaagagacatctggggacagggagtggcccagggaggagttggacatcagaatttagattgcaaaaaggaacactggggagggctgacttggttagtttgctttaattactagcagtcaaagagcaactcacaatggtttgcaccattaggaaaagtgattattacacacaccaaaaaaaatcccaaggaagagggactccagggaagaggcttgtcaattcagtggctaaggatgtcctcatggaccatctttccactttctgctgtgcttcttcagcacatcaccttcatccccatgctatttcctctcaaggtagctgtattagtcggctagaactgcagtaataaagtgccacaactgggtagcttaaataacaaaaatgtattgtctcacagttgtggaggctggaagtccaagattcaggtgtgcacaggattggttccttcttagggctgcgagagagaattcattccatacctctctcccagattctgatgatttgctggcaattgttgacattgtagatgcatcaccacgatctctgccttcatctttacatggtgtagctagtattcaaatttctctttttaataagaataccagtcatactagatcaggaacccactctactccagtatgagctcatcttaacaaattacatttgcaatgactctatttccaaataaggtcacattctgaaatactggggattagaactcaaacatgtcgtttttcggggcgagcggggagggcggcggggaacacaattagaaacaaaacagtagcaaaatggctgctccaggtgtcacacctacaaacaaagtccctagaaagaagaggctgtatcttccttactccttttgagaaacttcacagcacacacagcatcacgtctcaatggtcataactatgtcatatgccaacctctaaccaatcactgttgaaggtgctggtattgcagagatgtggaggtgaaatactccagataatgaaattactaccttgcctgacagacaaagagaaggaacatagtaaagttttaagcatgtgagttaccatgtttccgtaatctttcagtcctctaagttgttagcttttctcctttttcctaatcacatctattagcttttttagaatacatgttcattgaagaaaattggaaagcattaaaaataatatattttgaataattcaaaaatcccaccaagacttcttctaatttcccttctaatttaccggtaagtacgtgtttattgaaaaaaattgagacaatattaacattttacaaagaaccaatttaaaatgattcataatcccatcgagatatcccctactaatgtactagaaaatattttcccatatgtatatgttatatatacatacatacatatataacaaaaagtgtggctatagtgtgcgtaccgctgagtagcctgcctttcttcagttagtattaatttgattgtttgcatttcctttctgcttgtggtaatgttattaatcacaactatctggaacaccttacccccaacacatatttacactctacagttctcttttggtatcattaattgcaaaagagttccagctcaagttaaaccacaggaaaaggctcttggttccagtcatgggaggagagaagaggtctgatcagaaatgaattcgacgttattcattaaacccaagtcaaacagtcaaatgtttcctcctttgtgaagtatttttcactgactcctcctccaacctaaggagaattctcccatttgtgcacaattactattgagctgactgtccatgttctctaacataacactctgatttgtgatatcattggttttccacatgccatgatacccttgagagcagagatgagctctgatctatctttatatctccaggcctagcatcagtagacattgaatatgtgttttattgaacaaatgaattcattcattcattcacagaagaacaagctcagaatttttttccttattctctaccatagttccctacaatggtttatcataatttcaaaaagaggcaaagtttgaacaattaatttttaagtattatttggaagaaagtgaaatataattatttcaacactaacctagatattatgcttacatatcagtgaggcatgtgccttaaaaagccagatgtctgtaaaaatcaaataataacttgacaaccaggtgatggttgctaggaaactgcatttttctgtgaaaacatgatgtatgaagtgtagcctagattcatatcctacattaaacatcttccttggagttatctatgaagtctgattttgcatggcttgtcaaggtatataagttattccctcagttatcctgctcctgctcttaaaaatcatatggttctatacatagaatattatttcaacaccattatttgttctgaactcaaggttgtttaggttatagattgaggccccttttggctccaaaacttttcagtggcatcaaatgttagttaccctctcatagttgtcactgaggaacaaccttcacttttgatgtattaattgtgctaagtgaaaaaaagtaaaatatgtacaatgtttctatgtattccaaagtgaaataaaaataaatagaaattatccatgagttttgaaagatttttgctcaccactactggaacataatagagattttactatactctgcctaggaagttgactcctgacattgatagtgaagttccagaaagtgctgaggaactttgctaaattcaagagctgggaattttgtttgaaataaatatctcaatatttaactgctgtattaattagaaaaattgtattgcaagaaacagaaacccaaatcaaattagttaaagccaaaaaggacatactgagatactagaataacttgggtaacttacaaaattgaaggaactaaagaaaaataactgaaaagtactaaggatgtcaggaactagaaccaaagacaacacaactctctccaatcagtccccatagcttctactgttttctcagcatccatctcattttcccgggtttctccttgtgccaggaacatgaccaccagaagctctggggtcaaatacaagaggcaagagttttggctctccacatccttagaagtttctgtgtaaagattacaattgacccagactgggtgacttgcccagcttgtggcaaatgggtgaggttaagtgcattggttgacaatctccagtaggggttgggagaaaccagtttctaaaaggaagagtgaagcttttacatggacaagggcagaagtcaaggtatgcagaaacaatcaacagaagtgcattactccaaacatatccagcaatgattttaataccactttcaccagttttgtcaccacaaagtgacaggacaacccagctcctaacttatacaatgtcatctttatgactattctaaaatgctttgaactttttcatcttaaaacaccaaaggatcgctatgacagcgcaggtgctttttctcacgtgcatccttctacgaaatgcttagacatgaattctgaggcttacttttcacaaattaaaagattttttcatggaaacacaaaagatacaaaaagtagaaagatccatatgaagcaccttcctccacagtttctaagcttctaaaatcaatgtttcccagttcattaacaagctcgtacataattattagagtaacaccattaaggttagcacatacaatgactcccaaagaaaaaacattgtctatttataagcattgctgtgaatgggtggaacgtctcagcaatacagtcacaagcagcagtcccggtgttctcactcagatattccacgtagcacttcatagtatgctttaagtgagggaatgtgacctatagatacatctacacgagaaggattcccataaggcataaactgttcaataaacaatcataaaaatatattcattcttccctatctagaaatctatgtctttatttaaaaatacgtgatgattcatgcttaaggacgtgttgttggacagttggttacagtcttttatctagtcaaaagattcttatctgccagaaatgtgataagtccacttataactagtctctcaaaacatcctagatatttttctctgtatgcatagttaatcatacaaattaatctaacctaatgccatcttgttaccctaaaatgtttaatgataatggcttatcatctttcatccccataaattttctccttgctttcagtgagcagcaacttcactcccatatacgcacttgttgtgtattccttctcctgccaaattcacacagtcacctcctcttccaggataagacgtttactgctgataatcacagccacaggggaaacaaagaactgccatgctcaaatgagggtaaggtgaggcaggtccattaatttacaaagggactgattacaaacatgcaagtggggtgcagggaaaccacaggtgatgctacatgaacgcagggctgaagacagtagagctgttactacccctaggccaaagggacagagagatagtgggcaccaaaaccaaaggaggggaatctacaggcaggtgctggcccagcaacagttttttagatgaactaggtacggaaattgagaataagcatttataaacttcaacagtaatcccaaagaataattgtgtctaataaaaaatgaggtttatctaataataaaaatggggttggattttctatgtctttttttttttttccaagatggagtcttgctctgttacccatgctagagtgcagtggcattatctcggctcactgcaacctctgcctcccgggttcaattctcctgcctcagcctcctgaataactgggattacaggtgtccgccaccacccccagctaatttatttatttatttttaattgtatttcatttttctagtaatttctttgaattctatctatttacagaagtgccagctattgataaattggaaataaggaaaacaagctgggccttagccacagatattgtaagaagcttttctgtagagaaggccttcttgggcaaaacaggcagcccaaggatacccagtaggaggatagtcaaggaaattgatactctatccttcctctcttcacttcctccagtctcttgtcgaagttctccatttggctatacccactgaggtccatgtgggtcagtctctggaggcaaaaagcaggatacagaagggtggagagtggatccccatcctgtacagttgaaaagtctatgtccccaacattgcaaatgcacgaagtcccatcaccacagagtgatgtcatttagtcacggagtaatgtctccctgtgccacttaccaacttactaacactgaactccaaattcactctaaatacatgctctgtcataatgaacagaattcctttagcacccatcctttacagtgagcatgatattgagctgtctcagtagagggcgctggagggatactgcaacaggaaagggctctcctgctgtttgcagctgctgcaagaggtcagcagtgtgggtgggagggcttttgtcatgctcttccctggctgcatccctgagcatggggttcctttgcaacttctcagctgcagcctggcctagcattaaaaatagaacccattacacaggtttgttgtaagtaagtgttttttgttttttgtttttttttttgagacggagtcttgctttgtcacccaggctggagtgcagtggcgcgatctcggctcactgcaagctccgcctccctgattaacaccattctcctgcctcagcctcccgagtagctgggactacaggtgtgtgtaagtactaatttttaaagggcagatataatcagtatattaacatgcagttctcacaggggtaactaaaaacaacttttaattttattcctcactgtctgcttgggagtgaaggactggctagcccttctcctacccctggatgaaacttggggtggcacaatggctgttctcacacaggactttggagggaatataaaatcctacaattacttcaagacacaaacatagtctcaagtcagttattgaaaatgtccaatccaatgcatcaatcagtaattcaatttgtattcaaaggtaagacttctgggaaggaatccttctcttttatttccttactccccactgttcactaattggcttttggcccttccagggttaagtgctcagatgaaggaaagaaaaggggataaaaaagttcatacttgacagatactgtcaaaatgttgcttaatgctgtctgtctgacagatgcttaagactaacctttcttttatagacacttttgggattcttcagaggggttcctgccaagtgatgtattctagttctccaattgccccacatgacttagtccttggttttccagaagttcactcagtactgaccttcttctattttcaagatagtacccctcttacacaagattttaaattgttccaaaccagaacttacacaccactcggctcacactagaccatgggaatattcgtctaccttttatcccaacaaactctacgactgaaggtcaagctggggtagcaacaactctcctcacttcacctgcaaaagcacttgccagacctcctctgagcctctctacagacaccacccgcagtgtctgtgaggtctgctaatggagcttgccacaaaatacagactgaaacaagttttataaacttcctcagctttttgagagagggaagaatttcccatttgaattcttccaaggagatttccccctgtactcataacttttcatctttatttttctttcctatgacccctaagcaaacatcctgttggtgaccataagcttggcaataaattatccacgtgttgcctcactggggttttactaccagttggtctatactgttgtgggaataacatgcacagtcactgcagaaggaattaagccattgtataaactttaaaacatgcaagcccacccattaaaattgttccttgttattcttaccgtatatatccaaagtaaatgaagttgagatttgatgtcatcagtagcccatttgattatctacaagaatcagataacaaactggtattatgggggagagatataaataggaaatcagtgatgtgctcaaactgtaaatctagccccgccatggcttatttctataccagttgcttagcatggccaacccgaaagtcaacgattttaatagtccctgaatagtattatgatgatctctggttacttagtagggccctacctagcagactgtttctgctttaccacatttggatgtcagatccaacttttcttgcactgactggctgtaataacccatatggggcagggggagaaataagtggttttttaaatttacttttgccagtatgtgttaatagtacttagtttcataattctggatgtggctccagtaatcagaagagctttaaacagaaagatcaaagtccatagaaaagagttttgtttccgtttccttagaatatagatcatcctgtgaaaaacataggatttcttcaaggtaaataaatagtactcacaggaggctaaggcagagaaactataatgacaagtagttcaagtgtgtaaagaaaaatactggttattaggaaagactgctcagatgggccagtataattaaaatagttaaagtgacaagggattgatctgaaacaagtcatgagaatccctacaaaaagcagttccctaaactggctgcataagaaccatctggagtaataagcttacgaattaaactgatacaagcctgtctgtacctgagacagccgatatccagtctgggcttcttttcagtaagagaattctgattttattgctggtaatgtatccagctaaaagcaatgtttctcagcttctcctgaagattggtatggccatgtgactaattctggtcattgaatacaagtggagattattggctattacttctgaaaaggctctttaaagagggaggaagagctgagtttgaactttttgcctttctacccattcctccttctatgtagaatttagaccttaaggctgaatctgtagcaaccatcttagagcatgaagcaatcttgaaggtgggagtcacaagttaaagatggcagagctaatggattaaaggagtctgggttcccagccaccatgggactgccatgccaaccctgcactgctccttccacacttgttttataagaaggaaagtaaacctaacatagataatcctgttactatacaccatcaaatcctaaacacagtgctactggcattttcttagccttaccagattgcaacagatgattttcattttcaggcaagtataactacctccacaatgctacccagctgtcagtgattacagcataccatttggggaaatgcatgtcttagaattaatgaaacaggtatttagagtcttcagtttatccagctgccttagcttgcctgaaatcttactagtaaactcactgattctgggaccatccagaagctggaaattcccaatgtggaagagaaatggccatgagagaatgccttgtgcatacctggcacagaaaggaagctaaggaaaagcaatccaacacagacattgccacccacagttgtatggaaggcaaagtatcagtgagaaagaagctgtagtaacatcagtgttggagaatctttatttattatagggttaacctcttgtaccgtaatggaccttaaatgagcacagaagtctggtctccaaagtgagacctaaaggaagatgatgccaaccagagcatggaggacagactggaagttttcccctggcacaggccatcagtaatcagctgttgatatgcctatgttaattgtctggtaaactcgtggtgctgttttggctcttctcaactagttcactttttaaaaatttaagcacctcattaaagaaacccttttagatgtggtaaagcgaaacagtctactaggtagggccctactaagtaacgagagatcatcataatactattcagagactattaaaatcgtcgactcttgggttggccatgctaagcaactggtatagaaataagccatggcggggttagatttacagtttgagcacatcactgatttcctatttatatctctcccccataataccagatacatggtagtcactcaacaggacaaatattaaataacaaatgacacaatacatggtttcaaaagggtgtttactatttggccaaacaatattttttaattgtcagtcataaagtgaaatacatactaaaatatatattaaatattcaccaaatctgcattgctgctacatgaaaacattttttggtctgttggaaaatgtaattcctgagatcattgttgggctttgtcaatcattttcctcaccatcaaatcaccttaagtgacttgggagtgtgaatctaggatgttcaattttagaccaattttctctatcttctaaatgagtaaacaggctctgtcttttataaaaggtagaaaaataaccatggtgtgctaatttttttcaaggtataccatatggaaaagtataggctgaacacaaaggaagtcttttctgaatggctctcgatcacacataaggaacatatgttttccagttaatctgtccttgatgtacagcagtccagctgttgttttgcatttattaaaatattctctgctaaatagttatgtttgtctttaaaagtaaattgcataaaattacatccaatttctttctctaaaccaacatattcttcaccttcacaaagcaaacacatggtgcactgaaaccgaggtgttaccagctttacatactgttctgccatttgtgaggggtgcaaccacaacataagtcagaaaaaaagctatccagcttttcgtggaatctggtgaagtttatacttagcgataagcctctaagcctgaacttagcagggctagcaaaactttatttatttcctaactcctattattttagaatggttttcaaaataatactgcaagttcctaattgaaatacaaaacagaacaaaaagctgtgagaaatcttttttttctttggctccttaaagacttggaataatttatattagtgttgcatacattttaccttctacattttgatgtacttgctcttgaaagcactagaacaaattaattgaaataaaacctctctgaaaccatttgaatctttgatcctaccatagagttttaaaggctttcaggatataacttgtattttcccctgagtctgagtgtctacatgattatagaatgcatgtctcttgcttcatggtgatatctaatatgcatggaatactgaaaaataggtatttcccaaaggctcctatataccaggcatctcagactgacactgaaaaccttttgaagcatttttaacaacaaataatggactatttcacagactgatgccaataattagttttctggacctacagttgaaagcaaaattatctttttaactaaataggatcagcttcaaaatcctttttggagatgtttttatctattaaatgcctttattaacaacaccatcttccattttctattactccaattcgatttctcctgcatacaaggtaatgagtagaatggctgtgaatccagttaacattccagcattctgaatcatgaagaaggtgaaatcggtttttcttccagttaccttttctctcagcatatcattcatctctggaaactagaagacagatatattgttagataactgttgccatcttgtggcaaaccacaaaacagtcacttagaggcataccttggagacagtgtgggtttggttccagaccagtgtgataaagcaaacatctcaataaagcaagttacatgaattcccaggtttcccagtgcatataatagatatatttgcattatactgtagactattaagtgtgcaatagcataatatctaaaaaggcaatgtatataccataatttaaaaaaatactttattgctaaaaaatgctaccaatcattcgagctttgggtgagttgtaatctttttgctggtggagtcttgattccatcttgatggctgctgactgattagagtagtggttgctaaagatgggagtggctgtggaaatttcttaaaataagacaacaatgacatttgcaacatcaatttatttctttcatgaaagatttctctgtagtgtgcaatgctgtttgacagcattttacccacagtagaaattatttccaaagtggaggcaatcctctcaaactctgtccctgctttatgaactatgtttatagaatattctaaatcctttgttgtcatttcagcaatgttcaccaggaatagattctgtctcaagaaatcactgtttgttcctccgtaagaagcaacccctcattcattctagtttaatcacgagattgcagcaattcagtcccatcttcagtctccacttctcattctagttatcttgccatttccactacctctgcagttacttccttccctgaagtcttgaacacctcaaagtcatccatgagggttgaaatcagcttctttccaatttcaattaatgtggatattttgactccttccataaatcacaaatgttcttcatatcatctagaaggataagtcctttctagaaagttttcaacttactttgcccagatgcatcagaggaatcactatctacagcaactagagacttacaaattattcttaaatgatatgatttgtaagtcaaaactactccatggactgatccatggactgcggaatgtatgttgtgttagcaagcacaaaaactttcatctccttgtacatctccataagagctcttaggtgatttgatgcactgtcaatgagcagtaatgtttgaaaggaatttcttttatttttctgagcagtgggtcctaacagtgggtttaaaatactcactaaaccatgctgtaaacagatgtgttatcatccaggctgtgttgttctatttctagagcacagagtggattcaacataattcctaagggccctaggatttggggaatggtaaatgatcactgacctcaacttaaagttaccagctgcattagtccctagtaagacagtcagcctatcctttgaagatttgaaaccaggcattgacttctctctagtatggaaagtcctggatggcatgttcttctaacagaaggctgtttcagctacacttaaaatctattagtttagtgtagtcaccttcatcagtgatcttagttagatcttctggataactttctgcagcttcccatcagcacttgctgcttcacctgacacttttatgtcatacagatggcttctttccttaaacctaatgaatacacctctgctaatgtccagtttttcttctgcagcttctttacttctgtaagccatcatagaattgaagagagttattccttgctctgaaataggctgttgcttaacggaatgttgtagctggtttgatctttctatccataccacgtaaattttattcatgtcagcaataaggctgttttgctttcttattatttgtgtgttcattggagtagcccttttaatttccttcatcaatcctttctttgcagtcacaactgggctatctggcaaacaaagtctagcttttggcctgccttgggtttcaacatgccctcctcactaagcctaatcatttcaggcctttgatttaatatgatagatgtgcagctcttcctttcacttgaacacttagaggccactgtaggattattaattggtgtaatttcaacattgttgggtgtcaaggaatagggaggcccaaggagagggagatggaaggatggctgatcaggggtgcagggagaaaacacacacaacatttgtcaattaagttcaccattttatacgaatgtggttcatggcgtcccaaaacataatagtaacatcatagatcactgatcacaaatcactataacagatattataataataatgaaaaggtttgaaatcgtttaaaaattaacaaaatgtgacagagacaggaaataagcccatgctattcaaaaaatggcactgacagatttgcttgaggcagggttgccaaaaactttcaatgtgcaaaaaacctagcatttacaaagtgcatcaaagcaatgtgcaataaaacaaggtgctcctgtaatagaatgctgggaggggtggtatgatcatttactttggatgtttaaaggttttagtactgatagcttaataggaatatctagttctttcaggcatcaacaagagtaaaagtactgaagtagtatttttctccaactgaatcaatcagtgggatggaatttacctcattttatgttctctttctccttttccattacctgctctctatgcttcacccaacccattctttcatgacctcaagtttacccagcaaaatcttcacatctaccatcacctgtaccagaacttgtatttctctaatttttcagtggactaaatccttcacgttttaccttatatcttgctaaaacacttttgctagctaatcctagtttattctagattcctttattatcatctctcatcatatattctactttctctcttatttcatagcattttttattatttgtaattatttagtcatctgtgtgattttttgttgtttaatttaaggatcccctctttctagaggaaaagccccatgaatggaaaagccccttgaactgtgcctattttgctcactccaggatgagtattatttcttagtattatttctttaaactgaacaactctagtaagattccattcttatatcagaaagtaaaatgactataagatagcatgagacattaattttgtgacaaaagttataaatgtagcattggttctaagagatgaaatccttgctcttctgagggtctgcagagaacaacgaacagagctagacaaatataatttggaggtaagaatgcaaataaaaaactcaaattattaaattatgtatgtaatacatccagttccaaatgcaaaagaaatagtccttgattttcatacactaccatattatcattttatagaaagatttccatgatttattttaaaatgcacaggatattctctctcttacacacacacatgcacactcttttttttttagatggagtctcgttctgtcgtcaggctggagtacagtggcacaatctcggctcacagcaacctctgcctcccgggttcaagcaattctcctgcctcagactcccgagtagctgggattacaggcgcccgccaccacgcccggctaatttttgtagtttcagtagagacagggtttcaccatgttggccaggatggtctagatctcttgaccttgtgatccgcccgcctcggcctcccaaagtgctgggattacaggcatgagccaccgcacccggccatgcacgctcttttgagcacaaacacacacatacacacagatacaaagacacagacattgaacagatataaatatatactatgtcaaataactattgtcaaaattttaccaattttagtgtaccagttttagtttaacccaaaaagctgtcactgtttagaactttgaaataacaaaatgctatttactctaataagttattcctcttccaaatgtggcatagacacaaaagagggagaaaaaggagaaaaagtcctatagggacatactataacataagacaagatgtaccaaccacaaggggaatagagatagaggaaaatatctctatttcagcaaaaacaaatcatttcaccttcaaacaatacgattatgttttaaagaaccagtgaggatcagtttcaaattactattagtgtaaactactcaagtagaatgatctgttgaaatgggattgttctgaattacaacagaaaggccttccacactgcggaaagcagaaggccacccttagttaacttataatccagatactcatttccaaattttaaattaaaagaaaatacaaattttaagcttcttaccatatctgccagagaaatatagaggaacatgcctccagcaagtgcaaatataatatttggagcgaaattgttgcccaccaaaatgccaaaagctagcccaacatagcaggaacatgcagaaaggaagttgaatagcaaggcttgtcgagtgctcatccctgcattgagtaggatcacaaagtctcctagaagaagaagaagaaaatatcaagtgaatagttttttttttatttctggatgatatcaaagataatcatcaatgtccaacaaggtcttcattttagtgcatcagaaggattttaagagcatgtcacctgaaaagtctcattccactgaaatcaagaagtaagcagacttttacaatatgaacagagctccttacctaactcgtggggaaactcctcacataggattgctatggaagtactgagtccctgaaggagagacaaggtgcaggaagccccaatcgccaggccatcgatgaaattgtggagggcatcgcagagcgttatcatccaggcaatcgtccctatttctgacagtttgggccccttcaaacaggtacatgaacttggctctttttttccatcctagcagaaaatcaattaaaatgataaccaacatttcttgaaagtctcagaaatacagacaagttggagatgggttgtgcttgagaaaaacaaattgttccaacagaaagtcttttagagtaactaggaaaccctaataatatataacagagcaaagaaaacttatggttgagagaaaggaaattcatcaactgacacacctcgaataagccactaacagatattttcctttactttccctttaaaacaattcttttgacttgtataaacttcttcctactgcctttctaaaatgtagcagatattaacctaagaaatttatttatacacaagatttaaaatgaaggaagttattcaaagactaaacttaaagtcttttttatgttacaatttaaatgtgaaatccacaactagagcatgatgaatgacatcagcaacatttgttctaacccctcctatgccaccatgtgacagggagcaagttatcacagagttccttcaactgtgaaatgaagacattgtactaaatgattcatttatttatcaacaacttattgagtttccattctgttccaggtaccctgtggagggtttaggctgtaacaatatggtctctaccagctccaaagcttaattattttcttaacaaattgcatgaagtgtaaatggaacaggctagcctttacactaacacttcctttcatgtagaaacaattaaaaaatagaaaatcctgtgatggactctttgtaggaatttagatttccagaaaatttacaaaattgtacaaaatcaaatgacaaatgccaactaaaacactttccagaagttgtagaaaaagataaaatgcaaattcatttttaagtacaaaagcactttgcaattaactggagaacattttattcctaattctcctcctctcacctctacctaagcagctaatcattacatttattgaacttctgaaatttgtaaaacactctgttgaatgctataggaaatacacagaaatggaaaacacagcttctgtcttcaagaagtgtatttacattggagaaacaagtcataatatatatggatacattaaaaaaaaaacatgcaatatatatccaacagagaggggcttacttcagagcaaccatctaagaggttttacagttactccaatatcacttcaccactccaaacactttggggaccaacactttcagaatcagccttagatcctgcaatacatctctttactatttcgttagtggcaaatctgcacctttggatttttgtttgtttgtaggcacagataaaagcatttggagcaaatatttttttaattaatatgaaatgaatgggaaactgttagtaataggattcatcatcattgtcatcaccaatgtggtcgtagtagaaatagtaacagcaaaggcacatagcatttataatgtgctaggcactgttctaagcacttcaaataccgaattcatttggaacaattctatgaggaaagtacaactgttaccatcattttatagttgaggaaattaaagcacaaaaaggttggtaaacttacccagagatacaaaaaaagagtgaatgggcatttttggcaacagtgctttactactacacacatatcggggatgggaattcttctctgtaataggatctgaaggtaattcgcaaggagacttccccacctctcagaaaactcttctgaacgcttgatgcaacattgagtaagtatcaaatcttttttattttaagaaacaaagcttatccgcataaaaaattctatcttttcttaaaatgtgggctttttattttatagctgtatcttaaacgcacaacacaataaacaatcataatttagcacaggtggatcgggtagtttgcataaaaaatgccccagagcgggaagcaattacagctgaaggagaaacaaaggtggtcatagggaaagccacagaggaagtgacctgggctttgtaaaacttaatgccgtgatatacttaatgagattattttgaattaaagcagttgttttcatcttccaatctaatttgtctaattacatgtttaaaatttccttattgtgatgacttcagaagaagactacaaaaccaagtcttgactacctgatatcactacagagtctgtatacaaacacccttaattttacagaagaaattaaattaatatatcaggaatgattctcatacctctaagtacagatattattgactctatttattatgcctcatgctttggtcccaaatgatactgttgagcaggtaagagttatacatttttaatagttttggaacaaaccaaagtcagcaaaccttcacagaaacttcttttttaattcacctagaattaaatcactgagcagagagaacactaaattcaagttcctgtagttaaattagtgaatatgcctatctctctctttcctttttaaatttttgttttctattgttattgttgttcacttgcttgctttcttgtctgagttttactctaaatatgaggctatttctatcctcagccatgatgaggcaattcagcctagtgaaaagacactaagtctggaatctaaaactgagttcaagcttggctgtgagaagaattaccgtgtaatcttcagcaagacttgtaacacctttcacttagttattaatggggatggaagtcaaagcaatgtgtagtgttatcagaatgggggagaaagaatatcatgcaccaaagttaaaaaaatagagggagactatgttgaatcccaacataaattggagggcaaaaaacaaaatttttttcaaaaaaagtacttagaaattaaaatggagaaaacaaatgggcttattgcagaacagtttaaggaaggaggagaaagttgtagaggatgaggaggcctgggggaatagggagcacaaggaaagggagaagtagcatgaggaggaggaggaggaagacaagtataaggaggatgagaaggaggatgaggaagaggatgaagagaaggatgattaggaggaggacaaggtggagcatgtggagaaggaggaaaaggaaaacagggagaacaaggagaaggaaacgagcaagcatgagtaagaggagcaggaagaggactaaaaggaggagaaagataaggacagacaagaaggacacaaaggaggaggtgaagaatatatggaagagtctcttttaataagtacagaatgtgaatctaattctattccactaaatctcataaaaggccatcacagaggatagcttcagtaataaagtgaacaagaaaatctgattgtcactcagtatccttcatcaaccatccaaatgtttgcttaatggacccacatataaagcacagagtggtgcagagggaggatatatataggttcagcattctcttctcctaccagggggaatctggctttccagcactaaagaagtcccaaacttcaaaagccaaggctgatgctgagcccccaaaaagctatcactgtccaacagggcaagaggaccaggtggctgtatgtggtagcagaatgattccactggattcctcccattataaggggatgctcttggactcacaaagatagacatatacaatatatgtcttccctgccttcagtgcctctgcaagcaccatcattcatggacttatagtgcaactgatatatagccaaggtttcctgtgaaaactatctcctaaccattttttagcaaaggaagtgagacagtgggctcaatacatataattcatggatcacatcacctgcaccctctagtagcaaccagtttgacagaatgatgaaatgtcctgatgaagcctcagccagggtgcaagccaagagataacaccctgagaggttggagttctgttcataggttgggcagccaagtatatggtgtcatctctgctgtagagaatgcacaaatccaggaaccaagaggtgagagtaaaaggggtataagtcaggctcaggggctcctgccagtaatcccagcactatgggatgccaagggggaggactgcttgaggccaggtgttcaagaccaacctgaacaacataactagacctcgtctatacaaaaaatatattactttgggaggccgacacaagcagatcacgaggtcaggagatcgagaccatcctggctaacatggtgaaaccccgtctctactaaaaatactaataaaaaaaattagctgggagtggtggtgggcgcctgtagtcccagctactcaggaggctgaggcaggaggatggtgtgaacccgggagacagagcttgcagtgagccgagatcgcagtgagccgagcctgggtgacagagtgagactccatctcagaaaaaaaaaagaaagaaagaaaaaattacccaggtatggtgtcatgagcttatgttcccagctactcgaaaggctgaaggagagttacagtgagctatgattgcgccactgcactccagctgggcgacagagttagaccttgtctctaaataaataaacagataaataaagtaatctatcttatttttatgcctaatacaccacttaaagaattcttactgacaggccagatggccaagtaggaacagctctggtctgtagctcctagccagaccaacgcagaaggtaggtgatttctgtatttccaactgaggtacccagttcatctattcaggatggttagacagtgggtgcagccctctgagggcaagcagaagcagggtgaggacccaggaagtgcaaggagccggggacctccctcctggagccaaaggaggccatgaggagccatgccatgagggacagtgctctccagcccagatactatgcttttcccaaggtctttgcaacctacagaccaggagattccctagggtgcctacacctcaagggccctgggtttcaaccacaaaactgggtggttgtttgggcagacaccaagcgagctacaggagtttttttccataccccagtggtgcctggaacaccagcaagacagaatcattcactcccctggaaagggggctgaagccagggagccaagtggtcttgctcagcgggtcccacctccatggagcctggaaagctaagacccactggcttgaaattctcgctgccagcacagcagtctgaagtcaacctggggcactcgagcttggtgtggggaggggcatctgccattactgaggcttgagtaggcagttttcccttcataatgtaaacaaagcctccaggaagttcaaactgagcggagcccaccacagctcggcaaagccactgtagccagactgcctctctagattcctcctctctgggcaaggcatctctggcagaaaggcagccgccccagtgagaagcttatagataaaactcccatctccctgggtcagtgcacccacgggaaggggtagctgtgggcgcagcttccgccgacttaaacgttactgcctgccagctctgaaaagagcagcagatctcccagcatagtgctcgagctctgctaagggacagactgcctcctcaagtgggtccctgacccctgtgcctcctgactgggagacacctcccagcagggctcaacagacacttcatacagaagggctccaactggcatctgatgggtgcccatctgggacgaagcttccagaggaaggagcagacagcaatctttgctgttctacagccaatgctggtgatacccaggcaaacaggggatggagtggacccccagcaaactccagaagacctgcagaagaggggtctgactgttagaaggaaaaccaacaaacagaaagcaatagcatcaacatcaacaaaaagaacggccactcaaaaactccatctgaaggtcaccaacagcaaagaccaaaggtagataaagtcaccaagatgagggaaaaccagcacaaaaaggctaaaaattccaaaaaccagaatgcttcttctcctccaaaggatcacaactcctcaccagcaagggaacaaaatcagacggagaataagtttgacaaattgacagaagtaggcttcagaaggtgggtaaaaacaaactcctctgagctaaaagagcatgttctaactcaatgtaaggaacctaagaaccttgaaaaaaaagttagaggaattgctaactagaatagtcagtttagagaagaacataaatgatctgataaagtcgaaaaacacagcacaagaacttcgtgaagcatacacaagtatcagtagccaaatctatgaagcagaagaaagtatatcagaaattgaagatcaacttaataaaataaagcatgaagacaagattagagaaaaaacaatgaagaggaacaagcaaagaatccaagaaatatgggactatgtgaaaagaccaaacctacgtttgattggtgtacctgaaagtgatggggagaatggaaccaagttggaaaacacacttcaggatattatccaggagaacttcctcaacctagcaagataggccaaaattcaaattcaggaaatacagagaacaccactaagatactccttgagaagagcaactccaagacacataatcatcagattcaccaaggttggaatgcaggaaaaaatgttaagtgcagccagagggaaaggtcatgttacctaaaaagggaagcccatcagactaacagcggctctctctacagaaactctacaagccagaagagagtatgggccaatattcaacattcttaaataaaagaattttcaacccagaatttcatattcagccaaactaagcttgataaatgaaggagaaacaaaatcctttacagacaatcaaatgctgagggattttgtcaccaccaggcctgccttacaagagctctgaaggaagcagtaaatatggaaaggaacaaccagtaccagccatggcaaaaacaaagcaaaatgtaaagaccattgacactatgaagaaactgcatcaactaatgggcaaaataaacagctagcatcataatgacaggatcaaattcacacataacaatattaagcttatatgtaaatgggttaaatggcccaattaaaaggcacagactggcaaattggataaagagtcaagaccgatcagtgtgctgtattcaggagacccatctcatgtaagaagacacacataggctcaaaataaagggatggaggaatatttaccaagcaaatggaaagcaaaaaaaacaaaaacaaaaacaaaaacaaaacaaaaaagcaggggttgcaatcctagtctctgataaaacagactttaaaccaacaaagatcaaaaaagacaaaaaagggcattacataatggtaaagggatcaatgcagcaagaagagctaactatactaaatatatatatgcacccaatacaggagcacccagattcataaagcaagttcttagagacctataaagagacttagactcccacacaataatagtgggagaatttaccaccccactttcaatattagagaaatcaatgagacagaaaattaacaaggatattcaggacttgaactcagctctggaccaagctgacctaatagatatctacagaactctccacccccaaatcaacagaatatacattcttctcagcaccacatagcacttattctaaaagagaccacataattggaagtaaaacactcctcagcaaatgcagaagaacggaaatcataacaaacagtctctcagaccatagtgcaatcaaattagaactcaggattaagaaactcactcaaaaccacacaactacatggaaacggaacaaactgctcctgaatgactactgggtaaataacgaaattaaggcagaaagaaataagttctttgaaaccaatgagaacaaagacacaacgtaccagaatctccaggacacagctaaagcagtgtttagagggaaacttatagcattaaatatccacaggagaaagtggaaaagatctaaaattgacaccctaatatcacaattaaaagaactagagaagcaagagcaaacaaattcaaaagccagctgaaggcaagaaataactaagatcagagcagaactgaaggagattgagacatgaaaaacccttcaaaaaatcaatgaatccaggagctggttttttgaaaagattagcaaaataggtagactgctagccagactaataaagaagaaaagagagaagaatcaaatagacacaataaaaaaaatggtaaaggggagatcaccactgatccacaggaatacaaactaccatcagagaatactgtaaacacttctacgcaaataaactagaaaatctacaagaaatggataaattcctggacacatacagcatcccaagactaaaccaggaagaagtcgaaaccctgaaaaggccaataacaagtcctgaaattgaagcagtaattaatagtcttaacaaccaaaaaaagcccaggactagagagattcacagtcgaattctaccagatgtacaaagagaagctggtaccattccttctgaaactattccaaacaatagaaaaagagggactcttccctagctcattttatgaggccagcatcatcctgataccaaaaccaggtagagacaaaacaaaaaaagaaaatttcagcctaatatccctgatgaacatcgacgcaaaaatcctcaataaaatactggtataccaaatccagtagcacattaaaaagcttatccaatatgatcaagtaggcttcatccctgggatgcgaggatggttcaacatatgcaaaccaataaacacaatccgtcacataaacagaaccaatgacaaaaaacacatgattatctcgatagatgcagaaaaggccttcaataaaattcaacaccctttcaagctaaaaacactcaataaactaggtattgatggaacatatctcacaataataagaactatttatgacaaacccacagcccacttcatagtcaatgggcaaaagctggaagcagtccctttgaaaaccagcacaagacaaggatgccctctctcaccactcctattcaacatagtattggaagttctggccagggcaatcaggcaagagaaagaaataaggggtattcaaataggaaaagaggtagtcaaattatctctgtttgcagatgacatgattatatatttagaaaaccccatcatctcagccccaaaactccttaagctgctaagcaacttcagcaaagtctcaagatataaaatcaatgtgctaaaatcacaagcattcctatacaccaataacagacaaacagaaagccaaatcatgagcaaactttcattcacaattgctaccaagagaataaaatacctaggaatacaacttacaagggatgtgaaggacctcttcaaggagaactacaaaccactgctcaacaaaataagagaggacgcaaacaaatgaaaaacattccatgctcatggataaaaagaatcaatatcatgaaaatggccatacagtccaaatttatagattcaatgctatttccaacaagctaccattgactttcttcaaagaattagaaaaaaactactttaaatttcttatagaaccaaaaaagagcctgtatagccaagacaagcctaagcaaaaagaacaaagttggaggcatcacgctacctgacttcaaactatcctacaaggctacagtaaccaagacagcatagtactggtaccaaaacagatatatagaccaatagaatagaacagaggcctcagaaataacaccacacatctacagccatctgatcttcaacaaacctgacaaaaacaagcaatggggaaagaattccctatttaataaatggttttgggaaaactggctagccatatgcagaaaactgaaactggaccccttccttacactttatacaaaaattaactcaagatggattgaagatttaaatgtaagacctaaaaccctagaaaccctagaaggaaacctaggcaataccattcaagacataggtatgggcaaagacttcatgactaaaacacaaaaagcaatggcaacaaaagccaaaattgacaaatgggatctaattaaactaaagagcttctgcacagcaaaagaaactatcatcagagtgaacaggcaacctacagaatgggagaaaatttttgcaatcttatccatctgacaaagggctaatatccagaatctacaaggaacttaaacaaatttagaagaaaaaaacaaacagccccatcaaaaagtgggtgaagaatatgaacagacacttttcaaaagaagacatttatgtggccaacaaacatatgaaaaaaggctcatcatccactgatcattagcgaaatgcaaatcaaaaccacaataagataccatctcatgccagttagaatgtcgatcactaaaatgtcaggaaacaacagatgctggcaaggctgtggagaaataggaacacttttacactgttggtgggagtataaattagttcaaccattgtggaagacagtgtagcaattcctcaaggatctagaaccagaaatgccatttgacccagcaatcctattactgggtatatacccaaaggattataaatcattctactataaagacacatgcacatgtatgtttactgctgcactatttacaatagcaaagacttggaaccaacccaaatgcccatcaatgatagaatggataaagaaaatgtggcatgtatacaccacggaatactatgcagacataaaaaaggatgagttcatgtcctttgcagggacatggatcaagctggaaaccatcattctcattctcagcaaattaacacaggaacagaaaaccaaacaccgcatgttctcactcataagtgagagttgaacaatgagaacttacgggcacagggagggaaacatcacacactggggcctgttagtggggtggggggcaaggggagggatagcattaggagaaataactaatgtagatgacgggttgatggatgcagcaaatcaccatggcacatgtatacctatataacaaacctacacgttctgcacatgtatcccaaaactttaagtataataataaaaaaaaaaagaattcttgcctcctgtccccgaaaccttggacttgatgagtttgatggccctactgtccaaggcagtaattcttataccaggaaacatggtcattttctgattcactggaagtagagactaactcctggcaatttaaatttatttatggccctgaaccaacagagatgagaaagtcactataactagctagggtaatcacacctaatgatcagggggaattgattttctgctacagaatgaagacaaggacagtgcttaaaactcagggaattcagtgggatgcctcttagtactcccttcccgatagtcctggtcaagggaaaatagcaacgatcccccaataaaaacaagactaccaagcactcagatcttaaagaaatgaagatttcaattgccctaactggaaaatgactcatccagtcaaggtgatgtcagacagtaaggtaaatacagaaggtattgtcgatgggggggccctataatgagcagtttaggcctcatgaccagctccagaagtgagctgcagctataattaatgttccttaattgcatcctcttctcccaatattttatatgaagagtgttgctggggaccaatattttagtcaggttgcagtattagtaaaagacatcatgggaatgatatggtagttgatgggattttgtgcataccctgtgttaggaacatgcatttgtcaaccacatggaggacaagattggaggttgatagagagaaaagtggtagagtattcaaggtatctttcatttctccctccagatccgctttccgctcttctttccccataagacctgcaggcactctatcaaaggccctcatgtccaggtgctcagcaggttccagacagtgagctctaacaaaattggagggaaggaggagtggggatcgggatatttattcccttggctccctccttgaaggttaacttaggctggctatgtccacaactaaagatcactgttccacgtacagtagctttctacacaaaactagctcctttcaagttctagagaaccttttttcttcccttttccctttggtcataggttgttgacagctccactgttactagcctcaggttactgccctgtggttcacctacactgtgctcagagttttacaaagtgtctctcccctatttattatttatccttatttgagtaggccatctctctctggaaaggatttgacatatccaaagtctaatgctcattccacaacacaatactatgaactatatatactgttaaataagttttcatgaaaaaagtaacaaaaggattacatagacatgaatatattaaaaagagttaaacgcattctgtaaacataaagttttgataggctttgctttcattactaggttttccagtgataaatgtttgtattttatagctggtgattacttggtccttctccttacctgaaaagtcagctaactaccaaaatgaagcttcacatgagaaaagagaaattatttatcctttaatgcatgtaaccaaatataattcaaatgcacttaccttccagtcattcagtttcaggtaaagctcaaaactatttccaaaactctctttgctaattaaaataaccattaacaagaaaataacaatttctagaaacctcgcaagttgtttcctgtctctccaatcctgtggaatgtgagtaaagttgttttggtctttagtagtttaattaataatcagttattttcagtttgggaccatagcatttttactgccttgaaaagaacaatttaggagaaacctgagaggttttcaagaaatctgctactttgccaatggaatctaaagtaaataatagttaaatatttatggttatcctaatggactatttataccactctaaaaggctgcttactgttgctacagatgaggatggcattaatgcactggtacattcaggacacaggatatcatttcttataaaaagcccataaaatgtacctccccgcctacacaactctcattcttactgcaacatcttaaagggattcaggaggcaccaggaaattgtttaaatttcaatgtaagttggagaaatcagttgctaggatccttaaaagtagtgtttccaaaatataggaatatctacactgatcagcctcaaggctttcagaataattcatatgagaaaacaggggtaggatgggatgccgtggagaaaccaaccccgtgcagcagctgcctgtcatgtcttaacatttgacatgaattacatcaagaactgaaatattcaagatcccactcaatatactccatgtgactcacctgcaaaaaaagagagactgctttctgtggcagagaagatctagaaacacacggtcaaggagcttagggaaagtggtaagaggcaaagaaatagatgagaagagagattagagccagtggtaactgcaaccaccatgacagaacaggcacttaggaccaagtgggggtgataaggaataggcaaggtgccaacagagagacaaatataaagctattctctgcaaggggcaactggcaccctggtttatatttcaatagttcagaaaaacagaggctgtctctactctgtacatggagcgtgagaagtaggagccacacaagataagggtaccaggaccacattccctctgaaagctgtcactgtgccactctaaagatgtgctgacccgtttaagaaaagaagaatcgggcatgaaatatacagaatacaccactggagcacagagcagtagtgataataatatttatagtaataacagagcctcctgccgcattctcactatgctcctggtactgtcctacgcattttacatataccatcgtttaatcttcacaactgccctatatagatattatccccattttacaaatgagggaactgaggtatagaaaggttaggtaaattaaccaaagtcatacctctagaaatgtgcagaaacaggatttgagcctccatgccaaagaagctaagcctgtgatccccaggagatacaggattttattttctgtgttgttggttcctgttcacccagaatgtagtagcactgtaggcactcagtgagtgtttgttgactaaataaatgtgtagtaatattaaaagtacatcttctctcatgacatgttcacaaatcattgtcccatgaagcatgtattccagtctttccaaagagcaaacacatggacatttatgcacaacatggaaaggatgtgcataaaaaaagttcattaatcaattccaaattggttcaccaatataacataaaattcagtgcagagatgcttttgttgtttgtttgccaattcttagctactgagagttgaagaactggattaaaatctcctggcaggacaagatgtttttttcctttttggccgagaatttagcgtttaatgggtgttcaataaatattatttttaattaaatggtgggggggggtgctgaattaagtagagaaatgaaatatcaaaatacatttcagtcaatggatctcagaggcttcctcctctattctagtgatcaaggcagttttttgtttgtttgtttgtttgttttgagacggagtcccactctgtcgtccaggctggaaggcagtgacgcaatcttggctcactgcaatttctgcctccccggttcaagcgattctcttgcctcagcctcccaagtagctgggactacaggtgcgtgccaccatgcctggctaattttttgtatttttagtagagacagggtttcaccgtgttagccgggatggtctcgatctcttgacctcatgatccacctgcctcagcctcccaaagtgctgggattacaggcgtgagccaccacacccagccctcaaggcagaagacttttattggcaaccatcttgcatctaactttgtggacttacatattttttcagaagatggtttggaaagggagggcataaaagtaagaatattagcaatgaaagcagataacctgttaaagatttattgtttgcaagatgcttttctaaatgcctgtgataagtacatcatcctgattacagaggaaataaatgaggacactggaagaagggacttgcccaaaacgacacagctagaaaatgggaaagtcaggatttgtgcccagactatttgactcctaagcctatgcaataagaggtcaagatactgctcaagagaattgagtttttcagatgaggaatttctgaattaagtagcttgttgctataaggtaagaaattattattttattgctgtttgccagtctccatcctggaaggtggagtacctccaggattcaagtacctctggttttgagtagaagacactgaactaatgtgctgaggtgttctgaggattgctaacacttcacacacaattaaaataatacttccaattgttgaggagaaaaaaaacaccatcctagagctttcaaatccactacatataatctactgtttacagattgcaaaaactgattgcaaaagacagttgttttcctgactgacccgttcttagtttataacatttaataaaatgtaattttggagccaatgtcttgtattattaacactgtttaagtgttagaacacaggaatgcttactttgaagaagaatttctatctagaatgttttccaatgtcattttatacaagcatccactgtgcctacctactctgttcatctttctgttcctaaaacccactgaactgtttcctaccatagagatttctcactggctgtttcctcagccataatattattctctcggatattcacatggatggttccttcttacaattctgattttaacttaaatgtgttctccttgaggaagtcatccctgaccacccacactaacatagtgacccagacatcatcatatcacattttaattccctgcaggacattttaaaatttatttttgtattttatgtgtataaatgtatggggtacaactataattttgttacatgtatagattgagtagtggtgatgtcagggtatccatcacccaaataaagtatattgtacccattaagtaatatcttatcatgcaccctcttccctcctgctcacccttctgaatctccattgtctatcattccatattctatgtccacatgtacacattagttagctcctacttataagtgcctgcatggcatttgtaactctatgatgttgggctgtgtgtcccactagaatgaaccagaatggcagagcgcatgaacattttctgtctagtttgtcatggaatttctaaggtgtagagcagagcttggcacttggcaggtgatcactgaatagatgagaagaaaataaatgatgaaatgaatgactgaataccatcttcctacgctttaatatagcatcactgatttaatgtatggaccaggatatcattcagaatataaaatgttgtcacaaaagtagcctgatatatcacagaggcccagtttaagattgccattattgttttaatataaaagttacatgattctgggattttgatcaaagtcacaaacactataaaaattacaaaaaaaatacagactatttttgcaaaagtgatgtttgtccagaaaagaatgtttgagattctactttctaaatggaaataatctctagatttgggtgtttgtttgcaacccaggaaactataatgatggctgatccctcacttattttttccaatatatattttgtaacctggtaatagaggaggatacactagaaagcataagaccagaggccggaatgtcttatggaaccctccaatgtaatctctattggtgtttcctctgctgctaaacgtttctgacttttatccactttcactaagttggtataaaggttcgataaagtcatgttcattaagcactttgatattcctaagtagaaagagattcagtaaaataaagtctgttcttttattttacttttaatgttctgatacctgataacaaataaaaagtaataataccttaatcacttcgaaaaagaattaggctcacacattggtctctctttctacttattaggattcaaaacttctataataatacttctaaataaattgagccaataattagcatggagagcaaagttaaaggcaggagaatgtcaccacttaatttaaataaatgaagagttattaattgaattgagagccttagaatgggactgaaattctctatctaagaagcagacatatagtagaatcaaatttcactacctaatcaatgccctaactctaacccttaatacttttattaagagtcagcacttaaattgttcttcaaatatcttcaattctttttttattcactaagattattagtgaagtattaatagttataaaagtgaaatttgttatctggaaatttacctcagacacaaaactgaatagatatgattgtagagacaaataaatattatagatgagggtgtgtgtgtgtgtgtgtgcatgtgtgtatgtgtgcatgagccagtctgctaattactatataatatagtaatgtcaacctcaaaaagcagtttggcaagaccacacttcatttacaggatgcattagctttggtatctttttgatttagaatccttactttgaatatatagaataaataaaatggaataataaaatgtagagtaaattctgcctctgcaagtgcttcttcaagggagatggatttcatttattacaataaaacaccttatggtttggcaaatctttcatcatgcaatccactgagtaaaagttactcaccaggtcttgattcagtattcccaaactgcagaatgcagcatgcaaagaatagagcacaatataaatatttttaaataagcaaatagcagaagccaaagaaaacaaagtggtctattttagtcatccaacaattatgaaatggacatcctttataaggcaatcttttaaaaagctgatgttaaagactgaccagcaatagaataagtatttaaatattccattgcttcccctggtttgccactgggctttccacacagtagaataagcaattctttctgatgagcagaataatttacttgaacctcatatattattggttcatttttcaagagaaaaatgtattggcattcattattaactttttttatcaatcagcatgcatgacagaacaacacagcaattcttcattacactaatggaggaaaaattaacttgacatcaagcctaattgactaaaacctcactaattcttctaaatagggataagtcctgcttgattagtgaaagcaatttagtatagaacatgtttagatagatgcacttttattgctttccagaacttaacactaacaaactgggctctccagcatcaaaggcgagataacggtagaggttcttcacaaaacctgccacagtgtatggataagactaacacaacatatcaaacacataataacaacttggaatttctctagataattgagaagctttaggtgcaatcttgccaaaaaaattgtttcaaaagaaatttttacagatgctgccaaaatactctatagccaagcccatagcaaaataaaacaaatcataaattatcagctatgacagactggtaatcaaaactaacaaggtttcactatgcgggcaatcctcaactcactacaagttgttttacaaaagttcatttgtaagctaattgttagaaatcataacttattacagcaatattctcattaggaaattagtatcatgtatatggagcaaacatgagcttgggatgcaagaccccagaaggggacctcagcatagttttgctgtttattatctgtgtgaacttgagggagtcactgtacttaactggatcttaatttatgcagctgtaagttgacttaataccaagttcatagtgctattgtaggaatttaatataataatagctaaaaagctaccccagtgccctctactcttacccatagccatttatgttcctttttcaagtatttctctatatcagagagtattggctggcaggtcatagaggagcatcagtgagttcatgaacccctttaaattgtatgcaaaatttggtaggtctgttgcaacaggtaatgggcttcatcaagcggctgtctaagggaatgattaaaaaccattgttctatagccactttcttgaatgtttcaaaattagaaaatgacaaatgtttaaaaacaatgactggaagcactctctgcacttaagttgctgttctgcccaactgtattatcccagtaaagtcttacatatctgtcaagatggatacaagcatgattttctcagaagagcatccttgaccatttcgctttcatcatgttccatcccaatatgcgccactccatttgcatcacgtcccaccccaaaacacaccacgtctctctcaacatagtaacttgcatatgcctctactctagtactcatcacactacacaataactattttttatgtcagtaagttctagttttatatgctcaaaaatttctagtcaaataaatatgaattttttcacaaaaataaatgtatacttagattttatttaaagtagccattttaatcgatgagaagcatacaaatcaggaagtaattttgcttttttaaaagaactctgagtgtaacaaatctaagttcaaatcgttactctgatgttaaacctccctgaaattcagctttcctatctgtacaatcaagataattacacctaaatgaatgttgcatatgaataatatttacaaagtatgggtatatttcttgcacgtgacaggtaccaccagcatcacaccaccaactaccaccattattatttctattagttattcaggagtgacaggtacaggcatacctctttttcctgcacttcactttattgtgcttctcagatattgtgatttttacaaattgaaggtttgttgcaaccctgcattgagcaagtctatcagcaccatttttctatcagcatgtgctcatttcatgcctctgtgccacattttggcaattctcacaatatttcaaactttttcattattattatatctattatggtgatctgtaatcagtgattttgatgttactattgtcattgttttgggacaccatgactgtgcccccataagatggcagacttaaccaattaatgttgtatgtgttctgactgctccggtgaccagccattcccccaatttcctcccttctgtagggcctctctattccctgagacacaagagaattgaaattatgctaactaataatcctaaaatggcctctatgtgatcaggtaaaaggagaattgcatgtctctcacttaaaatcaaaagatagaaatgattaaacttagtgaggaaaacatgtcaaaagccaagatagaccaaatctaggttttgtgtgccaaacagccaagctgtgaatgcaaaggagaacttcttgaaggaaattaaaagtgctactccaatgaacacacaaatgataggaaagcaaagcagcattattgctgacatgagtaaaatttgagtggtttggatagaagatcaaaccacccacaacataccctaaagtaggagcaagcccctcttttcaattctatgaaggctgagagaggtgacaaagctgaagaagaaaggttggaaggtagcagaattggttcattgggtttaagaaaagaagccatctctatgacatagaagtgccaagtgaagtagcaagttctgatggagaagttatccaggagatctaactaaaatcattgatgaaggtggcacactaaacaccaaattttcaatgttggtaaaacagccttctgttggaagaagatgccatccagggctttcatagctaaagagaagaagtcagtgcctggtttcaaagcttcaaaggacaggctgactctcttgtttggggttaatgcagctggtaactttaagttgagaccaatgatcatttaccattccaaaacttctagggcccttaataattgtgctaaatttactctgtctgtgctctagaaatgaaacaacacagcctggatggtaacacatctgtttacagcatggtttactgaatattttcagtccactgttgggacctacagctcagaaaaataaaagaaattcctttcaaaatattactgcttattgacagtgcatctagtcacctaagagctcttacggggatgtacaaggagatgaatgtcgttttcatgcctgccaacataacatccctcctgaagtccatgggtcaaggagtagttttgacttacaagtcatattatttaagaaatacattgtgtaagactgtagctgccatagtagtgattcctataatgaatctcagcaaaggaagttgaaaaccttctagaaaggattcatcaatctagatgccattaagaacatttatgattcatgggaggaggtcaaaatatccacatttacaggagttgggaagaagttgattccaaccttcatggataactttgaggtgttcaagaatccagtaaaggaagtcacggtaggtgtacgggaaatagcaagagaattacaatgagaagttaagcttgaagatggaagtgaattgctgcaatctcatgatcaaacttgaataaatgagcagttgcttctcatgaatgagcaaacaaagtggtttcttgaaacagaatctactgctggtatagatgctgtgaacaacgttgaaatgacaacaaaggatttagaatacttcataaatgtagttgacaaagcagtggtagaggttcagaggatggcatccaatgtggaaagaagttctactgtgggtaaaatgctgtcaaacagcatgttctcgcatgtacagagaaatctttcatgaaagaagcaatcgatgttgcaaacttcattgttttaaaatacttccacagtcactccaaacttcagcaaccaccaccctggtcagcagccgtcaacatcagaggcacggccctccacttacaaaaacattagaacttgctgaaagcttggatgatcagtagcactttttagcaataaggtatttttaaattaagatatcaatgtcattgtttagacataatgacagtgcacacttaatagactatagtgtagtgaaaacatatcttttatattcactgggaaaccagaaatcatgtgacctgctttattgtgatatttactttattgcagtggtctggaaccaaattcatctgattttgacaccgactatggttcagagaatatctgagcagggacagccttccaggaggtaaagaacataatgatgtttctggaacttcatacaaagaagcagactactttcatgtgatcacctggctcccagtgcactccagagtttcaaggcatactgttctccttgtctacaacagtgtgtgattctaactagatgggccaccactctgtatctcacagctgtgtagtacatggttgagtttgtaggtgtgaagaaggtaaacgtcaacaatttggcccctgaaaatgaggacactggctcagggctgaggattctgactttctactcagcaatgtattatcatcgctagtcaacgtgaaccacattaagagagagcctattaaaagcctttcccacttttccccaaccccacagtccttcattactacttcccacctgcctgaaattgagaacatctaactcacaatccacccacaaacactttctccaccttccatcccatcttagaataagaacccttttccttttcattgtgaacagctccacttgtactctattttcattttttctctagaaatgtgctccataagatatccctaccatgacttccattctcttttgaacgttcaacctctccctgtctgcctggcctttcctctctgtcttaaatctaacacaatcccaaatcctgatactccactgaactgctcttctccctcatttttttttcacttcaatgacaaactccttaaaatagtttacttttctagtcttttcctatatctctttaccagatccagcctttcctcttctttcagctacttgcagcaaaataatgttccccagagtagctacatgtaactttagaagcattgaaaatgtatgcattctttgccaaagccttttctaaaccaaggaatgagttattcagcacacacacacacaccacacagcaacacgtcctaaatacactttggacctctcaccttacccacagagtttctgctgtccatggcagatcttcccaatctcctctttcttgaaaattattccaaaatgttctctccctaccccacaccagttctctatcttcagataaacatactatggaagatgatctattattctcattcgtctgagccagggcaatgcaaacaaagacacaccttctcaaagaaggtccaatatactagggtccacaggggttcctgtattcacagctaaaaatataccaccactccattccactctggcccctggtcattttcttctgtttcttctgttttttctttgttatgcccctaaggatgggatggcctagcacatgggactttgtccatcaagctctcttctaatgaacctgacaccaggaaatgtgttctcaggaagaagcaaagcatcaaaattcaatccatcaacagacaaatggacaaagaaaatgtggtatcaacacacaagagaatactatgcagcctttaaaaagaaggaaatcctgtcatttccttctttttaaaggctgcatattttaaaacctgggaggatactaagccaggcacagaaataaatactgcatgatttcattttcacatggaatctaaaaaagttgagctcataaaaacaaagtagaatgtttgataccagaggcctggggactgggaggaggagagatgttggtcaaaagggacagagttatacttagaaaggaaaaataagatttagagctctattacacagcatagtgaccatagttaatgatagcataatgtatagttcaaaactgcttttaaaaaagtagactttacatgctttcacaacaaaacaaatgaaaaataggtgaagtgatgaatatgttaataagtttaatttcatctttctacaatgtgtacatatattaaaacataacattataccctataaatatatgcaattattatttgtcaatttaattaattaacttctaaaaattcaatccaactgcctttatagcctttgctcaaacttgctatttgattttgttctctgcaaactgccatggaggccctgttctcttagtctattctggaagccctcatatatatcactcttggctataaattgctcttacatgaactaatccatctacttttgaatcttcaaaatgatccccattatgtcttcaagaaaccccactgcataaaatgctttcctccttccagttgataagtgcttataaatctggcatatgattcgatgactttgaaccaagtctcctactctttcaacagttgctcaatattccgtcattgaaatagaggactttgtggctttgcatctatacataatgttagatgctgtttctcttacttaatccccatcaccctcacttctcaggagcatgatggtgatgtatggttgtatggtagacacagaaataataagatttagtatttaatgcatacctactcttagtcataactttaaaaatatttcatttaatcctcataataatcctgccttgtagatattattgccagtttacagatgaagaaagtgagttttagaagttgaagaaacccgattagttatcagagtcagatttaaactcaaatctacctgactcaagtacttttgacaaagataagttgcactaatgttcatgttactaattaacacctaatgaacaatgtataattcaaaaatgacacaaattttgtgagaaaatataattattcactcatttaatttttcactctgctttaagcctccctaattctaaaagtagaaaaatcagccaagtacagattacctatatttagctgtaatatagaaaaagaaaaaagttgcaatgaaattcaacactgagaaaaatgtttcttaatctaattaaggctatttaaaagaaaaagaaaactaaagaaagcaacctactgagcttagaagcattcctattaaagttggaaacaagacaaattaccaactatcaccacttctactcaacattgtcctacgagcccttgccaataaaacaagagaaataagagttaaaacaattagaaaacaaattaaaaagggcttctttgctcttcaatatggatgcagaaagtccaaaagaataaacaaacaaaacaatactgggagaattcagcactactgcaggacgcaaaaccagtgtactaaaatcagtgtactcttacatagcagtaataatcaactagaaaacagtaggaaaaaagttatcatttgtgatacctgtggagctacaaagtaattaggaagaaatctaacagaatattttaaaaatatttctaatatagtaaattaccaaaccaaaaaatcttaaatatcataaaaatgtaagctgcagcctagttaatctctaaattcaatgcaatgtcaatgaaaatctccacaatgatattgatatggaaaaacaaagacaacttttagtgaaaaaacaaggtgaggagcagaccttgtctttatagctgactaaaaactataataattatggcagtgtggtggtaggtcagagttttgttttttttttccaaatagacaagtgaaagagactagaaagccaaaatacagatacattaatacatacaaacttgatacacggcaggaataaaatgatctgttcagcaaaagaagcgaggataactgcttatttatacaggaaaaaactggatcctcatatacaaaaataaattaaacttaaaatttttgaaagaaaatatggaaggaaatcttagtgaaaagagaaaccacagatttggagaatacatttataaatcatttaatcaaggaaaattaacatccagaatatatgtaaaactcctacaaatgacagactctttcttagaccaaatttcagttaggctcctctgaggtctcttctcaaccagaccttcgacttctgtgtccatttttgcagaattcagtcatagcaagaatcctgccaagtcagtttagcaagaatcccctcatcctttatatatgatcactcttaatatctgatcaaattcctcattccctctgactcagggaaaaatcaaataattatttttaaaaaattcttcattctccaccatccccaaagtgatatataatcaccctggcctgccttcagcaagaattccattaaattggtttagtaggaatccccctacccttgatgttttctcttaagaatattccatgcattcttcccctctctctgctaattggctataaatgccaacctgtctttactttatttagagttgaacccaatctctctccgctgttgccatagaagcaacccttattgcaacagtcttgaatacactcttccttactgttttaacaagtgtcagaatagttttttctttaacacaaatcattaagaaaaaaaaactcaactaaaaatgtgcaaaacagatgaataggaaacataaaagtaaacttatgaccaaaacgcatatgaaaagatgctcaactgcactataatcagaaagacaaatcagaaaaagataccacttcagacttattaaattggcaataatctttttaagtctgaaatttccaagtattgctaaagacaaagagaaaacaggaattattttttgctgttcatgagaaggtaaacaaacataagaggctggaaagcattttgttgttattcagcaaaattaaatgtgtgcatactccatgacccatttttacacatctatttattagataataatatatatgtatatgatacatattaatatataatataaaactttatatatgtgtttatatgtgtatatatgtaaatatatatattatatatatgtatataaaaaactattcacagagggaaaagaaaaacctaaaagtctacagattatctccagaactcaaaacttcataacattggaattgtgtttgcatggacctgaaagcacattccaaaggattaaaattataaactccacaaaaatgctgactatttaaatgtttatcacacaattaatgagaatgttatcttttcatatggatatcaaagtagtccatgactgacacccataagaaactgactgttctccaaacagagtaaatagtacagatttttgtacctttaaaagcacattcatacctaatcttatttgattatactagctgacctaagagttggcaatatcaacattttgtttgtttgtttaagatagggtctcactgttgcccaggctggtcttcaactcctggactctggtcttcagctcctggactcaagtgatccacctgccttggcctctcaaagtgctggaattacaggcatgagccaacagtgcctggcccaatgtttgttttattttttaatgaactttctgtgtaaatgttgatgccaccagcctccacaagaatggaatatactagctggccaaatgattagctaacataaggaaccagaacagataaccctagatccctcctgacattagctatcaaataaaatgcttttgtcaaatttacataacttggacaagcttttatctggggaaaagcaagtagttcttaatgtagtgttttccttccttggcaagtggctctagctggtatttcaaggctctaacagagaatcggtggtgcaaagcctgataaatcgtcatttgaatagcaaattatattggactttaagattctcttccattaagagagagtaaatgttccaaattctcttaatttatctgacaggtcaaaggcaggcttgtgggcatttatattcagaaggttgtctttattactaaattacctatgagcttttaaagtccagctttactttctagaaaatctactcaaattttaaggtagataagaaaaatgagaaagaatggaattctgtatattttaccttctcattttgttaccctaacctagaaggaacatatacaaatagattcaaacagctatgtggtttattacaagaagtcatctttttaagtgatgatctttacataattaagcatatggatttagaagctattcccaaaggtgcaaaagatgaagtgatgcgacttgatgactatgataaaaactaagaaaagacaaaaatggtaaatggaagagggagggagatgtatatttatcacaagtgtacaatgtattagacacaatgttgcatagttgacccataagaaattatttcactttcacaaaaatcagtaaattaagaatctttgctcctcatttaacagatgagcaaaggctcaaaggtgttaattattttttcccaaatcaaacaacatattttaatcctaagatgcaaacaatggcctgtgtaattccaaagcctatgcttctcttccacatccaactgccttgcaagaaaaggagactcagaagaagcaccaggaaagtattacagcagctaaaatggtgacagagcaaggatggtatcatgttaccaagaccacctcataagtaactcaacagggaggggaggggctccagcgaaaaacctgcctttatatttctagcatttagcccacaataggtactcacttacgtgttaaactataggaatggctcaggaagaaagagtgaatgaggattaggaacatagcttgtggcccacgcctgtagtcctaattactctgaaggcggagtgggagcattgcttgagcccaggtgtctgaggttacaatgaccctgtctcaaaaaaaatgaataatttaatttaattttaaaaagaggaatatcacatgctgcctagaacaaccacttacattattctaaaaatgttcagagaataggtagtgagtttagaaactgtacatgattaagcatgtacggagatgatgaggaaggctggttaacaaatggaaacaataggcagcgtagtgtaaggtaagttaaccaaacagaccaggaaacaggattcctgcacttcaatcctaatgtggtacctgtgtgaccttgggtaagttccttaccttctctgtacatcagtttccaaatctgcaagatggaaataataatcgtacttgcctcacagggttgttactgtgaagattaaacgagttaatatatgtaaagcatttaagaatatgtctaacatatatagtcttatttcagaattagccaatctttagaaaagttggacagttgtgggaaagaaggtttgagaaaacttgggagtagcagattgaggaaaaaaataacaccttgaggtagaaaagatggaacttgtttgtagacacgggaaaaggagagattcaggaaagataaatgaaaacaggccagatgtggtggctcacacctgtaatcccaatactttgggaggctaaggcagtaagatcacttgagacctggagttcaagatcagcctgggcaacatagcaagaccccatttctacacaaaaaaaatttagttagccaggcatggtggcatgtgcctgcagtctcagctacttgggaggctgaggtgggaggatcccttgaggctaaggagtttgagatttcagtgagctctgattaagccctgcactccagcctgggttatggagtgagaccctgtcctaaaacaacaaaacaaaacaaaactggaagaggccacaggaaagatgagaatatttagaggaactggccttaaaaaggagaaaggacaccagttctggcacaaaggggacagtggagagaagatgaggacccagagtagtttttttaagaagtaacagaagtaatgaggtgagacagcagagttcacacattccaaatcatcatctcagtctccttgttaaagtaagaaaataagaaataagaattttgtggagtaataaaaaaaaaactttagaacagtttttcatgaataaaagtatacttcatatcagtgaaagtaggctaaattcagtggattcaggtaccaattttcatgaccttagcaacacatagagtaaagccagataaaatgacctgtccagggcagggatgctctgagatagacccagtgagagagaaattccactaacagcaaagacaacccagaatttctcctcatgattggctatatcatctgcctctagttactgtttttatgtaagtaccagtcaatcaagatcagtggaaatcatttcttatgtcattttattatttgtatagttttctattttaattaattgttattataggggaaattaactaatttctgtttttaaatcttgtgatgttcaagaactatatgatttaaaatagtaaatggtcttttagtgaaatagtgcagaccagatatacatatttatctctagtccatcctgaaatgccctcttgaagctatgtccttataaaggaataaagacataaaactgcaaggacaggaggaaagagagacaacatgacagcattgagatttgtattttggaagatggaaagaggaaggcaagttctgactgacttcacaaagaaagtcaacaagaagcaaagtgatgcaggacccagaacctcaaaaaagttcagggattagaggcaccaagtacttctgaaggcagagggcaaagaccggaactaaacataagagaagtggctgcaagtctatttagggaacaagtagaacctcaagtccttcctcccaagccaatgtggcaaggcagccaccccaaatgatgactggagatctacccctggggaaagtgaactagagagaccctcaattcaaagacacaaagcaaactgaagacagttgggaagtacagtactaaagaaaggggtgttatgtcaaatattcttagtgccccagtccccttctcctcccactccacttcccaagtgatagccagtaatattctacccttcttcccaccgccaggcaagaatggagaaaaacacaccacccaaaagactggtagacaagccccatgcatatatgtacacacagaacttccagtcagttttttttgtatttcatacttaaaaaaaaaaaaagagtgctttccatttttctgtgcaaaatgtgtaatatttcagttatgttatggaagggtggaaagtttggaatctgtgaactctgctgtctcacctcatctgttacttcttgaaaactgctctgggtcctcatctcctctccactgtgccctatgtgccagcacttagaataatgccaagtatatgttaagtactggaaaaatacttgttgaatgaattatgtgtatttaaactctcatggaggcccaaccacctcaaaaatgttagcattctattcatagagtgtcacttcatatcagtcatcaacaaagaaaatctccctaacatctccacactttgcagctaaattctattttattgcacctcaactttacacataaaattcacaataatcaacttctaaaaatcactttatatttaatagtatctattcttaaatgaaagcacaggaaatttcataaaaagagagactgatgacagattgctggaggaacgagctccagggtccctctagtggccttgaagagctgacaccctccccaaagtaccaaacattcctcagcaatcaacatccaacaaacaccaaggctgtgtctgggctggggagccccacccggctgcagagatagtgaaatgactccacacttggctacacaggaacgtcgaagagaaaaacacaaagcatgtcacaaggtgacatgtgacacattacctagtaacaataactgaataactggggaaatagcatcttgtgcacccctctttttcctacatcttcctttttacccctctgtgacccccacttttccccaaaaagcatgcacgtgcccacacgcatgccacatagactgttgtgcctcacacttagtaggcctggagcaaaggtattaaggaactctcaaatcatttcgtctaaatatttaaaagttataatcaagctaactgttaaatgttaatatcttctattatttcactgtgataaatatgcttccatgaaaacaaaataaaaacatatgtgtaaaactatgatttttatatgactaaacacagataaaacaccagagacttctaaatttaaatattattgcttagctgagtattctgtaatgagccagaattgcttggatgaataataaagacattcctaagtcatacagtttaagtattctataacatgtctttgttctttctacatttcagcaagatcaaaaattatgcttttataatctagattttcacataatttacattctattgacagtaatgccaattagaccacctttcttaactcactgtaatttttagagagttccttattattttcaatttggaaaaactttgttgaagcagtgacagccgggattgtcaacaaaattcttaaatccatacttgtaactcaaattgaaccctgagttatattatcatgttcaatccttttaatggggtcacctaggttagattatttttataatataaaatattagaaagtattttaattttattattaaaatcactatcacttatattgtaatacttactctcttaaagcaatatccagacctacttatttcttaaatttcatttcttttgattttttgtgcaatgtaaacaaaactgaaaattgcagtctgttgctcaatttgtttaaatgtctatttatttgagactataccttcaaccaaaatagcgagaaaatagtccccataagaaattaacgtcaaaactattatctcaaggcctggtgcagggctgtcaccctggcacgcaccttctcttctttcttcagctgccttcttattcctggaagtgtatttccagaatcttagttccattattccctctcactagataggtagtttacctaggtttataattccacagttgttttcattcagaatattgaaggaattgtgccactgctctccagcattgatgtggggaagtccactaccattcagcttccaggtcccttgtgtgtgacctgtttgattattctcaaagtctttagcatattttcttccccgatatttgcatgactggttctttctcattatacaattccctactgacaccttgagggaccttttctgaacagtcaatcaaaagaagctcccacacatcactctcacatcaccatgctttagtttcatcaaggtaggttattactatatgatattttcttgttttgctcatttctatattttatgtttccattgaataaactgtaagctcctcaagaatttgcttctgaatttccagtgcctaggacaatgaacaggaactcaataaatgtttattgaataagtaaatgaaagcattactgtcataagtggaataaaaacagccttctgattttatttcaaaattatgtaaaacaggatcatgtcgagggcctcatctttgtcatggtgcttagatttactgcaaacatgtcttctgcccatagctaatcctaaatcaggagccttaaatctttaactaaaatataactttggagaagttaaacttatttgttaattatgatttaaaaaaataatttagcctctcacaaaagctgaaggctttgacagccatcctcctttctaaatataaatatgcctatcagctcattctgatactcaaggcacatttagcagctagtttatcctagtaggttcatcagaaggaactttcctgaaatcaggagaggtcacactgagtttctagtatggtcaaggaggtgatcagccctttaaatattttaaatctcaaactgtatctcttccgtgctttgtgttacaggacttgaggatcccaggggagaacttgttcaaggttggaccaggttcaaagctccttctctgtagaagtgtagccctgcctaaagttatcttgttaacgctggaaagatacaggaaaatcttccatcagagcaagaattcaagttaggctccaaatttcatggcagattatccctctgccatctggtatctaaagaattattaatcaatgtttaaattagcaatatagctgactggcacctcttgaatgacttgtcagagttcaaccacaatctcactataatccagtatttgccaaaagcttgtgtaaggcaactagaatttagacacatggtataaggaagggttttaactactattctttaggctttctctgctgtgcctcgcattaaataatatatcctcagaaagcaatatccttgggtcaaattatttttccccactacaaaaaataaatatttaacagttgatgttgtcatcttgcttacagtagagcagcaacataaggaaggcagtccagcaaagtatataagaacacaggcttcggtataaggcagccttggtactaatccaagctttgccattaggaactgagcatctttgggtttgctatttaacctctctaagtcatactctcctaattacaacagcacttgccccctaggttattaggaagatcaaatgaagtaattcatctaacgttctaggcatagtccttgagcatttaatgaatgttaattgtaattattattgtaagaaattatatacttgaacatttccagattctttgcaaactcttggctgaaagcatcattcattacactgcaaaaaataatttcctcttagctgagtgctaacacagaactggctcttcaaatacacttgagattttccttaatcaggtggagagaagcatatgaccaatcatgttttctttccagaaggaaactcaggtatttgccataataatctcttccagattgctctattttttttgctttttttccccttaactggctttcctttttattttgtttttagctgttcacttttatatcatgtttaactatatagcttgtggatctgccattcactagctgagtaaacctggaggggttatttaacatctaaagttccactttcttcatctgtcaaatgagaattgttgtagacaccagtgatactatcttttcagcatccctttttgataaccactcctctactccatccacattcccttgataccattaaaggggcccagccctctaagcacttagattagtctagaagtgatcatctaattcaagctgaaccaggaagacacttgccagagattttggatttaggactgaaagagtcaggtcaatttccttctagtagctgaaattataagacaaacctcaggaactgctagtggctatgtatcccacttatggaaaagatagcctacagtgaaagaaaagaatgatactaagagacaggaaagagaaggagggagagtcctaggggttctaatgtttcctaggttcttgtttttcctgtagcttggctgttctattagtcatctagtatctttccagtaagttgtcctttgtgcatatataattttgtttgatttctatcacttgaaaccaatatagttctaatacataagaaataatccctacactgagtagttgttataaaaagtaaatgagatcaaataattaagtgctaagcatattacctggtatatgatacgtgctcaagaaattgtgcctattaatattatttagaagatgtggatataaatataaattataagtcagacaattaataaaaacaattttaataatttgcaaatcttcttgcaatttcaaaatcaatcaaaggattatttgattctggatcttcaaagaattgtaaaataaatgctctgaataaattttgctatataatattgtataaatgcaattgagagactctcatatagtaaataatcttagagaataatgaagtccagaacagtgatccacaatttctttcttaactcacttgtttagagtaaacatatacagggaaggtggaaaaacaatgcagacttacattccagttaccccacatatataggaataagtctgacatacataaatgtacaaaaactgacttagctgcataaacagtcatgtttacacagtataaagaatgcagtataatgaaggaaaaatggaattaacatatacctgtagagataccacactgacattatcaaaatggatatgtccattagcttctgtgacagcaggatttgcatagcatgtcacaccattgatggcaggtaatgctttaggttgatgagttttttcttgaggaccaaagttatcatttccaaagtgggtatgaccattctatatgggaacaaaaaccaaagagattataagaagaaaaaagatgattcatacagacaaggaaatagagtttactgctttttatttataagaggaaaattgtatgtctattctatgtgtaaagaagtatttttagatatataaaatttctcttttttacatgtattttcatttattagattctgctgttactgtttgttcgtgttagaacacgtatacactcttattttgatgaatatgaatagaatatgaattatgcacatctgttattcaatattaaattgctgatacttgaaaaaaaacaaaaataacctccaaattttacaacatgaatcaagtatttatcttatacttgtcaatatattgactctttgttctccttaaactcacaagcctaataactggaccattctcataattctaaaaataaaatttctgtctttatttgcctatataaagtagctttagggggtaaaatattggatgttttaaataaagtccatttacctgaccatatgtctttaataacatctttagcattctttcaaaaaagaaaagtaggtaaaatccaccaaacacagcaactgccttctcaacataactgtcgactttgggatcaaatccaaatgcctaagggagaaaaaagggcaattcaagtaaaaccaagaaatttaacttgatttctggaaaataataccagtatgcaattctcaccaatgttctaagtctctcttcacatccaagtaatattggaaacttagctgccaaaaatcacaaaacaaaaactttgaaatttgaatgacaaaactgtatgagatggcacaaaaaccttacaactagaagtctcattaaataaagccaccagagaatcttacagtttcccacctataacacctacagcaatatttgccttgaaagagtaaacttttagcagtaaagcagcagctctgattctcatctttagaatacgatattaggtctagataatgaagataaatgagatattgattacctactgtctctaaaagtaatatattagtccatgatatccagaatcaaacttttaaaacaaatatggcaggccacttggattactgttttcccaagagaaatcctcttatacctacagaactgtgataaatcctaaaaaggtaaataaatcaaggcctaggcccaagaataaaagcaaaaagaagatttaaaattgccaccactctctctctctctttcacacacacacagcaataagaatggaataattctttctttaaaggacaaagaactggagttagagtttgaagttataaagagtcaagatgttcctaacagacaagacacataaacttcaaataaatagaatcagaggagagactaatgggtgaaaagccacaactttacaccattccacacattgtaaatctcccctctgaagcagaatagaagatgtctgggttcttgtcctatgtttgcctctggggagacatcatggccgcatcctcatttgaataacttctttgtgcctgtttatacaatgcaaaatggctatataaatataaatgttccatttacctaacattgaggttatgaaaataaagtgaaataagaaaaggaaaatcattttgctacaaaaaactctatgaaaatttgagagattattacaaagacagattctttatattgttaaacttcaagaaaatagaaaaccttaacatcatcaatgtagagtctttagtccacatacagtattagtttgtttaatttactttgacccataaagcagatgagataataaatacatatattatatcatattaaatgtattatgtatataatactcttttaaatcagaaaatctgtattgtcatcctagctttgttactagctgattgtaaggctataatcaaattatttaaccaccctaaattttaatattttttatctctacaattgaggctgtgaaatagatattatcttaggtcctagatcaaataatgataataaatctataactctaaaaagttatatacccactttcaatgtatagcttgaaaaattaaaggaagctttagttataattttctaaaaattacgagataagggtggtactccctgaaatactattaatattttctctctgtatggggtttgtctctccctgtgtgtgtgcattgtgggtggcagatacagtccatgtatacatatatttctctagttcccctttgtggatcccttctatgaaagtctctttctcctttccttcctcttcaacattgcctctcttttcctttcatttatttcccttcctccatttctcttccttatatgggcacaacacagatttgaaataaattgaatagtgtgcactatagtcaagatagatcaataacacattttatcaaagaaaaaaaataagttgctatttatttattagtcctcaattgatattttttccacagttggaaaaaatgaaaaggtttgtcaaccatgctctcatttactctctagtcacttataactgtagtaaatatatgagggaatttagtggtatatgttaaatacattataaatttacatttgacatttgcagtacagttgacattgcatgctctttagaaaaataaataaataaataaataatgaaacagtgtgtggaaaaattaaatttgccaagtgcaaggcagaataaagttttaaggccttctgaggtgtcccagagctgtctgagcacgtcctagtggctggcctcctagaatattaattttgtctctgatagtgatatccactgcagcttgggacaagcctttacaattgctgtgattcagctttctcttatccaagacactataaactagaccataaaacgctgtaagaattatggaggctaaaaacatacaaagtgctaaaacgttcaaaagaaacaattattcacagaaacaaatagccaacatccttacctctggaataagttggaaaattgcatttgaaaaaagagtcccaatagccagccccacaaaaaaggtcaaaatctttgggaaataagatttctttatcagtggagtcaaaatcaatccgaggagagatgccagattaataatcgtcactgacaggaatccatatccccaaactgtgggtcagagggaaaagagagtagaaattaatcagagcaaggaaccaaatgatgttttcctgtacattaagcttaaaagtgtctttaaaagcttaagacacatatcttctttaaaagaacaaaatctactcaatgaaaagtatatagaaaactgagaatacaaatatggcatagcaagcattaatagtaatactgtttatgttttaatcagccctaaatcatcattatgggattaatgagttttacagcttgcagggaaattggagaacatctagaacagcgaacagcgacaaacaatctgagatccacaggctccaagccacctagtttcatctatggctcaaggaatagattaaaacagcattttgaaaaaaaagaaaaaacaggggcagtgtgagcctcaggacaaaggtatggggtgatgggtgggagggcagggatggagatgggtcacagtgagctagcttcaaggtgaccatagctgctaacactgagtttgtcacaatcatttgtcttcagactcctgaggacagcatctcctcagagaaggtggcaccagcagcacctcaggtccccagctggagcctcctgggaatcaaagtcagtctgatgcaataagcactcaggaagtgagcacatggggcaggagggagcagctgcattacataacccaccctgtgagacacaaattaggcaaaaatattccatacagaagagatgctggtgacagaaaaaggtggtgcatctttcatctctggagacccagggcctggcacccagtaggcacacaataagtattgcttagaataaaatgaatgaatactatcctaagctctatagctaatggcatgtgtgacctattgcctttgggcctcaatttccctctctctatcttaaaggggctggtgtaaggacaaaatgggaacacaagtgaaacatacccaggacagtcacctatgtgtgggtgcaggctgagatacaacgtggcctcagggctgtgcaacatgtgactttgcctctggccccacacactgtacacaaagtacagtgtgacagaggagaaagctgcctctgcatagccacttctttaaaatatccagaaagcatgtttaaatggtgggccacttttctccatggcactgtcagtggagtacactagtaacacctacagctcagggagcatttgccatgtgccaggccctgtgctaagtgatcaacatatgtcaacttatttgaacctcacaaaaccctgtaagagaaatactactacctccttcatacagttggggaaaccaaagcagatggaattcaagtaacctgccagaatcacgcagatagaaagctggattttgaacctggacagtctggctcccaggcccacattttttagcatatgctttattattcctttagagataatctcatttttcaaaagcccaaaggactcaataaaactgtaaaaatgttttcctgaattatacatactttattaacacgagattgttcactataattattgttagtctagaatttctatgtacaaataaacaaacttagtaaatgttcattcagcctagatgacgtggaccaaaccatggctcctgccaccacacacacacaaacacacacaagtgcaaacacacacacagagtgatacaaagtcacctgtgctaagtaccaaatgaaaaggtcagattataaatggtactatgtaaccccgagaatcatcacagcactgaccatgacgactgcatcttctccagacactttcctatcagttgcaggtcctggccatgccctacaacttcacctaacagcccacttcattcccatttattaccttatcaccttaaacaatactactagtccccacagacattccacttggagagagttctcaattccacaccttttatcgtggtagatctacatggaatttctcttaacacaaacatacttctatccatcactagcctacatgccttcattcattcaacaaatatttataatctcattgggtagacaagatatatacatgttgaaaactaaaattaaaaggcaaagaaattgttaagtgccaatagaagcaaagccacatgcacatgttaaactcatcagcttccctgcaaacacctgttccattacccttgttcactacctacataaataacaggaacagtaggatcaatttcagtttttcactttccaccaattaattccatagacaactggtgatcaaaccctaccagttctgcttcaggcatctctcacctctagcctctccatcctcattgccagtggtcttgaagtcagaccctcatcacctctcactccctcatcttatataacatgacagttatcgatctggtgcccctcctactagctgacatggcctacagacttatactaaatcacaaaagtgatcatctcatgcccccatttgaaatcgcccctcataaactgacccttgcacagcctctccagtgttatttacccccttctcaacatggcctttacccaaacactatgttttcccaaccgagctttacctttacactgtggttctctgtctgaaaacactttcctatcttccttgcctaagaaagtcatacgtggccttccaagccaacacaaagatctcctctatgaagcttccctgctctccaggcagtactccctggctggtcaggattcccattactctttgttcacttaccacttcttgtgtgctacagtaattttatcactgatatatttgcctacatcatataaactgtgtgattctcaatgagaagggctatgttttattcatcctcagtgcctagaaaattgtccacgaaaaagcacacattccttgctgaatgaattgataaattccccatttcaaggtgcagcagaactctgtcaaaaagaaataccaatcgatctgcttatccaactttctaactttctttgcccttgcacatttatcagcacaacttgggggatggtgggagtgtaattcatcacattctaagcacactgcatagcttccccttcttgtattgttagaacatcattcagaaaaaaatgtctggagtttccattcaactgaagcactttccacttaactgaagcaccaaaagtatacattagtatgaatctattccttggacatctccatatatacgtgggactttctcaaacgatctgtttcagagagggaccagtctccttataagtgaaccctgaaagattttaatagatttcaaagaaatacagtcaggatagtttacatttattgactgtccactgtgtaagattcttctaagaactttacctattttaactcatttaattctcacaacaaccctatgagataggtgctgctatttttcccattttaatagtgaggaaatatggttctattatgatacccattttgcagacctgcatacagcccaggcttcaatttttgcctggccccatttaactgtgaaactgtatagaatggtgtttaacagtgtgaactctggagccagaggatttgtgttcaaatcccagctcatcccctcactggcatcataggttggttccttgacttccctaagtttcagttttctcatatttaaaatgcagattaaaatagctcctatttcatagagttattacaagaataaaataaaaccagttaatgctgtccctggaatatagcaagcctttaataaatgttgattacaattatgtttaaaaaattagtaagtagaccatgatataaatgttagttcatttaattcactgttactcagtgaaaagaagaacaaactaagaatcaggagctctcatttcaccttaggtacgacacctacaagaagccacttaacctctctggaacttggacttacatcactagttgtattacagagttggacaatatgatctccaaggatgcttcaattaatattctttattttatctactatatgaattaaatatgattctgcaacttcatcaaaaagtgaggcaatttcagaccattaaattattactaaaatgcaattaatttctctcctagagaatttaacttatcatcagtttactgtactcatcaatatcattttataaagcacatgaaatactttcaaaaataaaatgtgaggcctctgagaaattttactgtctacccactgaaatgtcaacataaatgtattcaaatttttgtatcatttggattgtttttatgttgattttttattgctttggatgagctaaagacttgactcttcattaagtgaaaagttatatgaaaaatccagtgcatttaattattttaaaatgtttttcttagtgagaaaaacaataggataacacaggggccagggaatgtggtgaacctatgaacacatgtataagaacaaagacattcttcttcctctgtgccaggcattgttctaggcacttacgtatattaactcatttgatactcccaacaattctataaaggtactattaaagtaactgacccatagagatattaaataatcatacagctgcactaaaataaaacaatcaagatatcacatcaaaaaggcaatagagtgccaagttaaacatcttagatgagtagtaacaagcactctactagtttccctaaattcccctggaaacatttccatatcttctccccccgatcccactccactccagcctcatttcaattcctaagacaatatgcaccctaagaggcatttctctttttattgggttatctgtctgaatatttggtgatcccataacttagaattgctgacttttccattttatgactttgtagtgttgtccctagaattctacctctcacaccctgcttctgacttcccagttctcaactcctggttcctgaaacagagtaacctagtcaactggggtttaaaaattacttttgaatatgagtaattaacttgcacagagcaactggggttaaaaaattacttttgaatataagtaagtaacctgcacagagtagagtatttgctttttctgaaacctcacttcctgtacctagagttatgcacgttagatgtagttatttaacagacctaactaacaggcctaccacagcacctaggtactgaataatgttcgaagtactttacaaatattaagtcatttaatctttacagcaagcccataagaaaggtactattttagatgaggaagctgaggcaggaaaaggttaaagtcatgttctcaacatagctggaaaattacagagctgggatttgagcccaggtaaactggcttcagagtctgtgcttttactgtgcaatactattagtcaagggtagtatcctaaagcgtttgctgaatttactttttaatgtaaagtgcaaactgtattaaacaggcttgtagaaatataaatatactctagcaaaaatatttgcttgaacaattagcaattcaaaattactaatatttcaaaattgaaattactgttattcacaaaattgcaaattatattgataaatgatacttggtgatttctatgctttgtatatataaatacagaatatcaatgagaacatgggttctgaagccaagacaacctgggctgaatctggctctaccacatgcaagttgtgtaactttgagcaaatgactttaaactccctgtacctttgttttcttggctgtaaaatgggaatagtagtgtctacatcatatagttgcatgaaattaatatatgaatatgtaaagtacttcaaagagtgcctgtcatatagtaagtaccacaaaagaattggctatcatcattgttatttttgtcattgttgttgttatttcttttattcatatagagggagactgaagtgtacatgcacaaaggaatccggaaatgaaaacaggcactttctttgttaagtcttcccttttcttctctatctttactctctttatctatctatactcctgtcagatgagctcactcagaacagcatctttatttttatttttttgagatgaggtctccctctgccacccaggctggagtacagtggggtaatcataggtcactgcagccttgacctcctatgttcaagtgatcctcctgcctcagcctcccaagtagctaggcctacaggtgcatgccaccatgtcagctaattcttttaacttttgttgtgatggggtctcactatgtttcccaggctggtgttgaactcctggcctcaagcaatcctctgccttggcctcccaaagtgctgggattacagggatgagtcaccgtgcctagccccagtgtctttaaatatcatctctagactggcaaatccccagtcttgacctctcctctgaaagcaatctcctctccaaatgtctgtgtgcctttgcctactggacctccctgtctacctgtgtatgtcaatgtctcaaagcaaccacgccaaaaattatattctttatcctcaccactcccttcctctacaataaagggctcttcccagtcttctccatcccgggaaatggtataacgatctctccggtttctctggctcaagacttgactcattgttccctctcccacaatcaatccagggcaaaccatttagcatgatctccaggactcatcccgaatctactgcttctccccacttctacttcccccactttagtccaagtccccatcatcctggcatcagctcctggcaatcgcttcctgaccaatcaccctgcttctactcttgccccattacaatctgttcttcagattgtaggcaggtggaatgcccttttaacagatttgaatgagatcacagcattcccctgtttagaatggtacagtgacttcacactacattcagaataaaacccaatcaatttaccacctcccgcaaggcttcctcacctggtctccatctcccgccaggacatatatccttctaccttccccaccaactcactaggctccagacacataggagcctcttgctgctcctcactcatgccaagctcattgccaagctatgttggctgtgccctcaatcaagaatgctcttcactagagacgaccttgctgtggccctctccttctgctcagatgatacctcatcagagagggcttccttgatctatctaagatgacactcacccactatcaccttctatccctcacctactaatattttattttcttcatagcacctttcactctgaaactatgttgtttatttgcttgtttaaatttgcttgtttaaatcttctccactacactgtaagccctaaaaagacagataattattcttcttgtttaccattgactccttagtgcacagaacaatacttggtatgtcgttcaataaatatttgcttaatgaacaaatgaacgaaactttaaaattccaacataattttcaaacagactccctgaacaattggtttatctcattggtgaaagtgacccttctacacatttaagcatgtgagctgtatattaagcatacatatattttattatggtttaaaatttctttgcatcagatcataccgttaaagtacatattcatggaaataccattatagtcacttaaaatagtctctggtattttctttcacctatgaaaattaaaactaataatttggtccctgaaaatttaatctagaagcatgctagttctcttatctcttcattggtaactgcagataaactgacaagctttaaaataatatggtaagcaaaagataatggaaatgaaatgatcaattataagccaaagaaaatgcaatccaatatgcacagcataaaatatatattgtttaaaatcaagaactggattttataaagtttttaagtgtactaaatgtaattttgattcaacaaagagaagagcataacttatgaagcttaaatgagttataattcttcttattccaaatactttcaaaatataagtattattcgaagaagttctatgtagattaattaaaagcaataaagcagaaaaagaggcatattaacttcatttcacaatggttcatagacttttcaaataaaagagaaaaaatgcttctaatataccttctgaatgacttggtcttgttttgtgcttgggccgatcctcacatgggtgaaagttcaattgctgtaagactgctggacagatgacagagaatttggagctggttatttgggtagcatttgaaaagccatgaagggaaaagatctcttcagcagttaaacactgaaatagaataaacaaaaaaaaaatgtgataataatgtgtaaaagcacataagcaaagatgctataaagagacacagactatttcatctagatgcacagcactctttatacaaaagcccaccacagaaattgaaaggcccctaaagttgtaaaacagcccacaccagtttaaacctagaaacaagaaaaatagaaaaaaaaaaatcccttcttaatcaacagctttcctacagcagaaaataaataagaattggtttgggcatatctaaggactttatttaaaataggggtgcaccaacaccattcaaacaaagggttttaaaacaattttttattgtcagtaccccctcttagtttacttttcttcagtttgaatggatattttgtgtgtgtcactggcatggctctctatagcatttcttgtagacaaatacctggctccctacagtttcatgctaagaaattcctctcttctctacactgcaataaatataaatataaaaagttgttttaaaatatgtcttttgcacaaactgtttttcattaaaatatgcattattctcaatgacgttgggtaacttttctatattaagttttgaaaatagtgctgggctgtttagaaattcattaactattaacaaggactagaatctacattaggaaaaaaactgcaaaaataattttttaaaggtataatgttgttctcacattttaactgtaagctcttccatatacagtacttgcattattaagaaaaatataaaataaatgctactgaatgtcataagaattatagtgtgaaaaatatccattcactcaaatggaagagtctgtctttaataaacgtaatttaggcaagttatttgcatgcttcagccaatgcttaaaccccaataagaccttagctatgtactatgatctgaattatgtctccccagattcacatgttgaagccctaatccccagtgtgatggtatttggagatggggcctttgagaggtaattaagtttagatgagttcatgaagttggggccctggtccagtgggattagtgcacttataaaaagagacatcaaagagcctgctcacttgctctttctctgctatatgaggaagcgagaaaatgctctctgtgacccaaggagagagccctcacagacagcaaccattctggcaccttggtctggacttcaagtctccaactatgagaaaataaatttctgttgcttaagccacctaggctttggtattttgttatggcagcctgagctgactaatacactatgaatggtatcaataactcaaagttgatgttaattgtttgaccataagatgctgtaattccctttactacagaaacaatgaaatttaaaatgtcatattttgttacaaggagatcactactgtttataaaggaaaaatgaaaaaacatcaaataatcaaatacaccaagatctatgcagttgtccaacgctaagattacaactaccttacagaaaatgcacatttagatttttttaatgtctaagtatgtacctaaaattgttccttattcaacccactgttttgagtttatgattaatgatagctgcatgccatccatagaagaggatacaccacactcaatgccctgttaacagtcttccctttagctcagaatgatgtataataaactaatggagggagaaaatacctcaagatttaattggggaagggaaagtgtgaacagtttattcatcaccaggaaggcatccagaagcataattgctagattcaaaaagtagacagcccttgtggttcaactggacactgtgtgcttccaggaataaataggtgtgatagcacatgatagcacacacagagagcaccactgtttccctgcaaggaagacttaccctacttggactttaaattcctccaactgtaaaataggaggaaaacgggaagatgcctatagataatctccaaagacttttcagaattagcatgctaaggctccctaatacctgatgactgttaagcagttctttttcagactcaaattgtaacccattcctgaatcaggacgcccacttgctaaggcacagtctgcattttttaatgaagtaaaatacaaaataatagaaactatagaccatatcacacataatagggtaagtgttgcttaaccaaactttagttacacatcatatataacatgaacatgtatactggatcatgatgtaaaatgtatttcttgctgtgaatggcagtcacgagcttgaatgccaccacccttaaggatgtcagaattgccaactgtacatcattaaagacaccctcctacatacaattagaaaaaaagaaacagtgcagtcaaataaatatataattaataccatcagatagcttagctgtgcagcatttgtgttgaaattttagctggacaggtggtcagggatagtcacggtagtcatggagagtggcaactgtccaatcaccacgaagaacacagagatgtagagatgataaaactcaaagctcccctcatgataagagaatgagaacagaatacgaacagtgcagcagaactgaattaatggcaagcctgacttatttaaaatagctatctaccagcaagtggaatgaacacaattttggacagtggcctatttctggcttcaaacaatcttgatatttattatactttgacttaacaaagttgaaccagaaacaaaagaaagcagttgtcttagaaagggtggtgcctcccagagtgggaacaaacaggatgagagtccagcgcctgaagagtgagggcaacaaaaccaaccggttataccatggacaaggaggctcaaacaccctcacaagcacaccctttcacctccaaaacaatgaacaaacaaattacggaaagggtaggatcatcaagtgctactcagaaaactattcaggatgattgtacggaatgctatctgccttaataaaactccatgtgctttcgccagctccttcacatttatgacagctttacttcttttcatgcttgtatctatgacactgctgttctcaagcatgctgccctgatgtttgctgtggccttttaaggtttcagatgtcctcgtgttcagcgcgttgacatttttcataaagactctaagtttgaagttaagctcctattcactggtctcttgccacattagggtgacctcaaatgggccttgtatgtgtgaaacaccaaagtaaggtagcattataggtaggggctaggtatatattacaaaagagaccgcaaagtatgctcaaaaccgtttcagcaaatagttatgtgcattttggcttccgcttctgctcttccttcttcctcaccagtttttatgagtcagaagtttttctgcctctttcctaaacatgtccttatgggaaagtggggggctggttcagagagaggatgaaggaagctcaaggaattagggcaagttccttccttagcattttacacaattgagatctggttataataaatgctgaatctgaaagcttcaatactgacaaagattctctccttgactaaactgcagtcaggctcctctgagcccaggcctcgaccctagcatccatccttacaggacctgcatcacctggtgttagcaagaaaccttctaactcagtttaaagagagttccctcaccctccatgtctgaccaccctggtcctgccttcagcaagaatcctgttaggtctgtttaaccaaaatcccccctacccttaatgtttcctcttagtaattttccattcactgaccccctccccactcctacccctgctcctccttggctgtaaatccctacttgtccatgttgtatttggagttgagccaagttccatactgaggtctcttttccccttgtgatcattaattttgtgtcaatttgactggccactggcttcccaaattaaacattatttctagggcgttaaacattacttctgaggtgtctgcagggtggttccagatgagattagcatttgaatcggtggactccgttaagtagattgccctccccagtgtgagtccaacccattgaaggtctgaacagaacaaaaggcagaggaaggaatttgtcccttttttccttcctcactgcttgaactgggtcatttgatttcagtttcttcaaccctccctctagagtttacaccactggctcctctggttctcgggctttcagacacaggctaaattaaagcattggctttcccaatctgtagcctgcagacagcagatcctgggacttctcagcctccacaatcacatgagccaattcctcataatctctcatatatatatacatatatatatatatatatatatgtatatatatatgtatatatatatgtatatatgtatgagtatatatatatgagaatatatatatgagtatatatatgagaatattatatatgagtatatatatgagaatatatatatgagtatatatatatgagaatgtatatatgagtatatatatatgagaatatatatatgagtatatatatatgagaatatatatatgagtatatatatatgagaatatatatatgagaatatatatatatgagaatatatatatgagagtatatatacatatgagaatatatatatgagagtatatatatatgagaatatatatatgagagtatatatatatgagaatatatatatgagagtatatatatatgagaatatatatatgagagtatatatatatgagaatatatatatgagagtatatatatatgagaatatatatatgagagtatatatatatgagaatatatatatgagagtatatatatatgagaatatatatatgagagtatatatatatgagaatatatatatgagagtatatatatatgagaatatatatatgagagtatatatatatgagaatatatatatgagaaaaaatatatatatatatatcctgttggttttgtttctctggagaactctaacatacccctattgcaatgtttcctgaatgaaatctgtttttaccacttcgactgctgttaggcactggttttttaacaatatcaagtatagtagccatgtagttatactacagattgcattaactccttcctttattctacaaatatttatcaaaccataaaagtctaggtataatattgatgggagaagtagaaagtggggaaagctggaggatgacaaccaggaaggaaatagtacaaagataaataagtaaaactgccttccatcagcaaacttaaatcactgtggcagaaataaattagatacatgaaggtctataaaaccagagaggaaattataaattcacaaaaaacataataataaagaactatgagagttcacatgagggagaaatgatatgcagaggaaatagtcaaaaacaacattgacgatagaatgctgggagagtagaaagaggatgctgctactgctgttgatagatgcaggaggcagataaaagggagggtcctcggagaatctctacctgcctgagcagtgggagaataggatggagccatgggaatttcccgtgcgtgcaaggggcaggagcctgccctcttcagttcctgtgtttgtgacctggaaccaatctgtgagatgggggcctgttagcaggaactccgctagctttgctgagaggtcgtttttttcttttttccttttcgcccaataaattccattctcctcacccttcaatgtgtctatgtgcctaattttttctggtcgtgtgacaagaacccagtataagctgaactaaggaacaaagttctgcaacactgtgattagggaacctaggaagagaagcccatttggcaggatggtggcaactttggttttagacatttcaagttgcaatgctcctgggaccccaaatgcaaatgattggtgagctttccctgagaaaggtagagaccagagacaaggatgtggcttcttctgcaatgaggtcatagctgagtgggagtagtggagctgatcaggagaatcagcatatagaaagaagaacaaaggcttgagaatgcatacacgatttgtgcaaaagcacgaaaaagagccagtatataagcccgagtgaattaagctcaaaacataagaaacaatccagaccagtcaaatttggtagatgtctgtggtttttgccttcctggaatgatgaaagacatgtaacccttgggtttttgtcccatcatctagtaacagacctccttactgccatgggaactgccttccatgtgattttggtaagcataggagcagtctggatcctataatcacctgtgctactgaaaaactctttctccactagtcctgctgtgagtctggggacatcttaaaccatttctgccgccatgtgaaagaaggctaactaagaagtggagaaagacagattttcaataccatcacaataccctggataagctgtacctaaagctgatgtgcaccctgactcttaagttatgtgggccaatgaattccctttcggcttaagctaattaaagttgattttttttcactcttacaaataaaagagtactgatggatacataaagtaattatttaaaagtcacttttaaaagctagtgaatgaatgctacatcataacctataggaaaacaaaaagataagcctttccactctttaaagcttccacacttcttcctgttctccacacacaggctgttttgtctgcttggttgtcttatcaagtggcacccattaaataatacaatacagtaagaccatctgatcctgtaccattataccaaggccttcacatcacaccagaaatgaaatatcatcccattcaaaagccaccccagaaatggtttcagattttgttttgcaatagattgagattctgtgggaggctgagtagctcacattcccaataaggaaagtgctaggtgtggttgtattctctctgtggaggtaaaggcagggagacacagatttttgtaatgcatttagactcaatgacaatcaactttaaataccattacaaagccccagagggagcaagcagcagaactggggttagaatccaagtctgaaagagctctgtctagcttcttttattttagtcacctctaccctgcgctgccctgccagtgattgctacagctgttgctattcagtaagaactacagctactttctgaaatttgccatgtatgcagctgtgatgaaagccatgaaacccatccttcccccaccccaagtaagtggcgatctcctgttctttaaagagatgcaacaagtaagaggtttaataagaatccacctataatcttcatctgttctgctcttatagaagcccattccacttctccttcattctcattcatttattcattaactgaacaggttgctcacaccttctctgagtcaggtattccagtaggtgttgagaataagacatggttttcatcttcaacaatctcatcattcagcatagaaaggagatacatataaaacagataagcaaataaaaatatgcacaacatatcatgtgattaaaggaatgaggtcagggaaggcttcctagaggaggagatacatgtgctaagtttgttattttgatgcatctgattcttggggaaataagacatgatacacaaaaaaattaatggagagatcagtaacgcaaatgagtatgcaattagttggtgaataaattttataagcaatagttatcataagagttctgggaagcatataaggactacagtaatagcaaaccataatatatgcttaacacgtataacctctttaatcaaccacttaaatagattttaggttaaatttggatgaagaaatcctgtctagaaaggtaaatttctaacggtacaagattaaacaatgtaaaagtgttaaagacagaattcagatatatgtgttctcatgccttttgacttgtaagccagtattctggctgctatgtcttggtccaacactgagaaggattcaatgaaagaatcattgagaccctggcagagaatgcactttgttgcccctaatagtgagttgaaacacacaattaaattaactgttaaaccatatttaggatcccactcagagacagacttcaaaaataaccctacaataagaaattacttaatggacacaatatgtattattcaggtgatggctacactaaaagcccagatttcaccactacccaatatattcatgtaacaaaactgcccttgtacttacatttatacaaataaaaaagtccggccagctgcagtggctcacacctgtaatcccagcactttgggaggccgaggcgggcagatcatgaggtcaagagatcaagaccatcctggccaacatggtgaaaccccgtctatactaaaaatataaaaattacctgagcgtgttggtgcatgcctgtaatcccagctactcggaaggctgaggcaggagaatcgcttgaacccagaaggcggaggctgcagtgagccgagatagtgccactacactccagcctggtgacaaaccaagactccggctcaagaaagaaaaaaaaaaatcctacagttcaaacatcagccaacttttctcaccagagtgagaattttaggtatacttcgctttctgcacttcatttcttttgctttttcataattttgtttagtttgcagctatgaacttaaaccatttttgcagttggctccaaaaatgctgtgaagacaagtgagagattcattcatttatttactcattcatacattcaacacatatttaccgagcactactgcatgccaggtacatagcaatattagtaatcatcttaataaatactaaagtagatatgaattccaggattccagaggtttctttcccattaaataatcattgggatacctaaaagtgttttgaatatggcaactggccaaagatcccaagagagcaattgaaatacatacatttaaaatggtagtttgaatttaacaattgggagaccacttctgacccttgaaacaagtgaaccgtcccattaatttatccttttagggctcactgaacaatggaattggtgacttacatgttccacactcacagcaggaacattcaaagcacgagtgactgaggaaattgcttccagatttgttcttcctgcaataatgaaactgcctcaattacaaggcactcaagtttcacttccaaatctccctgatatatacatacatacttatatatacatatatatatgtatacatatatacacacgctgaatctctctctccaccttctcttgaagttttcccctctttaaagtcctcttcaaagtttactcattattattctatcaagataaaagacagttttctaaggtttaagccaagaacactctataaaaataatctctaggtttaagaggtggccagtcaagtgaccccaactctgtttccccaagattaatttttccatttttcctcaggttttcttacacttcttactgaagtcactctggcactgatgccaccaacacacatgcactctcacatacatgcacactcacactcatatacacacacactcacatgcatacacatacatacacacacacttacgttcactctcaaaactctttttgaagggaagatgaagaacgcttttcctgaatatacaatttaaaggataaagatgccttgttttatgatgcactgctagggataaaaagattattatgaaacaatatatagagaatgctgctataaataaggataaatctgtgctccaaatgttaacagtgtttatctctgagtggtaaaattatgtgtggttttattttttttcctttctgcttctttatatctgccaaagtttttaacaatgtacttgtatttcagtttcttttaagaaaaataaaattaagtcatgttttgtttgtttaaaatctctttttccaggttcccctaaacaaaaggcaggctggaattcttagagattttactaaagaaaaagaaagaatgttgaaagctacaacaatctttttaaaagaggtttacaacattttctgtctttgtcatagtgatggacaagtttcccagccctaccccattccatattcagcttttcgaggtcttgtcttgaaaagagaaggtgttcttttagactcctaaaagtgtggtgtggtgtcagagcacagacacccaatctagatccttcgcttcccacccctgacatgtcttcagggggcagaggccaccctacttcccatcatctgctagggaatcccatgggcattatcccattttgccaagatcaaaagcctttgtttccttgatgtacaccaagggtttcccactcagtccttctgaggataaagtgtggagggcatgctgcttcttcaactcagggctggggagttgccacaagaaatgagtgcaccttggccgggtgcggtggctcacgcctgtaatcccagcactttgggaggccgaggcgggcagatcacaaggtcaggagatcgagaccatcctggctaacacggtgaaaccccgtctctactaaaactacaaaaaattagccaggcctcgtggcgggcgcctgtagtcccagctactcgggaggctgaggtctgagaatggggtgcacccaggaggcagagcttgcagtgagccgagatcgcgccactgcattccagcctgggcgacagagcaagactccgtctcaaaaaaataaaaaataaaattagcatggaatgggtttattgttatgtttaataaattaaatattttcaagttttcttaacattaatttctataatggtaagtattaatagatataaatcacatatattaaggctctttggtattctcaataatttttaagagtacaagggggtcctgagaccaaaatgtttgagaatctagcagataaaaatgacacaccagcagagagagcccttatgtaccacttcactgaggagctaggagcttctaacctaatcgtatccaatacccttctcatcctggttatcctacaactccacaaggttgtttctactgatgcatcacccatcagcatgtccttcttctgcccaaactgcaacccttgcacacacacataccaaaaaaacaaaaacaaaaaccttcaaaattacacatttctggcctggcatggtggctcacacttgtaatcctagcactttgagacaccaaggcaggaggatcacttaagcccaggagttcaaaaccagcttgaatgacaaaaataattaaaaattagctaagcatgatggtgcacaccagtagtcccagttactcagaaggatgagcaggaggatcgcttgagcccaggaggtcaaggctgcagtgagtcatgatcgtgccactgcaatccagcctgggtgacacagtgagaccctgtctcaaaaaaattgtacacatttatgccgagagtctaaagtcctaacacttaagaacctcacttgcctgtctctaatattccttcccccttcagcatgctgtaaaaggatagatgaatactctatcctaaccagttataatcagccttatattgtaacttcactgtgactttgcatctcccatgacccctgcctagaatatgatacatctcctctcaaactacccaactcctgtctgtcctgcaaggcccatttggaatccatcttcactgcctaatattgctatacccatcccttctccagactccagacatccctgttatctatttgtttagcacttaatgtgtgcttccatgtattattatcttctcatgaaatggatattccttcaataagatcataaaaatctacagagaatggacttcttcctttttatatcttcttcaacccctaataagtccttggacacataagacactcaatttataaacaattgctaattttgtagattaaggaaagaaggtgaatgaaaggagatttcaaactagcacactgtgtttgaatataattctgagaaatataaatcaataacctgggaatcatctaccaagacctctgaggaggcaaatattccagccataagtttttcttctcattctatgaaactttcctagaatcagtttaatgtggccctgatgctacaaataaactaatcctgatatcagtgtttctaagttgccgtaaagaatatagtaatgggctacagagaaaatcccaggctaaatgagaagaaaaaaattcctggaaagttcataaactaaaagtaataaaaactttatttccttctatttagatggcccatgggttaaattttaatgtactattcttttaggttttttatgtgtgtaattggacccatggaaatgcatgaatacctattccatttcctcacctctcagtcattcctcaacccattgtggtctggcttctattcccaccacttccttgaaattattctatacaaggtcactggaacctccctattgctaaatacaatgggtgcttctcaggccttatctctctgtttttttttttttaattcattgtcggcaacaaaaaatggaattgctggtttaccttaaattaaattaaatgatgcatctaggttgatgtctagatcatctgcttaaaccagcagaatagagagttcatgtgtccttttagaggatgatgaggagggaaaggaatattaatttagaaggttatgttggtttaaaattaatcatttaaaaatttatcagttaaaaaggttgaagttatttatcaagtatttcattcattcaacaaatatttcttgaatatcgcctaaatgtcagacattatgctagttatgggcatagcggaggctttccaggtaaacccagtcctttgcctcatggaccatacagactattgcagagtccatattaaggcatatataactgcaggggccgggcacggtggctcacgcctgtaatcccagcactttgggagaccaaggtgggaggatcacgaggtcaggagatcgagaccatcctggttaacacggtgaaaccccgtctctactaaaaaaatacaaaaaaattagctgggcttggtggtgggcgcctgtagtcccagctactcgggaggctgaggcaggagaatggtgtgaacccgggaggcggagcttgcagtgagccaagactgcaccactgcactccagcttgggtgacagagagagactgaatctcaaaaaaaaaaaaaaaagacatatataactgtagcatagtctggtaagtgtggaggtaggctccatgaatttggagaagacagaggtattagccaactctgaagtaatgggactgtcaaagccttcctggagaaagcagcactgaaggtgaaatgtgaaggaaaaagtagaaataaggctggagaaatatgggagtgggggcagatgcttctgccgtaaataccaggcaaatagtttagagtttattttcacaataatgggaagtcatgtgaggatagtgacatgctcagatttgcatattaaagattcaagttggctgggcacagtggctcatgcctgtattctcagcactttgggaggccacggcaggcggatcacctgatgtcaagagttcaagaccagcctgaccaatatggtgaaaccctgtctctactaaaaatacaaaaattagctgggcatggtggtgggcgcctgtagtcccagctatttcggaagctgagacaggagaattgcttgaacctggaagatggaggttgcagtgagctgagatagtgccactgcaatccagcctgggggagagagcaagaatctgtctcaaaaaaaaaaaaaaaaaaagattcaagtctgtgaactcagctctggaccaagctgagttaatagacatttacagaactctccaccccaaatcaacagaatatacattcttctcagcaccacatcgcacttattctaaaattgaccacataattggaagtaaaacactcctcagtaaatgcaaaagaatggtaatcataacaaactgtctctcccagctcagtgcaatcaaattagaactcaggattaagatactcactcaaaaccacacaactacatggaaactgaacaacctgctcctgactgattactgggtaataacgaaattaacgcagaaataagtaatttctttaagaacaaagacacaacataccagaatctctgggacacagctaaagcagtgtttagaaggaaatttatagcattaagtatccacaggagaaagcgaaaaagatctaaaatcaacaccataacatcacaattaaaagaactagagaagcaagagcaaacaaattcaaaagctggcagaagacaagaaataactaagatcagagcagaactgaaggagacagaggcacaaaaaaacccttcaaaaaatctctgaatccaggagctggtttttttgaaaagattaacaaaatagatagattgttagctagacaaataaagaagaaaagagagaagaatcaaaaggacatattaaaaatgataaaggggaaattaccacttatcccacagaaattcaaactaccatcagagaatactataaacacctcaacgcaaataaacttgaaaataaagaagaaataggtaaattcctggacacatacaccctcccaggactaaaccaggaagaagtttaatccctgaatagaccaataacaagttctgaaatggaggcagtaattaatagcctaccaatcaaaaaaagtccaggactggatggattcacagctctgtatcggtattcacggatacagaggagctggtaccattccttctgatactatcccaaacagtagaaaaagagagactcttccctaactcattttacgaggtcagcatcatcctgataccaaaacctggcaaagacataacagaaaaagaaaatttcaggtcaatatccctgatgaacatggatgcaaaactcctcaataaaatactggcaaaccaattccagcagcacatcaaaaagcttatccattatgatcaagtcagtttcatccctggaatgcagtgctggttcaacatatgcaaatcaataaacgtaatccatcacataaacagaaccaatgacaaaaaccacatgattatctcaatagatgcagaaaaggcttttgataagattcaacaccacttcatgctaaaaacgctcaataaactacgtattgatgggatgtatctcaaaataataagagctgcttatgacaagcccacagccaatatcatactgaatgggcaaaagctggaagcagtccctttgaaaaccagcacaagacaaggatgccctctattaccactcctattcaacatagtactggaagttctggccagggcaatcaggcaagagaaagaaatgaagggtattcaaacaggaaaagaagcagtcaaattgtctcgtttgcagatgacatgattgtatatttagaaaaccccatcgtctcagcccaaaatctccttaggctgataagcaactcagcagtctcaggatacagaattgatgtgctaaaatcacaagcattcctatacaccaataacagatgagagccaaatcgtgagtgaactcccattcacaattgctacaaagagaataaaatacctaggaatacagcttaaaagggatgtgaaggacctcttctaggagaactacaaaccactgctcaacaaaataagagaggacacaaacaaatgaaaaacattccatgttcatggataggaagaatcaatatcatgaaaacggccatactgcccaacgtaatttatagattcaatgctatccccatcaagctgccatttactttcttcacagaattggaaaaaactactttaaatttcatatggaaccaaacaagagcccataaagccaagacaaacctaaggaaaaagaacaaagctggaggcatcacgctacctgacttcaaactatagtacaaggctacagtaacaaaaacagcatagtactggtaccacaacagatatatagaccaatggaacagaacagaggcctcagaaataacgccagacatctacaaccatctgatctttgacaaacctcacaaaaacaagcaatggggaaagaatttcctatttaataaatggtgttgggaaaactgactagccctatgtagaaaactgaaactggatcccttccttacaccttatacaaaaattaactgaaaataaattgaagatttgaacataagacctaaaaccataaaaaccctagaagaaaacctaggcaataccattcaggacatagacatgggcaaagacttcatgactaaaacaccaaaagcaatggcaacaaaagccaaaattgacaaatgggatctaattaaactaaagagcttctgcacagcaaaagaagctatcatcaaagtgaacaggcaacctacagaatgggtgaaaatttcgtaatctatccatctgacaaagggctaatatccagaatctataaggaactgaaacaaatttacaagaacaaaaacaaacaaccccaccaaaaactgggcaaaggataagaacacttttcaaaagaagacatttatttggccaagaaacatatgaaaaaaagctcatcatccactgattgttagagaaatgcaaatcaaaaccacactgatataccatctcatgccagttagaatggcgatcagtaaaaggtcagggaacaacagatgctggagaggatgtggagaaatgggaaagcttttacactgttggtgggagtataaattagttcaaccattgggaaagacagtgtggcaattcctcaaggatctagaaccagaaataccaattgatggtttgcagtcccattactgggtatatacccaaaggattataaatcactctactttaaagacacatgaacacatatgtttattgcagcactttcacagtagcaaagacttggaaccaacccaaatgcccatcaatgatggattgtataaagaaaatgtggcacatatacaccatggaataccatgcagccataaaaaaaggatgagttcatgtcatttttagagacatggatgaagctggaaaccatcatcctcagcaaactaacacagcaacagaaaaccaaacaccgcatgttctcactcataagtgggaattgaacaatgagaacacatggacacagggaggggaacatcacacactggggtctgtcaggggctgcggggctaggggaggtatagcattaggagaaatacctaatgtagataatggctgatgggtgcagtaaaccaccatgtcacgcgtatacctaagtaacaaacctgcatgttctgcacatgtatcccagaacttgaagtctaataaaataataaaatgtgtatatatatacatatatatgtattcaagactggaagaaatgtagaggaaagagatatgtgaggcaagactggatgcagagggcggcagcagtaacagagtgtatgtgtattgaatacttacagcatgccaggcaaaagacagagtggctagacatattatctgatttcatctctactacaatcccataaggtaggtacaattttccccattacacaaagaggatgttggagcttcaagagattaactaagagatatttataagttattatgacaagacttatgtgcatttgatatgggaaggggaaagaaaaagtgaggagtcaatattaacatccagtttcacagcttagttcagtgagcagatagtaatacctatcactaagatgggcaaaacaggaataccaaaaggttttgatggagaaagagatggagttgatgagttttgtttgagacaggtttagacctgttgagttggggaaaagaaaagagttagacatcaattgtcagctgggtgcgcaaggctgaatctcaagagagaaatctgaagtaagccaactcatgtagaaagcatctacagatagataatcacagccatatgagtccttgaagatatacagaaagagtgtgtgacatcaaaataaaacaggctcgagatggaaacctgaggagcactaatatttaaagaatgagcaaaggaaatcaaaattgaaaagcagcagccagagaagtaagaaaaacatggcacaaacagctgcaagcaaggaaagaatgtgtttcaggtaggatgtaatcaacaccaacaaaattatcagagcggtgaggcctgagaagcacccactgaacctaacaataaggtggttccatgtgacttggtataaatttcagggaagtggtggggacagaaaaaagccagaaccaatggtttgaatagtgactgagaggtgagaaaacagaacaggcattcgcacctttctatggtccagttatacacagtaaatgaaacacaaagatcatggaatattcaggttagtcagagcaccgtggccttgctaatacagcatctgattaaagttagcccaaggaaaaagaactgaggattcaaaattggaatgtctggtctcccagaaaaatctggggactttgtctaacttttaccaaatgacttattcgtatctcagtttctgggggaactgatatgtcccaattttctcacaatattgtttcgagtatcaaatgttaattgtcaggaaataactttgcaaggttaaaaactagtttgtagaggaagtaataatgagttttagggccggccctgattattgcaagtacaactttaacaaggggaagaaaagacattttttccctcttttcactcaaacaagaggggaacatcagcagagaacatatgccagcttcaaataaatgattgtacagttcccagtggcttcaagaaaatggcattagttctaccttgacattcaggcacttggatgacacaagaggcacttggctttttggaaaataagtccttctgtgggatgatactcttcagcatgagaggcaatagtggaaagtgcatcggttatagaatccagtcaccctggaatggaatatgtgctctgccaatatgagtcatctgatttaaagtgagttacttaacctacctaaggttgagtttcctcaagggaataacaagagtgtttactccatgggatcaggaggtttaacagaatggtgtataaagaagaactgagcaggatgcctggaacacaagaagtgctccgtaattgttagtaaatattcttactaggacaggacctgtttcctctgccacagtaaaggccctacccacaacatttacttaaacagcgttcatcccaagactagagacagagccagtgtctagctgttcatgctaatgtgtaggtgaagtaaccgaataatatacttacgttctggggaactctgctcctgaagaaaactgtagagcattatgatttaacattcaaactctattacctggtaccatcatagcatgcatctcttaacataagggactgcatgttttatagaacatatgatgaatatttatataaagcaggaacttttgccaagctcagaatcggtgtactgattttactgttcgctgaagttcgggctaactttctgtttccctgtcgctgaagagatacatctctcacttcttccagttagactaaaataatgctcattctcttatctgttttctatccaacagggttcagctaaatgcagagggtcctggattcttcggcttgcaaaacccatatagaggtccatacagatttagaagtagatctcaatttaaaaccgcaattctatccatttctggaagtattatatggttccccaaacattcacatttcagtggtgatgccaatctggggcaaaaataataaaataaagccaacttctaaatgtagcatcagaagtcctctggaagggaggtaataatttcaatgcacattgaagtactcaaattattttattagtctctactcctaaggtttacattttcaagaatttactaccagtgtttggagaaagggaagtggaggtaaactgtaaaagcctctctgaaggtgagtcaccatggaaaccaagactgaaatcaaaggcactggactgacttatttctcactgatcttttttttcattaattcttgctgtcttttcatggctgtgctttcttcttttagttgacagacgcttgggtgttcagatcatcaatggaagacaattttgttaaggataatgtagctatatcgagtaacatactattatgatgataataactatgcattgagcacataatttgagccaggcccaatgctaagtattttacatacattgtcttttgtattacgtattattggaagcaatataggtaatggaaaaaagtcttatatctttattgagttggcacgtataacatactgaatatataagtgcccgaaatatgttaaatgctcaataaatgttaatattgttcttattttctagtccaaaaaactgtcctatgagtaaggctctttttttctcaatttacggatgtgaaaactaaggattacaaaaagagggtaagtcacttggctgtgatttcccaggtggtaaacaagagaattagaatttcagcgcaagcttgcctgactccagaagccagattgtaaaccattatgctgtattctctaagatagttagaggtctaagaagctcaccaaataaattggttacaattatggtttattttttaattaggttcaaagaactaaagacttagaggcattatcaatgctcacttgatttttttctctagctattcaattagttatttaaagaaaaaaagtcaaggtgttaaatatttggccttggagggcataatgctacatttcaggttcacctttaatctagactcaacagatttttgtttttattctccttaaacttcaggccaggaaaaacaacagagtatctttagaaagagacggaagccaaattaaacaaggctccattctgaatgttttctatgctcccaaatcctatcaacacaaaggtaattcgatgaaaggttcatttctttataaaataaatctcaaggctactgaaacagacaattgggaataatttgagaataaattaattagttttgattacaaacaggaatctactgttatataaagttggaaatgggaaaattctgaaaattacctagttttttagatagcctagagtttagtaacattctttttttaaaataaattgcattgtaaatgaccctaatactagctgtttgcacttagtaatgtgtacatcccttgaggaaacaccacttggaatacaagtaacttgcaaacccattaccagccacattaaattgccttcattagatgttgcttttcttttcctgaggatcactgatccttctcaacttcaggccttattttccatttctatttatattcctatttttctcccccaatccctactaccaccaaaaggaattcacttttctcaaaaaaaaaaaaaaagaatcaaaagtatattaaatttaaagaaaacacctttaaacaattattatggttgaaaagtaataggtttttatgactagaaagcagaaaactaagtccctgcccctcaatatatcccaagataagaataaatcatggaaagcataacagctgcaaatctcccacccagatgagagaacaaccctagggaacatccctagagagaaagatctatcccaattatggaaagttcacctgataactgtgtgagaaagctcaaactgcctcctagcagcactgtcttacctatagttaagagtcagtgattctgttgaagtacttggctcggctcacctactcttccctccttgcttcaactcattccccaacacctatgcacaaaccactttctccagtgttgtgcagttaagaatgcaattgcttcagaggcatcataagggaagatttccattctaaaccgccagaagagacagtggattcattggccgaaaacttctagcataaaagtgagaaatgaactgaaaggtttcatactagacatgcctgaagtctatccatagaagaaagtactattgttgctcaaaatatagtcccttaaaaaaattcattatatatgaaacaataaaagaaaatttcatcctctaaaaaagaattcatgtaattcacatgaaaattcatcacatttggtataagcaagagttcaatcaataaattttttaaaaaccaaaccagataagccaaattgactgagttataacttttccatgaggcatttccaaccccaaaaaatccctcacctttctaaactagtagcagatgttttctagtatccatgtgacaatcatatatggccttgtgatatgttttacaatgtctgctttcgtgattactgcagctttgccttccatagtcacttttcacagtttccatcttatttctttttttttttttttttcgagacggagtcttactttgtcacccaggctggagtgcagtggcgccatctcggctcactgcaagctctgcctcccgggttcacgccattctcctgcctcagcctcctgagtagctgggactacaggcacccaccactactcccggctaattttttgtatttttagtagagatggggtttcaccatgttaaccaggatggtctcgatctcctgaccttgtgatctgcccccctcagcctcccaaagtgctgggattacaggcgttagccaccgcgcccagcctccatcttatttcttaattataaggtctctgaggacaaagacaagtcatcatcatcgtagcctccacagctctagtaccatttccttaatgtgactaagcaatgtaaccagataggcagtcgatgactagtaacttctccctgtagttcaaaatctaaggtcatggttgctctagctagagaaagtatggttttctagattgtaattcaaaaaatgcactatagcatagtgtgtaagactgcctgaggttctaccacttacttcgtgacgttggtccagttacttaacctctctgtgccacatttttcttacacataaaatgaagataataatgggacctttatcatagagttggtatgagtatgaaacatgataatacaaataaattggttaagggagtaatgccacacagtaaaagattaataaatcctagctataattattacattacatataaaagggttcatatgactcctagaatagtgggtaaagatgtgattttgggagttagatatgaaaggaatgaaaagcattttcctaatggatcccaatcacacctggcatcaaggcaaactaagctcttgacatcacagtcaaatgaattacgaatgtccctcattttcccaaagccttgaaatacaatcaacacactgtacacaatcaacttatgtgagagtgatctaatagatcagaatggggccattgtcttggaggattcttaacaagagacctaggtaacctcaccctctgtcctgcccttccagtttctcacctgaacaagcaggttagaaggcattcctagaaggtttacccccaccatttctcagcacataaaggggaaaaaaaaaaaagaacaaatgttctttatctcttctgtccatagtcagtgcttcccagaaacaccctcatctaacccatcattacccccaccccaggaaaaagtgcagtagatgacaacaggcaatgcaaaaaacatgtttgcagtatccacacacatacatacactcctttttgctacataccactagcctggccatccattaatatgagcccggagttattctttctccttctggcatcacagggtcagaagataatgaaggaagagatctagcaatacttaaataaataatgattacaggcaaaatattgaaatagaaaaggcttatctttggggccttttgcatactcttcagccatgcctgctcttcttgaagtctctgaaggcagagcctttatattaccttctgagtttctccaaattcaagtggtccttacatctcatgaaatccactgcagatggctccttagctcccaccttgacccactccaatacattccacactctcatgtcagattaatgttctgaaaacacaggtcttatctcacattggtttttaaacacatttattcctagtgttccattattgaaacactaagcatgtgggagttatttatatcccactgctcaaggtcattgccaaggtctgattgcaaaaattcaaaaaattgcaacctcaggcataaatgggttagttccttaatcaggcatatcactgtttcgtgcattataattatatgtgcatatgtcatgtctcctccaatagactgtaaagtcatgtgaggactcaaattatcaaactcatcttaaaccatcttcacccatctattcaaaaaaattataatgaatacatgttataaaccaggcactacactagtctctagagagaggagtcagaccatgcccttcaacttgttaaaaatcttttggagggtagagagaggcagcaggggttatagccacataagcagaaaactgtaatacatataaaataatttacatgttataatataattgcaatatataatatgttataattgcacaagcaccaagaaatacaggattgcattgaagggacttcgactacactcttgagaagatcaagaaaggcttctcagaagaagtaatgtctaaactgataccagagcataatcaggtatttctagagaaccaggcagtgtaaatggtccattaagattggaactgtgacaaaggatacggtttaagaaacatacagggaccaaatcagaaaaggactttgaagccactctaagtgtttgtagtttatctaaaagtcactgaattgtttaacaggatgaatgatatgatcagatttgtatttttaaataaccattcaaattagagtgcagcagtcatttaaaatgtctgctgaacacaggaatagaagtgacatcagcatggtaaaaaatatttcaggaattcagaaaatagagaaatcagtaaatcagtgctggctgtgataccccagaaaggttttatggtgaagtttaactgggcttaagagagtagattttcacagggcaattcaaggaaaagaagaacatttcagtcaaaggcaggaaaggtccaaggaagataatgagttaagaagtggttgagcaaaagcttatgggaatccatagagcagtgagtagtttagtttagtgggtgctaggtctggagaggtaggttgacacaggaggatcaggccttaaatgctaggctcaagatttagagtttgccagctgagacagttcatggaggctttttgaaagagtgttgctttgagaagactgaatatgaactgaaaaaggttaaaaacagaacttggttaccagtagaaatgtgagaagaaaaaaactatgtgcactacaggagatgggctgcaagatatatatcaaaaaatatatatcagaagaagaaattctgaatggaggcatttccagcagctcagtgtgataatttagaaaataggatcttccttttatcaggctgtttaaccactatctacacataagaacttgaaaatacagtgtttgaaagaggaaatgaggaaaaggaacatttgaagaatgagaaaggaacagctgaacaaacaaaaggcagcactgaggccattcttaaatgtcctagattaataacccaggggtatccagatatttggggcttccctgtgtattctaggaactcccctcaatagatcagacctttatccagaaatgagggccccagagacctatttggctaaaagggctccctcttctttgttgttttggtcactgcttctacctaactcttcgcactgtcagtagctataagaagcaaaactattggctcaattgttctactgtctacagtttgaactctgacctctttgatatcccaaagcaacaagctaatttagtagtccttacttaaggatacgaagaaaaatatttagaaaaccttccaaaattgtctaacaaatctccagagttcattagtctattacctgagaaaagctgacctaataaatatcacagccctcaaccaaaagaacaatgttatttgaaaactaaatcttgtagaagattcaataaattcctggaccttgaaacaaattttatcttcttagcctttttcaaagccaaaaaccagtgtctcacaatagacatgtgcattgtttattccaccctgtgaggaaactgaagttgtattcctcagggtatgtaagcattaatgaccctaaaattttactccagaattgggtggtttcacactggagcatacatgaatgttgtgggctcaagtccatcacttaccagcaaatcaatggattcttttagattggtatttcatttgtcatcatttaaccaatgattattgtcatcattaggactttttagaacatcaggcaaggtaccgtggctcatgcctgtaatcccagcactttgggagaccgaggccggcggatcacctgaggtcgggagtttgagaccagactgaccaacagggagaaacctcatctctactaaaaatacaaattagcccggtgtggtggcacacgcctgtaatcccagctacctggaaggctgaggcaggagaattgcttgaacccagagggggaggttgtggtgaactgagatcgtgccattgcactccagcctgagcaacaagagtaaaactcagtctcaaaaaaaaagcaagaacatcaaagagatgtttgttaggcttattaagtggtaaattttccttggcttccttttctttccaaggtaattatgggcttcttcctgtctctttttgatgcccacagaggccataatgagggcagttaaatatgcaaacatgagaatgagaaaacaggtgtcaagatacatataattttacctattgagacatcctgcctgctaataaacagagaatcgtattactggtacacttaaccaattttcctaaataatttaggcatgttttccaatgtctttgcaaaggtgatgtggggaggtcttttgcccctttaaaattcatcaacacctccagacactgcaagataaggaggtcatgcaagtcaaaacaatgtgtgggctacagatatgcagcttcaagtcaatcctctaaacttctttccaagcacgtgaccatacctacctggaaatactggagtcagctcagttgtttcccctatttgataagaaaagaatgcaactagccagcaaacactttattttcttaaatattagcataatttgtgggcatttccatttttccaacacatcatttctcagatattaccccagataaaataccatgcccagaactggaattatagacaatttactaaagaacatgcataaggggaccacaaaacccttctagatcaaagagagaccacctctgacatgccatggcatcagaaagttctacttttcttaagagccatatactttaattgtggtaagatatttctaacaaaaagatcaatctacgtataatgttattaacatggaatttatttgattacagtttccctaactgtaatctaaagtcatattcattaggaaacgccaaatttccaagagcagagtataatatgcagcatttcccaaacatcttggaccccaaaaacttcttgtaacaaactaacatcgtccaaaaatgacaaacgatatggaaaataccgtattctaccctccaatatcagctgtcagtgggacaggagtaaaggaaaacaagtcaaagcactgagttaactgagttttaaaagacggagagcagttttggaaggatgcagaaactacactttgtctacttaacaattttaagaactacccaatcacagagtatttattatagaaataattaggaataatttgattttatgtttacaaagaggtatgatgtttaactgctcctacgtagtttgaagcttgttcttaaacccaaggtattgccaaatgcctagtagtaccctgtttattactgaaaaaatttttttaatcattttggataaatactagaatcaaatatttgacctgacatatgacaaggaactaacaatataagcctagtctaccaccatctggatgaccaaattagaatcttagtctcaaggccgcccctgtttcagccctgaatgcctcatgtaatgtacacaggagccagaactacattatatctcgttttcaaatagcactggttacgcaccgggcaactgttaaccagggtggcatgtgataatcttccttgctaaccttgtaggaagtgtgcgagccgttatctttctggcaagatttaagtaactcattcctatctaaaaagcatctgttaaagtggcgtcacaccctcaactacttcataaagttttctataaaatgttaaaatcaccagagtcggacctctcagttcatcaggcgtaaaactgcagtttccggctgccaaatcccttaacaacgttaaccttttaatccttcagcctcgtctagtgaaaagcaagtgtcaccagataccgccttctacttgagaaatataacaagattctttctcctgcacttttcccaaataaaaacggctcatatacaaagtgaagtctagggacacccacagtacggagggctgcccggacctggcggccttacctggttgaagtgcagctggccaggctccgggacgcccacgcgggaggcggctcccatctgctccagcaagtgctggagctgcgccgccgacaggctcagattcgcgccgaacacgctcagcacatcctcgctgaaggctagccctggcccctccgccactcctccgaggccggcggccgccagcaacaggagcccggccaccgcgcgacccggggccatcctggcctgggcttccccttgagggcccgcgacgggctgccgcgcagagggacgcgcgcgggcgcactggcgtccttgcccaagggcgggagcgtcagtgctcggcgctgctccgagtcagaggtggcgcgggacgcccctggttctccgacgccttcgaaagaacagcagctcgcgacctgcggggcattgaagtggcagcgtagccgaggggagcgataggcggagtgggccccccggcctcctggagagcctgagataaagaggacaaagggggacagagataaaggccaccagggcaccagccggcaggctccagaaacgctgcgtggcagtagccctcaaacgcccggccgggcatggggccagacgccccggatccgggtttgcaaacgccccaggatttgcgtacatatgctcctcccggatataaagccccaaaccacgccacttcttaggaaaaactaaaaccacactaactgtagaactccacctcctcttcctgtctttctgctttattctctccgccgcaaacttagaagtgagacgtgcagtccccaaggagctgcagaaaagggctcttccggagtcctggggattgcgcgtttaaaggggaccctccctctccccggatcttctctgagcttggcaagttaatcggaagcactcgctggcctctcacctctcctatctgtttgtttgtctgtctctgcgtctttctctctgcgtgtcaacgtaagactcggtctctggatctctctctctttctgtctcccgcccccacaacctctgtatctctgacaggtccgcggtgaaactccgcgatccgctccggcgctctttacaaataaggggaggagggccctgtccccgcctccgtagcacgtggtgacccatttccccagcctgaactcccgcgcgcgtccacgccggggcgcaggaccgccggccttccctccgcgggcgctgctcattcccagcatcagccatgccctcttccccaccctcactcctgagggttacctgatgccacctccgtgtcggggtccctaactcctctctggtctcggggacgcatgcatcttttcgtgatcttgatgaaaccaacttgctgaaatggagcctggagacccttgcattgtctacataattaacaggaattgcttttttttctcacttcttaaaatcagaggagaaagaggaaatccaatggtagcggtggcgggctagctgagccagcactgcccaagccggcccttcctggcgggatatccgcagatcagaggaatgtttatttgttcatatgggagctcaagaaaagctgacttaggtgtgatgtcaacaggtttgtgtaaagtgagtgtggtgtttgaggcaaagtttgtatctggtggatatagtggttcaagtgtaaagtgaaaccatgcttcactgttagatggctgtgaaaggaaaataaatcttgagacttcaaaatcaccaagctaaagggaaacatcaagaagggaccagcttagggcaaacctgcctgccattctattcaaattcatccctctgaggctcacctgagacaaatgcatatctgattgctttctcttctccatcgtttatgcaaaaaatgcagattcactgggccagactaaactgtctattgagtggaaggctgatcatggcctcaaaagaatgcaaccttttgtctcttgtctattatacttctaacctggaagcccccacttccaattgtctcaccttactggactgaaccaatgtacatcttacacatattgattgatgtctcatgtctctctaaaatatataaaagcaaactgtacccccgaccaccttgggcacatgtctcaggacttcctgaggctgtgtcaggggcacatccttaaccttgccaaaataaactttctaaattgactgagacctgtctcagacattttgcattcacgtgactaaggacaataaaaagaatacaagatgccgttcttgcctttcatcaggagaatgcacagcctcctaaaatagcacattttaaagagacattaagtctagacaaaggggaaaagatggggaaagggaaaaaatcttaatcttagaagaggaacctaaagacataactgcagaagaaagagacaggtagagaacattcccagaggctaaggatctaggcagacgaagctgaaggattgtcatatggaagaaggtttaactatattatatctaacttcagaggacagaaggcagcagtcatggggcaaagtcacccagaggaaggtttctgtggaattataaggcatggctgccttggaagatagtgatttctccatgatcaaaagtgattcaaatcaacagatcctgggtgaccgcctttagtaggtggtaggaggattcatgcctgaagggagatgaactaaatgatcttaatactgtgctctttccaattataaaatctacgtatttgttaataataatttacagaattatgttgatgctaaaagggcaaatatttcatctaagggccagaagtaagttaatatcacagttgtcctcttaaatcactcagctcgtgggactcttcaagcctttcattggattttaaaatatagtttgttgcctatttttcctttggacctccgtgatgcaaaatgatttttggaaattaatgaatgctctaaatggctaatctatacccagcaagttgtttatttccagcttttctaaaactaaatttgtccataaagtgttagattttaacaaatataaaaggtttttaaaaatacaaatcttggctgggcactgtggctcacgcctgtaatctcagcactttgggagaataaggtgggcagatagcttgagatcaggagttcagaccaacctggccaacatgtaaaaaccctgtgtctactaaaagtacaaaaattagccaggcatggtggcgcacgcttgtaatccttgctactcgggaggctgaggcatgaaaatcgcttgaacctaggagacagaggttgcagtgagccaagatcaggacactgcactccaacctgggtgacagagtgagactctgcctcaaaaaagaaaataatacaaatacaaatacaaatcttacattgtgggatttttagaatatataatttatctatttatcagtcattcatgtctatgcacatacatttcgccagcccatcaagtccacaaaataagaaacagtaaaataaatgaccaacctgcatgccaactttactaagcccagttaacataatgcaattaagagaaagtgttcagaaaatttcaggttactaactaccaaataggtaaggctaatttctagatcatccagtctaataaactataatcaccaaagaactacaggttaggcatctctaattcaaaaattccaaatccaaaatactgcaaaatatgaaactttttgagtgctgaaatgacaccaatggaaaattctacacctgacctcatttgacaggtgcacaaaattattggaaatattatatagaattactttcagcctatgtttatagggtgtatatgaaacataaatgaattttgtgtttagacttgggtcccatccccaaaatatctcattttatatatatgtaaatattcagaaatctttaataatccaaatttgaaacacttctggtcccaagcatttcaaatcaactcataaccaaataatgtttcatttatttatttatttattttttaagaggcaggatctcactatgttgctcaagctaggacgcagtggctattcacaggcacaatccaactattgaccaccacggagttttgacctactccattcagacctgagccagttcacacctcctcagacaacctggtggtccccagtcaccaccaccccacatctgaaggtcatcatattgatgccaaacttagtgactggcacagcccactacatcccagagctcctgggctcgagtgatcctcccacctcagcctcctcaacagctgggattacaggcctgtgccactgcacctagccagataaattttagggtccaaattctataagtcatattattacaaaagaaaaacacttcccatttaaaatataatgtataatgtataaaatatatttttcttagaaatttgccttaaaggtcgaatacttttaaatgataatgagggtagcatgccaagtacactggccaggatgttgaaaaatgtcacgtttctgactcaggcacttgggaaacctgggaaactcatttgacctcaccaggatgaattcccttgtctgtaaaacaagataattgggacagaagaatatcaagtctccattccagcctttttatttctaagtgtctaatttggaagtcacttatcagaacaaaacatgaaacccctaaaaaagaaataagacttcacttccccaagtgaaaggacagttaacttcaaatcttactttctctaatgatttcagttttttctcagttcagatcttttgtgactatcgcaaatataaagcaaactggcctcttgtaaacattttcatgcatgcattttctctgtggaaggactaataaggaaatctaaaagatgacacacccctttctcttcttcccttctcttccttgccatccagcctggaagtcgttaggtggagtatagcagtgtctgtgtggaggggagccatagtggcccaaagaggggtgttggagcttgaacaagaaaaaaaggatatctaagtaggagagaacatagcatggacagtaggagcccaagcagggtcctgaaggtgtccagatttgggaagagacatgggaaatcagagctgcatcactaatgggataagggtgtatgtgtgtgcacaagcactgactatcaaacccaagtatgatcagcagagcatccttcccagcatgatctgtcagagcccaagctggaagagtagggtgcccaccaaagtagtggccaggtgttgggtgccagagactgagcacagctaggaagcatccatggatctaggggagagagaaagagtcagccagtgtggagagtcagagcctgagaaggtgatgaaggcagtcaggcctgaggtggtcataacagaatgtcagagatgggcaagggggaggaaggtgaccctgaagagcagtagcatgaggtatcggagtctgtgcagtgaggatggcagcctggcacggtgtgtcagaacccaaagaggataaggaaggaatcagtggggaagaggatggcagcagaaatacattagttatacataaggggattcattaaataagtaaatatattagattataatagccagttttctcgttatcacagaagggagttgcaaatatggagagggagaaaactagaatgaacgaaccctctggtcttaggttggaattggagagatcagtatcaattcatggtttgcggtgtagaaacagatatatatatatatatatatatatatatatatatagagagagagagagagagagagagagagagagagagagagagagagagagagagagttatgaataattaccagctctgtccactgacagggtctgagaacaatgacactaatagcaaagagcataactagggcactgagcttggcttctaaatattactatcctctactaaacagaaccagagccccttagaaaaagggctgattccagaagcagacaaagaacaggatgaacctggaatatcaccttgtgcttgaaagcaagggaatggtccaaaaatgcagaaatgcatgttacattattccaggataacatgagattagcaacttactctaaaatggatcagaaggaataaaagtatttttactgtgctggccacttttctgtaagtacctcataattttaaaatttaaacattgaatactaatgaggaaaggagaacgttcctgcaacaaattacattaaaattaaatctaaaattttacaaaaagtataattttctgtgaaattaatttactcactaatacatatttttagcgtttgcatcacagtccattgtgtctggaatacaagaatgagaagatactccttcttttactcttaagtagcttgtagttacaggttggaggaaggtgaaagatggttgctgtaatgaagacttttaaatgttgcggtggagatagataggagcactagtgtctgcagatgatagtgagcacatagtttacagagtaggtaatccctgagctttaaggataagtagaagtttgacagaaagacaaaaaaaaatggaagaacattccaagacaagaaaatgcaaaataaaatgcttgagaggcctgagagaataaagagaactgcaaggggtttcttggaattggagaatctggaatagaaaggcagcatctggcagaatcaggaaaagtctcaaagttccaagtctttgtctaatgatgtccccaaagattccttatgatcatctgaggcaacaacaacaaaatctcttcagtgaatttaaacctctttatcctgtattatcagtatcaatatttagtcctcattattacaaataagccatacctaaaatgctcaaataagaccaagataatgattctatctggaccatctatgtctattcagccatccataccagagacagtagaggtaggaatcagatttctgcaaggcccctcttaacttaattcctaatctctaaaatggggattaaaataatacctgctcaatttacctcactgaataattgtgaaaatcagatgtgataaagtatgtgaaatctctttatcaactctaaagcagaatgcaggtgttaatatatgctggaatggtagggtaacgtgacccgtgtaataggcctagcaaagggccaatgggaaatggacaagaacaaccaagaatatctcaggacaaagactactttataccttacaaaactcaggttttttcctaggaaattgaagtgctaatcggaaatggaaagatccataaattacaccaagtctaatcttgtcatttaggggataaggaaaagaatgctcaggagagttaagcagtatggccaagtaacatatttagaccggaacagaagcccaaacttgtctttttccatttcaccacgacaaaataaacaccagtcaatgtttcaaggataacacccttatgacttcaatgtgattgagaaagtgaaattggaaattatactaacctatgttcttcctagttcttcttcttcatcccttttcttcaattattttctaatgaaccagtgtccccaccctttatgctgctgtttcacctgagctcacccagcattatctcagcatggtttttatgctttataattctacaaattttaaaattattattagaatgttgggaaattttatatatactaacatggaaatatactgagtaaattaattaaaaaaaatgaggcagaacacgttttaaaacaatgaaacagctgcgcacatgcgtgtttgtgtgtacattaacaaagttctgaggaatatgtgccaagttgtttacaatgttttccttttaagaagtaaatgtaagaagtaggtctgaggacaggtgattcaaagggggaagaacaatacctttctctgtggagaaaaatgtgttgttttcctttatatcctcctttttttttttgagacagagtctcactctgtcgcccaggctggagtgcagtgggcacgatctcggctcactgtgacctccgcctcccaggttcaagcaatcctcctgcctcagcctcccaagtagctgggactacaggcgtatgccactatgcccagctaatttttgtatttttagtggagacggggtttcaccatgttggctaggctggtcttgaacccctgacttcaggtgatccacccgcctcagcctcccaaagtgttgggattataggtgtgagccaccgcacccggcctgtacttaacattttttcaaaaggcatgttttacttaaaggaataaaaagttatcaaaatgtagatgatggaaaaagtttgagtagactctaaatggggacagagagaataaggctcagtaaattgtctccctgtacctgatgagaagaaagtcctgagcagcaaacaggaagaccccatgctgcgtggctggcatgcttctttatcaccgaaagctaaccaaaaagcagagatttatttaaaataaatgtcttacgaagcccagaaaagcatccaactcctttcactctgaattctcaataacgccaagtctttgatgcagcatggggtaagctgaacagcaggcatgaataattctccacgagagtacttcccatatgtccactctcccaactcttaaggatcagagtccgaaagcctgactgaaattgagctgctgggaaatgtaatcatgtgagaacaattaaaaattttgctttcaagataagagcttagtacaaagcctagccttagacaaacttatgaaatgaaactatgacaaggaactcttctcccctgggttctcaaccccttagtaccaggaacctacagcctcttctcttccctttcttccctttccttcttttccttcaaatctcctaacctcagaaactttatgcatgctaaaaatattaaaaattaagaacaaaaaatgataactgatcaagctctatttgcattttttcattttttatttttgttaatgatatccttggtttacataatttgcaaatagctttaacttaagaatttaagtgagactattggaaatttaaaaagcaaacagaaaaagtcttctcttttcagtatatgcactactaagagcttaaatccatataagaattttcttgattagtttcagtattttccagatatttattcacatcacattcttgctgcagaacacctttgtgaaatgacatgtttactctcactgttattaggtactcatctgtaacttgtggttaaatcataaagccctgtttaaaagaggtttatgttctctaaggaatgagcatcaactatcctaacccaaggtttcctggcagcacagtgctgtggaaagaacaatgaaataagaatgaagatttgagttctgattctaactgaaacaatgtgaacagctttgtaatattcatagtttgagtctcttaacaattctgtgtatctcaggaggttattacaagaattagttaagataacataaatcaaagcattttataagctatatattcaagaaaatctaaaatttcaaactggccaaaccaggttgagaagtcattttgaacatgatttacagcattgtgacactacttgctcgtctgtacgcacataacaacaccaaacaagccaggtagcacatcctctctagaatggaaaattagttctctgcaggtctagggaacctactgcagacaacactgctctctctctttttttttttaaacctgtgtggaatttttcattttaccatggactgttttaatgttttccagttctatttcctgttctgatacttttggttggtacacttcaggaagagaaaaaatttgggggggcacaaacaaatgacaaaccaatatttggtacctgtggttttacatttatatataagccattcttgtattcaagccttaatgaggatcaatgcacttgaaataaagtatgatttacacaaaaataaactaaaactaaggatagattttacaggaaaagataatggtttaaatacacaagaaacttgcaatccaaaaataataaatcctaatatcctaagaaccataaagaaatgttcaatttgtatttgagacagaagaaacatttgcaagacatgaagtctggtgccatggaaaaattgacagatttactaatgtccaatgatttttatgttccaggccctaattcttgcagacttacaaagtctgcaaacactacactttgccttctttggtaaatgtgtatttctcaaagtgtgtgggcaacatatggaccttgtatgtcttctatgaaccctacaatccagtcattaattcaagttaatcaaaacatgtttattatctttctaaaaatgaaaaatatgctttccactgcagttttgaaactaatttagatttgaaacaattttttgatgttaaaagaagtgcaaaaccttacttagacaaaagctcatgagtctttttaaggttaacaacaaacaggcataagtaggtgctctgctttgttccaaagtcccatttgcctaatcacctacatttctctcatctaaaagaagaataaattgctacgatggagttaattccagcaaaatagggagttcatatggattcgttttcaatattttattatttctcatttgtgaatttgagggggaaagagaggaagaaataaggagggtagaagagattttctataacaggataagtttgacaatatgtttcacatattgaattaagttctttcctttgacatttctcatttgttttctcattaaaggtgtaatcacatgttcaaactgtaattttcaaacttttattttcaaactaccttgagggcttattatatatttgaactgtaatcctactgctgtaaaaacaagaactaagtaagcaaaccctatatttagcaggaaaagaaattccccaaggccagaattattatgctccataaaacttgccaactgcaactgcaactgcaccctcccacatgtaaagggaaaatttagactaaaacattaaaatccaaatgagtaagatataataggtgacctaataaattctggatagctaccacattacagagttttcatctaaaatatttcatagggatagtaattaagttagagagttttaatctaaaatattactaaatgtctaaataaactttaaatatttaatctaaaataaaatcaccaaaaatttttcttatgagtatctaaaacaggaataaaatgcaacttctccaagttgtttcttcctacttagactactgagatttaatacaaagaaaacttttaccaatgttatgtcaaagttttcaatctttaaaatgcaaaattatgtcttttaggtcactgcctgttttgttctgtatcattttctgattccaggatttgaatctttaaaaatactcagaaaaatcttggaacaaacatggagccaaaataaatttgccatccagagagtaggacagaaagtcaaagccgataagctcaaatgtcctttctgctcttttatcttaagagaagcctgtaagtcctccatcttagccaatgctggagagtaagattagaaaaatgggactagaaaaggaatgtttagcattactgtctgcaaacaccacacctggcctgtgtgataggtacagaactgaagaatggagttgggcatcatcacagaccaaatcatatcaaacccgtttgcagagttagttcagagatgcctgggttttaagataaatagagaatgtttatcactgttttttttttaactcacctatgtccctgttgacactgtagaactcaatgtttatgactatagaaacaataccatcaacaaaaataatatctataattatcctctctaatccgcagttattatgatgacataatcactccggagaaattaggtctatgggatagacctgatggaagcctattttgaagataacagtattctcactataccattcagattaacatgtcatcggctaacggccatcattttcttacagatgttcatttccttgtataacctttgcttgacttgttatctgacatttcaattctggtatgtgaatatgtagaaaattaatttattgccttaaccagacaagaacactttgcatatagtgtgtattcttaagtattaggagtgaatttaaatcaaagacaaaatacagaagaacaaatttgttttaaaatgtcgattcatttaaaacaaaagtcaaagttaaaaatcataagcaatacatatttcaaatttataatcttcttttgatataaatattgatagagatgatcaagaccattacctattaataagctgatctacatttgagaaacaaacaaacaaaagaatgcctactgactgggcttcttgccaagagcccaggttaaagtacaaagagactgcagtgtttgatcagcctatgaagtttgttatgaagaacctaggtgtgcttggtcacagtgtatttttaccttcaattattttaaaattgttaaaatacttgcttttttattttttaattgttctttaatctatatcctaaatatttctttttaaaaagttgtaaaactctatgattctcaactttgtactgactacataacaaccttcaaaggacctgttcacgtgactgtgcgctagtagcctctggcctatgacgtgagcttatttaatatttagatagtataagtatatatggaaaaagaggcattttttggccagggaatgccattagaaatgttgtgaggattaaagtagatagtatatataaagtgtctagcataaagccacatagcagaggctcagtaaatgtaaaatgtataaaagtatgtgcatgtgtatctcaagcatggtgctatgctttcatatacttctttccttttccagtatatcccacaatgccctaaaaggatactaatgatgattaggacattggtctgaatttcatatcagaaacatttgtggccagatgcagtggctcacgcctataatcccaacactttgagagaccgaggctggaggatttcttgagccaggagttctagactagcctgaacaacatagtgagacatcatctctacaaaaagtttttttaaaaaattagccaggcatggtagcacacgtctgtaatcccagctgctgaggaggctgagtggggaggatggcttgagcccaggaagttgaggctgcagtgggctgagattgtatcactacactgcaactttggcaacagagagagatcctatcacaaaaaaagaaaaaaaagataaaggagagaatgaaagaggaaggaaggaaggaagggagggagggagggagggagggaggggagagagagagtgagcagggaggaagggggggagagagagagagaaagaaagaaagaaagagagagagagagaaagaaagaaagagaaagagagagagaaataaagagagaaagaaagagaaagaaaagagagagaaagaaagggaaggaaggaaggaaggaaggaaggaaggaaggaaggaaggaaggaaggaaatgtatttcttctttactaaaaaaatataaacactgaaaagagaaacttttgccatcataaaatctacaacccaaccttatctgaattcttaaactctgccttctgttctattacagcaaatgaattttccatgctttcttgcaagaccagccttccagtggatctcatcctctttcctactcaagttatttgtctccacaattctaaccttctttctcctactatatcatcggctctggactagatcattcccatgagcagaaaatattgtctcttttctcttaaaagttcctttcaccctacatctctgtcaagctactgctctatttgttatgggttgaattgtgtccccaaaaggaagatatgctgaagtcctaaacttcagtaactcagaatgtaaccttgtttggaaatagggttgttgcagatggaattagttaagatgaggtcatcttaactaacagggtgggcccttgatccgatatgactgctgtccttttaagaagatagccatgtgaagacacacagggacacacagggagaacgccatgtgatgacaaagacagagattggattatgcggttgcaagccaagaaatgccaaagattgccagcaaccaccagaagctaggaaaaggcatgtaaagattaccctagaggtttcacgggagcatggcccttgccaacaactgtatttcagacttttagcgtccaaaactgtgtgcgagacagtaaagtcacccagtttgtggcactttgttacagcagccctaggagacttataggtcatcagtttcccactctatactaaattattcccatgagcagaaaacattatctcttatctcttagaagtttccttgaccctacatctctcttaagctactgccttattgttttgcttacttttgatggcaaatttcttgagttacctacaattgctgtatttacttctgctcctcccattctcgaatgcactcattctggtcatgatccctcatcccactctccactccccagaagatagctttgtcaaagtaatttattgtactttatttttctttatgacatgtaatattatatgtttatttttaatgtagctattctctgtttcacttactagactctgtaagttccaaaaagacaggggatagatgtattttttaaccatactccaggccctggtacttcatatatcctcaaagaaaattgatgaaatacatttgcttttagatttttaattacatttagtacataaaatttccatttggatataaacactctttgtttatggatggtaatattttgcaaggattttgttataatttttcaagaatttggaagttactactaatatgaagcatacatgctgtgccagcatacattatcacttatattttatcccaaggtaaattatgatgtctttatattgcaccttccacagctattagaagatactaatcttcacattcatcctatgtattaggaaaaagcggtgtttaacttttaatttacagatttggaaattaagggacttaagaccaaagggcctttctgtgatatctaagtggatatatgataaaatgcaaactgggataagaactttgaactgtcaaatcagtttaatttccactaaaatccctcagcagcaacaccaccttataatttcattggcatgtaagattattatcttaattatattaaatgagaaaaaacaacttcctcctggatattaaagcaatttacagatgaggaatatgaaatcatatattatgcaaatatatgcaataaatgaagatttcttgctcagttcttattctgtgggccagcagaaatttagcacaatgaactgaataaaaagagaaaattaaggagcactgttaaatgtattcataaaatgcagtatctaatttgaagggggctatgatcacattagtctatgatgtgatagtttacagtaatcaccacttatatccacataaatttgtcttttccattttctggttgccttgtttatcggtagtaaacagcagcttaatagcaagataaagcagcatattaaagatactgtaactttgctaactgaaaatatcagggatgaattattacactttcttaaattgctatactttctatcaaggcctccatagaagaagaacactatatgttttattcaagctaccttttggacatgagttaatataacaacagcattttagtcatctatgtgtgtacataataacaataattttattaatacattatgttcatatttccactgaactcatcttttttaaaaggatgtcgtgacaatactgatttcatgaagaaagatttgagaaatttcaatgatgaagtgatattggacttcacaacatagaaattatttaaatatacatttgtatgctcttttatcacatcttacttcaaactttagtttaattcaaacgaacttctctctccctcaaagctctgctcatatccctattactctccaatcatttttcacattacctcctccttccaccctagttacgtggaagtggtgactctacactcatctaagatgaattccgtgtctgagctatggacacttttctcttccactgctgcaagccagtcagctgctctctttccttcctctttagccctttcctcacccacctgcggcttcttcccagcagcacccaaacctatacacctactcggtggtgtcctgaagatgctccttctcccagcacaagttttcaccttcttttcaaacaccaacccataagctcaacaatctcacagtatcttcctctactgggcctctcaggagcactgggcattggctgactactccatccgtcttcaagcagtcctgcccttgacttccaggaagccacactttcccagttttccttccatttttcgtattgttttgttagtgttaaatgctagtcattttaaatgttggtatcccttcaaaccttgttctttccctcattctacacatgcttcttgaacaccttatctattccctttgtgtcgattgctacctgttatgggcttagttgtgtcccatcccccacaaaaaaaaattgctatgctgaattcctaacccccagtacctcagaatgtgactctatttggagataaggcctttaaagaggtaattaaggtaaaatgaagtcacatgggtgggccctaatacagtatgattggcattcttataaaaaggtgaaattcagacacagacacagaggaaagactatgtaaagacagagggagaagatggccatccacaagccagggagagacctgagaagaaatcaatcctgtcagcagcctccagaactggaaggcaatatgtttctgttttttaagccatccagcctgtggtattttgttagggcagccctggaaaactaatacactccctctgattagactgtggctcctaaactcattactgtggtgccagctctgaatgccagactgtatccctctacctactggatgtcaccacatggatgtctcaaaaatatttcaagaattcaatgtatgttggctcatccagttacctgtgccagaaacatggtcactgtattagaccctacttgtaccccacatcatatcctcttagcccacctctaattgtagtttcacttcaagtcattctctcatattttttacctcaggttttctttagaattctaataacctgctcagcagctttcaagcatagaggagttaacatccctggaggcaaccctaaaccaaagagaaatgagagtcagagaagaaaggctcagtcttcagtctttcaaagggtcacttctgaaaagctttcaacatggtttctcagggaattcctacaatatgtgccccagggttttacagcaataaatagttcaataatgcaccctttactggctttcttccttccctgaattagattttctccttccctaacacactctcctcattctgtcactcttatttcttgggatcatctctaaaataaacttcctgcatcccagttattgacacagacttgcttttagggagaaaccacactaagagagtcaatatcattcccttatctttctcctttatataccctctctggccatcaattatcaagccatagtaattctactatggttttcaaattgatctactctctttaagtccactgcctttatcttaagataggctatcatcaactcttaactggataatttgctgtcttctgtctccctgccttgcaaattgtcccttaccaagttattttccatggggaagtcaatgtgtgctttctaaatggactatctaatcctactcactcacagtaaccttcaattatttcccattgtctttaatatgagttccttaatatgatttttgaggtttgtcctaataaagacctagttttcctccacagtcacatctctcaccattcctacttcttacttcatacactaatcacactgagctactctcaggtctctgaccagccatgtggtctgtcacctcaggacctttgcacatgctgcctctttctcttgagatgcacttcttcattcctcatctccacttccagcttcttactacttctagtttagaccgcatttactcttgaaaatcttctcatgttaatttttggttaagtgcccctcctatgtgttcttaaaacattacactgtattttaattacctgtctagatttgtttatgtcatctattcaattagagtatttgaagttttctatttctcattgtgtctaaaatgctccacatattttaggtattcaataaatactgatagaataaatgaattaatgagtaaaataaaaatgttaaataatgttaaattttttaacaacaaaaaaactggcaaacaaattttcaaatcatataaaaagagctgaaggaaaacagaagcaaggtggataaatagaaaccctataaaaatctaggacaaaaaccctatcttcagaaatctttgctatcatcattgccataaccatggatacacgcctactcggatttttttaaatgcattacttagaaagcaattttaaagcttatactataaagcaggcatttttaaatggaaaaattaagtcaatcccatatgttagtctggaatggcattttatggagatggctttaatttatgaactcgcccaatagaactgcaaggtgttgaacagagctagccttcactaagacttaaaagtacataacatctgttccaggcctttgactccataatctctcaccctgacaacaccctttctcctcttcctgcttatgctgcaggtccttgctctgaaatctgaagactcctgagtctgcccactgccacacaccttggtgaatgtaagagtctcaccaggatttcctggtgaatttctcttcccagctatcacccatgtaaacagtatgttattactgacactccctatacttccactttgttggatgcaaacaaatacagcatttgagcggacctgtggggatttcaggtcagctgaagtgaagaggttggtttcccaggaaatctacaggaaatacatggagggcaaggcacagccttgatgaaccttacaaactgctctcagtgagtggttctcatcaaggaagcctcaagatggtgaagaatgcatgttctagctgggaccctgtcagcagcgcattgctaccaccaagttaaagttatttccagcacaaaccagtgttgttttgctcaagagaatgcttaatccctaccagcctcttagcaaccgtgtgccattattctcaagagaaggggcagggcaggaacaatattaccccatcactgaaaaaccctcaagttgcagaacatgctaatgatgagctggtaaaaacattgccatcactaactatatgagaaagccactatagaaatcagttccttaaaaacactgtaagactgcatgattattttgattctcaatttaacaggcaataacttttactacaagtaaactttggtttgattccaaagaatagctaacgagatcatgcaaatttcaaaaatacaattccttcacttattcaacagatatttttggggtgcctagtagacactcttctgtgtactgaagaatcatcgatgaacaaaacaggttgccgggtggtggggaggagaaggggaggggatggttaataggtacaaaaaaataattaaaattaatgaataagtcctagtatctgacagcacaacagggtgactatcgtcaataataatttaattgtacatttaaaaataactagaagaatataattagattgcaacacaaaggataaatgcttgagggagtgaataccccatcttccatgatgtgcatataatattaagtggggagaaaaacacaagaatacaaaactatagaatataatacttgagcttataagaacaattaattgaggcatatataggcaaaaataagctttcagacatagatattgatttaggaaaagaaaagaaaacatagatatacataacagctactagtgttatatttggcatgagattaccaatagtattttttaaagtattttctgcgctttctaaaatttcataatgagtacatcatcggtggcaaattaatactacatcatgtatgtttaaatgcaaaaaacaggataagatgccactttattcatcactgccaaaacttggaggcaaccaagatctccttcagtaggtgaatgtaaaaataaacagtagtataggcatacaatggaatattatacagtagtgtaggcatacaatggaatattataaaaagaaataaactatcgagccacaaaaagacatggaggaatttaagtgcatattgataaatgaaagaagtcaatctgcaagggctacatactgtatgattccaactatgtgaccttccagggaaggcaaaactatggcaacaatcaaacgatcagcagttgccaaaaggccgagaggaggcagggatgcttaataggtacaacacagagcattttaggacagtactactattcagtatacaccgtagtggtggatatatattatatattaccaaaccctgacgtacagcaccaagagcgaagcttaatgtaaacagtgggctttagttaataataatgtatcaatactggctcatcaattgcaacaaatatattgcaataatgcaaaatgttactaagagaaacttgtagagggatacaaggaggtttatggcaactctctgctcatttttctgtcgacctaaaactgttctaaaatagaatttattaattttttaagcaataggctaagatgaactctctcactttgaccttccagtgttataggattcaacccatggataatacaggtttgggccgtaaccccaaaagacacaatcctgaaggccataatcccaaatgttgaaatcccaaaagatcaaaatccttaaaatcccaaaaatcaccatcctgaaaagtcaaaattccaaaaataaaactctggaaaaaataaatttaaaaaattatttaaaagacatttgtttacattttcatttttattacttattattattattatttgagacagagtcactttgtcactcaggctggagtgcagtggctcaatcttggttcactgaaacttctgcctcccggtacaagtgactctcgtgcctcaaactcccagaagtacaggcgcacaccaccatgcccagctaattttttgcatttttagtagagatgggatttcgctatgttggccagactggtctgaaactcctgacctcaagtgatccactcaccttggcctcccaagtgttgtgattataggcatgagccaccgcacccagcctacatttttaaaaggaaacttacttgagaaacacgtaaaaacatagctgaacacttcatatgccactttttgcaataaaatgggcaatgataatgacatatttttgcaagaataaaactcaggtatactaacaacagttgcacaagtgtggcagttataagcagacaaactggccgggcgcagtggctcatgcctgtaatcccaacactttgggaggccgaggtgggtggatcaccggagatcagggtttgagacaagcctgaccaacatggtgaaactctgtctctactaaaaatacaaaaattagctgggcgtggtgctgggcgcctgtaatcccagctactcaggaggctgaggcaggagaatcgcttgaagccaggaggcggaggttgcagtgagctgagatggcaccactacactctagcctgggcaacacagtgagattccatctcaaaaaacaaacagacaaacagacagacagacaaactgtattcataaagaaatatgtcttggggaaaagctaaacgtattccccttgaaagccagaacaagacaggaatgccctctctcatcatttctattcaacatagtattggaagcccaagcaagagaaagaaataaaaggcatccaaataggaagagaggaagtcaaactatccctgtttgcaaacgacatgtttctatatctagaaaccccatagtctcagccccaaagccctttaattgataaacaatttcagcaaagtttcaggatacaaaatgagcatataaaaatcactagcattcctatacattaacaatggccaagccaagaacaaaatcaggaatgtaattccattcacaattgccacaaaaagaataaaatacctaggaatatcattaactagggagatgaaagatctctacaatgagaattacaaacactactcaaagaaatcagagatgatacaaacaaatggaaaaacattccattctcatagataggaagaatcaatatcattaaaatgaccatactgccaaaagcaatttacagattcaatgcaatacctatcaaactaccaatgacattcttcacagaactagaaaaacactattttaaaattcgtatggaaccaaaaaagagccctaatatccaaggcaatcctaagcaaaaagagcaaaccaggaagcatcacatttcccaacttcaaactatactacagggctacagtaaccaaaacagcatggtactggtacaaaaacagatacacaaaccaatgaaacagaatagagaacagagaaataaacctgcacacctacaaccatctgatctttgacaaagctgacaaaaacaagcaatggggaaaagactccctattcagtaaaatggtgctgggataattggctagccatatgcagaagactgaaattggaccccttttttacatcatatacaaaaatcaactcaagatgcattaaagacttgaatgtaaaacccaaaactgaaaaaaccctggaagacaacctaggtgataccattctggacataagaactgcaaagatttcatgacaaagatgccaaaagcaattgcaacaaaagcaaaaattgacaaatgggatctaatcaaacttaagagcttctgtaaagcaaaagaaactatcgacagagtaagcaaacatacagaaacaaacatacagaatgggagaaaatatctgcaaattacgtatctgacaaaggcctaatatccagcatctataagaaacttaaataaattttcaagaaagaaaacaaacatccacataaaaaaagtgggcaaaggacatgaatagacacttttcaaaagaagacatacatgaggccaacaagcatataaaaaaaaacgctcaatatcatgatcattagagaaatgcaaaccaaagccataatgagataccatctcataccagtcagaatgactattattaaacagtcaaaaaataagagatgctggcaaggttgcagagaaaagggaatgcttgtacactattagtgagagtgtaaattagttcaaccattgtagaaagcagtgtagtgattcctcaaagagctaaaaacagaactaccattcaacccaacaatcccattactgggtatatatccaaaagaatataaatcattctgccataaagacacatgcactcgaatgttcacttcaacactactcacaatcgcaaagatatagaatcaacctaaattcccatcaatggtagactggataaagaaaatatggtaaatatataccatgaaatactatgcagccataaaaaacaaacaagctcttgtcttttgccagaatgtagatggagctggagaccattatccttagcaaactaatgcaggaacaggaacaaataccgcatgttctcacttataagtgggagctaaatgagaagaacacatagacacaaaaaggggaacaatagacactggggcctagttgagagtggagccagggtgggaagagggagaggatcagaaaaaaattactactgggtactaggcttagtacctgggtgacaaaataatctgtacaataaacccccatgacacgtgtttatctatataacaaatctgcacacgtacctctgaacataaaataaaagtttattttttaaaaaagaaatatgtcaaaagcaaaatgtataaacccatgtaactatggttggtagttgtgagctcccagctttataactgcagtcatctgaaataccatatcagacaacctaattcttttttatttttttttgagatggagtctcactctgttgcccaggctggagtgcagtggcatgatctcagctcactgcaacctccgttccctgggttcaagtgattctcgtgcctcagcctcctgagtagctgggattacaggtgtgcaccaccacacccggctaacttttgtatttttagtagagatggggtttcaccatgttgatcaggctggtcttgaactcctgacctcgtgatccacccacctctgcctcccaaagtgctgggattacaggcgtgagccaccgtgcctggcccctaacctaattcttttaataagatcaatcaaagaccatgatggggtcatcaccacatatgcagtcacccaaagagttgagagcttgagaattttatctttcacaaatgcagatgtacaaaagggacatctcttcatttactgaggaagtttcaacatttttatatacatacacaatacttacacggaaagaaccttgtgccaatgcacttttgtggagtcaaatttgcaaaaaaaatgcataaaataaattagcactctctaaaagtttttgcacaatttatacctccagtattggaaatgatgcaaagataagatacgtagcatagcaaattgacacaatgtggaagtggcagaagttacatgtgattgaataatttggcagaagagatttcttctgtgttttcacttctatgattgaaatacttgctgcacttgtgtttagagagtggttgtaacctataaattttgtaagtatatgctgtccatttgaaaatctggttattgcttggccattgcaattaaacaattttctactttcacaacaccaataataattaattttcaaacttatatctttcatagttaagtagctttgtacacttaatttatcacagcctttatgcatggggataatttcactgatctcttcctttgtgtttcaagaaatgcagtaagaaggaataatatttggctttcccagtatcgaatctgtgttagggttcaccagagtaacagaaccagtaagatatgtatatagacacatgacagggaatctaatagtggaattggctcatgcaattatggtggctgagaagtccaacagtctgcaagctggagaccctggaatgtgagtaatgtggcttagtccaactcagaaggcctcagaatcaggaaagccaatgttataactttgtctgaggccaaaagtctcagaagctgggagaccactggtgtaagctctggagtccaaaggtcagcaagcctggagttctgatgttcaaggcagaaaaaagtctgtcccaggtcaggcatggtggctcacagctgtaatcccagcactttgggaggccaagacagaaggatcacttgaggtcaggagttcgagaccagcctggccaacatggtgaaactaaaaaatacaaaaattagccggcgtggtggctcatgcctgtaattccagctacttaggaggctgagacatggagaatcgcttgaacctgggaggcggaggttgcggtaagccaagattgaaccactgcattccaccctgagggacagagtaagactctgtctcaaaaaaacaaaaagaaaagtgtctcagctctcagagagagaccaattctccttctatatttgttcactctgtgccccctgccgattagagggtgtccaccagcacagaggaaaggatttccccacctagtccactcagactcacacactcatcttctccagaaacaccttcacacacatacccaaaataatgccctaccaggtttctaggtatcccttaatccattcaagttaacacctaaaattaaatccacaaaacttggcacccatatgcatctccttaaaccatacttaatttccaaataatgacagtaacgaggtaatagttctgcctaacatggtgcaacgagcataatgcatctatcttgcataaaataaaaaacacactaattccttccttagaattcagctttcaggatttaaacatttggaatttaatctttcaggggtataattttcaagattttagttattagcaatttagatattagcgacttttacggatttcaagttttcaggatttcaacatttgggactatgtattttaggattatgattgatactgaacaaaacagtgattcccagatcttggaactttagaaacaataaaattttccttaaaaggttaaggggagaagacaaagagttttccactcctcctttgccaagtaagcacactaaacatacacatgtgtatctgcacacacacacacacatacacacacacatataaccagacaatattccataaaaaagaatctctcttcacagtattccattaaggagaaggacattttatcacataaaaattaagagtatgattttttaaactctttatggctttttttatttagcataattattacacaattcatttttgttgtatgtatcagaagttcactgtttttattgcttaatagtattccattgtttatatccaacaatttgtttatctgggcatcagcaaaagagaccatttaggtttttttctatttttggctgttgcaaatgaaatggttattaacattcatatacaagtctttgtgtggatgcatgctttcttttttgttttttgttttttggataattacctaggagtggaatggcttaattctatagtaagtgtattttattttattttattattttactttaggttctgggatacatgtgcagaatgtgcaggtttgttatataggtttacacgtgccatggtggtttgcttcacctattaacccatcatctaggttttaagtcctgcatgcattaggtatttgtcctaatgctctccctccctttgccccccaccccccgacaggccccagtgtgtgatgttctgctccctgtgtccatgtgttctcattgttcaactaccacttatgagtgaaaatatgcagtgtttggttttctgttcctgtgttagtttgctgagaatgatggtttccagctagacccatgttcctgcaaagacatgaactcatcgttttttatagctgcacagtactccatggtgtatatgtgccacattttccttatccagtctatcattgttgggcattggggttggttccaagtctttgctattgtaaatagtgctgcaataaacatatgtgtgcatgtgtctttaaagtagaatgatgtataatcctttggctatagacacagtaatgggattgctgagtcaaatggtatttctggttctagatctttgaggaatccccacactgtcttccacaatggttgaactagttcacactcccaccaacagcataaaagtgtccctatttctccagcgccttgccagcatctgttgtttcccaattttttagtgatagccattctaactggtgtgagatggtatctcattgtggttttgatttgcatttctctttttttgtttgtttctttgtttgtttgagatggagtctcactctgtcgcccaggctggagtgtagtggcatgatctctgctcactgtaacctccatctcccaggttcatgccattctcctgcctcagcctcctgagtagctgggactactggcacccaccagcacgcccggctaattttttttgtatttttagtagagacagggtttcaccatgttagtcaagattgtctctatctcctgacctcgtgatctgcctgccttggcctcccaaagtgctgggattacaggcgtgagccactacacccggccttgatttgcatttctctaatgaccagtgatgatgagctttttttcatatgtttgttggccacataaatatcttcttctgagaagggtctgttcatatccttccaacactttttgatggggttgtttgatttttcttgtaaatttgtttaagttcctcgtagattctggatattagatctatatcagatggataggttgcaaaaattttctcccattctgtaggttacctgttcactctgatgatagtttattttgctgtgcagaagctctttaattagatcccatttgtcaattttggcttttgttgccattgcttttggtgtcttagtcatgaagtctttgcccatgcctatgttttgaatggtattacctaggttttcttctagggtttttatggttttaggtttaagtctttaatccatcttgagttaatttttgtataaggtgtaaggaaggggtccagttttagttttctgcatatggctagccagttttcccagcaccatttattaagtagggaatcatttccccattgcttgtttttgtcaggtttgttgaagatcagatgattgtaaacgtgtggtgttttgtctgaggcctctgttctgtctcccctttcgtctataagtctgttttggttcctgtaccatgttgttttggttactgtagtcttgtagtatagtttgaagtcaggtagcatgatgcctccagctttgttatttttgcttaggattgtcttggttatacaggctcctttggttccatatgaaatttaaagtagtttttcaaattctgcaaagaaaggcaatggtagcttgatgggaatagcagtgaatctataaattactttgggcagtatggccattttcacgatgatttttcctatccaagagcaggaaattttttccatttgtttgtgtcctctcttatttccttgagcagtggtttgtcattctccttgaagaggtccttcacatcccttgtaatttgtattcctaggtattttattctctttgtagtgattgtgaatgggagttcactcatgatttggctctctgcttgtctattattggtgtataggaatgcttgcgatttttgcacattgattttatatcctgagactttgctgaagttgcttatcagctttaggagttttggggctgagacaaggagttttggggctgagacaatgggtttgtttgtttttgagacgaagttttgctcttgttgcccaggctggagcgcaatggtgcaagcttggcttaccgaaacctctgtctcccgggttctagcaattctcctgcctcagcctcctgtgtagctgggattacaggcaagtgcaaccacgcctggctaattttgtatttttagtagagatggggtttctccatgttgttcagggtggtcttgaactcccaacctcaggtgagccacctgcctcggcctcccaaagtgctgggattgcaggtgtgagccaccatgcccagccaacaatggggttttctaaaatatacaatcatgtcatctgcaaacagagatagtttgacttcctctcttcctatttgattacctttatttctttctcttgcctgattgccctggccggaactcccaatactatgttaaataggagtggtgagagaggccatccttgtcttgtgctggttttcaaagggaatgcttccagcttttgccattcagtataatattggctatgggtttgtcatagatagctcttattatttttagatatgttccatcaatacccagtttattgagagtttttaccatgaagggatgatgaattttatcaaaggccttttctgcatctattgaggaaatcgtgtggtttttgtcattggttctgtttatatgatggattacgtttattgatttgtgtacgttgacccagcattgcatcccagggacgaagccgacttgattgtggtggataagctttttgatgtgctgctggattcagtttgccagtattttattgacgatttttgtgtcgatgttcatcagggatattgacttgaaattttctttttttgttgtgtccctgccaggttttggtatcaggatgactgagaggagttcctctttttctattatttggaatagtttcagaagtaatggcaccagctcctctttgtacctctggtagaattcagctgtaaatccatctggtcctgggatttttttggttggtaggctattaattattgcctcaatttcagaacttgttattggtctattcaaggattcaacttcttcctggtttgctcttgaggggatgtatgtgtccaggaaattattcatttctcctaaattttctagtttatttgcatagaggtgtttatagtattctctgatggtagtttgtacttctctgggatcagtggtgatatctccttcatcattttttgttgtgcctatttgatttttctctttttctttttttttattatactggaagttttagggtacatgtgcacaacgtgcaggttagttacatatgtatacatgtgccatgttggtgtgctgcacccattaattcatcatttaacattaggtatatctcctaatgctatcctgccccctccccccaccccacaacaggccctggtgtgtgatgttccccttcctgtgtccatgtgttctcattgttcaattcccacttatgagtgagaacatgcaatgtttggttttttgtccttgagacactttgctgagaatgatggtttccagcttcatccatgtccctaaaaaggacatgaactcatcattttttatggctgcatagtattccatggtgtatatgtgccacattttcttaatccagtctatcattgttggacatttgggttggttccaagtttttgctattgtgaatagtgccacaataaacataagtgtgcatgtgtctttataacagcatgatttataatcctttgggcatacacccagtaatgggatggctgggtcaaatggtatttctagttctagatccctgaggaatcgccacactgacttccacaatggttgaactagtttacaatcccaccaacagtgtaaaagtgttcctatgtctccacatcctctccagcatctgttgtttcctgactttttaatgatcgccattctaactggtgtgagatggtatctcattgtggttttgatttgcatttctctgatggccagtgatgatgagcattttttcatgggtcttttggctgcataaatatcttcttttgagaagtgtctgttcatatcctttgcccacttgttgatagggttgtttgttttttcttgtaaatttgtttgagttctttgtagattctggatattagccctttgtcagatgagtagattgcaaaaattttctcccattctgtaggtttcctgttcactctgacagtagtttcttttgctgtgcagaagctctttagtttaattagatcccatttgtcaattttggcttttgttgccattgatttcagtgttttagacatgaagtccttgcccatgcctatgtcctgaatggtattgcctaggttttcttctagggtttttatggttttaggtctaacatgtaagtctttaatccatcttgaattaatttttgtataaggtgtaaggaagggatccagtttcagctttctacatatggctagccagttttcccagcatcatttattaaatagggaatcctttccccattgcttgtttttctcaggtttgtcaaagatcagatggttgtagatgtgtggtattatttctgagggctctgttctgttccactggtctatatctctgttttggtaccagtaccatgctgttttggtaccagtaccatgctgttttggttactgttgccttgtagtatagtttgaagtcaggtagcatgatgcctccagctttgttcttttggcttaggattgtcttggcaatgcgggctcttttttggttccatatgaactttaaagtagttttttccaattctgtgaagaaagtcattggtagcttgatggggatggcattgaatctataaattaccttggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttgttttctttgacgcaattgcaagtgggagttcactcatgatttggctctctgtttgtctgttattggtgtataagaatgcctgtgatttttgcacattgattttgtatcctgagactttgctgaaattgcttattagcataaggagattttgggctgagatgatggggttttctagatatacagtcatgtcatctgcaaacagggacaatttgacttcctcttttcctacttaaataccctttatttccttctcccacctgattgccctggccagaacttccaacactgtgttaaataggagtggtgagagagggcatccctgtcttgtgccagttttcaaagggaatgcttccagtttttgcccattcagtatgatattggctgtgggtttgtcatagatagctctcattattttgagatacatgccatcaatacctaatttattgagagtttttagcatgaagggttgttgaattttgtcaaaggccttttctgcatctattgagataatcatatggtttttgtcattggttctgtttatacgctggattacgtttattgatttgtgtatgttgaaccagcctcgcatcccagggatgaagcccacttgatcatggtggataagctttttgatgtgctgctggatttggtttgccagtattttattgaggatttttgcatcgacattcatcagggatattggtctaaaattctctttttttgttgtgtctctgccaggctttggtatcaggatgatgctggcctcataaaatgagttagggaggattccctctttttctgttgattagaatagtttcagaaggaatggtaccagctcctccttgtacctctggtagaattcggctgtgaatccatctggtcctggactttttttggttggtaagctattaattattgcctcaatttcagcacctgttattggtctattcagagattcaactttttcttggtttagccttgggagggtgtatgtgtcaaggaatttatccatttcttctagattttctagtttatttgcatagaggtgtttacagtattctctgatggtagtttgtatttctgtgggatctgtggtgatatccccattatcattttttattgtgtctatttgattcttctctcttttcctctttattagtcttgctagtggtctatcaattttgttgatcttttcaaaaaaccagctcctggattcattgattttttgaagggttttttgtgtctctatttccttgagttctgctctgatcttagttatttcttgccttctgctagcttttgaatgtgtttgctcttgcttttctagttcttttaattgtgatgttagggtgtcaattttggatctttcctgctttctcttataggcatttagtgctataaatttccctctacacactgctttgaatgtgtcccagagattctggtaagttgtgtctttgttctcgttggtttcaaaaaacatctttatttctgccttcattttgttatgtacccagtagtcattcaggagcaggttgttcagtttccatgtagttgagcagttttgagtgagtttcttaatcctgagttctagtttgattgcactgtggtctgagagacagtttgttataatttctattcttttacatttgctgaggagtgctttacttccaactatgtggtcaattttggaataagtgcagtgtggtgctgagaagaatgtatattctgttgatttggggtggagagttctgtagatgtctattaggtctgcttggtgcagagctgagttcaattcctggatatccttgttaactttctgtctcattgatctgtctaatgttgacagtggggtgttaaagtctcccattattattgtgtgggagtctaagtttctttgtaggtctctaaggacttgctttatgaatctgggtgctcctgtattgggtgcatatatatttaggatagttagctcttcttgttgaattgatccctttaccattatgtaatggccttctttgtctcttttgatctttgttggtttaaagtctcttttatcagagactaggattgcaacccctgcctttttttgttttccatttgcttggtagatcttcctacatccctttattttgagcctatgtgtgtctctgcatgggagatgggtttcctgaatacagcacactgatgggtcttgactctatccaatttgccagcctgtgtcttttaactggagaatttagcccatttacatttaaggttaatattgttatgtgtgaatttgatcctgtcataatgatgttagctggttattttgctcattggttgatgcagtttcttcctagcctcgatggtctttacaatttggcatgtttttgcagtggctggtaccagttgttcctttccatgtttagtgcttccttcaggagctcttttagggcaggcctggtggtgacaaaatctctcagcatttgcttgtctgtaaaggattttatttctccttcacttatgaagcttagtttggcaggatatgaaattctgggttgaaaatttttttctttaagaatgttgaatattggcccccactctcttctggcttgtaaagtttctgccaagagatcagctgttagtctgatgggcttccctttgtgggtaacctgacctttctctccggctgcccttaacattttttccttcatttcaactttggtgaatctgacaattatgtgtcttggggttgctcttctcaaggagtatctttgtggcgttctctgtatttcctgaatttgaatgttggcctgccttgctagattggagaagttctcctggataatatcctgcagagtgttttccaacttggttccattctcccagtcactttcaggtacaccaatcagacatagatttggtcttttcacatagtcccatatttcttggaggttttgtttgtttctttttattcttttttctctaaacttctcttctcacttcatttcattcatttgatcttccatcactgataccctttcttccagttgatccaatcggctactgaggcttgtgcattcgtcacatagttctcgtgccttggttttcagccccttcaggtcctttaaggacctctctgcattggttattctagttagccattcatctaatttcttttcaaggtttttaacttctttaccatgggttcgaacttcctcctttagcttggagtagtttgattgtctgaagccttcttctctcaactcgtcaaagtcattctctgtccagctttgttccattgctggtgaggagctgcgttcctttggaggaggagaggtgctctgatttttagagtttccagtttttctgttctgttttttccccatctttgtagttttatctacctttggtctttgatgatggtgatgtacagatggggttttggtgaggatgtcctttctgtttgttagttttccttctaacagtcaggaccctcagctgcaggtctgttggagtttgctggaggtccactccagaccctgtttgcctgggtatcagcagcggaggctgcagaacagcggatactggtgagcagcaaatgttgttgcctgattgttcctctggaagttttgtctcagaagagtacccagacatatgaggtgtcagtctgcccctactagggggtgcctcccagttaggctatttgggggtcagggacccacttgaggaggcagtctatccgttctcagatctccagctgcatgctggaagaaccactactctcttcaaagttgtcagacagggacatttaagtctgcagaggattctgctgccttttgtttgtctatgccctgcccccagaggtggagtctacagaggcaggcaggcctccttgagctgtggtaggctccacccagttcgagcttcccggctgctttgtttacctactctagcctcggcaatggtggccgcccctcccccagcctcgctgccaccttgcagtttgatctcagactgctgtgctagcaatgagtgaggctacgtgggtgtaggaccctctgagccacgtgcgggatataatctcctggtgtgccgtttgctaaggccattggaaaagcgcagtattagggtgggagtgacctgattttccaggtgccatctgtcacccctttctttgactaggaaagggaattccctgaccccttgcacttcccaggagaggcaatggcgtgccctgctttggctcatgctcggtgcactgcaaccactgtcctgcacccactttccgacactccccagtgagatgaacccggtacctcagttggaaatgcagaaatcacccgtcttctgcgttgctcacgctgggagctgtagactggagctgttcctattcagccatcttggctccacccctctctttttctttactagtctagctaatggtgtgttttgttaatcttttcaaaaaaaaacagttcattgattttttgaagggtttttcatgtctctatctccttcagttctgttctgatcttagttatttcttgtcttctgctagcttttgaatttgtttgctcttgcttctctagttctcttcattttgatgttcgggtgttgatttcagatctttctagcttttggatgtgggcatttagtgctataaatttccctcttaacattgctttagctatgtcacagagattctggcatgttgtctctttgttcttgttggtttcaaataacttctttatttatgccttaatttcttatttacccagtagtcattcaggagcaggttgttcaatttccatgtagttacatggttttgagtgactttcataatcctgagttctaacttgattgcactgtggcctgagagactggtatgatttccgttcttttttcttttcttttcttttctttttttttcagctggagtcttgctcctttgcccaggctggagtgcagtggtgagatcttggctcactgaaacccctgcttcttgggttcaaacgattctcctgcctcagcctcccaagtagctgggattacaggcatgcgtcaccatgcctggctaatttttgtatttttagtagaggcagagtttcaccatgttggccaggctggtctcaaactcctgacctcatgatctgcccacctcagcctcctaaagtgctgggattaccggtgtgagccactgtgcctggccaatttcctttcttttgcatttgctgaggagtgttttacttccaattacacagttgattttagaataagtactatgtgatgctgagaaaaatgtatattctgttgatttgaggtggagagttctgtagatgtctattaggtctgcttggtgcagagctgagttcaatatccttgttaattttctgtctcattgatctgtctcatattgacagtgtgatgttaaagtatcccactattattttgtggaagcccaagtctctttgtaggtcattaagaacttgtttaatgaatctgggtgctcctgcattgggtgcatgtatattcaggatagttagctcttctcattgcattgatccctttccattatttaatgctcttctttgtcttttttgatctttgttgctttaaagtctgttttatcagagactaggattgcaacccctgcttttttttttttgctttccatttgcttggtaaatatttctccatgcctttattttgagcctaagtgtgtctttgcatgtgagatgggtctcctgaatatagcacactgatgggtcttgactctttatccaatttccaacctgtatcttctaattggggcatgtagcccctttacatttatcgttaatgttgttatgtgtgaatgtgatcctgtcatcatgatgctagctggttattttgcacattagttgaagcagtttcttcatagtgtcattgatctttatattttggtgtgtttttgcagtggctggtaccggtttttcctttccatatttactgcttccttcaggagctctcgtaaggcaggcctggtggtgacaaaatcccttagcatttgcttgtctgtaaaatattttttcctttgcttatgaagcttagtttggctggatatgaaattctgggttgaaaattcttttctttaagaatgttgaatattggcccccactctcttctgtcttgtagggtttctgcagagagattcgctgttagtctgatgggcttccctttgtaggtaacctgacttttctctctggctgcccttaacatttttccttcatttcaacctagagaatctgaagattatgtgtcttggggttgctcttctcgatgagtatctttgttgtgttctctgtatttcctgaatttgaatgttggcctgtcttgctaggttggggaagttctcctggataatatcctgaagtgtgttttccaacttggttccattctccccgtcactttcaggtacaccaatcaaacgtaggtttcgtcttttcacatagtcccatatttcttggagactttgtttgttccttttcattcttttttctctaatcttgtctttacccctcatctcactaagttgatctacagtctgatatcctttcttccacttgatcaatttggctagtgatacttgtgtatgcttcatgaagttcttgtgctgtgtttttcagctccatcaggtcatttatgttcttctctaaactggttattctagttagcaattcctgtaacctgttatcaaggttcttagcttccttgcattgggttagatcatgctctttagctcagaggagtttgtttttacccaccttctgaagtctacttctgtcaattcatcaatcaccgtctccgtctagttttgtgcccttgctggagaagagttgtgatcatttggtggagaagaggcattttggtttttggatttttcagcatttttgcattagtttttcctcatcttcttggatttatctacctttgatctttgaagctgatttttggatggggtttttgtgtgggggtcctttttgttgatgttgatgttgttgctttctgtttgttagttttccttctaaaagtcaggcccctcttctgcaggtctgctgtagtttgctggcagtccactccagaccctgtttgcctgggtatcaccagtgaaggctgtagaatagcaaagattgctgcttgctccttcctctagaagctttatcccagaggggcactggcctgatgccagtcagagctctcctatatgaggtgtctgtcaacccctgttgggaggtatctcccagtcaggaggcacaggggatcagggacccacttgaggaggcactctgtccttcagcagagcttgagcactgtgctaggagatctttccttgtcaggatccactgctgtctttggagctggcaagcaagaacctttaagtccgctgaagctgcgcccacagtctccccttcccccaggtgctctgtcccaggtagatgggagttttatctataagcccctgactggggttgctgcctttctttcaggcatgttctgccctgtgaggaagaatctagagagaaagtctggccatagtcactttgccgtgctgtggtgaattccacccagtccaaacttcctggcctccttagcactgtcagggaaaaattgcctactcaagccttagtaatggcagacacccctctccccaccaagcttgattgtcccagatcgacttcagactgctgtgcttgcagtgagaatttcaagccagtgcttcttagctttctgggctctgtgagagtgggacccactaagctagaccacttggctccctggcttcagcttcctttccaggagagtgaacagttctgtctcgctggggttccaggcaccactggggtatgaaaaacactcctgcagttagctcagtgtcttcccaaacagccaccccagttttgtgattgaaacccaggtccctggtggtgtaggcacacgagggagtctcctgatctgcggattgcaaaaaccatgggaaaagcttagtatccaggctggatagcacagtccctcacagcttcccttgggtaggggagggaggtccccagcactttgcacttcctgggtgaggtgatgccacaccctgcttctgctcaccctccttgggctgtacccactgcctaaccagtcccagtgagatgaactgggtacttcagttggaaatgcagaaatcaccccccttctgtgttggtctcactaggagctgcagactacagctgttcctatttggtcatcttgccacatccccgagtataatcttaaaataaggaaaattcctttaactgtaataatcttggacctatttacaaacttactccattttgtgatttttctcattttaccatgttcttatgaacatatcatctgacacctatatcacactggctgggaatcacaggtctatgacccagtgttttgcctcatgacagtttgcatggagagggctgtgctgaaaaagtcaggacccttcagccttgttttccaaaggatggagagtcagtttcccaaagtcagcccttctgggccctcagagcagttggctggttgcatgcttcctattgttgttcttcatcatttatcatgggtgtggagtcatgtgaaatgtgcaaatgctaactcaatgtagacagcgaattagtcttccacagtgaccatttgatatgcttatttccttgaaattcttatacctgttcctatgacacagaactatgagcatatgttcacagaccagattctcctagtaatacctttagagtatggttcactgagaaatcaatgacatgataatggagttctgtcagaggaggcaggtgatgttactcaccagaaatcccaaataggtactcactgctcctcaacaagtaaaggctcagaacttccagatccagtactgtggtccactgcctcttctacagatgctcttctctgccccaggcccacagtatctcaaggttactgtggcttagatagcatttacctttatatctgaaagagagtagagaatgaggggacatttgtgttgaggtccaggaatcagacccatctgggtgttatgggttattttatgattactggaaacaaaaaagatttccttggcacacaatattcagggggaattcctgattcctccatccagctaaattctctttccatcgaactaaagcaagtggggactcctggaataatgcaaggctttgatggcaaagtccctgaacacggggaggggagtcacacacatccctctcttcctctcaatttcaggacaaggaaggataagtccacattcttcctatcaaactctcactagagattagaaatagagactttgaactgtgccttgggcatctcctcaggcactggagcagatgtagctctgagaagaaaacagcatggccgcatccttttatccagctcctgctctataaattggcaaagggaactcatcttttattctagttctatataatttactccaaattaaggaggaattcttaattataaatgttaagcagaagttgcaaatatgtaagtttaatgcctctgtttaagagaggcattaataagagaagattgatctttcttctaagggtactggtctttcaagagaaaagtaatcttacacaattgatagaagaggttagtgctatgataaaatttaatacatccattgtgcaccattgaaattatttgacttcactcactgactgctgtttctgctaaattgatatcttagatctaagagtgatttgccatattctagataggactaagcggcctggtgcaaaataaccctgaagtgttcacgactgacccctcagcccagacaaaatcatggagatgcagaccacacaccaaattgaagctgaaaacgtgagatacctgggattatcacagccatccagagagcatccttctccatacacataaattaaggcatgtgccctatgccctttctccaatatgattttcctctaatccttggaaccactagaagaacactaactgcctgactctcctattctcctgacaataccacagatgaattaggaacccattttcctaattctctgtgtgttggtttgtttggacagttactctagtgaaatcgagtcttcacaacaaaagatagaggacccagactaagcaacttgcctaaacctgaggactagagtcacttttatcatggctcattgacatgatacattgacatataacgctctcctgagacagttacactcccaccttctccctctattcctattcctggttattccaaacctctccttctcctgttcttcaccttccagatgtactggttagcatcttctcctcatggctgagaaacaatggcttactatcctgtttgccaatccttgttccaccttccttcaagtctttcttcctcattcagagaatgaatattattgcttctcagttttttggctaagattaagtgagaatgaatgagtgaatattaattttatcttgtgattaagtgagaatgaatgagtgaatattaattttgtcttgtacttattgtagtaacttctatataaaattttaaagaggacaacatttctgtctcaacaccgtcttgcctttcgcaacctttcagacaaacatctcaggcttccatattttccctattgtctgctctaacgtaacatgatttccaggaaagataataaattgctcactgtaaggtaaaaggttgcaaagtttatgcctttccaaagagatttgctttaacacaggaccaaaatttcaatttccaattctggaaatgcaaaatcagtaagaaatcttggagaaggacaattttctggtatcctttaaattatacccctacaaacattgtgttcaaataacaactcactcatggttcataaaatcattttcatggattaatatcagtttattttttaatagaatggaaggaaacaaatatcaatgtacatcaattagagtaagcgtaaacttttttttagaattttcatttccgttttttataaatgtacaacatatatatgtatatgtaattataagcaaaatatataaatgcatttcttgttatgatcatcatcaaaaagtttgaaagttacctgcccctcacccctagatcatgttaccaaatgcttttgattcctcttgtgcaacttcactaacatgcatccctgcttttccatccccatcactgtccacataggtcagattattcatttccgttctgaagttctacaataatcacaaagcctacataactgctgtctcttacatttttctgggtgtttacagtctctaagtcaaattatttcctaattcaaactctgaaatctgtgcaagacaaaaatctgaattcctgtgcctagccctcaaccatctggcccatttttaccttgccaaaccttatctcctgcagttacccaacttgcctccaggcattcttctcttttctgcaccagatctctgctcaaaccatcctcctcccactctttagcttgaaatggctcccttgcctcatcttcacggcatcttatcagtccctgaatccttcaagtctcagcccccttcccatgtccttcatcccccagtgaatgcattcactgaccaccccatacttctgagaaagccttaaatcttattatttttaaccttttcactggtgcacattattggtgtactcatattttctgttactttctacattcttatcttacctttccaaggagattttaagttccttaaaagaaaatatatcttaagtttttctagcttgttgcacttagagcaaaggtcctccataaaaatgttttgattgatttttcctactgtacacatgatgctaaggtcactgtgacccaatagttgaaaaattggccattaattttaaaaatacatactattgtgcttattttttattttccatcttatttcgttttctaaactaatagttattatccttaaatcacttctgagcaattaattttaactttttaaccaactgtactactactactaataataataatactcatttttctttcttcaaccctctctgcaggaagttttaatgtgaaaaataatttaagtcattaaaacaataaatactctgaattgaggtgtaatgggtgacctttatgatagtttcttctcactagagagattgactcacaagttacataaatacttagaaaagatatctatgggggaattcaaacatcagataatgattgaactttttgaatttaccatttcaaccttgaaatcctgtaattctaaattccacttgctgagtaagtagattctgaacaaccaaaagttgcctgttccctccttgccacctcacctctgaaatatgccctgtaatttacttacattcacaatggttcattaaagtaaccataacaaagcttacagttaatgataaattacaagaaaactagctctttagtctaacattgtgtggattatcatttggatttgtaaaaaattattatgtatataggtattataatgtttattacccttgtctgggcttacttatattttaacaaaacgaatagttattctttatattcctaaagtgttaagataatggacagcctgagaaatgataacagtgacccccctccaacaggaaagactgggttgaaaacacagtgaagatatagcccacattttataaatctttgattaaaacagaagagtcatcagtaagatcagtaaaaagaaaaggatgtctcctttcataacttctattcagcattatactgaaggttctagccacggcaattaaacaagaaaaagaaattaaagacatccaaactgaaaagaagtaaaactaactctatttacaaatgacatgatcttgtatatagaaaatcctaaggaatacacacatatacacacacacacaaactattagagctaataaattagttcagtgaggtaacaggacacaagatcaatatacaaaactcaattatatttctgtacactaggaatgaataatctgaatataaaattaagaaaataattccatttaaaataacactaaaaggaataaaatacttagaaataaattaaagagttgcaacactttgtactaaacactacaaaacaccattgaaacaaattttaaaaggcctaattaaatggagaaacattttatcatcaccggtcagaagacttaatttttttaaatggtgatactctacaaattatctagaaattcaatgaaatccttatcaaaatctcagctggctttttttttgaacaaattgacaagcttatatcataattcatataaaaatttaaggaatatagaatagccaaaaaataataaaaaatgaggatcaaacttgtttgacttatattcccagatttcaaaacttggcataaagatagacatacagattaatgaaatagacttgagagttcaaacacaaactcatacattcattaatgaggtaactaattttccacaagggtgccaagactattgagtggagaaagaatagtctttttcaacaaatggtcctgtgacaaccagatatccacatgaaaagaatgaatttggacccctaactaacaccacatacaaaaattaactcaaaagagatcaaaggcctaaatatccagctaggattataaaactcttagaacataacatcggtataaatcttcatgaccttggattagacaatggtttcttagatttaacacctaaagcataagaaagaaaagtgtatatacatttgacttcatcaaaattaaaaacatttttaccttaaaggatacttttcagaaaatgaaaagacagctcacagatacaaaaagatatttgcaaatcatgtattcagtaaagctctagtatccagaatatatacagaagttgtatgattcaacaatttaaaaaaaaaaacaatttaaaaacgaacaaagagcttgaatagacatttatccaaagaagacatacaaatgaacaataagtacatgaaaagtcattcaagattgttagtcattagtgttagtcattgggggaataaaaaccacagtgaaatattacttcacagccactaggatggctataatgaaaggaggaacaagatgtgtcggcaaaggtgaagaaattgaaaacctcacacattgctgttgaaatgcaaaatagtatagccacttggaaacagtttgtcacttcctcaaaaagttaaacacagagttaccatatgacccagcaattccactcctgtatatataacccccaaattgaaaatgtacattcacagaaaaattgtacagaaatgctcagagcagcattattcacaatagccaaaaagtggaaataaccaaaatgttcaccaacggatgtctggataagcaatatcattagataaataataaattagaatatcattcagccataaaaagggataaattactgatgcttgccaaaacttggatgaatcttgaaaacattatgttaggtgaaaaaagtcagacacaaaaggccacatattgtaggattctatttatagcaaatgactagaagaggcagatctctattacaaggacaaaaggtagattagtgtttttgccaagggcttgggggaatgggggcatggggagtgactgcttataggtttggggtttttcaatgataaaaatgttctgaaattagataatggtgaggagtacacaaccttgtgaatatactaaaaactactgaattgtacattttatttaaaggggcaggttttatggtatgggaattgtatcttaattcaaaaataatgaaaaagaaagatcaaactacttacagtagatcaaaccacctgtagttatctgtgaacacacttgacttatgcttgcaaccagtgctatcaaactatcagtggtttagaaccaatttttttttcaatttcctctcagttttggaccaatacttttaaaactacaataggaagaaattactagcagaacaaaataaacacacttaaaattactctgttaaattgctatgagagttcctaaaagtttactctcaattgccgtgcttatttcattatggactgggtaagaaacagtttgtaggtcagcatgggtccatggcccacactttgagtatcactgttttagactatatattcttcaaggacagaggcatgttttattcacctctgaatctgctcaggtagcgcaaaatgggcacgggtaggaaagattgctcactggttaaattgaaccaatcaacctacttctaatggcagcttcagcaataaacaaatcaatcgattcaggccaccagtgttagaaacttgctaggatcagctcaactcctaatcaatcgtgtatagggccatgggttcataataacaacattatgcttccacattaaatggcaaatgtgctttcttcatttcacatgtttataccttacctccattaagtgggtggcatcatttaggaaataaataacatataatcaaaacaaagccaaaaatagaggcaagaatcctttcagctctcaagtggcaaatcatttcagtgttgaactttgatatacaattcatagattatttacagaaagtgctttctaatgttgctaagaatagccctagttttttgttttttgtttttttttaagatggaaaacagtgtggaatttgaaaaatgttttaaaattcctttacctgaaatgccagcaattatgcaagtagctaccagaccaagagagtgtttgcgaaacagagttgaaaactgggctagggtaccgtaacagattttctaatacctgttcattattattgcaaagggcatgtggagctattattttaaatctctacacaccctatcagctagtctgagaggattttagctgacaaggccctgggaacaagattttttcaggcttagttatgtggctgattctatctgaggcctgaaaaaatacactccatttacttgatcaccgccagagaggaaacaaagattcctatgtgtggccccctttaaagaagtggaacagtgctatgctaggtacaacagagtcagccagcctggaacagaagccacagcagctttgcccagattagagctgtaattccacgttccaaaatgtctggccaccaaaggacagccttttcataggagtgtgttattactttttatttgttagaggggatgttattctacttcctgaaagaaataaataaagtgagattatgtgagtctggccaactttatatccttacatattaacacttaattaggtaactctgatttattatactgctgaagaatttgtaaagcaagtaaatggctacataaagtttctcacataaatgtaaggatagaaacttccataaagatgatttaatatagtgcattatgtcatagtacagacaaacagcagtaatttgtcttgttttacagaaaatttactgtgtggaaaatgaggagtgctaagttatattagccaaagaacaattacttatcaatgttttttataatgacagtgtgtttctcctttggcatatgcacacacacaaacacagagggatacacacagtataacttgacaaagaagccattcctttagaatgctggtacaattgttagcatttcatgtaaaagagcttttccaatattttttcaaactccttccctctcttttttcaaaaactatgtatataaaattaattgcttagcttcagaggatgatatagaaccaatgtattatcttaaaaacaggtaaagggctagaatcagacatttattttgcctttcttatataaactgtgccactatccaaacaaatagaagatgaaagcagcatctctttatgcaaggtatttcaactaataattgaaaaccaaatgatggaaatagaacatcacccttttgcaatctgcaatgatttaacgaattgaggcaaggagcgtcaatgtcttctaacatcagaaaaagacaaacagccaggaattataggtcaataaaatcaaacttgagtctgatcaagtccctggatttagctgccaattttcaggaaatacagaagacaaaagagcatgttgagcttcactatgaggattcaaaacaaaaaacaaaaattcagactgcaggacactttgtgttaaatgccctaagtttttcaacagataaactataaggcaaagaatgaaatggaggataagtccatagattaaaagacatacaaattttttaaatagacaaaaacaattagagtgtctaataatgcacacaagtgatgaaaccataaagaaggaagcaacccagcttgagcaacatagtaagaccagcatctctacaaaaaaagaaaaagttagccaggtgtggtggcacacacctgtagtctcagttactcggggggctgaggtgggagggtcgcttgagccctggaggttgaggatgcagtgagccgtgattgcaccactgcactccagcctgggcaacagagtgagaccctgccaaaaaaaaaaaaaaacttggatagaagttacatggttaattttcaaaagaaggacaggtgtgattgggaaaggtcacctggagaagctactagaatggctggcaaaactatattttggcctgggtggaagttgaaagtgtttaacttcaataattcaaagccagacaattattttgtgtggtttttctcgatatgtattttatttcacaataaaaaagaaaaatatataagccttgcatgatggttgatactgagtatcaacttgattggatacaaagtattgatcctggctgtgtctgtgagggtgctgccaaaggagattaacatttgagtcagtgggctgggaaaggcagacccacccttaacctgggtgggcacaatctaatcagctgccagcatggctataatataagcaggcagaaaaatgtgaaaagagagactagcctagcctcccagcctacatgtttctcccgtgctggatgcttcctgccctcaaacatcaaactccaggttcttcagttttggaactcatactggctctccttgctcttcagcctgcagatggcctactgtgggaccttgtgatcatgtgagttaataattaaagaacccctctttacatatatatatgtactatgtaagtcaccatgtaacctgaactgcctatcatgaactgggtgctttctgacccatctagccataaagtaggtggtgcatagcagcattccatcatcaaatggaagtggtatatacgtcatcgggctcgagcaggtcctgaaggcacaagtaagttacatgaggaagtggctcaaatgcccatggtgtccactcctgccaccctgccttctctcccctagcctggaccaatggcctcatggggagttccctatgaccagttgacagaggaagagaagaccagggcctggttcatagatggttctgcacgatatgcaggcaccacttgaaagtggatagctgcagcactacagcccctttctaggacatccctgaaggacagcggtgaagggaaatcttcccagtgggcagaactttgagcagtgtgcctggttgtgcactttgtttggaaggaaaaatggccggatacgtgattatatactgattcatgggctgtagccaatggtttggctgggtggtcagtgacttggaagaagcatgattggaaaattggtgacaaagaaattcggggaagacgtatgtggatgcacctctctaagtggtcaaaagcaagatatttgtatccaatgtgagtgctcatcaacaggtgacctcagcagaggaggattttaataatcaagtgaataggatgacccattctgtggacaccactcagcttctttccccagccacccgtgctgtcacccaataggcccatgaacaaagtggccatggtggtagggatggaggttatgaatgggctcagtaacatggacttctactcaccaaggctgacctggctacggccactgatgtgtgctcaattttccagcagcagagaccaacactgagccctcaatatggcaccattcctgggggtgatcagccagctacctggtggcaggttgattatactcgacttcttccatcatggaaaggacagaggtttgtcctcactggaatagacacttactctggatatgggtttgcctatcctgcatgcaatgcttctgccaagactaccatctgtggactcacagaatgccttatccactgtgatgatattccacacagcattgcctctgatcaaggcactcactttaccgctaaagaaatgtggcagtggcttcatgctcatggaattcgctggtcttaccatgttctccatcatcctgaagcagccagattaatagaacagtggaatggcctgttgaagccacaattacaacaccaactaagttacaatacttcacagggctggggcaaagttctccagaaggtcacgtgtgctctaaatcagcatccaatatatggtactgtttctcccatagccaggattcacgggtccaggattcaaggggtggaagtggaagtggcaccactcaccaacacccatagtgatccactagcaacatttttgcttcctgttctcacgacattatgttctgctagcccagaggtcttatttccagaggcaggaatgctgccacagggagacacaacaacgatcccattaaactggaagttaagattgccacctcgacactttgggctcctcctacctttaagtcaacaggctaagaagggagttgcagtgttggctggggtgattgacctggactatcaagatgaaatcagtctactactccacacagaagtcaggaagagtatgcattgaatacaggaaatccattagggcatctcttagtattatcatgctctgtgattaaggtcaatgggaaactacaacagcccaatccaggcaggaccacaaatgacccagactcttcaggaatgaaagtctgggtcactccaccaggaaaaaaaaaaccatgacctgctgaggtgcttgctgaaggcaaagtgaatacataatggggtagtagaagaaggtagtaatcaataccagctacaaacacatgaccagttgcagaaacaaggacagtaattgttttatgtatctcctatttcctccttcttttgttaaaagcatgtttgtgcatgtatacacttgtactaagaaaatatcttcattttattactttctcctttatcatgtgacataagatttattgacttcacatcagcatttaagtatggttaactttatataatagtatttgggttgaggattggtgcgtttccagttgtacgaaggatagttgtattatattaggtgtaataatgaacttattttcgtttttatttgaagattatgtatggtctcaggagatgtgtatgggttcaagttgacaaggggtggacttgtgatggttaatactaagtgtcaacttgattggatgcaaagtattgatcccgggtgtgtctttgagggtgctgccaaaggagattaacatttgagtcagtgggctgggaaaggcagacccaccctcaatctgggtgggcacaatctaatcagctgccagcgtggctagaatacaagcaggtagaagactaaactggcttagcctcccggcctaagtcttcctcctttgctggatgctttctgccctcaaacatcgaactctaagttcttcagttttgcaactaggactgtctctctttgctcctcagcctgcagatgacctattgtgggaccttgtgatcatgtgagttaatacttagtaaacttccctttatgtgtatatatcttccattagttctgtccctctagagaaccctgactaataaacctgtaatttaaaacaaaatcctggcgaggcgtgatagctcacacctgtaatgccagcactttgggaggccaaggtgggaggatcaagaggtcaggagatcgagaccatcctggccaatatagtgaaaccccatctctactaaaaatacaaaaattagctgggcatggtggcgcatacctgtaatcccagctacttgggaggctgaggcaggagaattgcttaaaccagggagtcagaggttgcagtgggccaagatcacatcactgtactccagcctggcaacaaagcgagactctgtctcatcactcacgtggaaaacaccacagaggctcagagcagtgttttctccatgtaatttactgtgtgatacctttctcctaaatgaggggttgtaagtagaacttgggtttttaattcctttcatacccccaaagtatacacctgaaattggctctgtgattagttatctcattctcagtcacatatcagctttgctggcaactaatattattatacaaatattttacagaaattctggctaaaagctatatatagtttctggctacagattttgacaataccctgacttcctagcttctattcttgtctccttgcaaccaaaatgattgtttttaaaaaacaaatgaaaacactatgagcactttaggaaaagacttcctaatttctcacaaaatgaaacatattcaatgacccgtcaatttcactcccagatatttacccaagagaaaaaatagtatacacttacacaaagatttgtacaagaatgttgagcacagctttattcataaactacagacagcccaaatgtcaatagaatacataaactgtggtatatttatataataataatagtactccacaataaaaagtaataaagtactgatacatgcaacaacatggatgaatttttaaaatattatgttgactgcaaaacactttatcaataaagtacataccatattaatatatttatatgaaattctacaacaagctgcactaaccaatgatgaaaaacaatcagtatactggttgcctctgaggcagtgagtacagagattgactggcaatggtcacaaggaaacttcctaaggtgaaggtaatggactgtatttttatggaagtttgagttgcagaggtggaaatatttgtcaaaagtcagcaatttaagcatttcattttatgtaaatttttaatcaaaatgaaagaacacaggccaggtgtggtggctcacacctgtaatcccagcactttggaaggccaaggtgtgagaatcgcttgagcccaggaattgagaccagcctgggcaacatggcaaaactgtctacaaaaaatacaaacattagctgggcatggtggtgcgtgcttgtgatcccagctactcaggaggctgaggtgggaagatcgcccgaactcaggaggttgaggctgcagtgagctgagattgcaccactgcactccagcctgggcgacagagtgagaccctgtcaaaaaaagaaagaacccaaaactctaggtaatgatctacatactgaagtatttaggagtaaatatactggagtctgtatattattttgaaataggtcaatcaatctgaccgattaatggatagttagaggaattaacaaatgaatagatatgtgataagacaggttttgtaaaatattaacagtaacattggtgagcatacaagtgttcactgtaaaaattctttccactttgttgtatgcttaaaattactgtaataaaaatgttgggcaggaggagcaaatgagatcatatccttccatatttagaaacctacggacacttcccatttcattcagaaaaacaaaacaggaactccttctgcctgtaaggacctatgtaactgggccctatctatctctttactctcattccatatcactctgctactttgtcattctttcccaatgaccttggctttctgtgtgtccttcaagtataaccaagtttgtttctcctcaaaatgcctacataggtgttgcttctacctgggatgctccttctcccagatcttctcattactgctctcttttggttccctcttggctcacctgtaacctcctcagaggccttcccttatcaactaatcaagactaacacacaaatgtccccacattcatgctgtcacttttgcctgatttgtgttccacataccatttatcttcactggaattatttatccatttgtgaacttcctcactttagaattcttcccaatacatattatataatatccccaaggaaatttagcaagctgctgacataactgatcacctgaggagtacaaccagtatgaaagaaaaaaatcaaatggaaaataatataccacatgaagaatttgaagtcagaacagtaaatatcctcaacgaaatacagagggtataagtaatatgaaccgggataaagatgtcctaaaagttgaagaaatattataattgaactaaaacaataaattgggtaaataggatatactactaattaataaatcaataatctggaagaaaagttgaaggaactcctccagaaagtatcagaaaagggcgatgggactgaaaatttaaaaaaataagacaaaacaaaactaagggatataaagaatagaagtataaatgccaacatcttgaaaataagactttcagaaagagagaaaatagcaatttgaggtgaagaattatttcccttgtggagaaacttaagactctatgagaagacattttaaatgaataattaaagtgatatctcatgttcttgaatggggcaacttaattttataaagttatcaatgctcagcaaattaatctacaattttgaaatgatgccaatagaaattctagtgagatcttattaggaacgtgatgaaataatcctaaaattgatacagaagaataaatgcccataaatagctaaaacaacttaaaaaaaaaagagcaaggagaactttctttctggatactaaaatatgtaatagtgtaagaaaacacactataatagtgcaggaatagaaagtagaacaatgtatcagagtagacaactcagaagatcattgcatacatgaaaatttactacttgatgaaaaaggcacaaatcaatgaggataataaagactgctgcagtcaatatcaatggaaaactaagtcactatatggacaaaaggcctaacaccacataaacatgggatcacagatgcattgaagacccaggactgaaagataaaacgacatattttagagagctggagtaggacaatatttgtaattcttagacaaaaatcccaatagtacaaattataaggtaaaatttgatgaatttgattggatgaaaaataaatatgtctttccagtaagtgacattgtaaataaagtaagcaaataaatagcagattgaaagaagtatgtgcaatttgtaaaattgataaggatctaatatctaaaatacacatgaattctttaaaaacaaaaagacacagtttagttatgaacaaaagaaaccaaactcattggtagttagagaaattaaatttaaaacaaggattgtcactttaccaagaattgtcaaaaattagcaagcaggttaccgccatattttgacacggatgtagtaatataagcacccccatgctcggctggcagtagtgcaaacttgtgctgcctttctggagagaaattgcacaatcatacaagtacatagggaacatatacaagaatgctcgtcacagtattgccattttaaaaaattgaagacaatctcactgtcttccaccaggtgaacaggtaagtacaatgtgatagatgcccagtaaaaaatattccatgatatttagaaggatcatgctgtttctacacacagttacaggggtagagcttacatcaagaagctgagctttaaaaaaataaaggatgaatgagatagagtctataggataatcacattttttaaaacaaacaaataaatggatcaagtccatacataactattgcagggcctgagccaaagaatgtaaatggaggttcacatgtatctatagatttaaaagtgataaatcaagctgaaagattattaaatgcaatattttatctttttatttcacaaaatatcttcctaatgataaaattggaaaacatacataaagatatgtttatatatgtatgatgaaaagttggcaaaatattagagattagactggacttaatcattatcgcacacatctggatgttctgtcaatgggccaacaatgtttggctgagtaattatttaatattacaaactatttctgagctaccatgtgcagctgttgtaaacaacatgctaattcacaaatctaagccacaatttgaagagaaatcaaggaaatattcaccactggaaataatacttcatttagccacagtctataacattcatactatctcagagcaaagatttaacaaggtaatttgtcttttctcttacctgtgtttccactgttcaaatcctccctgtacttcagacgttatctgccctaatgctgccaacagcacacgcaccgcctttcagtgcatttgaactgagaggatacgagcgagagataccgagaagtactttcctggggactcaatgaagagtcagaagagtgaatattgagggctacaaattatgttgtgccagccatgaacactggaaggtgagtgatagagtttcccaggtattctataatacattcttgtttttgtaatattcagaaccctctaacatggggtctaagtcaagagccaaaggtcaaaggatgacaacagtaggatacatgctaaatatattaatagagctcctatgggaagaagctgaacaaaattatggaatgcggttaaaatggatgaagaaaggaaggaaggaaggaaggaaaaagaaaaaaaaaaagaaaagaacctaatagaataatgaggatggtatgccattgaaccaaaaagtattatttattaactcaaccttctctatctgtggccaaacaaaagagaaaagggtaaagaattaaccaagtaggtagctctgtggctcaatggatagctcattgcacttacagtgatgaaaaaaatgaaccaagtattatttgcatttccagtatttcttggtagcattttttcgaacaaaattccaagagatcacaatatgataaccttcctatttgatttgtgcagtattatgtaaatcttgccatttttgcaaaaatatatatgagtgcttcattagttttccttagtacatatcttaatactttgatattcaaatcaatctctctctctctgtttttgttttgttttgttttgttttgttttgttttgttttttgtgggacagagtctcactctattgcccaggctggagtgcaatggcaccatctcggatcactgcaacctcctcctaccggcttcaagcgattctcctgcctcagcctcccaattagctgggattacaggtgcacaccactgatcccggctaatttttgtatttttagtacagacaaggtttcaccatgttggccagactagtctcgaactgctgacctcaggtgatcagcccgtctcggcctcccaaagtgctggagttacaggcgtgagccactgcgcccagccacaagtcaatctcttgaagtactgtgtactccatcatctgggtagattttcattgtcttctattgttaactggtttaattatgcctaatgtactttttgcaataaagagttgagaagttcaacattgtgttcagtgactgcataaatccatgtttttgtgagatttagaatttcactttgcaattagtttgtattttattgtgacatccaaaaatcgggaagagctgatggagaaggcacaagacagtcagcaaaaatccctagtggtgctaaaggggaaggaagcataagtggagattaatctcgtatgtagaagttcattagtaaatatattcatgtcatacagactttcggttccttattgcaaatttatgatttgggaactcccttaatgaaatttgggagcaagcaagaactccctgtatggttatctcaacttcctttagtgattattattaaaacagattgacccagttgtcagaatgttgaattgtgactctccttgagctacaaatatggatatcctttaatacatgtatcttttattatcaaatatagtaattgcaactcttttccaatattgctagatctgacaatgagaacagttatggtattttaagtaagattgtcacagaaaacactgaaggaagaatttcatagaacaacacaacttagaagagcagccagatatataactggggctgactgggaaggggatcatattgacagcataatcaaagggaagactatcatttaacctgttcagaaacatggatccaggctgttagcagcataaacaaatgaaaataaaaggaatgtatactagaaccacaaaaattaagcaaccaagcaaacaaacaaataaaattctactaatttatagttttcaatattttttaaaatctttgaacccataaaacctgtaccaaaattctttgccttaccttggcattcaagttctactgacccattgtattttactcacatgtttagaaattttctactaggccaggcgcagtggctaatgcctataatccccgcattttgggaggccgaggggggcagattacctgaggtcaggagttcaagaccagcctgatccacatggagaaaccccatctctactaaaaatgcaaaaattagaccggcgtggtggtgcatacctgtaatcccagcttctcgggaggctgaggcagaagaatcacttgaacccaggaggtggaggttgcggtgagctgagatcgtgccattgcatgccagcctgggcaacaaaagcaaaactctgcctcaaaaaaaaaaataaaaataaaaataaaaatcctactactaaaattatttaccagctgactcaattatttaggagctgactattcaaatggtcagttggatttcttgagctttttttactcttcttctcttttattgtatgttgggcaattctgtcctgaatttcagtaagatacaaagaagcagaaagattaattactcagtttcaggaagtctagtaaaagttttgtgagaacaaaagtgtatgctatcctcttagccagcattctccaaagaaacagaaccaacaggatgtgcaaagagagagtgagagaaacagagagagatttaagtaattggctcacacagttgtggaggctggcaagaccaaaatctgtagggcaggccaattccctggagacccagggaattgcagtttaagtctgaaggcaatgtactggctgactttccacttctttaggggtcagtgacaggggtcaaggggagtaatcttttcttttatggacttcaacggtttggatgaggttcacccacattatggagggtaatctgctttactctgtcagagtctactaattaaactgttaatctcatctaaaatatgtctttatggaaacatctagaataatgtttgaccaagtatctgagtacagtgacctagccaagttgacacaaaacatttatcatcacagctatccaataaaatttagtgaaatttagtactgtttggaagggcaaaggaatttatctctagagtcagttacagttcagtagaaatccattactcccaaacctctctgtgaccttagacactaagctaataataatttcttgacctctaaatatgggaataaatctttctttacttcctaggattattgtgagcattaaatgatttaatcaatattgtttaacacatcctagatgctcaataaatattacctgattattattttattattattttaaagcatattgagcttttttaacctccatattttataattgagttatgaaacagataattgtaagataaatgtatattttatattttctcctcaaataatatcagcaaattagcatgcattctttactaaaagaaatatcagaatgtatcaaactgtctcataagttggctgcccagttgtctaggcattcttattgtaaaagtaacatacggttattactgaaaaataagaaaatacaggtaaacataaaacacaaaataataaatctctctttctacacacacacacacacacacacacacacacacaacacacatacacacacaccagaatattgaattggaagctgcaactgaaaatccaagatacaagagataacagacataaaactgagttttgaggcagacactaagatacaaatttcaaaagaactattcaagaagtacatgcataacactttcttactggattgaaaggagaagagtttgagagaaatttatgagatttctttggtgatagctcttcagataagaggtcacagtaagcccgcaagtgaaggctggggccctgcatcactcactctgcctttaggcatattaaaggcccaaaagtaattatggtccttaattaaatcctcaataccaaatccctggatttagtaccttctttaattgaatagcatgcctgggccagactaatatatggtaacagcccacagtgacagctatacagacattcatcattttgtgagtgcagcctctgtagtctctaatccccatgacggtaaatcactaactctctgatgtaggatttcgtttttgttcagtgtgctttatttgtttttgtttttgcagtggtggtgcaatgtggggaagagagggagctattacaccaaactcttcttcccttgatttagtagggctgaaagaccactgacaagatttagggctgtgacccacattcatgtgctagggattaacaggtaagtgtgtatgacagtttgtgctgcacaaaactcaactgtcagtctggccatctttgccagctcatgcattatttttccattctgtaacatgagaatagatgtagtctcctgctcaaagaaaagaaaggaggctggtgtctttattgaaatctcctctaggaaggttcagcttctaattcactccatagcataaattcctggaatatatttgcagtacatgtaactactcaagagcctaaaaccagggctcattatgtgacttgcctttctttgattgttgattattttttctttctagtttgaagctgtagttgaaagttctcttcaaagagaatatcagtcaatacataacctcagatctatcagagctagactgattctcagagctgatggattagacagatatggttgaaggcctttcagagatgagatgaacctcatcattactggagtgctaagtcacccagtgaccctcaagaatattgctttattaccacttcctaggaagtatgtccttttgtcaaatcaaaaatcttgccacaccacaagactctagcctacaagatgaaacttttatctcacagcagcctgttaagtccttgtcctgcaacactcagcttattctggactccctaattgtggggattttcacatcagccactttctgctttctgcttcctcttgaaccccactgagaaggctcctggcgtgccttgttgtgtgctgaacatggtgccacagattccaatgtaagtgtgtatctttccctaacctcccaattttttggcctacccttatatctatgccaacagcacaataaaaaatggaaccctattttcccttacatcgatgaaaattaaatgatccacagctaaacatctgtttcatgattaatcattatggtactatcatcatgtgcatttaacatccctccttcctgcaccacacatgcacacacacgtgcacacaggatttagagctggaaataactctgatatgggcaggcatttgtcacttggggtaaagggcaagggaactaacatttttaaaatgcttacaagacagagtagcatcatgagtcctgtggtgcagtggaacaagaacaggctgtcaagtacaaccggtgtagtttgaatcctggcttagccactcactctttatgacttcaggcatattacttaccttctttgtacctcacttcttcctctcttacatgggaaaatagttcatgctttataaggtaaggagataaaaaataatgaacatgcaacatgtagcgcatgatcaaaaaaacatagctattataattgtctccacttttcagaataggaaattgaggcttaaaagaatgtaaacaaaggccacacaatttcttaatttaaaatatagtcattcacacatgcacacatattttatagcagcacaatttgcaactgcaaagataggaaaccaatcaaaatatccatcaaccaatgagtggataaagaacatgcaatatacacacaatatgtaatactgcctagccataaaaaggaatgtcttttgcagcaacttggatggagttggagaccattattctaagtgaagtaagtcaggaatggaaaaccaaatatcatatgttctcacttataagtgggagctaagctatgaggatgcaaaagcataagactgatataatgtactttggggacatggaggggaagggtgggaatggagtgagggatgaaagactacatattgggtgcagtgcacactgtttgggtgacaggtgcaccaaaatctcagaaatctccactaaagaacttattcatgtaaccaaaaactacctgtaccccaaaaactattgaaataaaaattaaaattaaaagaaaattctgatgtctttctctctatatatatgtgtatatatatgtatacatatataaatactatatatgtgtatctatgtatatatgtatacatatgtatacatatataaatacatatatatagtcattttatatatatatagtcattcaacgttcagtcaccttttgattgagatatatgtgcttgatactgatgaatatgcatgtgtttgtttctccaagcaagatttttcaaataaagtgtttcaaaggacaggccataggctggggaaaattctgcatgcctcccacttctcagcagtttcctttattctcctccctcctcatgccaaaacaccctacatatgtatatacatatgtatacatatgtatacatatataaatactatatatgtgtatctatgtatatatgtatacatatgtatacatatataaatacatatgtgtattatatgtatataaacacatatatgtatatacacatatataaacacacatatatgtatatatacacatatataaacacacatatatgtatatatacacatatataaacacacatatatgtatatatacacatatataaacacacatacatgtatatatacacatatataaacacacatatatgtatatatacacataaacacacatatatgtatacatacacatataaagacacacatatgtatatataaacacacatatatgtatatgtacatgtataaacacatatatgtatatgtacacacataagcacatatatgtatatgtacacacataagcacatatatatgtatatgtgcatacataagcacatatatatgtatatgtgcatacataaacacatatatgtatatgtgcatacataaacacatatatgtatatgtgcatacataaacacatatatgtatatgtgcatacataaacacatatatgtatatgtgcatacataaacacatatatgtatatgtgcatacataaacacatatatgtatatgtgcatacataaacacatatatatgtatatgtgcatatataaacacatatctgtatatgtacgcatgtatgtatgtgcatatacacatatatgtatgtatgtgcatatacacatatatgtatgtatgtgcatatacacatatatgtatgtatgtgcatatacacatatatgtatgtatgtgcatatacacatatatgtatgtatgtgcatatacacatatatgtatgtatgtgcatatacacatatgtgtatgtatgtgcatatacacatatgtgtatgtatgtgcatatacacatatgtgtatgtatgtgcatatacacatatatgtatgtatgtgcatatacacatatatgtgtgtttatgtgcatatacacatatatgtgtgtttatgtgcatatacacatatatgtgtgtttatgtgcatatacacatatatgtgtgtttatgtgcatatacacatatatgtatgtatgtgcatatacacatatatgtatgtatgtgcatatacacatatatgtatgtatgtgcatatacacatatatgtgtgtttatgtgcatatacacatatatgtgtgtttatgtgcatatacacatatatgtgtgtttatgtgcatatacacatatatgtatgtatgtgcatatacacatatatgtatgtatgtgcatatacacatatatgtatgtatgtgcatatacacatatatgtatctatgtgcatatacacatatatgtatctatgtgcatatacacatatatgtatctatgtgcatatacacatatatgtatgtatgtgcatatacacatatatgtatgtatgtgcatatgcacatatatgtatgtatgtgcatatgcacatatatgtatgtatgtgcatatgcacatattgtatatacacatacatatacgtgtatatctctatatatacatatatatgtatacataggtaactgaacgtacaggtatgaacctgtaccccaaaaactattgaaattaaaattaaaatcaaaagaaaattctgatatctctctctatatatgtgtacatatatatacacacctatatatgtgtatacatatatacacacctatatatgtgtatacatatatacacacctatatatgtgtatacatatatacacacctatatatgtgtatacatatatacacacctatatatgtgtatacatatatacacacctatatatgtgtatacatatatacacacctatatatgtgtatacatatatacacacctatatatgtgtatacatatatacacacctatatatgtgtatacatatatacacacctatatatgtgtatacatatatacacacctatatatgtgtatacatatatacacacctatatatgtgtatacatatatacacacctatatatgtgtatacatatatacacacctatatatgtgtatacatatatacacacctatatatgtgtacgtgtatacatatatacacacctatatatgtgtacgtgtatacatatatacacacatatatatgtgtccacatatatgtgtgtgtacatatatacacacacatatatatgtgtatacatagatacacacatatatacatatacatacatatatatctctatatatgtatacataggtaactgaacgttgaatgactatatatactatatatagtcattacgtatatatacactgtatatagtcattatatatatacactatatatagtcattatatatatatgcactatatatatagtcattttatatatatatagtcattcaacgttcagtcaccttttgattgagatatatgtgcttgatagtgatgaatatgcatgtgtttgtttctccaagcaagatttttcaaataaagtgtttcaaaggacaggccataggctggggaaaattctgcatgcctcccacttctcagcagtttcctttattctcctccctcctcatgccaaaacaccctctcagatgcaaattttgtaacccaatcattactgcaggactttgctgtaagctacctgtcaattaaatttccctggagtctctcaaaccactctacattgcctattttaaatctatcagtggatgtggataaggataaatattgtccatagggaaaaaaaaaaagcacacacacaaataaaagaatgaactatacctaacagtgggataggggaaggagagataaagcttcgaagtcactattaacagttcagatcatctttgaacaaaatagcatttactgaaagtcttttgatagaaatatttcctatcctttcataaatttgttctttcttgttaggtgtttcctttttcctttttttctttttgttttaccaattccactattgagaaacttattagatgtttactgaaaagggctggaccattttcggaacttgtgcaaccttcaaaattcttagtttattcaatatgtagagcttccactattgcttaactgccacacccttttcaaattccttagaaacttgtaaatctgaaaccaatcagagatggttaattcatttcatacagtcccaaatgccaaaatacatttttttcatggaaaattcaagctattcccagatgtcaaccataaacatgcattttcctccccttttcttcactgtttgggtcataaaactagtgccacattcacagtaaggaagcaatggctctaattttaatctttcatcttgttttaggctaaactggaggtcagctttaaagggtatatttgttctagtcagccaactttattgagccctaactatgcagtaggcattggggaaagtggatgaataaacccagtttctactctcaaggatttcagtctattaatggaaacacattcatagacaaataattattaacagtgagaatcatttctacagatacaaaggaaaagattaagcctatgtagctttttgtggcagaggtagatatcaggaaaggaactagagaaagttggaagtgtgaacaccatatgcccaataactattgaatggatgagcaaattgtggtacatccacacagtagcatacctgacaacagtaagaatgaactactgatacaggcaacatcatggatgaatctcaaaaacattatgctcgctggacacagtggctcatgcctgtaatcccagcacattgggaggctgaggagggaggattgcttaagtccaggagttagacaccagacagggcactatagtgagaacatttctctacaaaaaattagccaagttagtggtgcatgcctgtagtcccagctattcaggaggctgaggtgaaaggatcacttgagcctgggaggcagaggttgccatgagccaagatcaggccactgcactccagcctgggcaacagattgagactctgtctcaaaaacaaaatacagaaacattatgctaagtgcagtatgctggatgtagaagactacataatgaataattcaatttatatgaaattattttaaagacacaactatagtgacagaaaacaaatcagcagatgttggggccgggggcaggaggaggggatagactgcaaggtgacataggaacatttttgcagagtaatgttctagattacaattgtagtgcttatatgactatataagtctgtcaaaagccattgaattgtacatactcttaaaaattggtaaaatttatcatatatattgcattgtattatgccttaataaagctgacttttaaaaatgaatgagtccaattttgctatatatacacagggcataggaaaggcaggaagaggtttctggaggagactgcagatagagacaaccaaagacagggaaacataaaacaacatcagggagaagaaggggttataagtggttcattatttctggagccgaagtgaaagagtgaggaggactgagaccagaattagattatggaagactttatggccattctcatcttcctgtaaaaagtgtagctttggccttcaacaggaaacagcaaaaagagaaaaacacactctcctaatcgatgacaatatgagatgctcttgaggtagcttaagtcagatatttacctggaataaataaatataattatttacattgtaaaatctaaagtgctagcaagattatttctcagcaatgatgttggctcccaagagcactccagaaaatattctattttgaattagaggcaaattcactctaccaaaatttagcaatgtcctgactatacactagccccacaaagtggtcatttgccccctagccaagccaaattaaaagtttgtgacacttttacaactaaataatttgaaaaagtgaattatccatgattagtagaaaaaaatgaaaatagtgttttacctaagcatgagagaataggacaaaataagaaaagtagattaggacataaaaagaagctaaaatgaataattttgtaagaaaataacctgcctcaaccacagcttttgtcaaagggcttccctcagttaatcgatatctgagtctacctatcttgagagaaagtggctcttttgccctctattacaagagctgacccaaagagactcagggtcagggcttgtcctatactctgggccaggtcacaataaccaaccctcaccccaatacacacacacacacacacacacacacacttttttggtgtacataccttgcccatgtgcttcaccagacatgcctcctgcttcctcctctagctccagaaagcctgtgtgtaagctctggcatctgtctcctcacaggaaagaaaaccacttgaaagacattataggagcctcattttactttctgggaaattaatataaaagatccataggttttagagatagactccaatttggagatggatgcagtaataaaaacaacaaaagatcacacaaatgtcacttgtcttcacagttaatacttcctcctctccctctcctcccttccactctctctgtctctctctccctccctgccccctcctcttttgcttgcatagctccttcactttatacccatgcagatagagttgcccaaatcagcaaagcaactgtatctgaagtatcatgggatagatctacctccatgtcaatatgcagattgtcttgtcttacccttcacactggaagaatgatgatgatattaatattagtaattataacaataatatttccactcattaaacaactacaactcaccaggcagtcaacattgctagtccttataatcacctgcagagcagatgctgcaattatctttttacagatgaagcactgagactcatagagataaaataaggtgcccaaggtccagtaaggtgatagttgcagaatgaagattgaaacgttgatcagtctaactccaaatcttatactttttccataaaacactgatgaaaagtaaggtgagaaggaaggaaagaacaagaagtctgttctgtgtccagacatattcaggaccacatagctccaaagttagagaagcaagtgctgatgaacaagacttcagaaaaatatctatgttctattcatattccaccagtattaaacctggccactggagaagacagtgtggcgattcctcaaggatctagaactagaaataccatatgacccagccatcccattactggatatatacccaaaggattataaatcatgctgctataaagacacatgcacgcatatgtttattgtggcactattcacaatagcaaagacttggaaccgacccaaatgtccatcaatgatagactggattaagaaaatgtgacacatacacactatgcagccataaaaaaggatgagttcacgtcctttgtagggacatgggtgaagctggaaaccatcatttttagcaaactatcacaaggacaaaaaaacaaacaccgcacgttctcactcacaggtgggaattgaaccatgagaacacttggacacaggaaggggaacatcacacactggggcctgtcatggggtggggggagggggagggatagcattaggagatataactaatgtaaatgacgagttaatgggtgcagcacaccaacatggttcatgtatacatatgttaacaaacctgcacgttgtgcacatgtaccatagaacttaaaatacaataaataaattttaaaaagaaaaaataaaagaaaaaatcttatccagtaaaaaaataataataaaataaaaataaaataaaaaaataaacctggccactgggggagtaaagacttcacccattgtattagtctattctcttgctgctatgaagaaatacccaagactgggtaatttataaagaaaagaggtttaattgactcacagttccacatggctggggaggcctcaggaaacttacaatcatggcagaaggcacctcttcacagggtggtaggagacagaatgagtgtcaaatgaaggggaaagctccttataaaaccatcagatctcatgagaactcactcactatcacaagaacggcatgggggaaactgaccccgtgattcaattttctccccctggtcgtgcctttgacatgtggggattatcaaaattcaaggtgagatttgggtggggacacagagccaaaccatatcacccatccaccagtcaacaattatgataaggaaaataatagctccaccaaggaggtgatatttaatccaagtctcaaaaataagttggcatttaccagagtaggggattgaacattatttcagatacagcactttcagttactaaagcatttcctaaatattatggtgtttaatactaagaaaaagagtgtgagataggtgggactgttatcgatatgttcattttaaagattagaaggtttaggatactgatgatcagataggctgatcttataccacatcacacatccaggcaatagtatacatggaaacacattggagaggaaaactggtttttgtaggaattgggttttaaattttaaggcagaaaaagaggtatttgcagagcacttttaagcttctgtgcaattccccctaatttaacacagtaataagttttagctcaaaggctttttgaaggaataataattttgaaaatcttccctattttcttctaccttttaaggatgtagggtaaaaatgctctcccaaaatataagtgtgcttgaatgtgatccatcctgtcagcaaaggcaggagtaatcataatgtaaagatagatttttgcgtatggcttatgccaatgtttgtatttgatgaggatgtctgacaggcagatcatatgcaaatatttgagctgaccgcctagaaatgagggaactgggaaagcaaagatgaaaagaaggagtttaaagaaagtggagcaagttgtagcatgtttggtgcaatttgaagggagcgccagcactgctttaattgagttcatgcaaatcatttaacaaacaaacaatacccaggacatgggaggcaggatcagcttcaggaaaacttttctgttgagtcagaaaagatatgagagagaaatgcagcagcacacagagcagatagaaccagagtaccaagtcaagtttaggaattgttgaggccaaaggaagctgcagagtggaccaccaagacagagctgataggattacaggaagctaagacatgtctttttgaatggaaaaataataataaatatttttttcaagagagcaaaatggcttttattggacattattgtgtttcagacactgccttatatgctttatattactcattatgtttacaacaatccctttaagttaggtgttactgtctttattgcatagataaggaaactaatgatgataaagttgagtgacttgctcaaagtcacactactggttgagagccagctgagtttcaaacacagtcttctggctctgttgcccaagtgctcagtcactctcctctctttctcactcttggaaccttgacttgtgcactaaaatatgtccaactttctccagatcttctagtatgctgtctgctatggactgaattatgtccctccaaattcataggttgaagtcctaagccctatgactgtgtttggggctttaaggtggtaattaaggttaaatgaggtcataagagtgaggccctaatccagtaggactgggacccttagaagagtgaaagagacactagagatgatgggatgattgcacatgtgaggacacagtgagatgacagccatttatcagctgcggagagagacctcaccagaaaccaactctgctgaagccttgatcttgaacttccagcctctaaactgtaaggaaataaagttctgttcttgaagcatccagtctatggtattttgctatggcatccctagccaactaatgtactgtctagcagtaacaaaggccagcctaggttatggagaatcaaatcaatacagatatattacctgaaatatgaaatgcacgatgatacttggctctgcacctggggtattgtgctagacctggagttatactataactttggaaggtaactggtgaggaaaatggaatgatagtttagttattaaacttatatctattgagttctctcaatgagccagatgtgaggaatctagtgtataattggacaagatatacatgtaaacaaataaatgtgatgccaaatgaagtgaactctataaaggcatagtggatagaaagtggaattggaaccaggttaattcgtgttcagattcaaggacttctaacattatgaaatggggaaaattgcctagtcttcctttccaagcctgcattttctcatctataaaatgagtttaggctgagggctgagcacagtagctcatatctgtaatcccggcattttggtaggtcaaggtgggagaatagcttgaggcctggagtttgagaccagcctggggaacaaagaccccctctctaccaaaaagaaaaagatttttttttcaagcagctgcgatatggtagtgagcacctgtagtcccagcctcaggaggctagggtgagttgattgtttgagcccaggaggttgaggctgcagtgaggtgagctatgatcatgccactgcactccagtgggagcaacagagtgataccccatctcaaaaaaattaaaaacaaaaataaaagaaagtgagtttaacacatacacaccccataaaaccactgcgagattaaatgacctattgtaagtaaagtaaatttaaagtacatggcacgtggtaggtgctcaataaagtgtatatagagtcatcattgtaattatctatgagatctagtgggggcaagcataaaaggattatcttctctatatagaaatatcaaaggaagacttcccagagaaagtaataatctgagtttttaaaaatgagtagtttatccggctgatagagaaaaatgtatttgaaagtgcagttcgggtacagaaaacagcatgggtaaagataaaaagacataaaaccaaattgcaagttagagcactatatttaattcaacatggttgacctagaaatggaaggaatagtgaattaggatatggtaaacactgtttatcacaaagacccaaaatagcagtggcttaaatctgatagtttattcttctttcacatgaacgtttgagcagctacggttcctcttctctacagaatcatcagagtccttggttccttttatctttgtcttcatccacatagtccaaggtagctcactaccaagtccacattccagtcagcgggaaggaagacagcaaaggatggaatcatcacacttttcaaggacagaagccagaagttgaacatgtgccttctatccatatcctcttaaccaggagttagttacatggacactgtgacctgcaagggagcccagaaaatgtggtatatgccaagatgttattttcccataccaaattcttagttgcagatttttacatttttgttccaacactgccaaaattttaccataagaactcttttatcaatagtatttctaaggaaattgctatgtttaatacaccacagtgtctgccactaattacttattcacccaaaactggcttctcttagtatgactacagttgggctcgctgatctgtgcactcagtaatctgccccatgtgctctcttacctcatgttcactgtgaggagaggaggatctttatctcatttgaactgagggagaagaaaaatttccacatcgggtgtctgagcaacaacgggttccctattgaacagaaacccaatgccaagatattgccaaagtaaccctttcaaattctccctaggtcagaagtttattgtctaatttcatagccatttgatggaagttgcagttaccattttaaatgtataatgtacattagaatagataatttacctgtgtcataattaatttataaactacctggcagagcgaggtggctcacgcctgtaatcccagcactttgggaggccgaggcaggcagatcacaaggtcaagagatcgagatcatcctggccaacatagtgaaaccctgtctctactaaaaatacaaaacttagctgggcgtggtggcacatacctgtaatcacagctatttgggaggctgaggcaggagaatcacttgaacccgggaggcggaggttgcagtgagccgagatcatgccactgcactccagcctggtgacagagtgagagtgcgtctcaaaaaaacaaaaaacaaaaaacaaaaaaaacaaaaactacctgactaaactagaaattaaaaagaaaaaaagtctaatttttcaaagtaagagtgcgtacatattaaatgcatttaatgtcacaagaaaaattttatccataaaaagataaatgacatttcatcaaataaaatcaagaatctgaaaactataaagctaaatatggcaacaactaagttcattatttctttaaaaataatagacaccaaaagtctctttgagttaggacaaaaagtcaattaacaaatgaaataattactataatttaattataatacagaatatctaatgatattgaagtaggtgattaagcctaatagtaataagtaataagaacttgtgccttgtactaggttctaggagtaaaagaaaaaaaaaagtatatgactgtattttcttttttttttttttttaattataagacaatgtattgtagacccagctgcctaactcagtgattctcaatcttcttgcccactagaataaccttgatggttccaaaaaatatataccaatgcccaggtcagacttcagcaccatataaacagactgcctagaagtggagcccagatgcctaggtgattcttatatgcagccctggttgggaactactgcccttactaggctatgagctccttgagggaaaagactgtgtctggtttatccctaagctcatcatagtgcctgacacatatagatactcaaatgttcaataaatgaatggatgagggggtggatgggtggatggatggatggatgcatggatggatagatggatggatagatggttgaaagctagcatttcctgctctcaaggtacttattatcaagtaagaaaaatacaacttaaacacagatagttaagtagacacaagccagtagatgtcgcatgattaccactgtatttcacaacagagattatgatctgaaggaaagcctaattaaatgcttacaagggagaactttcatttataagccaaacaggaaaggcttcaattacactgctgattaacacttaattttaaaagagaaggaaggagtcatcacatagatcttaacacttaaaaggaataaaaataaaaatgctattagcaatgagggaatgcaaagactaaaccttggaagtgaatttttgagtgctgtaagccctgttttaataccaccttctctaggacagaccatgtgtctggttttgttggactggattttgtttggcttggttttatggtaacttttctcccctgttattatttccaggtcaccaggccattctactctctttgaatctacaatcagtgctttcatccagatagatgatccagtatttggatattaatctttccagggcactcagccagaagcattcttacctaactcctccacaccctagtgccacttagcatctaaattgagcccagatcctttggtaccaaacactgctcacaagggactatgcaaattaaatgactccttttgaacaactgggtatttataattaatatacctcccaatgtaaattaaatgaataaatatgttgtggaaacaaattacatttggacaagaatcttttttcaggtcagcttgtatatttatgtctgatgaggaaagagaaaattcttagtttccttggggaggaagttattagaaaaatttgaaatgtttttcagcataaaattacataacgtatccactcaaaaacatctctaacagagtacggcttatcagaaaacaaaaaattatattcaactagacacagtaggcaaataaaattcaggcacagaaattgaaaaaatgatttaaagttagagctaaaccaagatgcaaagattatgcctcatgtttttcaacttttgataagtaatgtaccaaggttctagaggcctctcattctcagaagtaagaccaatctggggagtgttctaactcccctctgattcctgactgataagaaccaaaaaggagggcccgagaccacatatggtaccacctttggtgcagccatcaatgacaacttcccaagcagcagagctgacacctggttcttattctatctctgtcatcacatgtgccaacatttgacccaagcactaaaagaactttgatcaacaacacagcagtattcctcaagtacttgatccttcctcccttccaggaggggaaactttgctggttcccctcctggtttgctgattcaacatctctgttggcctttttcacctcacttcttaagtatttgtttaatattctgtccatttgccttttttacggcctccaaaaaatgagtctccagcatatcttctctcctttttaaggttcagatcaaagtctccaaatgccttctgcttatcttctcttggatattccagtatccaaaacaaaacttgatatcatcttattgtcaaataatctggtcctcttttcccatcttagattcatgatcttaccattccttcagtcttccaggctactgggttgacaaatgttctggattccatcttaaaactgtatctcagaattaacctctgagatatgtccccactttccgtctctttgctcaggctctcattacttctcatccaggctaattcaagagtctgctaactgatcctcctactacttgtcttttccccactgtcacaatcatcctcctgggttttcttcttaaagaacagcaaaatgtaattttgtcacagtcctgcttgtaaatttttgctgactgtcccttgcatacaagattaagtccaaacttggcctggctcggtggctcacgcctgtaatcccaaaactctgggaggcctcggcctgaggtcaggagttttaagatcatcctggccaacatggtgaaaccctgtctctactaaaaatagaaaaattagttgggtgtggtggcacacacctgtaatcctagctactcaggaagctgaggcaggagaattgcttgaaccctgtaggcggaagttgcagtgagctgagattgcaccactgcactccagcctgggagacagagcaagactccatctcaaaaaccaaaatcaacaacaaaagaaaatttaatcagaagggccataccaggcctttctcaatatgacccactttgcttcaccaggtgagctctctgacacgactcaccacactcttaaatgaatttctctctttattccccacaccagctatgcctttcctatattttacatgtgttgtatcttctgtgtaaaatatctgatcttccccactctacctacacctcaacctggaaaacttctatttttttttttatttaaaaaatagatcaaatgtcacctggctagaaagtcttctctaattttctcaaggtttaatccacccacatttgataagaacaagcacgtaattccaagatcctcggaagcatcctgctataaagtatgttccttgcaacagacatgaactgcgtctaactggctcaccactgtatctccagcagctgacatttttcccagcacataatccttgttcagtttatatgtgtttaatgaatttatctcttgctctttagtcattagagcacagagacaaggaacatagttgagacaggaatttggtggaagggggaatgttaggagaagaggaatacagaatcctagtcagtcagtaaactaaaaagtctaagcagacagagaaactgaatttgaagtctatcaaagagacttcctaggagcccacatgaaagagaaggctctaaggctcaggtgtgaacagagagacagtggttaaaaatgccaatccaatatgaaccccaggcaggtagattgtctctctttgaaatcccatgggtcttttacatgtagtgtcttgtattacaatttatttgttcacatgactgaaacacccaacagactgtgagttccttgaagacagccaccttattcctccttatattttgagtacctgttactgtgcccaccacttacccaaggttttactataaatttcttgttccattaaaaacccttaggcataataaatgattgtgcagggactgagtttcactgttagaaccactaatgaaggcagacctggagtcagagaatccaaagtattaatgcgttcagtgagaccatgaaagttcaaatcacatgagacacctgagaaccttgagtttgcttttcacagatttatttttagggcaatgaccctgaactttgtgacccagacctacttctacttggtcccagtaagttttcatcttcagaagagctgagaaatagctcaagctgaataattggccataatttagtcaaggtcttctttgacagtttgttgacatttacagtctctaagagtatgatcctgcctgattagactcagaatacagtcagccccatttttaaaagaccaactcttacacaaaattattggcctattagcttttcagtattactctttgatacaatgcaaatatgagcttctcaggtaaatatttcacacgaggactcttatggagtggccacaaattctttaatcttcctcctttcaagaagtgaagcccatgtgctagaatctgggtgggcttgtggggtgtagaggagaaaatgccatctgatttctaaggtgagctcattaaaaagccatgcagcttctgccttgttcacccttggagctgcctgagccagatagaagaattctgactatcctgagaccaccatgctggagggtgcacaggcagatactccaccgacaatccccactgagctggtcctgcagccatctcagcccaggagggacacgtgagagaagaagctgtcttggaagtaaaactctagctccagtcatccaagtcaccccagccatttgagtcaccccagctgaggtcccagagccacctcacctttccaagttattcactacacctcatttcagacccagatttattataacaagtacttggtgtccataagaaaaaaaaaaaagtccaagtccagctccactgatagtggaggagctgaattcaagacccataggatttgagctgaacttcctgggtctcaggggcactaagatagacaaacccagcagagatgtgggccttgggagtccatctttctgagcattcttatgcaccgatactatctccagcttcattttattcttgattttctttccctctgtcccattttcttcacgttatataaatgaattttcctaagccattttcaatctttttgaaaatcaaagtaaagtataaatacacaaagttatgttaaaaagatgttgaagaaaacagcagtccaatcaatttttgttgaattaactcattcattaaaggtaaaagcaatgataaagtcctatctttctctctattcttaggataggtgctgtcttacttttttttttttactgacaagatgctacagattgaatatttgtgtcccccaaagattcctatgttgaaatcctaaccccaaagtgatggtattaagagtatctagtggtggggcctttggtaggtgattaggtcacgggggctctgccaatttatttatgtgcacaaattaaaagggcacaatagtattagtgcccttataaaagggaccccagagaactccctcactccttccatgatgtaaggacacatcaacacatcaaggagatgcctgtctatatgaaccaggaagcaggccctcatcagataccaaattttctgacaccttgatcttgggcttcccagcctccagaactgtgagaaataaatgtctattgtttataatccacctattctatggtagtttgttatagcagcccaaacataagggataatatcccagaataagggataataataacaaacaacttgttttatttctcagattgatgaatacaatctggaagttggtaaggggtgttcaacttatctgtgatacattggcaacatggaatattaaggaactccataggtaacatgtaattgacctgaagggatgttttgaaggtgtggaaatacaaaaagtaaactataaccttgtgcatatggtgagatccgatttggaaaaaaaataataataacaccagccaaagcacacacatatgcacatgaacatgtagaaatacgtgaaaggattcccaccagattgttagcatttgtcatttggggacccagagatgggaagtgcagggggtaaatgaggtgaaaagattttaatagctcattttgcctttattttcctttatactgtttcacttattgcactaagttcacattactcttgcaatttttgaagagaaattaaagggggaaggttgttattttttttaacgccttagaacatgcattttttcccctctttcccttatcctcccatggtaatgtctattgatctactcttagcatcctacgtgctacagcacatgatttagaatttgaaattcttttcacttttaaataactttattgagatatataatttacatataataaaatctgcctattgtaagtgatttttagtaaatttatagaactgtgcagtcaaacccacaatacaattttaggatatttccatcacctggcaaaattcccttgtggctatttgcagtaaattactcccacatatgcccagagcttctgtctctataaatttgtcttttctaggtatttcattacaatggaattttacaatatgtagtcttttaattctggcttctttcaggaatcataatgtttttgaggtcctccatgttgcagcatgtatcagtaatctgttctttcttttcttttcttttctttttttttttttcttgagacagagtctcgctctgctgctctgtcacccaggctggagtgcagtggcgcgatcttggctcaagcaacttctgcctctcgggttcaagcaattctcctgcctcagcctcccaagtagctgggattcaggcgcccaccaccacacctggctaattttttttatttttcatagagatggggtttcgccatgttggcctgcctggtctcaaatttctgaccccaggtgatctgcccgcctcagcctcccaaagtgctggggttacaggcatgagctaccgtgcccagcaatctgttcctttttattgctagtttttaattttatagatatatcaccttgtttaatcttttcaccgcttgatgacatttgggttgtttccacttttttggctattattaatactgctgctgtgaacatttgtgtacatacacctactatgtacccacaaaactggaatttgaaatttcaacaaagaaggtgtgaggttattgatagacaagaggggccattttataagtgatcgaggcacaattcattatatacatgttgagccactgagagctcctctaacacaccatgttttggtacatagctagtaagtgaaaaattaggtagcccctgagtacttatttaaattatctgcctcttttggataaatgcatggaaaaattctaacagttacagtttgttaaaacctgtaaacaaatacccaattagcagcaatctcattgagactatcagaagctgaaagaaaccacactcaacttcataactcaagtagaattccccttgcgaaaaaaaaaaaaaatccatggtagtactggactcaatacacaattttgctaccaggtaaccaacaacaaaaaaaacagtttgcataaggtcaactatctctaaacacaaattcacagttttggcaaatattctccaaggtttaattggtttatatcaaacaactccaaacagcatgtcagtcatttttattagtaaggggcacatttcacaagtaattttctctagagggttcactgagaagctttcaaactcagacatttctcagatggatttctgagatttttctcggggtaattctgctttgaaaatcttccaggctaaaattgccaaagccacggtctacagtgtagacctttggaactttgttgattgatctgcccctatcctggagcagacccagaattgtattctgagaaaaatctattaactgtctatagtgctcctaggccttctccatgcagaggtaggccaatgtctattcaagacaaagtctagcttaggcaccttaattttcataaggggacattaacctttttctctttgctcaattgatctctaaaatacatactttttgaagtatattagctttataatacatgtgcttcaatcataacaccaaataattgctctaaggcatttttcagataataaaatacctgacagtcactacccagcttttatcaaaagacgtaagaaataatattcatagagaatccataattaattcataattcaaggagataaagtctacccagcccaacaaatagtttagatttttatccctggatcaatccaggcatgcgatgtggctgaagtataagttacgggaagggagaggctggagaaggttgtaaagagacagccaggcttgggattatatttcaaaggccttatagcccatttattcagtcaccatgaaatgctgtgtcatcaaaggatttcagataggtaggacgctgttacataagaccaggtaaaaggtgattagtatcttagcagaaacagttataatttgaatttaaattcaataggactgaaaattggttgaatgtaggagacaaaggaaaacagtcaagatgactcccgtagcatgggccctgaatggagaatacagaagaaacaggttggggcaagaagttaataagctcagtgttaaaaatgctgagtttgataccccatagagtatccccagaaatgacttactgagttattcatgaatctgaagcttggaggatatgggctggtgatacaggtttgagaatcatcagcaaataaaagacaattaaaactataacagctacctacctgctatgtctcctaggccaagtcacctctctatgcctccattttctgatttgtaaagtgaagattatcatacctaattgagggttacttaagaaaattactatacttttgcttagtatgctcttgatatatgtcagttgtttaaaaaactaaattaattgccaagattgccttgcaagaccacatagaacaatggttattacacttttggagagaaattaatgcttttgagaatagctgtaaactatggactttcttattagaaaattacacataatcaaagacccaaatttttgcacagaatttcaggaggcctgtggatcactaaagaacctgggtttaaaattttttgatgtacaaggggaagagggaaaatctgagaatcaaacaggaaaaaaaaaattatgaaatgagcagattaggagaagaccaagaagagattatcagaaagcggcaaacatcaaacagtttcaagaagaggctgtgaccaattttcccaaatttggcaagtagggccaataagatgagttaaaatgatcattggcaacattcacgaattgtattagtctagtgatgggagagaaaattagagatcagtcagttaaggagtgaaaagggagtggaaaagcagtggcaactcatggacaaaaaggaagaaaaaagatggaatgaaagacaaaagagaatttgtggtcaagaaagggctgactttctgtttgctgtgtttgttttgttttgtggtcatgagaatttattttttgttgttttggggtatttcgtttgttcattttttaaggatgagaaagatttggggtgtatggactcaggattggagccaacagaagggctaaggtggaagataagaacagagtgggaatgactgatgaagcaacattccaggaatggagatggggaggaaagaaatggaatcaagggctccaggagagggcttggctttgtgctagaaggacacatcatcctccaaatatgtggaaaggagttaagaaagtgtctatatattagtaagtgctgggcagggtggacaattgatggatgactgtaactttctcaagtaagaaacaaggtggtttttgggagcctgaggcaggagaatcgcttgaacccggaaggcggaggttgcagttagccaagatcgcgtcactgcactgcagcctggcgacacagcgagactccatctcaaaaaaaaaaaaaaaaaagaaaaaaaagcagattaacaaggtggtttactgagaacattggcagttaaatgttgaggaaatgatgaagatttggaatagaagccaaagaggatgataaagaaagctaagcaaaacaagtaaacttgtattactctggattaagctcttggaactcatttctcataagtttttaaaatcttgataaccactgatgagagaatacaccaaataagtattttggcaattagtcttcctatttcactagcaattgtgtttagataaaaatcattataattacatcttaagcttcttgtaatacattagacttacaaaactgcaaacactatactagatattatgtatgtatatattatattatattatatagatcatatacattatgtgatactaaatgccaaaattttacttgatgttttgaagtgcttagtgttgttcaatgcttactttagccagctgttatgttttcagacagtgatttgctttagtcttctcttccttgcagaatcataaggaaccttagcttatgagagcagtttcttcaagaatctgcttattagagtaaatagaatgaatttcatttcgtacagttactactacaacatttgatgataccaaaagcaaagtgaaacctgaagcatgctcacataataaattacaaaattttccatatgaagcattctttattttctgaacccaaagctctgtgtccctttgtaatgaatcagcatctcaggcaaatgttcttgtgaggaggcaaatttttcccactggatttagcacttaaaacagaagttgtccccaccaccaccacactttctaaatacaaagagccctgttataagatagtctcatctgagttgtttttcttttttcttttagattatgtgggaaatgtgttgcatatttgcatttagtatttgtgcaaatgttttaaacctttttctccgtgttgaagctggtttcggttatagttatccgaataagggggggaaagaggtgaaaggacaatatagtttaaagtatttaaagccctaaaacttcacaaaccaggaattaaatataaaggtattcgagttttttctgacttatgaaaatttaaagagcagtaccggccgggcgcggtggctcactcctgtaatcccaacgctttgggaggccgaggcgggcggatcacgaggtcaggagatggagaccatcctggctaacacggtgaaaccccgtctctactaaaactacaaaaaaattagccgggcgtggtagcgggcgcctgtagtcctagctactccggacgctgagggaggctgaggcgggagaatggcgtgaacccgggaggcggagcttgcagtgagctgagatcgcgccactgcactccagcctgggcgagagagattccgcctcaaaaaaaaaaaaaaaaaaaaaaaagagcagtaccaaaaatatgtaaggttttcttagaaaatataaagtgctaacctaaaaaggaaaataatgtatttgccacatttaacaaacacttatggaccaagataaaacagatagcccataaatttggcgttgtccctttaatgtacatgtctatagtgccaccatgtggtactaccggtgttgtaaatatttctaaatacagtaattcagatattctgaaagttagacactagatggcagtatatttccctttaaaattgtttattcatgttcaaaggcagtatctattttttatggtataactttgttgaaaagtaaaaaaaattactacagtttttaaaataatatgctttgtaacatagactgattgcattaaaaagtatgcttttaatcatcatttatttctcaaatagaagcaaaatattaaaataactacttgcttcctttattagcatgcccaacctaggcaaaagaatctcaccaattttttcttcttctactaaagtcctgtgattagcacagtaggatccaactgtattgattctatataattactaattaacaaaattttactaagtaaagacttagaggcagaaaaaacaatgagaaatttaggcaacgagtcagcttaggttcatttatgtactgtcttcaatggctaaagaagaaatattggcaggggagggctatgactttcattctatctcccttttatcctgcttctgaggctaagggctcttcctaatttatcctggcaatcagaaagaaatactctatgccatcctgaaatacaaatccaagatgcattgttcaggaggttttcctagttggaaacagcaagtgctacatgatatatcagcatccaacagagccatggctttttgtatagaaatttgtcttttccttaatataaacaaaatccagatcttccaaaactgtcaaaggatcaccaggcacacaaaaaacgttagcaggagcatgaagccccaactctagttaatgtattaatttctcctttgggctcttgcttctgacatctgcctctactaggtaggtttgagacaagaagtaaaggaatgctcatttacctttaatatcctagcccatttttggacagagaccctgcctttaacaccaataagcaaaactacaacagagctagcatatttaaatgagacttaactaaataaaaaggaataactatagattgcttgatagaaacagaattacattagttccatcagaactagtttcctgatagtttttataattaatatgtaaaaatatttaactatccccttgatttttgagtactcactgggagaaaattaaaccatgtcctttccctggaatgattctaattcctcacaagaaaaaacttgagcttggaaaccttgagtcttgatagaatttgattacctttgagatagcattgggggtggaaggtggcaaggaaatagcctttttgtgctttggaactaaaaatatgtagaagtgatcttcaccaataaccctctcctcacacatatgcagaaaatcaggactttgggaaggtacatgaggcaagtgggctaaattgtttgaaaaggggcctgtcataatgggtggaggggtaaatggctgagctcaagtactcgagtcctccaagaagaagagggaggaccaggctgcatgttcccacccactcccatacagatggtgaccaaaacttcacccccaaattgaacaacactcctgaacaaccaaagggtcaaagaagaaattttaaaaaataacttgagacaaacaaaaatggcaacacaacataccaaaacttatcagatgcagcaaaagcagttctaagagagaagtttatagtgacaaatgccaacattaagaaaaaggaaagttctcagataaacagtcgaactttatacctcaaggtatagaaaagaataccttgaggaactagaaaaaaaaagaataaaccaaacccaaaggtagtagaagaaaggaaataataaagattagagcagaaataaatgaaatagagactagaataacaatagaaaagatcaacaaactaaatgttttttgaaaagttaaacaaatttgacaaacctttagccagactaaccaagagaaaaagagaatactcaaataaaattacaagtgaaaaaggaggcattacaattaataccacagaaaggcgaaaggtgatgaggccactatgaaaaattatacaccgaattggataacctagaagaaatggataaattctttttaatataaaacttaccaagacagaattaggaagaaatagaaactctgaacagaccaataccaagtaagaaaattgaattactgataaaaaaaaaaaaatgtcccaccaaagaaaagcccagtacctgatggcttcactggtaaaatctgccaaacatttaaagaataattaatgccaattcttctcaaactcttttaaaaatttaagagaaggaaacacttccaaaattattttatgagaccaacattaccctgtactgaagccagacaaagaaattattttaaaaaattacaggccaatatccctgattaatatagatgcaaaaatcctcaacacaaataatactagcaaactgaattcaacaggacattaaaatgatcacataccacaatcaagtgggatttatccctggcatgcaaagatggttcaacatatgtaaatcaatcagtgtaatacaccacattaacagaatgaaggataaaaatcatataatcatataatcatctcaataaatgcagaaaaagtatttcacaaaacacgacatcatttcatcataaaagctatcaacaaattaggcagagaaagaaagtacctcaacacaatgaagaccataaatgtcaaacctgcaaataatacactcaatgatgaaagctgaaagcttttccgcaaagattaagaacagagtaagggtgcccactatcactacttatatttaacatagtactggaaatcagacctagcgcaatgggtcaaaaaaaaataaacaaaaagcatccaaattacaaacatagatgtaaaattatgtggttgcaaatgatatgatcttatatggaaaaagccctaaaactccaccaaaaaagtattaaactaataaacaaatgcagtaaagtttcagaatacaaagtcaatatacaaaagtcagttgcatttttataccctaacaatgaactatcaaaaaagaagttaaaaaaatcccatttacaaaatcaacaagaagaataaaaatacttgggaagaaatgtatccaaagaggtgaaagatctgcacactgaaaattataaatcactgatgaaagaaattcaagaagaaacaaaaaaaagaaagatatcccatgttaatatcaatattgttaaaatgtccacactaccaaaagcaatatacagattcaatgcaatccctatcaaaatgccaatggcatttttacatgaatagaaaaatcaattctaaaattcatctgaaatcacaaaaaaaccctgaatagccacacaatcttgaggaagaacaaagctggaggcatcatatttcctgatttcaaaatatattgtaaagcttcagtaatcaaaacagtatggtactagcataaaagcagacatataaaccaatggaacaaaataaagagtacggaaataaatccatgcatttatggtcaactgcaaaggtgccaaacacacctttgtgaaagaatagtctctttaataaatgatgtcaggaaaactggatatctacatgcagaaaaataaaattgtacccttatctcacactatatacaaaaatcaactcaaaatggattaaagatttgaagctataaaactgctagaagaaaacaggggaaagcttcttgacattgctctggacaatgattttgtttttactatacgacctcaaaagcatggtcaacaaaggccgggcatggtggctcatgcctgtaatcccagcactttgggaggcccaggtgggtggatcacctgaggtcaggagtttgagaccagcctggccaacatggtgaaaccccatctctactaaaaatataaagattagccaggtgtggtggcgggtgtctgtaatcccagctactcaggaggctgaggcaggagaattgcttgaacccaagaggcagaggttgcagtgagccaagaccatgccattgcactccagcctgggcaacaaggagcaaaaactccttcaaaaaaaaaagcatgggcaacaaaagcataaatagacaagtggggttggattaaattaaaaagctctgcacagcaaaagaaacaacagagtgaagagataatgtatggaatgggagaaaataaatgaaaatcatacatctgataagggcttaatatccaaaatatgtaagaaactcaaacaactcaacagtaaaaacaaaaaaccccaatatgaaaatgggcaaaggacttgaataaacagttctcaaagaagtataaatggccaacaggtatatgaaaaaaatgctcagcattactaatcatcaaaggaatataaaccaaatgcataatgagataacacctcacaactgctaaaatggccattataggccgggcgcagtggctcacacctgtaataccagcacttgggaggccgaggcaggtggatcacaagttcaggagatcaagaccatcctggccaacatggtgaaaccccatctctactaaaaatacaaaaattagctgggcatggtggtgggtgcctgtaatcccagctactcgggaggctgaggcaggagaattgcttgaacctgggaggcagaggttgcagtgagccaagatcacgccattgcactccagcctgggtgacagagcgagactctgtctcaaacaaaaacaaaacaaaaaaaaacaaagaaaaaaaaacaaaaaaaaggctattattgaaaagtctaaagataaattttggtggatttagaaaaaatggaacttttgcacaccattgataggaatgtaaaatggtacagctattacaaaaaacagtatggagtttcctcaaaaaactaaaaataggactaccatatgatccagtaatcccacttctgggtatatatccactggaaatgaaatcagtatctcaaggagacatctgcacacatatgatattgcaacattattcacaatagctaagatatagaatcaacctaagtgcccataaatggataaagaaaatgtggtattatacacaatggaatactattcagccattaaaaatgagggaaattctgccttttgcaacaacgaggatgaacctggcaaacattatgctaagtgaaatatgccagacacataaagacaaatgctacatgatcatactcatatgtggaatataaacaagttgatttcatggaagtagagaatagagaggtggttgccggggactgggggatgggcgaaaggggaagatgttggccaaagggtacaaggtttcagatatgtaggatgaataaattctgaaaatctaatgtacagcatggtgactatacttaatgtactgtatacttgaaatttgccaaaagaggagatcttaagtgttctcaccacacacacgcacacgcacacaaacacaaaatggtcactatgtgaggtgatgaatatgctaattatcttgattgtggttaaccatttcacaatatataagtgtattaaaacatcatattgtataccctaagtctatgtgatttttatttgtcaattataactcaacaaagctggaaagaaaagacccaaatataggcccctagatatggcagaacatcatatatagaatgcatcatgggagctttggccctggtagtgggcctgggagcctcagcagaaatctctgtgcctggctttaccacaagagaggaagtcacagacaatacctcctctctttgcctggactgcaggactatcctgggcaataaaaactgatagcaacaatacagactgcgtgggagcttccccccatttttctgggtgagtgaggcctaggtttctcatgcaatccaaagggaagagggtgtcccctgacaacttattatattaatattgaatttctgctgggggcggtagctcacgcctgtaatcccagccctctgggaggctgaggcatgtggattgcttgagctcaagagtttgagaccagcctgggaaacatggtgaaacctcgtctctacaagaaatacaagaaaattagccaggagcggtgacacacaactgtggtcccagctactcaggaaactgaggtgggaggatcgcttgagtccaggaggtcgaggctgcaatgagcagtgattgtgccactgcattccagcctgggtgacagatcaagaccgtgtcttttaaacatatatatgttgaacttcttgtccgtgctaaggaatggagggatgaaccagacaaatagtagggaaatgtgacatttaaaaatactgagtgtaaactgagcaatgtcattctttacatagataatatagctcacacattatgatgtgcacggcttgaagcctggctgaatcaaggctctaggatccaagtaagtgacaggcactatcgtagaactcaccagatatgatttggatatttgtcctccccaaatctcatgttgaaatgtaatcaccaaggttggaggtggggccggctgggaggtgctcaggtcatgggggcagatccatcatgtcttggtgtcgactttgtgataatgagtaagttcttacgagatctggttatttaaaattgtagggcacctccccgcaccttgctcccactctcgccatgtgatgtgcttgcaaagctccctgaggcccctgagaagcccagccaagatgctggtgccatgcttgtacagcctgcagaaccaagagccaattaaacctcttttctttataaatgacccagtctcgggtatttatagcaacacaaaaatggcctaacacaccacctctcctaagtacaaacacagtatctctgaattttttagactaagagattaagacccagaagaacaggaaaatttctttttcccacccatgttagtcgagttcgaagaggggaatttcttcttccaaccattgttagtccagttcccagctaagaatctcctcttctccgagtggctgacctcagggattagcactcccttgaccagagatgatgtctacccacaggggtgtggcctcccagtctctacaaagtctcacaataaaactgactaaccacctttactcacacagaagacagacaaaaacagtatacaaatgtgtattttgttatatccccaaatcccattgttacagtgtgacacagcataataattattaaatattttccttttcagaggaacacttcttattctaatctttagttcaccctgcagtaatgttggggaacagctgtggaaagaggaaataatccttctgttccccaccccaccacctctatcactattaaacacatttttgttttcagattcacgaatttctgaacatgtattctccatacagttttacaaagtgactctttttttcagctcttgaaattaatacctcttgaatttagtatgcaaacatatgcaagtattctggaaatgcaacagaccccagatgactagctaaagcttagagactgtatgacaaagcactttgagctccccagacacatcagggccttcccagagagtggtcttcccatgcttgtagagttgggttaacatttcctttgggtaatttgaatacttcaacttcctcaggctgcaggtcctaaagccttttgtatacaggaagaatggtttactacttctttgagttctggcttattaattatagcaattattttgttcacctatacagcatgtcaaactgttatttatctgcttaatcagcacatcaggaaataaaaagccattgcctgtgtaagaaatactgacctgatgaaatatcttggaggcattcctcagtaccaattaaaataatagacattgtcacatggtgcaattattttccagaaaacagctgacgtgtacacactaagcttggcaaaattcctggctaatttcgcaagaatgtttattccaaactgagatcatctttttaaaaaaagaaaaaagacacagacaaagagggtaaggagggagggggagatgaaagtggagaggcagaaaaggaagggtaggagacagaaaggaaggaagggtcgaagggagggaggaagaaaacaaataaggaagggttcttcataaatcaagagaagatgttagattttaaagtcgtcttttctctatctgaccagatatctacctaatcctgcaacgaaattttattaattacagaagaggtcaaatatttcatctttaccagagattcattaatttaaaatgttctaacctcaaattcacattacaaaatcatagcattaggtctttttcagattttaataatttccctaattaacacaaatgattttaaaggaaattaatcaagaaaaactttatttcagagaggttcatggaagaggaaaatatagagtgaacatttacaaataaaaacaaacattatagaaatgcagagtcatgactgatgcattccaaccttgtgcatgtctggaatacatctgcaaatcatctgctcagccttcagaatagtctgtacacacacacagatacagccacacatacacccagagaaacccaggcattgtcaagcctggaggaagccaatgttgacatgtcagtcctttatctggtaagaaagaagcatgaactgctctatcacacttagtttgtttctgatttctggatcctactaaaaagcaaggaggatgaaattttttttcttttctattgattcagaatctggaattttgactacaaaaaaatttttttggaaatcttgccattagtctaaggcagggggttacttaggggttgaaatctattagctgctaatgtttttggcttagtgagaataacaggatttggggttctgaagggaaatagagtttgtagcttgcttaaaacttactgtagacccccaaatattaagattttaacatttgtattattaatgataatattattctttttaaatctgcgtactgtttttctaaatgttgggttctagagaaatatatttgaatagcacttgcaacttccatgagtttcttaccaatagtaaagttatatggtaggaatcccagataatggcttcacaactcaatttggaagattatgtatagtttaaagatgttatgctaagtttgctttaagtgctccattcagcaaactatgtgcaaaaaatgcagatagaatgatggatagttagattaaattatcgactttctgaactttccagttcttactctgaaaggatttcaattaaggggaagaagtagtgtagtcttaatataaaagtatgaagtaggttataaataagcttttattttgtgagtttctaatcaataagctcataattcatggtaactcttttaggctaaataagattatcaacatcatgacattttctccttgctagatcttcattttatatagagattcttcccttaggaataaaaaaaatcagagaaaaaatttcattatatattaggtacagtaaatgagtgaattataactatacctttattaacattttagttgtattacagtcaacaaggaaaaaatggtctaaggagatacattatgtttgcaatgttaactctttcacataaccagtctcttttttttcccctgagtaaatgcattttatcacattttcttgcaaatttgtatcttcttttcttccctgcacaagaaaagtttaacccacttacattctttaagaaagcattgatgagactagaaatgatcagtattacagatgtcaaattaatgtaacatattccttcaatccaacatgcattgagcatctactacatgccaggtgctctgttagatgctggggatacaagttaaataagatgcataggcccttaactcaaggaggtggcaatctattggagaagatactgacaaacagaataaaatgtgagctttttattgtggaagtatagcagttggaactctttggttgcaaatgacagaaaacatgattcaaactggcttaaacaacaaagaaatgaactggttcacatgacaaaattggagaagggggaatggtacatacagcgtatctcaatccagagattcaagtgacgtcaccgggattggtttgtgcacctatcttaggtctaccttcatctgcattggatttgttctcaagctccagtgaagactggcaactcccagctcatttcttactatgtattatttgaggagattactcttttagtaactcacattgacagaagggtcagatttgtagaagttaataatgcatctttattttgtctttcctttcctcttggttctgcacttctgctttccagaatcatatttctaagtaaacttccggtacataagtctttgtctcaggctctgctttggagagacccaacctatgactgggatgttattccagcacacattaacccctaaatttgccccgatctattattgcagactcccaacaaccatgcgtctacaatgtagtcatggtcccctggtcatacctgataaaactagggaaagaagcctaacagacaaggtgggcaactcagaaatttccccaggggttgatgggaaatggactgaggaaaagttgttctcactgtggtggacgaagcttaatgactcgctttgcaactttactggagcacattcagtgagctgatggtcagaactgaggaacttcatccataagcagttgtcaaaccattgggagttggaaatagaccacggtgaaagtacctacattagaaaaatcagcaactgttacaaatccagtctttttccacccagacagccaatttgctagcacaccactgccttcttccctttgtagtattctaacacctgagaaaggatgagtgcctttgttctgtttacagagcaaagtacagatgaagcaatacgggtcaggcaaaatcaaataatctccaaactaagagctttgttaactcctgttggggcacacaactttgggctgaggtctctcctgaaatgaagacctcgcctgaaacgaattcttcttatgaaataattttctctgggcccacagggcaggttccaattgatctagtaacctattattgggcttagaaactaaactgagcttgccagagaccatctttggtctggtctagttagtaccaggagacaaaggacaagtgacaacacaggtccacgaattaacaaaagacaggagagacatgggactgtgccacccacaatctgaagccatgacctcaccactgcttagcaaacctcagtgtattgcttgatgtcactagtaacacaaaccagtcctcctcctatgaggaggaacatgccacaggaataggaagaaggatggaattgcttcctctgttggggttcagaaaccaaaacatggcacttcgatatgctgaactgaagaagcagccttaaggtttatttgaccttccccctacctcctttcgctcaatcctgtctctctcaaagcacaaggtgaagttgttctctgaagatcccttgtctgcctgaagtctagacctggcaataaaggaaacaatgaccactgttttcttctttgaatttttattaaccgaactaatacacaggaagaaaagctgaagtctgtcaacaaacctggacagaattttgtcacaaaccatcgtaggctcttcaggcccaatagattttgtcccaggccattatatgttctctaagcccattgaattcccctgaaaatcagttactaccctccaaaaatcatccacacttttccatttcccttccccagttacccattgggatactgggtaatcactctgtggtttttctcctgtgcacactaataaatttggatgccatttctcctattaatctgcctttcgtcagtcgattgttcagcaaaccttcagagggcaaaggaagagttttaccttggctcttacaccttcaatactgcttccttctggagagaaaaggagaagagtctactcctcaataaaaatttgcagctgccatgttatctgccatgagatctgaggagcagaggaagccactgctgaagggaagaatgaagcacaacatgagatggagagcactgctgctttaggttcctggtagctttcagttccttcggaggcccagcacgtaaagcacttagtacagtatggagaatggcattctatgaaagttgatgactattaatgccagcatactattgtcgatgactattaatgccagcatactatttcagagattgtaatttttaattcatttagtcaatctcctcctactaaatatttagactgcacttttagttctctctccaatatatgtatatatatcagagaaagagaattatataatcgtgtgtttgtgtgtgtgtgtaattattctggcactcattaagccagtaaggaagactttattcaagactatttatagccaaggaacagagtgaggggatcagtggatggaaaattactaagaggagacatcaaggtaggaggattcttactaaactgacctaacaggattcttgctaaaggtgggccaaggacttataaatcaaaggtaggggatgaacttggtcacatatcaagggtgacccaatatgagtgggacagggggagggcacagatttttactgaactgggctatgcaagaacaggacacgcatacaggaagccaaggtcagagctagttgagaagaggactcaaaagcataactaaaatttggtcaaggagggagtcttcgttgagagagaaaaaaatttttttgattaaaacaaatgtctagtaatacaattcagtgaacatgtatgaagcattttcataatttttgttacacagtatcaatggatttttgaaagaattgagcctatttgcagtacaaatacgtgacagtatgagtttgtccaatttttcacagccttttttgatcaattcataatatatgtaagtatacagaattcttcagccattcagaaaagaaaaggtgtaagcacaatcatccaatttttttgttttatgaacaaaattggatgttttcctcattaaacttacagtgcttttgaagttattttggagttgcagcttctgtaacagaggtcaggcattcttgttctctttgttgtctgaagtacactctggagtttatcttatatgaaatggtttccactttctaaccatttgttccagtaaaatctagaccactgctacatgcaagagaatcaatttcctgatattaatagtctgcatgtttgtttttttctaactgacccaatcaggagcaaggtaactcctcagtcacagtttatttttctgcccagcctttgaaccatttactaggtatttatctagtcattttcttcattcagcttccttcccatgtgccttatatataatcacttgaagcagcacagcagacgcaggtttaataagatagctctcactatctttgccagatgcaacgttttccagttttctcttagaaaatgcaaacaattggaaacagttataacaacgcagtttaccccacacagataactcgaacactatcactagaggattccacagtgaagtgcccatggtatggagaacaatatttccctgttctttcactgaaatacctctgcattattttcctaaaacagagaactactaacttggacaaagggcaggcagttcatgccatccatcctgtgcagtcacaatagctaattataacagccaacctttattgagccctggcaatatgctggtctctgttttaagcattttcatgtgcttaaaatgtaattaaatttcatttaaaattaactcaattaattctctctaaacctacgaagtgagcatcatcagtatcccattgtacagatgaagaaactgaggaaccaagaagttaaaaactttgctcaaggtcacataacaagtaaggggcagagctaagtttcaaactcagaccctttgattccagacaccaagttcttagatgtctatctcaaggacaagaaagaaacaataggccgggcatagtggctcaggcttgtaattccagctcttcaggaggccaaggtgggaggatcccttgagctcagaagttcaagaccagcctgggcaatatagtgagacccccatctctataaaaaacataataatttttgtaaaaaaattaagaaacaaacaataaagccaaattttccgcaatgacacattagtgatgtttccatttacttatctaaaaccttaaaaacacattcataaattcattccaactgctctaggaacttccattagctcacaatccaacctctaaaactttgtatttatcccaaactctaaaaacttaaatattttacgcttcattggttctttggggttactttaaaagccagtaatatactttgtcattcttagatgtcaggcaagttcaaatttattgtcagtccttgtcttcctaagttgaagctcactcatttgctaatatgcccttacacagcagctctgctgtcctttttccatgtaattgttagactttccctaacatctttacacattttttttaagatgtgttgaccggaactacaaagaatattactggcttatatgtaaaaggtccttgctgaagtatagggaaattttattttgtttttactatacctctcatgatgagtgttcttgacctttttggcaatggagacacacattgtctctccttggaaatctatgtctccaggatcataatgaaatgtctagaactgtgatatcatggaaagaactctagcctgtacatgggtatcccaggcccagttccctgctttgccaactttcaaaagtgtgattatggagaattatttaaaccttgacttccttacccacaaaagggaacactgatgaaccactctatatgggtggttaaggacatagatattgaagccaaaccacctggttcaaaatctagcttacttgtctatgggtgttaacttgggcaacttacttcacctttttgttcctcagtttcctcatcagcaaatgaaaattataacactaatacctactttcaagcatcaaatggttgttaaaaccatcagatgagttaataaatgtaaagcactgagaatctagaacattgtctgtaacagtaagtgttaattattgttacattacaaggataccatgagaatgaattaacatgtagtgcctgaactattagtacacacctaaacaccagttcatttatgcagtcatctacagtgaccacttagtacatgcaaggcagtatgctagacacaggcatataaaccaaaaagtcacttgtcctcactagttatattttcataagaaaagaaaataataaaccagtaaataaatataccacaaaataataaccacaagataataaatataccaaggctcaaaactcttactactaaaaaaaaaaaaaaaaaaaaaaaaaaaagaatggcgttctgagagtactcatgatgtcacagaacctgaatctgtctgagtccaaactcccaggctttttccgtgactttttacaaccttctagcaaacaatttctacaaagagtgaaaagtatcaagatggaggcttgcacctgtggtggcagtttattttttccaaatgcattttctttctcttgccattagcctcaaggcctatatatggacctctcctcaggcaaagaatcatctgatcccaggcatacctgcagttcccccgcagctggtacacacgctgcacaagcccagtgctttggatgcgagagttgactttgaagatacctactttaggtaagcatctcattacgatgagtagaataattaacaaccacagtaagtgcttttctgtactaaaaatcttaataactttcggcacgttaaaaatagccaaaatgttctaataaaaaatatgctgttgagttaacaacaattaagtgaaaagcagataaaaataaaattaacaagtgatccaaccccttcataaatttacacatgggtgatctcagtaaaacgtttgtttttgttttgttttaagacctaactgaactgtgataattgctttctctttcaggagcagttacaaatattttgtggcaggaagtcttcccttaagtgctgagtctgcaccgcgacaaacacacttttaaagaagaaaactgtataagcagcaatgtcttcatagccaaccactggttcaatcatttaaaaagtttttaatcaaggacccctagaagggagtttcctttataaaaagccctctgattacaggcgtgagccaccatgccatttgtgaggccgaagcgggtggatcacctgaggtcaggagttcaagtccagcctggccaacatgatgaaaccccatctctactaaaaacacaaaaaattagccaggtgtggtggcaggcgcctgtaatcccagctactcaggaggctgagacaggagagttgtttgaacccaggaggcggaggttgcagtgagctgagaccacaccattgcactccaccctgtgcaacaagagcaaaaactccgtctccaaaaaaaaaaaagccccctgattcacagctcaggagtaggaattcacacagtttctaagcctgagcaaccttagaaaagaaagaaggaaacaaagatgtgaaaaatttattttgcatagactcagtcagaaagtagtgagaagtctggtcacagaataattttatttaggaaaacagaaatctatgggacaataaattctatagctacatggaaaatggaaataacaatggcagcttatgtcctttaaagccatgcttccgagactctaacgtgcatatgaatcacctggggatcttattaaaatgcagattctgattcagtacttctggggtagagcctgagattcagtaaatctcacaagctccttggtgatgccaatgctgctgacccctgaaccacactttgaccagcaaaaacacatttgcttattgtaaaggttatatccactgttaagtttaaacaccatttcataaattaatgtgaagaagagttaggaattaattgttcattcaatcaacatcattgagcttactatatgctaggccttatggcgggtactaaacattcaacagtaactaaagcaaaaagtacacttgggaggctgaggtaagcagatcgcttgagctaaggagttcgagtccagcctggacaacatggtaaaaccccatatctacaaaaaaatacaaaaattagccaggcatggtgccatgctcccgtggtcccagctactcaagaggctgaggtgggaggatcactggagcccagaaggtggaggttgcagtgagctgagattgcgccactgcactccagcctggatgacagagtgagaccctgtcttaaaaaaaaaaaaaaaaaaaaaaaaaaaaaaaactacccttgatcaatctactttcgactgttctttcaagcaagtaataagcacagggcttacaagaacttttgtcattcacaattcaaaatgtatcaatcatgcttctcgtgttaagtttttcttgatgtaacatttttaagaatgcctcaattcagattgtttacacttttttttttttagatgaaatctcactctactgcccaggctggagtgtagtggtgtaatctcggctcactgcaacctccaccgcccaggttcaagtaattctcctgcttcagcctcccaagtagctgggattacaggcacctgccaccgcgcccggctaatttttgtatttttagtagagacagggtttcgccatcttggccaggctggtcttgaactcctgacctcgtgatccacctgccttggcctcccaaagtgctgggattacaggcgtgagccaccgcgcctggcctgtttacactttaaaaataattggcaatttaatccagtgaattagcattgctctattttatatgaactagtaataaaattttaaaggttttcatatgcatggcatagtttaccagcagctagctaccttattgcaaatgttactgggtcatttcaattaaaattaaagcaaataggaaagtggcaagaaatgtttcatttaattttggcttagtgtggccaagttctccaggtgaatgtcatggcttctgcctcaaatttgtatgtatagtacagatagtagaaaaacttatactcatcaaagagttcatctttttttttcctcatgagcatgaactaccgccctgctgcatattaaatggcaaaacagaatcaccagaaagtttcaaaatcctaacaggttagacatactaagagaacagatgacctactcaagattattttgcttccccaaaaatggataactctcagcaagaagggagaataagtacatgaagggccatgtatattcacaaagagcatctgaaccaagtctttgcttaccagattttacctttttaaaagatgccaggaggtggcagcatttgttgcagctgtgtgagtttactcattaaagcacaggttctcagaaagtctggtgtatcagatttggaggagaagggttggtgacaagcataaggtggcaggagtctgttcggattaaaaaggcattgggacaatattataacacaatattatacttgaaagcaaaataaatctggtgtcattggtgttctattaaatcttaaaatcttgggtagccatatacaaaaattaactcaaggtggatttaaagacttaaaaaacctaaaactacaaaaaccctggaagataacctaggaaatactattccggatataggatccggcaaagatttcatgatgaagacgccaaagcaattgcaacaaaaacaaaaattgacaaatgggacctaattaaaataaagtgcttctgaacagcaaaagaaactatcaacagaataaacagacaacctacggaatgggataaaatatttgcaaactatgcatctgaaaaaggtctaatatccagaatctataaggaatttaagcaaaaaaaccaaacaactccattttaaaacgtgggtaaaggacatgaacagacacttcgaaagacatacttgtgatcaacaaggatatgaaaaaatgctcaacatcacttatcattacagaaatgcaaatcaaaaccacaatgagataccatcacacaccagtcagaatggctattgataaaaagtcaaaaaataacagatgctagtgaggttgcagggaaaagggaatgtttatacactcttggtgggaatgtaaattagtttggacattgtggaaagcagtttgacgatttctcaaataacttaaaacagaattgccattcgacccagcaatcccattattgagtatatacccaaaggaatatgttaaataaattgttctaccatgaagacacatgcacgcatatgttcttcatagcactattcacaagggcaaaaacatggaatcaacctaagtgcccatcaacggtggattgcataaagaaaatgtactacatatacactatggagtactatagagccataaaaaagaacgtgaccatgtcctttgcagcaacttagatggagctggaagccagtatcctaagcaaactaacacaggaacagaaaaccaaataccacatgttctcacttataagtgggaattaagtgttgattaaatatagacacaaagaaaggaacaatagacactggggcctacttgagggtggaggatgggaggagggtaaggatcaggtactatgtttattacctgggtgatgaaataatctgtacaccaaactcctgtgacacataatttatctataaaagaaacttgcacatgtacccctgaacctaaaataaaagtttttaaaaaaaatcttcagtagtgggaatatacagaacttatctgcatcttcaaagaacagagtgagaaagacaaaggagagcctggattttaactgagaggcatatgactaaagtgtagttccagaactgtctctataaacaatttccttcacacatcattatatttgctaagggtttggtatggtgccaactacagagtatgaaaactcagtaaatatttctttctttctttttttttttttttttctgagacagagtctcgctctgtcacccaggctggagtgcagccgcacaatctctgctcactgcaggctccgcctcccgggttcacgccattctcctgcctcagcctcccgagtagctgggactacaggcgcccaccactacgcccggctaattttttgtatttttaatagagacggggtttcaccgttttagccgggatggtcttgatctcctgacctcgtgatccgcccacctcggcctcccaaagtgctgggattacaggcgtgagccaccacgcccgtcctatttccattttttaacccattcccactgctgagaaagatttgctcaggggcagctgttatttcactaaccaatagcagtgcaatttttgcttctcatacttttgtcataggaaaatcattacaaatataacagccataaatgtctcggaaatcatagcagatgaacctggcagccagataatcaggaatgaagtgccctttctaagagttcagtctaagaataagaatcacaatgaatgtgattattctagttgccacagccccgctcagtgttcagttttaaaggcttcccgccttatcatcaatcagtctctttacctatattcctacttagaaagatattcaacatatgcatcactatttttaaattatgaattaggacacattagataaaagaaactcttttttagttttttttaaaaagttgatctgcatttatcctgttgagatacacttttaagacttgagaatatatacattaaaagccctactatccttttctataaaattctacctcatgatcagtgtactattttcattattagaacagatatcaaaacttcagaaaccaaaatttattctgggataatgtattcatttttttaaaatcttgtgaattcttcatctacagtaaactaaaagatgaacaatgaatcatgtgtggcttggtatgattcaaaattctgaagaatagacttgttaattgtcacatattctttcctaggaaagaatatgtgtaatgttgtgacccaaaccgctttcaaaaaatccaccaaattctactaatactaaggtttcaaatgggaaatttagagctagaaaaggtacatagagataatataatccaacatttttatatgacagatgggaaaatttaaagaattcaatcaaaaacatttgtaattttaagaatgttatttgctacatccatatagatgattactatgtatactttacataagaatttttaaatatttgcttttgatgtcttccttctttttaggcaaaaaaagtctatattgctaaaaataagaataaactatgaattgcatatagccatatgtttcattgtttgatatgactgtttcatgagattctatctggctcaatatgatgcaggtttaactacagcgggcttaagaaaagataccaatatctatgaatctgtatagcttggaaaaaggagaaaatgcttagggtggcacaaatatttggaaaagcaagagaaaaaaatggaataatacaattttgtggcaacatgaagtgcaagcaaaacctgcttatgtcagttattagaaatcaaggggagaaaaatacatttggtaacaataggaaattaaagagagattttttttttagggactttttaggaagcaggttagatttgcctaagttgcttctctccaactttccattaaaatacctatgaatgtcattttttttaaactggcaatagttctgtaactcagaagactttatgccaaatttggggtggaattttcactaaagatggtgtcaagggagatggatagactatttagcaatttcttccacatcctgagccatacaggcagtcctgaagaagatggaaacatacttcaactcatcatctatttggtaaatcgattaatttcacttatcttcaaaatgtaggcactgaacacttacacattcctcaaacacataaaaataggtatctaataccctccaccacaattcagaccacaagtgagggagggagcccaaaagttggacataaaaatacatatacttgggaggaaatgtattcatagacttcaatatataatttatgtaagcaggcaattgcatttttaaattatcaatgtgttttcctcattcttttttgagacacatgactttcacttagtcttccctaagtaattacttgcctgggttacaaaataaatgcaaaaagaactggaaaggtcatggtggtgcatgcttgtaatcccatcgctttaggaggcctagctgggcagattgtttggccccaggaattcaagatcagcctggccaacatggcaaaaccctatctctaagacaaaacaaaaattagccaggcatggtgatgcatatgtctgtagtctaagctacttcaggaaggggagcagggaggggctgaggcaggaggatcacttgcccccaggaggttgaggctacagtgagccatgatggggccgctgcactacagcctgagcaacaaaccgagaccctgtctcaaaataaaaaagaagaagaagaaaaagaagaactggggtataaccaacagttgcatccaaatataagattttgtagcaagacaatgaacagtcatgtaagtcagtttagaccataaagttttacgtcagtaaaaggaaagttctcctaggccctgggaagaaaaggagctagaatagccagaagagcaagattatattgtaaatattataatacagttattaaactgaatgcaaaagccaaaaaaacttgatatgaaattgatatatttcttttaaaaataaatattataccagctccataagccctgttacatgacaaagactgaaatgctgggggtggggaattggagttaaagtaaagttctgctttcccaagctcctttgaccacatcccacaaatgttaataggaagtagagtgagtttaaattttagtcacaaactcgaatgcagcatatcttagtctcttttctgttgcttataatagaataactgaaacagagtaattttcaaagaaaaaatatatataaatatagaaaattatacattgaaaattaagtttccaacacatgaaatctggggaacattcaagccctagcattccaccccagccccccaaattcatttctttttcacatgcaaaatacacccactccatccttatagcccccaaatcctaacttggtgcagcaccaactcaaaagcccaaagcctacagtctacacaatggtagtataggattaaggcaaacattcccattccaaacgggagaaataggcaaaaagaaaagaataacaggccccaagcaaatccaaaacccagcaggacagacattgtatcttagagctggagaataatctcttttgagttcacacactgcctcctggacacgctggagcaggagttgggccctcaaggcctcaggaagctgcactcctatggctttgctgggtgcagccgctgctcctttggattggagtccagtgcctgaagctttcctaagtagatgttgcatactgctggtgacttcacagttctgaggtcatggtggcagtcttggtcccagagctccactaggctttatcctagtgaggactctctgcagtgaccatggctccactaggcattgccctggtggggactctctgcggtgcctcaaccccacatttcagctgcgcgttgcctactggggtctctctgtggtggttccagcccctgtaacaagtctctgcttaggtccccaggatttccataacattctctgaaatctgggtagaggctgccaaacatttatagctcttgctgtctgcaagcctgcagaattagtaccacgtggactctgccaaggtttataacttctgcagctgcagctcagctgtgcctggtgtggggcgcagagtcagaggcaaggagcctactacaaacctgcagggagccctccctggacctgtatcccagtactactctgccctcccaggcctgcaagcctgcgatgggaggggcagccccgaagatctctgaaatgccttctgggtctttcttccattctcttgatgatttctgctgtctgtaccaatctccttagcagatggtctctctaggccatactcttggattcctctcctgaaaatgctatttcacatggtcaggctgataaatttccaaatttttccactgtttcccttttctctggaagtttaccactggcagttagaagtaaccacacagcagcctgaacactttgccgcttagaaatttcttctatgggatattctattctgtcacttttaagttgacggcttttcacaaagccctagggtgtggccacgcagctgagttctttgctatggtgtagcaagggtgacctgtgttccagttcccaacaccttattcctcatttccatctgaggtctcattagcatggcctttgctgtcaacattgctatcaacattctggtcatgaccacttcaccaacctctaaggacttccaaactttccctagtcttcttatcctctaaggcttcaccagaatctaggcttttttctagcctatttttccaaattcttccagcccctgtccattacccagttcccaagcagcttccacattttcaggtatttgttatcagcaacacctcacttttcactaccaattttctgttttagtccattttctgttgcttatagaatacctagaatgagtaacttataaataaaagaaaagcattttgtacagttatggaggctgagatgtctcagggtgagggaccaaatctggtgagagcctttgcgccggtggggactctgaagattcccgaattgaggccacagggcatcacatggcaaggagactggttgtgctagctcaggtctctcttttcttgtatagccaccattaatccattaaccctttaatctgttgttccattaatggattgattcattactgaaggcagagcactcatgatcccatcacctcttaaagtcctcaccttttaatagtgccacattgggtattaactttccaacacatcaaatttggaggatacattcaatcataacgcagcagaaatacagcctagtttatttttctacaaatcaatttaatatctatttcaagtcccttttccaccagaagtggaatttggggctcaattcttctcttctttaattaaggttgtttacctagtgccaaggaaggaagcaggtctgctcttcaatgtcggccatccacataggcatctgccaagacatccatcatctagtctggttttcagagcttgagcatcatcagtccaaacaaggtgacactgagatgtcacaccacccaaaggcacaggcactctggggccattcaaatgataagtcatcatttgaatccctagatctagtctttgctgaagtttatgttttggaaatccttgttatattaataattcttattggtactatctttcttgcttcttcttgtaattttgcttgcctctctcttcttttctcaggtaggctctatgtacaacaagatcagcttctaggaaatctagccttgtatgttccttacatattgtaatcacaggaatagagaaacactctttcttccaacacacaaatcaagacaagataaaggactctgattgccccagttttggtaaattgcccacctctggccaattcttgagtcagaaagataagccactctgattggtcagctcagcctatgtgccatttcaggttaagtttcacagactcacatcttaaatcaaagattccattgagagtgatttcttaagttatgcttctgagagaaaacagtaagggagtggggaaagctagagaaggggaaaaaagtcttgcaatttccaaaacctgatatgggagctctagagcataaattatacctcctagcatgtcatcctggggcaaagaagccctgggtgtggagagattggaaggccatcaaacttccaggcactttcagctttacatgtagacaaggcagacccagtgcccaaggtccagcctccaaagggctcaggtgcaaagccttactggcaaagcacacaaaagctgggaatgggcttacaaaactggcaaaaaggaatcctgaagaatcgaagtggagcatccagtgtccactaaatttgctcagtgctttggtggggaagatacagtctcttgattaacgccaccaaaacattctcagggttagaagaagggcagttctcaagggtaagaatgtgaagccaaaaaaacaagtgaccacttgtatcattcaaagcctgagatagggctgttaaattttcctggagctacagtatttctgcacatttctccttttctcctaataattttttactgtaggtgttgatgttagtcaatacataaagttttataactgttataacttcactgtgcaatgtagtgttcatgataaaaataacccttcttttaaccatttagcgttttgaccgttgatatctatgtgtctgaaatcattaattacatctgtttttaaatgtcaccttataaatctttgtccaccctcttttttaaaaaaattatgtttgttttatggaagatatcacaaccaataccaaagaaatatgaaagtatattcaaggcttctatgaacacctttacatgcataatgtagaaaacctagaagagatggataaatttctggaaatttatcctagattaaaccaggaagatatagaaacactgaacagaccaataacaagaagcaagattgaaatggttaaaaaaaatgccaataaaaatagtccaggaccagaaggattcacagctgaattctatcaggcattcaaagaagaattggtaccaatcctactgacactattccaaaagatagagaaagaggaaattttccctaagtcattctatgaagtcagcatcacccttataccagaaccaggaagggacacaacaaaaaaagaaaactatagaccaatatccctgatgaacatagatgcaaaagtcctcaacaaaatactagtgagccaaatccaacagcatatcaaaaagataatccaccatgatcaactgggtttcagaccagggatgcagggatggtttaacataggcaagtcaataactgtgatacaccacacaaacagaattaaaaacaaaaatcacatgatcatctcaagagacacagaaaaagcatttgacgaaatccagcatccttttatgattaaaaccctcagcaaaattggcacagaagagacatgccttaaggtaataaaagccacctgcgagaaacccacagccaacattatactgaatggggaaaagtttaaaacattccccctgaaaactggaacaagacaaggatgcccactttcaccacttctagttaacatagcactggaagtcctagacagagcaatcagacaagagaaagaaataaagggcatccaaatcagtaaagaggaagtcaaactgtcactgtttgctgatgatatgatcgtatacctagaaaaccctaaagacatatccaaaaagctcctggaactagtaaatgaattcagcaaagtttcagggtacaaaattaatgtacacaaatcagtagctctgctatacaccaacagtgacgaagctgagaatcaaatcaagaactcaaaccctttcataatagttgcaaaaataaaataaaatacttaggaatatacctaaccaagaatgtgaaagacctctacaagcaaaactacaaaatactcctgaaagaaactatagatgacacaaacaaatggaaacacatcccatgcttataaatgggtagaatcaatattgtgaaaaataaccatactgccaaaagcaatctagagattcaatgcaattcccataaaaataccaccattagctgggcacggtggctcatgcctgtaatcccagcactttgggagtctgaggcgggtggatcgcctgaggtcaggagttcaagaccagcctggccaacatagcaaaactccgtctctactaaaaatacaaaaaattagctggacgtggtgttgggcgcctgtaatcccagctactagggaggctgaggcaggagaatctcttaaacccaggaggcagaggttgcagtgagctgagattgtgccattgcattccagcctggacaacaagaacaaaactccatctcaaaaaaaaaaaaaaccaccatcattcttcacagagttagaaaaaacaatcctcaaattcatatggaaccaaaaaggaacccacatagccaaagcaagactaagcaaaaagaacaaatctggaggcatcacaattacctgacttcaaactatattctaaggccatagtcaccaaaacagcatggtactgatataaaaataggcacatagaccaatggaacagaatagagaacccagaaatagagccaaatacttacagtcaactgattttcagcaaagcaaacaaaaacataaaacggggaaaggacaccctattcaacagatggtcctgggataattggcaagccccatgtagaagactaaatctggatcctcacctgtcaccctatacaaaaatcaactcaagatggatcaaagtcttaaatctaaaacctgaaaccataaagattctagaagataacaccagaaaaacccttctacacattggcttaggcaaagacttcatgatcaagaacccaaaagcaaatgcaacaaaaacaaagataaatagatgggacttaattaaagtaaaaagcttctgcacagcaaaagaaataatcagcagggttaacataaccaacagagtggaagaaaatcctcatctatccatctgacaaagaactaatatccagaatctacaaagaactcaaacaaatcagcaagaaaaaatgaacaatcccatcaaaaagtgggctaaggatgtgaatagacaattctcaaaagatgatatacaaatggccaacaagcatatggaaaatgctcagcatcactaattatcagaaaaactcaagtcaaaaccacaatgtgataccacctcactcctgcaagaatggccataatcaaaaaataatagatgttggcatggatgtggtgaaaagggaagacttttacactgttgattggaatataaactggtacaaccactgtggaaaacagtgtggagattccctaaagaactaaaagtagatctaccacttgatccagcaatcccactactaggtatttacccagaggaaaataagtcattatacaaaaaagatacttgcacacacatgtttatagcagtgcaatttgcaattgcaaaaatgtggaaccagcccaaatgcccatcaatcaacgagtggataaagaaaatttaatatatgaattctggctaggaggcttctcgttctgctcaaattgttacaaagttcagctagagaagaccttcccgtgaagttttaccccctgctcctctggccatcctcctgatggatgcctgtggtgccaggcaggaatgggctacttggggatccagcgagctccccgtgcctttctgctacttcctctacctctgtatttcactcagctcagctgtctaacttgactcagctctttcttagtgcctgaaacatctaaaagggaaaatccagaagaagacagagagaaactgagctcttgacaatgcattcactaaagaaagtgacctttgaagatgtagctattgacttcgcccagaagagtggagctttctcttgatggacatatccaagagaaagctgtacagagatgtgatgctggaaaacatcagtcacctggtgtccctcgggcatcagataagcaaatcctatataattttgtagctggaacaaagaaaagagctatggagggaaggaagagaatttcttcaaggccagagtccagacagggaaactgcccttaagaaaaaacacatgatatccatgcatcctatcatcagaaaagactcatccaccagtttgacaatggagaaatctctcattccagaggatccctttgaacataatgatttgggagaagattgcactcacagttccacaatgactccatgtttgttaactcacagtggaaagaaaccctacatcagcaaacagtgtggaaaatcctttagtaatcagttgtcccctaaacaacataaattcatactaaaggtaagtcatatcaacgtaatctatgtgaaaaggcttatactaatcgctttcaccttaggcagcacaagttgactcacactggagagagaccatatgcatgtcatctatgtgcaaaagccttcattcagtgttctcaccttagaagacatgagaaaactcacatgggagagagaccacataagtgtcatcagtgtgggaaagcctatattcaatccttaaaccttcaaagacattagagaacttaccttggaaagagatgttatgaatgtgataaaggtgggaaagcctttagtcagagctctggctttagagagcataaaaaaaatcacactggagagaaactacatgtatgtcttctatgtgggaaagccttcagtctatcttctgaccttagatgacatgagagaacatgcactggagaaaagccatttgaatgccatttatgtgtgaaagacttcagtcaatgtactaatcttaaatagcatgagaaaattcaccctagagagaaaattataaacatcttcagaacatattctgactttagatgacatggtgttaggaatgacgaatgtaaggaatgtggaagagacttcagctatagttgtaacatctaaacatgccaaaggactcaaatcttgaggaaatactgtaatcaacatggagtatacttcggttacgtttattcttcagtccacatcaatgaatggaagagaaattgtatggcatgtatgtagcaaagacttgttagtgatctgatcataaacgacatgagagagctgaaactgtcaacataataaactaaaagtcttaagcaacagctttgacttaaaacatgtgggactttcaggtagagaatctctagctctatatgtatacatggaatctctatatagagagtctctagctctatatgtatatatgtaacatatatacatatatgttacatatatacatatattgttggaaaaaagaaaatgtgtatatatatgtgttatatataacgtatatatatttcaatatttgtaagtattattttataattattttgtaagtattatttttgcattatttcaatatttgtaagtattgatcttttggaaaagtttaatgaaatttcttatataattctgcattcaatttattcccaggtcaatttgctattatacatttacatgccacatttttatgaatagacattttctcaaatttctgaattattttgctaaactatgtgctaagagttttttctagaggtccaccttcttgactcacttttctgatgagaaatctatcaggtttctctacagtgattttcaggtttgatagctcctcaatgtgagaaacttaatgtcaactaagaaatgaattaccactgaagagttttctcatttcaagatgctgactgtgttttgtccagtgtgaaatttgacatgtgccacaagtgttgctctatgaagaaaggatttctcatgatttttcattgcataatttctccagtaataagtatttggtatttcaagagaattcattgctctcggtaagattttcctttcttatttagcttataaaggctttcctctcttattttccattttagcaacattttatcactgtgttttcttgtgaacatcaaaactggtgcttggctgaatgtttagtcacagaaaatacaaataaagggttcatccaagtaaagctttcttatgttatttgacaataaattgcaaataaaaaacattttcacactgaatgcagagctagagattctctacctgaaagtcccacatgttttaagtcaaagctgttgcttaagacttttagtttattatgttgacagtttcagctctctcatgtcaattatgatcagatcactaacaagtctttgctacatacatgccttacaatttctcttccattcattgatgtggactgaagaataaaggtaactgaagtatattccatgttgactacagtatttcctcaagatgtgaggagatacatatacatatatatatacatgtatacacatatatatacatgtatacatatatacgtagtatataatcactgattatatacatacgcgtatacatgtatatacacacatgtatatacatacgcgtatacatgtatatacacacatgtatatacatacgcgtatacatgtatatacacacatgtatatacatacgcgtatacatgtatatacacacatgtatatacatacgcgtatacatgtatatacacacatgtatatacatacgcgtatacatgtatatacacacatgtatatacatacgcgtatacatgtatatacacacatgtatatacatacgcgtatacatgtatatacacacatgtatatacatacgcgtatacatgtatatacacacatgtatatacatacgcgtatacatgtatatacacacatgtatatacatacgcgtatacatgtatatacacacatgtatatacatacgcgtatacatgtatatacacatgtatatacatacgtgtatatatatatatatacacacacacacacacacacaccatggaatactactcagccgtgaaaaaggaacaaaataatggcatttgctgcaacatggctggaattggagaccattattctaagtgaagtaactcagaaagagaaaaccaaatatcacatgttcccactcatctgtgggagctaaactctttggatgcaaaggcataagaatgatacattggactttggggacttgggggaaagggtggggggtgacaagggataaaagactacacattgataaagtgtacactgctcaggtgatgggtgcaccaaaatcccagaaatcaccactgaagaaattattcatgtaaccaaacaccacctgttcccccaaaacctattaaaataagtaaataataaatcaatcaataaataaaataaataaaattatgtttgttttagatgtgctttttggaagcagcaaaggttttttaagcagttgttttttaaccatatttggagaactctgttttaactgggtagtataactcatttaaatttattatcaggactgatatcatttgtgttgttatgctatctgcgggtattgtttcttttttctttcttgctgttttctttctatttttcaggtttctatgccacttcctctgttttctgtcatttgctctttgggttgattttatcttctgcagctttggaagatatcaactctcttttaagttctattgatattagtgtttaaaaattattctttttcattctttactaactttcacataagattttaaaaagtaactatctttttgctttctcccagttcacatttttctcacttagtcatagtctttcttcatgttatctggacattcagatccacattaatgtgatttgattctatatgtagtttttccactgtcttcttttaagaacaatttccaatgtttgcatttcatttttacaaccaaacttacaacaattatttaaatctaatgcgatggttgattttacgtgtcaacttgacacatattttttagtctactcttacattctgcaaaaccttctcaagtaagtccaccacatcactgattaaatttttttgttataacaagtctgcttttactaactacattgttgattttaattctattgcatttttcattttcatgacaatttcctcttctctggcagctgattttatctccagcacatttctgtacatttcacactactatgtctttaggttaatttctactctcctcttggctttctgttccagtttcataaagattatcttactgttttaataactgccaagatgtttaccaaaatattttcctggttctagtagtaaatcatttaaaaaatatgtactccctctctgaatcatcggagaaaaaaatcagcttttcttgtcattttctttttaaaagcatacacagaagtttttttccctctccaattccatgaaaaaagaattttttccatgtaaataccaacattcaaagtccatgatcctacctcaccccttaggcttttcttttctttttttttttttttttcttttttgagacaggttcttgctctgttgcccaggctgtagtgcagtggtacaatcttagctcactgccgccttaacctcccaggctcaagcctcccacctcagccacccaagtagctgggaacacaggtgcatgccactatgcctggcttatttatttatttatttatttattatttatttttgtagagacagggtctcaatttgttgctcaagctggtcttggactcctggtcttaagtgatcctcctgccttgacctcccaaagtactgggattacaggtgtgagtcactgtgcccagcccagccttttctttggagttaatagaattctctttttatgccatttcttggagataacttggcatgtaaatattctaattaaatcttcatgtcttacagggcttgagttggggtcttctcagacctaagctgtcaacttcaacttctttgaacttctcatcccacagaatatgtaaaattaatggtccaaagctttcctaatatctatgctaagtacatctagtttcttttaggactgcacttctctgtatgtaatgagtcactatcattcacactaccctctgcctaacatgctcgccaaaactccatatatcctgttgctatgatctaaatgttgatgtcccccagaaaaaccatgtgctggaacctaatgcctaatgtggtagtattaagaggtagcgccttttgaggaagtgattaagtcataaggatttcaacctaatgaatggggtcagtgctataacagagctgccttgccctttccaccacatgaggacacaataagaaggcatcatctttgaagcagggaaggagctaacatcagacactgaatctgttcatgccttaatcttgaacttcccagaccctcaaaggttgagcactaaatttctgttcctaaaccacccaacctaagattttttttatagcagcataaatgaactaagatagaaattggtactgagaagtggagtgctgctttaacaaatacctaaaaatgtggaagtggctttggaactgggtaatgagcagagtctggaaggatttggaggaagaggctgaaaaaaaaagcctgttttgctggaatggacagtaaagcgatattctgatattctggtgagggctcagaagaaaaggagagctgttaagaaacctcagtcttcttagactttatctaagtggttgtgaccagaatattgacagaaatatggatgttaaaggccattctgatgaggtctcagatggaaggaacacattgttagaaactgaagaaaaaaccattcttgtataaagtggcaacaacttggctgaattgtgtttatctcctagtgctttgtggaaggtagaacttggaaacgatgaaatatttggaagaaatctctaagcgaagtgcgaagagtgcagcatggcttggcttctgttgactgcttacactaaaatatgagaagagaaaaactaaccaaagatggaatttataacaaacaaggaagtagaccttaaagatttgcaaaattctcagcctggccatgttgtaaagaatgaaaaattgtgttcagggcgaacagcaagggtgtggccaagtcactatttgaaaaggatatttagtatggatgggcagaagcttgcttgcttctattcatcaaggcaatgggagaatgggcctgaaaacatttccgagatcttcagcagctgccctgtccattacaggcccagaataccagggccttgagaacagaaatatttcaaacttctgcccctctcattctggtgcagcactccttcaacccctcagctgtggctcaaatgggcccaagagcagctcaggtttctcctctgtgcagatgcacaggcagtaaaccttggtggcatctgcacagtgccacctcaccagagtgcttgagctgtgaggacatggctacctccacctagatttcaaaggattacccagagagcctcagagccactgcagagagtcctcactagagcaatgtctagaggagccatagaggcagagtctcttctgagaccccccaaaaatagagccaccagcaagcaactccaaacaatgacaactacagcatgggctgcacccggcaaagccatgagggcagggctgttcagacctgtgaggcccagcctctacccctgtgtgtctggaagatgagatatcaagtcaaagaagattattctggagtcttaaggtttaacgtttgccctattgggttttggatttggttggaacctgctatcccctttttaaaaaaaatccttccttttgaaatggaaatgtctatcctatgcctgtcccatcattgtattttggaagtatataacatgtttgatttcacagctggagagtaacttgcctcaggataaatcataccttgagtctcagccatatccgatttagttgatattaagatgagaccgagttttagacttttgagttggtactggaacaagttaaaattctgggggctattgggatggaacaaatatatgctccatgtgagggggccatgaattatagggggccaggaacagaatgtcatagtctaaatgttgacatccccccaaaattcacgttgaaacctattatctaatgtgatagtattatgaggtgcagccttttgggggagtgattaaatcacaatggctgtggcctcatgaatgggattagtgcccttacaaaagagatggaagtgcactgccttactttcttctatgtgaggacacagcaacaagacatcatctctagatcagagagtgaaccctttccagatactgagtctattggcactttagtcttgcactcctcagcctccagaagtgtgagcaataaatttctattgtttatccgttactcagtctatgatattttgtccagaagaactaagaaaactgtcttgtttttttctaaatgaatatataaagattacagttttaacatggatatataaagacagataccaatggaacaagacagggtttgaacaatcctctgaatacctcaaaaataatgcctgggttgtaaagaaacagccctcgtcactttttattcattggtagagaatcaaagttgtatttgagaggggagctgttagtagctttctctacctacttgcaagatgtaggtatattccatttcaagaggaaaaacaataaaatacaaacagatcaaaaccactcatactggccatgaattgtgaatggtgttattattatttgaataaccttaaaaaactgtcaggcttagttttcaatgttatgagtttttatcctcttctgtgtcttcataaatatacatatattttgagacagggtctcactatgctgtccaggttggtcttaaattcctgtgctcaagcgatgctcctgcctcagcctctggagtagctgatattataggcatccgtaaatatttttgcaaggaattcagagagttactgaaacaatacctgctagccagatgccatttaaatttaagactcttgctcaatatttaaaataatactgaaaaattaacattttattttttcttcttatcattattgttgttgtagttcttgctgcagagtaataatcatagctatgacttgttgagtattttttttaaatcaggcaggcattgtgagcacactgtatgaactttttctaattcttgtaatatcataattactaatctcactttccataaagaaattgaagttcaatgagtttagataacttgcccaaatcatactgctattaagttgtaatgctaagctcataatcaaatggctttgactccaatcccatccctgtctcacatgatgatacctcacccagcaaaggattctatggctataggaacacaactgccgtcattcccattgaattttttcttgcatgtaaatttcagcacaacaagcgttttttttaatagtacaacctgcacaagttgccaacaaatctcactagtaatatacatgggagaagaggagacagcaattgataatacaactaaatcaggtaaatcaatacaagatttttgatctagcattaatgtctgcacagatgcatgtttgatgtaagcctgtaatgctggttctggtagtaaaacgatagtattttttcaattcatcatgtaattaaatgaggtatttcctgcaaccaacttccttccttcagcaggatttaagctttttgatgaaaggatgttaactgtttgagggagcagagtttactatccacatcctttcagttaatacccagatttagaattattgagaacaaatgtttgaatcatctctataaactataaattagataattctataaaataattgattttaaaggaccagatctttaactctttaccacatttctcttccttgttttttctttttaaatctaaactctaaacagcatgtaaagtattgtaagagcttgcatttctacctcaaatatgccataaagggctctataaaaaaagaggctgaaaatatatactccactttaaaatgagtacacacataggttgttctgaatcgcagttggtaggtctttagagataaaagttattttaatgggttaaagcctctcctttcacctatgacaaaactataatctgtggtgagggatgtcaaatatattggtaaggtgctattaccacagaccctgcagacaacaaaaggtaataagggaatactatcaacaactctacacacaaatttggcaacttagataaaatggatcaatttcttaaaagtgcaaactaccacaactcactcagtatgaaactttgaatagccaaataactacttacaaaattaaattcataattttgagacttaaaaaaagaaaagaaagaaatctccaaccccagagagtttcactggagaatttgaacaaagagcgaaagaattagccccaattttacacaatttctccaggaaataaaagaagaatgaatgcttcttaattcattttgtgaaggtagtgttacactgataccaaaaccaaagacagcacacacacacacacaacacacaatgaactatagaccaatatctttcatgaatataaacatgaaatatttggaaaatagattcagtaatatctaaaaaaaattatatgctattacaaagtgtgatttatccctgggatgctagactgctttaatatttaaaatcaatcaatgtaatatgtcatataaaaattacatgatcatatcaactgatgaaacaaaatcatttggcaaaattcaacacccattcatgattttaaaaaaacaacactcagaaaaatagaaatacagggaagttttctcaatttgacaaagagcatctgtaagaaaacctacaatttccattatacttaatagtgaaaaactgaattctttccccctaagactgggagcaaggcaaagatcccactctctccactcttattcaacatagtgctacaagttctagccagcgcatcatggctagaaaatgaaataaaaggtatacagaccaaaaagaaagaaagaaaactgtttctatttgcagataacatgattgtttacatagaaaatcccaaggaatctgtaaaaagaactcctagaactaataaatgagttgagaaaagtcacagggtacaagatatacattcaaaaatcaactgttgtggagcacagaggattgggggcagtgaaaatattctgtatgatactatcttggtggatctatgcaattatacatttgtccaaacccatagaatgtacaacattaagagtgaaccttaatgtaaactacggactttgggtgacgatgtgtcagtgtaggttgatcagttgtaacaaatgcaccactctagccgggatgtcagtaacagaggagcctattatgcatgtgtaggagcagggggtatatgagaaatctctttaccttcctctcaattttgctgtgaacctaaatctgctgtgaaaaaaaaattgtctgtttaaaaattaattttatttccatatattagcaatgaacactgaaattaaaaatatgatatttacaatcactcaaaaaaaaagaaacaggtgtaaatctaacaaaacatgtataggatttacatgctgaaaactataaaatgctaaagaaaaaactccagaagatctaaataaatgagcagccaatgaggattggaagactcaacatagtaaatatgtcagttctccccaaattgatatacaggtttaatatatttcctatcaaaatcccagcaagacttttaataggtacagaaaaaattctaaaatataacaaaaatatagaggaactagataaaaaaggacaaattattccaaaaattatatatggaaaggcaaaataattaaaatagctaaaaaaaactttgaaaaagaattttaaaaacgggaagaaacagtctacctaattccgacattttatagctatagtaatcaagattgtgagttattgtaagtaagacagatatatagataaagggaacaaaatagagaaaccagaaataaattcataaattcacagaaatatgcccacttgactttagacaaacgtgcacaagcaattcaatagagaaaagatagtctttttttatttttggacacaaagtctcactctttcagccaggctggagtacaatggcaggatcatggcttactgcagccttaaccccccaggcccaagcaattctcccacctcagcctccttagtagctaggaatacaggcacacaccaacatgcctggctattttttaatttgttgagagacagggtctcactatgttgcccaggctggtctcaaactcctgggttcaagctatcctcccaccttggtatccgaaagtgttgagattacaggcatcagccactgtgcctgtccttaagatagccttttcaataaattgttccagaacaattagatatccataggccaaaaaaaaaaaaaaaaatgaaccttgaccaaagttaaaaattaactcaaagtggatcatgcacttgcatgtaaaatgtaaactataaaacttaaaaaaaacacacacaggggaaaatctttgggatctagggttaggcaaaaagtccctagacttgacaccaaaaatatgatctatgaatggaaaaaaatgatacattggacttcatcaaaatataaatctttggctctagaaaagactgagttaagaggatgaaaagtcaagctacaggctgagagaatatatttacaaatcacatggccaccaaaggactagtatctggaatacaaaaagaactctcaaaactcagtgtaaacactcaatccaattagaaatgaatgaaagtcataaatggaaacttcactgaagaggataaatagatggtaagtaagcacatgaaaatatgtgcaacttcatcagcccttaaggctgtgtgaactaaaatcacaatgaaataccactgcatacctatgagaacagctaaaataaaaaatagtgacaacaccaaatactagtgagggtgtgaagaaactggatcactcaggtgtcactgcttgggatgtaaaatggtacagccactctggaaagcagtttagtagtttagcagtttctttaaaaactaaacatgcaactaccctatgatctaccaattacactcctgggtatttattccatataaatgaaactttatgttcacacaaacacctgtaaaagaatgtttatagaagatttatttgcaatagccaaaaagtagaaacatcagacatggtggctcacacctgtaatctcaaccactggagaggctgaggcaggaggattgcctgaggctgggagagatttgtcttggcaacatagcaagaccgtgtctctaaatagtttttttaattagcagggtgtggtggtgtctgtaggaccagctacttgggagactgaggtgagaggattgcttgagcctagaagttcaaagctgtagtaaactacaatcatggcaacctgtatacttcaacctaggcaacagagagacatctggtctctaaaaaaacaaaaaaagtagaaacagctcagatgttcttcaatgtgtaaatgggtatacaaactggaacagctgtaccataaaatactacccagcaataacaaagaatgaactgttgatacacacaaccacctggatgaatctccagggatttgtactaagtgaaaaagaaacaattctgaaagatcatacattgtataattatattcacatatctgatgtaacaaaattatagaagtgaagaacagattagtgactgctaagggttaaagagggatggaagaggaagagaagtgggtgtagctgtgaaagagcatcaggagagagcctgtagtgatggaaatgttctgtatcttgaatgtatcagtgtcaacatcctggctataatattgtactatagttttgcaaaatattacattgagggaaactaggtgaaagctacacaagatctctgtgtattcttcctcacagttgtatgtgaatctacagttgcgtcaaaatgaaacataatttttttaaaaaagggtaagaaggaaatattatgaacacttttatgactacaaattcaataacttagaggaattggcaaatttttttaaagacattaactaccaataatcactcaagaaaaatagagagtatgaagagtggaatatctattaaactgaaattatactttaaaatcttttaacaacaaccaaaaaatccaggtaaagagagcttcactagagaagtttactaagcatttgtagaaagaaaaaataatgcaatatctatacacaaacacacagacataaaaaaatggaagagagaaaaaatggcagataggagtcagaactaacttgcagctcttacccagatggacagaacagcatgtggagactcatattgtgaacttttactccaagagctactgcaggaagataccaggaatactaaaagaattcacagatcctttgaaagaagaggcttgctgctacaaactctgtgagacagccaaaaaactgtgagtatccaaagtgtgagagaaggaaagtccgcttccaaatacacatcctcactgggaaacctgaaaatccagatcatgggagtaggatttaaccttacctagagctgaaactagagagccaagagaaatagaaacgtaaacaaagcagcagggagagccctgtaggaactccctgcttccagggaagcccagggaagccatttctgactttatctcacaggggtcttttgggagggctcccagtggaattggggaaagaccacaaggagaaggaaacttccagctgaccttcataataatttcagccaagcgtaaattgtcctgggcagacaggaagtgcagacaggagcacagaagtcatggcaggtgaggagggttggagcctgaaatccctgcttgctttctcagcaaggaggcttgtagcctggggcaagatctcagtcttactcactggctgcctggatataaaatcagtgctggtggggcatggcgggagtgagacgggccttgctggctgcatgggagctgggtgagacctgtcactgctggctttcctctacttccctggtgacctgtgtgatgtatgatgcaggagaggcagccataattcccttggaacataactccattggcctgagaaccacacctgcatctcctattatagccatagcaagccctgcccaaggagagtctgagctcagacatacctgaccctgccctcaacagatggtctttctctacctgccttggtagccaaagacaaaagacataatctcttaggagctctatggacctgcccatcacctgagagacctgaatatttatccaggtgaccatagcgcaagctagcatcccacctatactacaccctccttagggtaggctggtttgcccccatattatccccccatagtactcttttgaaagcaccacctcctgactggaggtgaatcaactcaagctattacaacccttataaaagaacaaccctgctccaacaaagaagacaacagctaattacatggtctgtaacatcatggctaaccagaggtcctgagtctgtccacatgacaactttaccactagcacaaccagcacttgagaaaaccagttcactgaacaaaactacaaccaaggacccttacagagtccacttcactcctctgttacttccactggagcaggtgctggtagccacagctgagatacctgaagactgatcacatcacaggactctttgcagacactccccagtactagcctagagcccagtagctccaatgggtggctacacccagaagagcaaaagcaatcactgcagtctggctctcaggaagcctcatccctaggtgaatgaagagagcaccatatcaagggatcaccctgtgagacaaaagaatgtgaacagcagcccttgagccccagatatttcctctgacacagtctacccaaatgagaaggaaaaagaaaaacaattctggtaatatgacaaagcaatgttctttaacaccccaaaaaagatcacactagctcacgagcaatgggtccaaaccaagaagaaatctgtgaattgccagaaaaggaattcagaagattgactattaagctatccaaggaggcaccagagaaagatgaaaaccaacttaaagaaaatttaaaaataatacaggatatggatgaaaaaatttccagggaaatagcataaataaaaacaatcacgacttctggaaatgaaacacacacttagagaaatgcaaaatacactggaaagtgtcaacaatagaatcaaacaagtagaagaaggaacttcagagctcaaagacaaggcttcagaattaaaccaatctgacaaagacaaagaaaaaagaatttttaaaaaatgaacaaaggctccaagaagtttgggatcatgttaaatgaccaaaccgaagaataattggtgcccctgaggaagaagaaaaatctaaaagtttgggaaacttatttgagggaataatccaggaaaacttttctggtcttgttagagatctagacatccaaatacaagaagctcaaagaacacttaagaaattcatcgcaaaaagataatcaccgaggcacagagtcatcaggttatctaaagtcaagacaaaagcaagaatcttaagagctgtgaggcaaaagtatcaggtaaactataaaggaaaacctatcagattaacagtagatttctgagcagaaaccatacaagctagatgggattggggtcctatctttagcctccttggacaaaacagttattagccaacaattttgtactcagaaaaactaagcttcataaatgaagaaaactcttttttagaaaaacaaatgctgaatttgccactaccatgccagcaatacaagaactactaaaaggagttctaaatcttaaaataaaaccttgaaattcgataaaatagaacctccttaaagcattaatctcatagggcctataaaacaataacacaatgaaaaaaaacttaggcaacaagtagcacgatgaataaaatagcacctcacatctcaatactaatgttgactgtaaatggcctaaatgcttcacttaaaagatgcagaatgccagaatggataagaattcaccaaccaagtatctgctgtcttcaagagagtcaactaacccataaggactaacataagcttaaggtgaaggggtagaaaaagaagttccatgcaaatgaacaccagaagtgagcaggagtagctatccttatatcagacaaaacagacattaaagcaacaacagttaaaaaagacaaagagggggtcctggtacgggacatgtgagaggtatgctccaacttccagtttctgtggaaattcagtagagagataaacgttgttttcatcaagggtttgtaccagctattatttcttcctgaaaaacaaacaagcaagtttctgtggatcaggaatttgggagcagatcagctggaggactctgactcaggatgtctcataaggttgcaatcaagacatcagctaggactgtaatcatctcaagaaaataaagatccattccaagatggccgaataggaagagctctggtctgcagctcccagtgtaatcaacccagaagaagggtgatttctgcatttccaactaggtatctggttcatctcattgggactggttggacagtgggtgcagcccacagagggtgaactgacgcagggcgtggtgtcaccttagcagggaaatgcaagggatagagggatttccctttcctagccaagggaagccgtgacagattatacctggaaaaacgggacactcccacccaaatactgcgcttttccaaagtcttagcaactggcagacaaggagatactctcccacacctggcttggcaggtcccacgcccagggagccttgctcactgctagcacagcagtctgagatcaaactgcgaggtggaagcctggcggggggaggggcgtccaccattgctgaggcttgagtaggtaaacaacgtggctggggagctcaaaatgggtggagcccaccacagctcaccaaggcctgctgcctctagactccacctctgtgggcagggcttagctgaacaaaatgcagcagacaacttttgcagacttaaatgtccctgtctgacagctctgaagagagcagtggttctcccaacatggcgtttgagctctgagaaccaacagactgcctcctcaagtgggtccttgacccccgtttagcctaactgggagacacctcccagtaggggagtgcccctctgggacaaagcttccagaggaaggatcaggcagcaatatttgctgttctgcattatttgctgttctgcagtttccactggtgacacccaggcaaacagggtctgcagtggacctccagcaaactccaacagacctgcagctgagcaacctgactgttagaaggaaaactaacaacagaaaggaatagcatcaacatcaacaaaaaggacatctacaccgaaaccccatctgtaggtcaccaacgtcaaagaccaaaggtagataaaacaacaaagatggggagaaaacagagcagaaaagctgaaaattctaaaaatcagagcgcctcttctcctccaaaggattgcagctcctcgccagcaacagaacaaagctggactgagaatgactttgacaagttgacagaagtaggcttcagaaggttggtaataataaacttctccgaactaaaggagcatgtttgaacccattgcaaggaagctaaaaaccttgaaaaaaaggttagatgaacggctaactagaataaacagtgtagagaaaaccttaaatgacctgatggagctgaaaacccatggcataagaacttcatgaggcatgcacaagcttcaatagctgattcaatcaagtggaagaaagggtgtcagtgactgaagatcaaattaatgaaataaagcgagaagacaaggttagagaaaaaagagtaaaaagaaatgaacaaagtgtccaagaaatatgggactatgtgaaaagaccaaatctacatttgattggtgtacctgaaagtgatggggagaatggaacaaagttaaaaaacattcttcaggacatgatccaggagaacttccccaacctagcaaggcaggccaacattcaaattcaggaaacacagagaacaccacaaagatactcctcgagaagagcaaccccaagacacataattgtaagattcactaaggttgaaatgaaggaaaaaatgttaagggcagccagagagaaaggtcaggttacctacaaagggaagcccatcagactaacagcagatatcttggcagaaaccctacaagcgagaagagagtgggagccaatattcaacattcttaaagaaaagaattttcaacccagaatttcatatccagccaaactaagcctcataagtgaaggagaaataaaatgctttacagacaagcaaatgctgagacattttgtcaccaccaggcctgccttataagagctcctgaaggaagcgctaaacatagaaagaaacaaacagtaccagccactgcaaaaacatgacaaattgtaaagactactgatgctaggaagaaactgtatcaattaatgggcaaaataaccagctagcatcataatgacaggatcaaattcacacataacaatattaaccttaaatgtaaatgggctaaattctccaattaaaagacacagactggcaaattggatagagtcaagacccatcattgtgctgtatttaggaaacccatctcacgtgcagagacacacataggctcaaaataaagggatggaggaagatctaccaagcaaatggaaagcaaaaaaaaagcaggggttgcaatcctagtctctgataaaagagactttaaaccaacaaagatcaaaagagacaaagaaggccattacataatggtaaagggagcaattcaataagagctaactatcctaaatatacatgcacccaatacaggagcacccacattcaaaaagcaagtccttagagacctacaaagagatttagactccgacacaataataatgggaggctttaacaccccactgtcaatattagacagatcagcaagacagaaggttaacaaggatatccagcacttgaactcagctctgcaccaagcatacctaatagccatctgcagaactctccaccccaaatcaacagaatatacatacttctcagcaccacatcgcacttattctaaaattgaccacataattggaagtaaagcactcctcagcaaatataaaagaacagaaatcacaacaaactgtctctcagaccacagtgcaatcaaattagaactcaggattaagaaactcactcaaaaccacacaactacatggaagctgaacaacttgctcctgaatgactactgggtaaataatgaaatgaaggcagaaataaaaatgttctttgaaaccaatgacaatgacaacaaagacacaaagtaccagaatctctgggacacatttaaagcagtgtgtagaaggaaatatagagcactaaatgcccacaagagaaagtgtgaaagatctaaaaccaatacccttacatcataattaaaagaactagagaagcaagagcaaacacattcaaaagctagcagaaggcaagaaataactaagatcagagcagaactcaaggagatagagacacaaaaagcccttcaaaaaatcaatgaatccaggatttggttttttgaaaagatctacaaaattgatagaccactagcaagactaataaagaagaaaagagagaagaatcaaatagacgcaataaaaaatgataaagggatatcaacaccaatcctgcagaaatacaaactagcatcagagaatactataaacatttctatgcaaataaactagaaaatctagaagaaatggataaattcctggacacatacaccctcccaaaactaaaccaggaagaatttgaatctctgaatagtacaataacagtttctgaaattgaggcaataattaatagcttaccaaccaaaaaactccaggaccaggtggattcacagccaaattctaccagaggtacaaagaggagctggtaccattccttctgaaattattccaatcaatagaaaaagaaggaaccctccctaactcattttgtgaggacatcgtcatcctgatatcaaagcctggcagagatataacaaaaaaagagaatttcagaccaatatccctgatgaacatcgatgtgaaaatcctcaataaaatactggcaaactgaatccagcagcacatcaaaaagcttatccaccatgatcaggttggcttcatccctgggatgcaaggctggctcaacatacacaaatcaataaacataatccaacacataaacagaacgaatgacaaaaaccacatgattatctcaatagatgcagaaaaggccttcaaaaaaattcaacaacccttcatgctaaaaattctcaataaactaggtattcatgtaacttatctcaaaataataagagctatttatgacaaacccatgcaaatatcatactgaatggccaaaaactggaagcattccctttgaaaactgccacaagacaaggatgccacctctcaccactcctattcaacatagtgttggaagttctggccagggcaatcatgcaagagaaagaaataaatggtattcaattaggaaaagaggaagtcaaactgtctctgtctgcagatgacatgattgtatatttagaaaaaccccatcatttcagccccaaatctccttaagctccagcaaagtctcaggatacaaaatcaatgtgcaaaaatcacaagcattcttatacaccaataacagactaacagagagccaaatcatgagcgaactcccattcattgctacaaagagaataaaatacctagaaatccaacttacaagggatgtgaagaacctcttcaaggagaactacaaaccactgctcaacaaaataaaagaggacacaaactaatggaagaacaacattccatgctcatggataggaagaatcaatatcatgaaaatggccatactgcccaaggtaatttatagattcaacgccatccccatcaagctaccaatgactttcttcacagaattggaaaaaactactttaaagttcatatggaaccaaaaaagagcccacattgccaagaaaatcctaagtaaaaagaacaaagctggaggcatcatgttacctgacttcaaactgtactacaaagctacagtaaccaaaacagcatggtcctggtgccaaaacagatacatagaccaatggaacagaagagaggcctcagcaataatgccacatatctacaaccatctgatctttgacaaacctgacaaaaacaagaaatggggaaaggattcctatttaataaatggtactgggaaaactgactagccatacgtagaaagctgaaacagatcccttccttacaccttatacaaaaattaattcaagatggattaaagacttaaatgttagacctaaaaccataaaaaccctagaagaaaacctaggcaataccgagaggtgacagcgtgctggcagtcttcacagctctcgctcgctctcggcacctcctctgcctgggctcctactttggcggcacttgaggagcctttcagcctactgctgcactatgggagacttcttctgggctggccaaggccagagccggctttttcagcttgcagggaggtgtggagggagaggcacgagcaggaaccagggcacttgcgggccagctggagttccaggtgagcatgggcttggcaggccccgcactcagaacagccggccggccctgccggccctaggcaatgaaggacttagcacccgggccagcgcctgcggagggtgtactaggtcccccagcagtgccagcctaccggtgctgcactcgatttctcgccaggccttagctgccttcccacaggacaggcctaaggactgcagtcccccatgcctgagccttcccccgcctccgtaggttcctgtgcagcccgagcctccccgaggaggagcaccgccccctgctccatggcacccagtcccatcaaccacccaagggctgaggagtgcaagtgcatggcgcaggactggcaggcagctccacctgcagccccagtgcaggatgcactaggtgaagccagctaggctcctgagtctggtgaggacatggagagtctttatgtctagctcaaggattgtaaacacaccaatcagcaccctgtgtctagctcaaagtttgtgagtgcaccaatcaacactctgtatctagctactctggtggagccttagagaatctttatgtctagctcaaggattgtaaatacaccaatcggcactctgtatctagctcaaggtttgtaaacacaccaatcagcaccctgtgtctagctcaaggtttgtgagtgcaccaattgacactctgtatctagctgctctggtagggccttagagaacctttacgtctagctcaaagattgtaaatacaccaatcggcactctgtatctagctcaaggtttgtaaacacaccaatcagcatcctgtgtctagcttaaagtttgtgaatgcaccaatcgacactctgtatctagctgctctagtgaggccttggagaacctttgcgtggatactgtgtatctaactaatctaataaggacgtggagagcctttgtatctagctcaaggattgtaaacgcaccaatcagcgccctgtcaaaacagaccactcggctccaccaatcagcaggatgtgggtagggccagataagagaaaaaaagcaggctgcccgagcctagcagcagcaaccggctcaggtccccttccacactgtggaagctttgttcttttgctctttgcaataaatcttgctactgctcactccttaggtccacgctgcttttatgagctgtaacactcaccgtgaaggtctgcagcttcactcctgaagccagcaagaccactagcccaccgggaggaacaaacaacttcagacgtgctgccttaagagctgtaacactcaccgcgaaggtctgcagcttcactcctaagccagcgagaccacaaacccaccagaaagaagaaactccaaacatatctgaacatcagaaggaacaaactccagacgcgccaccttaagagctgtaacactcaccgcgaaggtccacagcttcattcttgaagtcagtaagaccaagaacccaccaattccagacacaataccattcaggacataggcatgggcaaggacttcatgactaaaacaccaaaggcaatggcaacaaaagccaaaattgacaaatgggatctaattaaactaaagagtttctgcacagcaaaagaaactaccatcagagtgaacaggcaacctacagaatgggagaaaatttttgcaatctacccatctgacaaagggctaatatccagaatctacaaagaactcaaacaaatttacaacaaaaaaaacaaccacatcaaaaagtgggcaaaggatacgaacagacacttctcaaaagaagacatctatgcagtcaacagacacatgaaaaaatgctcatcatcactggccatcagagaaatgcaaatcaaaaccacaatgagataccatctcacaccagttagaatggcaatcattaaaaagtcaggaaacaacagatgctggagaggatgtggagaaataggagcgcttttacactgttggtgggagtataaattagttcaaccattgtggaagacagtgtggcgatccctcaaggatctagaaccggaaataccatttgacccagcaatctcattactgggtatatacccaaaggattataaatcatgctactataaagacacatgcatagacatgtttattgtggcactattcacaatagcaaagacttagaaccaacccaaatatccatcaatgatagactggattaagaaaatgtggcacatatacaccatggaatactatgcagccataaataaggatatttattataaaataaaagttcatgtcttttgcagggacatgaatgaagctggaaaccaacattctcagcaaactaccacaaggacagaaaaccaaacaccacaggttctcactcatcggtgggaattgaacaatgagatcacttggacacagggcaggggatattacacactggggcctgtcgggggatgggggttaggggagggatagcattaggagaaataattaatgtaaatgacgagttgatgggtgcatcaaaccaacatggcacatgtatacctatgtatcaaacctgcatgttgtgcacatgtaccctagaacttaaagtataataattaaaaaaaaaaaaaagaaaatgggggtggggaggacagagagaggaaagaaggagtcaaaaggagggaaaaaggagtggggaataaaataattctcatgtttaagagggacattatataatgataaaagaactagtccaaagggaaaatatcacaatcctaaatatatatgcacctaacactgaagctccaaatttaataaaacaattactactagacctgagaaatgagatagacagcaacacaataatagtggggactttaatactccactgacaccactggataggtgatcacgacaaaagtcaacaaagaaacaagacttaaagtataacccagaacaaatggacttagcagatatttacagaacattctacccagcaactgcagaatatatattccattcatccacacatggaacattctccacgacagatgatatgataggtcacaaaacaagtctcaataaagttaagaaaatcaaaattatatcaagtactccctcataccacagcaaaataaaattggaaattaactccaaaaagaacctcaaaactaaacaaatacatagaaattaaataatctgctcctgaaggttctttgggtaagcaatgaaatcaagatggaaaataaaaaattatttgaacaataatagtgacacaacccgttaaaacctctgggatacagcaaaagcagtgctaagaggaaagttcatagcattaaatgcctacatcaaaaattctgatgtaggcatcagacaatctaagctcacacctcaaagaacaatagaaacaagaagaaaccaaacaaaccaaacccaaacccagcagaagaaaaaaaaaaataactaagatccaagcagatctaaatgaaattgaaacaaaaatgcaaaacataagtgaaacaaaaagctgtttacttgaatagataaacaaaattcgtacaccattagtgagattaaccaataaaagaagatccaaataagctcaattagaaatgaaatgggagatattacaacagataccacagaaatacaaaaggtaattcagggttactatgaacacttttatgtgcacaaactagaacacccagaagagatggataaattcctggaaatacatgctcctagattgagccaggaagatatataaactctgaacagatcaataacaagcagcgagattgaaatggaaacaaaaaaaaattgccaacaaaaaacagtccaggaccagacagattcgcaactgaattctatcggaaagtcaaataagaattggtaccaattttaatgaaactattccaaaagatagaaaaagagggaatctttcataaatcattctatgaagccagtattatcctaacaccaaaaccagtaaaggacataacaaaaaaaaggaaagctacagaccaacatccctgatgaacatagatgcaaaaatcctcaacaaaatactagtgaaccgaatccaacagcatatcaaaaagacaattcgccataatcaagtgggtttcataaaagggattcagggatggtttaacatacacaagtcaaaaaatgtgatacaccacatgaacagaattaaaaacaaaaattgcatgaccatctcaatagatgcagaaaaaaaaactgacaaaagccagcatccctttatgattaaaaccctcagcaaaatcggcatagaagggatataccttaaggtgataaaagtccccgcagccaacattatactgaatggggaaaagtttaaagcattccccctgagaactggaacaagacaaggatgcctgctttcaccatttgtattcaacatagaagtggaagtcctagccagagcagtcagacaagagaaagaaagaatgggcatccaaatcagtaaagaggaagtcaaactgttgctgttcaccaatgatataatcacatacctagaaaaccctaaaaatgcatccaaaaagctcctagatctgataaataaattcagtaaagtttcaggatacaaaatcaatgcatacaaatcagtagcactgctatacaccaacagcaaccaagctgagaatcacatcaagaactcaatcccttttacaatacctgtaaaaataaaataaaatacttaggaatatacctaaccaaggatgtgaaagacctctacaaggaaaactacaaaacactgcagaaagaaatcatagatggcacaaacaaatggaaaacacatcccatgctcataattgggtagaaccaatattgtgagaaataaccatactgccaaaagcaatctacagattcaatgcaattcccataaaaataacaccatcattcttcacagaattagaaaaaaaaatcctaaaattcatatggaacccaaaaaagagcctgcatagccaaagcaagactaagaaaaaagaacaaatctggagggatcacattacctgacttcaaactatactctatggccatagtcaccaaaacagcatggcactgaaaaataggcacatagaccaatggaacagaatacaaaacccagaaataaagccaaatacttacagtcaactgattttcagcaaaggaaacaaaaacataaaatggggaaaggacacccttttcaacagatggtcctgggataactggcaaaccgcatgtagaagaatgaatccagatcctcatctgtcaccctatataaaaatcaactcaagatggatcaaagaattaaatctaagacatgaaaccataagatgctagaaattaacatcagaacaacttttctagacattagcttaggcaaagacttcatgaccaagaacccaaaaggaaatgcaacaaaaacaaagataaatagatgggaataaactaaaaatcttctgcacagaaaaaggaataattagcagagtaaacagacaatccacaggtggtagaaaatatttgcaaactatgtgtgatgattaatattgagtgtcaacttgattggactgaaggatttaaagtattgttcctgggtgtgtctgtgagggtttggccaaaggagattaacatttgagtcagtgaactgggagaggaagactcatcctcagtgtgggttggcaccatctaatcccaccatatgaagaaggatgtgtttgcttccccttctgccatgattataagtttcctgaggcctcctcagccctgcagaactgtgagttaattaaacccctttcctttaaaaattacctagttttgggtatttcttcatagccgcgtgagaatgaactaatacactatgcatccaacaaaggactaatacccagaaactataaaaaactccaacaaatcagcaagaaataaaacaaataatcccataaaaaagtgggctaagggcatgaatagacaattctcagaagaagatatacaaatggccaagaaacataggaacaaatgctcaacatcactaatgatcagggtaatgcaaatcaaaaccacaatacaaaaccaccttactcctgcaggaatggccacaatttaaaaaatcaaaaaataatagatacaaaaccaccttactcctgcaacaatggccacaattaaaaaatcagaaaataatagatgttggcatggatgtgctgaaaagggaagacttttatactgctggtgggaatgtaaactagtacaaccactatggaaaacagtatggagattccttaaaaaactgaaagtagtcctaccatctgatccagcaatctcactgctgggtatctacccagaggaaaagaagttgttatatgaaaaagatattcgcacatgtaggtttatagcagcacaattcacaattgcaaaaataggaaccagctcaaatacccattaatcaacaagtggataaagaaaatgtgagatatacatagatagatgatggatagattagatagacagatagatgattgatagatagatagatagatagatagatagatagatagatagatagatagaaaatggaatgctactcaaccataaaaagtaacaaaataatggcacttgcagcaacctggatggaattggagaccattattctaagtgaaataactcatgaatggaaaactaaacatcgtatgttctcacttataagtgagagctaagctatgaagacacaaaggcataaaaatgatacaatggactttggggactcagagggaagggtggaagagggggtgaaggataaaagaatacacgttgggtacagtgtacactgcttgggtgatgggtgcaccaaaatctcagaaatcaccactaaagaacttatccgtgtaaccaaaccccacctgttacccaaatacctattaaaatattttttaattagaagaggagagaacacttttcaattcattctaaaatgctaacattatcctaaggccaaaacaagataaagacattacaagaaaataaaactaccgacaagtatccttaataaacatagatgcaaaagtgctttacaaaattttggcaaattgaattcaacaatatataaaaaggataatatgaataacagctgggagatatcctaggaatgcagcattcatttgacattcaaagatcaatgaatttcaatatattaacaaactaaaaaagaaaaataatatgaccgtatcaattcaggcagaaaacacatttgacaaaagccaacacattaatgatatttaaaaaaaaaatctcacccaagttgaaatagaaggtaacttccttatcctgacataggacctctacaaaaacttagatcaaacatcatacttaataggaaaagatttaatgcttttcctttaaaattgggaataaaacaaagatgtctgtttgcaccacatctattgaacattgtaccagtgattctaactggcgcaatcaggcaaaaaaaaaggaaataaagggcatctaggttaaaaaagaagtaaaactattttattcacagatgacatgatcatctaggtagaagatccaatcaaatttacaaaaaaaaacctactagagtaatgaatttatcaaagtagcaagatgcaggatccataaataagaatcaattgtatttctatatattagcaatgaaaaactgaaattaaacattaaaattgtattttatttttctgagacagagtctcactctgtcacccaggctggagtgtagtggcgtaatcttggctcattgcaacctccgcctcccaggttcaagtgattctcctgcctcagcttcccaagtagctgggactacagctgcacaccatcatgcccagccaatgtttgattttttttttttagtagagatggggtttctccacattggccagtctggtctcaaactcctgacttcaagtaatctgcccacctcagcctcctaaagtgctgagattacaggcgtgagccactgtgcccggccttaacattaaaattttaaaacactatttaaatagcactaagaatataaatacttaaggataaatctgacaaaagatgtgaaagtcctaaatagagaaaaacatacaacacaactatgagaaattaaagaatgtccaagtaaatggagacacataccctgttcatgagacaaaaaactcattattatgatagcagttcttcccaagttgttctggagatttaatgcaatccaaatcaaaaccctaacaaacttattgtagaaattgacaagctggttctaaaatgaattcagaaatgcaaaggacctagaatagccaaaacaaccttgaaaaagtgaacaaagttggaggactaacacttcctgatttcaagacttattgtaaagctataaagtaatcaaaaaggtgtggtattatcatatagatagagaaaagatcaatggaacaaaatagagtccagacatacagatacaactgatttttaacaatttgcaaaggcaatttagtgaagaaaggatagttttttttttcaacaaatgctgcagaatcagttggaaatcaataatctaaaaagaaaaaacttcaatccatatcttgtaccactatatgcaaaacttaactcaaaatgtatcatagacctgaatttaagtcctcaaactacaaaagttctagaagaaaatagaggagaaaatcttagtgagtttgagtcaggcaaagagtatgtggatacaacactgaaaccacaatgcagtaaaaaactgacaaattatacttcatcaaatttaaaatcttctctgcaaaagaggatgaaaagacaagtcacaggctaaaaaatatgtatttgcaaatcatatatctggtaaaatacttttatccagaatataaaatgaactctcaaaattcaataataagaaaaaaaatacaccaaaagtaaacaaaacatttgaacatgcatttcaccaaatggcaaataagcacataaacagatgcccatcatcattagtcattagggtaaagcaaagtaaagcacaatgagataccactaaacatatcaattgagacgattaaaataaaaaagactgaccataccaaggattgcaaatatatgaaggagctagaactctcatttcctgtagtgggaatataaaataatatactctttgggagaacagtctgcagtttcttaaaaagttacatgtatgctaactatacgctctagccatttcacttgtaggtatttcccatgacaaaagaaagtatatgtctatataaacagttaaatagttacacacaaatgttttagtggttttattaatatatcccaaaactggaaacaacctaaatgtctatgaacaggaaaatggataaataaattgtgactatctatacaatggaatgctactcaacaataaaaaggaattaactactgatacaacaaggtggatgaattttaagataatcatgctcaatgaaagaagtcagataaaaaatagtacctactgtatgattccatttatatgaaactctagaaaatgcaaactaatctatgacagaaagcaaatcagtggttgcttaggaatgtggaggagtgaggaatggaaatgaggaactgcagagggccatgagaaaacttttcagctgatgcacatggtcactgtctttattatggtgatggtctcatgggtatatatatatatcaaaaacaactctctctctctctctctctccaatcccccaaccccatctcttacaacaagaaagtatgtccctagtatatctggaagccatcttttgaccaagagaaaagccagcatgaggaaactgttaacacagggacagaagaaaagaaaatgtctctgaagggaagagagccagaattgtgattacattaaacctaaagattttcaacgatgtgacctgatgaaattccataatggttaagtcattttgagtcataattttacatcttttcaccttaggtgaaaagcatcctaaccaagataagtatatgctcagcattatattgataatttataatacgccattggaaaaaaactctcttcctggcatttaattatattacttatttcaaagaaaatgcagtaaaaaactgatctgtatatctactgatatgtctatcagtaaaacagataagtatatctatgtatacctactatgcataagccttacaggtgctacatagaggtgatatctgttgtttatactctttgtcttcccttcttcctttttttgataacagtgccccaatttacgcttagctaaccataatctagcattactaattcatgtcttccagatgagatagaccctccttgtcactaaaagtagacatgtgactcacagcattgtaagaagatagtaatggaacacaggtccccaaatttaccctcccaatctcttctcaattactttccccaacaagaaaaaatgctactgcaggtaagcaggggcatctaaagcagggtcacttgaggtcacaggctccagggtctctaaaaggaaagagatactctcactcttctctgttttaggtagtctggagggccttgttatagaaagacttaaaacaaaggtctcaattttatggcttccagtgaaagttagcctgaggaaacctatgaatgccttcaggaaagcattacatgggcttatttgtgtgtgttcttgggaaggtcagactaatctgggtagtgacaggtcatatggaggaacgctgcactcatggaagagttgcttgtagcccctgaggttaggcaagcattctcccttgcacccagggagctctgggagaagaaagactttttttaaagcttcagctgggtgtggacagattgccagttggtttactgccagcccacaaaagcagaaacctttcccctggcaggtttgccactgcataaaagaccctaactacttgtcctgtaattataggtcagtgtatacagagcctgaggtctgaacaggaaatggaaaataataacttgccctagtagtactagcaagccagagaggaaaactaagataaacacttcaaacaggtgttttgttgaaatagaactgttagaagagccaggtgaaaacttttctaaaaagtaataaattcactcaagaagatataattaaagattaggagttaaatatatgatagatgctagaatgataaaatatacatattttaaaaataggtaatgactccatgtgtttctgacagtatacccttcctggttgaaataactaaaatgaaataactaatggaaataactgaaatgctacataacatatttttaaaaattaatactgcttagccggcatgaaattcaggaatctaaatatttccaaaactgaaaaactggagggaatagctgagaaattgacttagtctgttttgtgttgctatcacagaaaaccacagactgggtaatttataatgaaaagaaatttgtatctcacagttctggaggctgggaagtccaatatcaaggtgccagcatcttgtgaaagctttcttgctacatcatcccatagtgaaaggcagaagagcaaaagagcagacactcaagagagaaagtaacctactcctacaataatggcattcatccatttatgggggtagagacctcatgacccaatcagctctcaaaggtctcacctctcaacactgttgaatggggagttaagtcccaacacaggaactttgggggacatgttcaaacgataacactgcctatctagtccttgtcactggacagaaaaagaagaaattctcacctgtgaattcataaccacttacactatatgtgatgatcaaaagcacacaagtaaaaaattttatttaaggtttttccaagttaatagtataccagataacaggcaaaaagaagcacaaatattccttactcaattttaacctaagcttcaaataatttccagagattgtttcaagaaacgtaagcaatttattatttataattcagttgacatattaaacagcatatgaaatatagctgaaaagagaattgataaactagaaggcaaatataaagaaattatccagaatgaaatccaaagagataagagatattaaaagacacagagattagattgagaagatctaacatatacctaatttaaattccagaaaacaagtctagggaaaatgaaagagaggaaatgttacaaaagataatggactaggaatgtaactgttgaaacatcaaatcttgagacccagggagccatataacatgcttccaaaatccaagcttattatattaatatacaaaaacattaatattaatattatatattaatgttattgttaatataatcattatattattaaacatataatttatacataaacaatatattatatataaatgtatatgatatataatatacaatagttataatatataataaattatatattgacttctatataatatagaattatataacttataaattatatatagctttatatataaatcaataattatatattgatgtgtacaattattattttatattattattaataattatataattggtattatataaatattaattttatattgcaatagttataaagtaaatatcatataacattattaatataataaatatagtatattaatattaataacttgtatttattaacaatatattaataaatgacataatttcacatttctttcagatttctgtaaaagcttatcaggagttatatatatgcaaaaccatatttatcttattaaagaggcatgtataagtgtcagaccatcacttatgaatagatttgacagccagatatacaacctttcagaaaacagaagcaaacctcctccataaaaacaagtaattggcagctgtctcaatgatgtccagtaactagccttatttcactcagaacagttttgtcggcttcatatagcatgaccaatcaccctggtttactagagcctgagggtttcctgcgcaagggactctctgtgctaaaagcaagatagtcctggatcaaccgggatgagttaagtctctatttccatgccttcatagaaatcattaaaagatatctctctgttatgggctgaataatgtcacccaccctgaaattcctatgttgaagtcctaacccccagtacctcagaatgtaactggattttgagatagggtttttaaagaggtatataagttaaaatgaggacagtgggatgggccctaatctaatatgactgatgtccttataagacgaaatgatttggacgtggacacagagggacaaccacatgaggacagggagaagatggccatctgcaagccaaggagagaagccctcaagtaaaccaatgctgccaacacattgctgttgaacttccagtctctagaacgataaaaaatatttctgttgtttaagccacccagtctgagatattttgttttggcagccctaacaaacacattctctaagggtttattctcatttttggtttagtgtatttcagctgatgattatagcctaatcctccccctcttcttggggcctctcttctctgtactcttcctcctcatatctcacacaggcagatttgttcctgcctcctcacctacattacgagctccgcacagtctcctttcttctggctccggctccctcattaatctttctgttattaacgctattaactcgttaaactatctctccacctttccaaacttccattaactctggcactccataagtgttagtcaaataaatgaagaatcacactaactcctctttccttccctctcactccaaactcttggtgagattcttttgcacttatgccctcgtttccccatttcccactcacttgtcagtctcctcattcttggttttcctcattatattgaaacacatctgaaaaagtcatgtaagaccacagccactgcgtatcagtgctatttgagagttaataaagttcccttttcctccaagacagcgagcagagtgaacagaagaaagactggtttctgcccttggctgcacagccatgccccgaggccgggcttaggattttataattcacaaagtcaactgtctcttcccctctccatcctttaggaactgtctgcagtatctgacactgttgagagctctcataccctttaaactctctcttctctggctttctgagctttcctcccacttttgatggcactgcaggagtttttaagcatctctctctcataccaaccccagaaataaagtcattcctcgaattcctgtacttagccccttgtctcctaactctttgaccactaatgttttagaaacactctcctgacaactatcgcatctttgcagttgtttccatttccaacgccatgtctctctgagcagcagccttgagttttcaattgcatatttattagtcatttccatatggacatctcactaaatctgtcatactaaacatgtctaaaatatgtatgtttacatgttacatgtatgtttggtatgtgggaatgcattacattcccacagattttttcccagttacagtgttactattctaatcactcagactagaacactcagagctatctatgagtcttcctctcactcaaactgcatatataatctataaacaggtcctgttgacctcatcttctaaaaatctcttacatgctcctttttatatcattggataatagtttagtgtggtggttaatatcatgcacactggagccaaatctgttaggttcaaatcctgactctccttctatttactaattatgaaaccttaggaaaattattcaacttttcatctgtaaatatggggattataatggtgatccactttatatgactgacaaccaaataagtgaatacgtgtatagcaggtattaaccatatgcttagccgacctatttcaacctcctaaccaaccagaagaactgtagttccctgctctcttgcatctaagtggggccatggaatgtgggcagaagtgttgtgtcacctttactcagaggcaattaaaaagaagacatacttttcctatgttctcattgccaatgaacacactacacagatctcaacctcagaattctctccacactggtatttccaaaatagcttcatgagaagggaaatttgtgtagtttcaatgatttagtgatgctatggtttgggtatttgtctcctctaaacctcatgttgaaatgtgaccccaattttggaggtggggcctaatgggagatgtttcggtcatggaggtggatccctcacaaatagattgatgctattccctgcaaggaggagaggatgagtgagttctcactgcattagttcctatgagagctggttgctaaaaagtttggcatctctcccctctctctcgccatacgatctctctgcacacaccacccgcctttgccttccattgagtggaagcagcctgaggccctcaccagacgcatatgctggtgccatgcttcttgtacagtctgaagactgtgagcctaataaacctcttttcattataagctacctagtcttgtgtattctgccatagcaacacaaatgaactaagacaagtgacaaacacaaaataacttgtcttttagacaatattgatgtctgaaattccacattgaggcatttttttcctcttcgtagcctgataatggcaaataccttctgacaccttaggatggatgaatttgtaagagatattcctggaagcaggtttgtacagtgtagagaaaatgttgggtaacaaagcaggaatggaggagggttaatcagcaagccaaaaagcttttatagttttgcctgctgtgctgcatggaattacatccccccaaaacatatgttcaagtcctaaccacaggtacctgtgaacatgagtttatttggaactaggatctttgcaaatgttatcaagttaagatgaggtaatactggattggggtgggctctaaatccaatgactggtgtcttcataaaagaaaggtgagggagagttgaatatagcgacacaaaggaaacacggggaaggagaccatgtgacaatgtaggcacagaatggagtgttgcagccaagccaagaatggcaaggattgctggagctaccagaagctaggaggaggcaaaggattcttccctagagccttcagagggatcatggccttaatggcaccttgagttcagaattttaggctccaggactgtgacagaataaattcccgttgtaagctgttcagtcggtggtaaatttttacagcagccccaggaaaatatgcctgctcaacaccctaccctgaattttaagttcattttatggaatcattttgagtttggagtttgatttaatccttttcagtaattaacgctcttcattttttactcccaaatatgtcacactggctctactcttataacaattgtatttatctatcttttggtaatggggctgccaccccttgcagaatgaaaagtagagtgtgtatgctcacacctccctccctccctccctctctccctccctctctctttctttctttctcagagtatcgctctgtctcgcccaggctggagtgcagtggcgcaatcttggctcactgcaacctctgcctccagggttcaagcgattctcctgcctcagcctctggagtagctgggattacaggcgcccgccaccacgcccggctaatttttttgtattgttagtagagatggggtttcaccatattggtcaggctggtctcaaactcctgacctcaggggatccacccgccttggcctcccaaagtgctgggattacaggtgtgagccaccgcacccggctcacagaatttcttaaaaagtcattgtgttcagtctttatggatcctctaaattccagctgctcagcctcccggagctaaatgagatcacttaaaggtcgactgttggggcctccaaggtcgcctcggagactcacctcataggcaatcaaatggatcgctgggtttttgtgtgtgtgggttttttttgtttattttttttttccagaaaaacactccaccaagaaggtttttataacctactggaggaggaggatggagagtgggcacgaaaggactaggatgaacatgccataagcaatctaaatgccactgcaatattgcctggtgaggacctgattactgatgttttaaagctaagctttcagttgtcactccacccagtagtgaaacaatgagctctaaaatatatatttcggctcaagctttcttatgtggggaggtaatccacccgaaggtatccccagcctgtacctaatacagtgcccagcactaaagcagctcagatgccagtgaatggtggccactgggaggcctgtcagtgggtgccagtagcggtctcttcagagaaaaagaaaactcccctctgccagatcagtattttatgagctgtgaaccaaaaccattgctaccaccatcactataattctatccacagtaattatcataaaggcctaacaatgccttgtagatgaacattctgagtaactgctctataaccaggagatttaagaccgcaccaaaaaccagtagagggttatactttactgggcacaagtcgtttatgataacgaaattgtagtttaatctgtgaagagatgtgaatgtaactgagacacgcttaaatggaatatacagatgagctttatttttatatctggcatgcttggatccatgccgaccctccagctgctcgggcctgcccttaggggctatggaccgcatgactctatcagcggcactgccaccgccgccgcctccgtgctgcctgcgttccccgaccattgattgggcccggcaggcgcttcctgggggcttccctaccggctccagcccttgggattcgggagcgccctgctaggaagccagagccccgcaggggccgcggcgtccaggccgcctaacgcgcgcccctcgcccggcgccccgaagcggccccgaggggcgggagccgaggcgagcggcaaggccgggccgggggcgcacagcgcccctagaagtgcgggcttcccccacccccggcagcgaccctacctcccgcccccgctgcgtgcgcgcgtgtgtccgtctgtctgtatgctctctcgacgtcagtgggaatttccagccaggaagtgagagagtgagcgagacagaaagagagagaagtgcaccagcgagccggggcaggaagaggaggtttcgccaccggagcggcccggcgacgcgctgacagcttcccctgcccttcccgtcggtcgggccgccagccgccgcagccctcggcctgcacgcagccaccggccccgctcccggagcccagcgccgccgaggccgcagccgcccggccagtaaggcggcgccgccgcccggccaccgcgcgccctgcgcttccctccgcccgcgctgcggccatggcgcggcgctgactggcctggcccggccccgccgcgctcccgctcgccccgacccgcactcgggcccgcccgggctccggcctgccgccgcctcttccttctccagccggcaggcccgcgccgcttaggagggagagcccacccgcgccaggaggccgaacgcggactcgccacccgggtaagccaaactcgggcgagtgggggcccggcaggggacgcgtggcccaagtcctgccgcccagccctccgcaccccctccagccccactcggacttcctcattcctgcgctaaccgctgggctagaccgtgggaggaggttgacagtagctgagaggcacatgggattagcgacagcggggaaagacacatccggacctcgcaggggctagtcggccgaagggccgcggccgcccggcggtcatttctcttcacgtccctccgcggggcgggaacgcgaaccgaaggggaactcttacaaacttttaaaatccccaaccccagccccacctgggggatggtgagaaggttggagtgcgctgcggcgcggaggagagagggaaggtggttggtgcagtgcagaaccagatttcacctaagggcgttccatgaaatgaaagcagaagtgcttgtcagtcctcttggctgggaaagccctccccagctccccagaattgaataggagagtctattcatccctctcctacttctaaaagaaacctggctcgctctctgtctctctctctctcccccctccccccctccgtgcgcgcgcgcgcgcgcacacacacacacacacacacacacacacacacacgatatagtcacctgctataggacttgattctgatcctccggggcctggcatttgagagagaaaataaattacctacctggatacttagagcactttttagacttgattatgtaaaactcttggacagtgccaccatgcattatgcatgaccgctgaaacaaaaataatgtaaaaacaaggcctatcctaaatgcaagtttttctatggtccttaaaaacagacaccagggaatgtttgccctgacttgctggtttatcctgaaactcaaatgggacttaatgatacaggatttaattatcaagattgacatgttcatggactttgttaagtagaggttttcagcattacagtttatgaaataaccatatttaactcaaagatttttttataaagctcataatctgaaaaaatgcttatggtattactaaaacatttaatagctctggcatcaaaatattctacatactggtgatcttttagtaaatagtaaaggttagggtcaagatattcaataatttttttctagcagaatcccacaactgaatattgtcaagcagtttaaactgcattcgtgtttgttaaaactttaaaagggaaacttaaaactaaagtatgttgtttttctgattttaatattgtgctttctagagatgaatccttttactgtttgaggcactataggaattatgtatttaaatgtatgtatttaaatttgaagcaatgtacttttttgagtttataaacttgggaagacaggaaataaaaagatttgtttcctgtagaattttacattcatgatttaattgaattgctaaaatggaaagaacatgtacgattaatggagacttggaatctgagattattcatccatattgatacacctgcaattcctaaatgccctcccctgcttgtttagataaaatgtcttcctgggctgcagcctactggacaaacttgaacacaaaggaacacacgttatatgtacatttaatactggaaccgaaaagctgcttgcagtgaaaagcaaaccacttctaaactctttgagactttttaaagaaggtagtataatccttttaggggttggtggtgatgtgaaaatctattatctttttgctgaaatttcattcttatgttaggcattggcactcacttgtgctgagtaaatgcccgtgtttttcaaacccagatagtaaatactgggggtatacatacaaaaatagtccttcccctttgtaagcattgctttgatctttgcacttcctttttactctacctcttaaacaagatctgtgttgattgagttgattaaagcacaattaatctgaaataggcagaattttagatttagtgattatattccttacatttctgttgttactgttcctggaaacaaattgaagtagtttgagaaactaatatttatgcaggttgttttaactacacttttagacttgcagataattgattaagtaagttactaccttgactttcagggattgctcattgtggtagatacgaggtctagatagggaattggcagctacatgaatgttggactatcattccatcagcaagaccttatttttacctaatttatgagaggtatttctctgttcagaagaggtgaaagttctggcttctggggggaagtggttacttcataaccttcaattggtttgaacttgggagaagtaagaaaagtagtcgatattttcaaacagtaaaataattgtatctgagttgctgtatggatttttgatgaagtactcaaaatgtcatcttttgcatcttcgggtcttagtagatgtgctattctgagtatagaattgactgcagtaggaagtgtatctggaaatgcacagtactgttgtataaccaatagagtaaattctcagattatgctcttctggtccacagattgatcagaaatcacattaacaggaatggatgtctatgcaaaatttctcattaattttcttacttttagtaggaagtttgttttattcggttggtctgttggttttctgtttacaaggtgaattgtctacagtagtgggattgttatattagaagagaaggagaaggaaaaatagaagttagtgctagaggatatgttaagatgttctgctcctacatctacatttgtgtctaatcagcattaattgatgactacgtcttggtaaacagtagaccatactggagcaatttactctgctttttgggaattagttctcatttgcactcttgcacctcccataaatactgaactcacttgtagtgttcttagaggtcagcaataaaccatcaagagcatatgatctctctttgaattttgtcactactttggagacagacagtttggaagaactgaaggtactcagcctcagggagaaaggtttgaacgttttggcatagtcctgcaagtcagtttggctccttgactgtgaatttttttaatcaaaaaagattaatatttgaaaccacataatttggacagttaatagttctggtaacataaccaagccttttatctttgtagtatttcattaattagtatccagtgcctcacttttagaagaaaaaaagagaaaaaagtagtaacattcttttaatgatgatgaaattgcttcatacctttggtctctgctgtattaggggttgttcctgggtgcaaattaatatactgtcttttacatttccggaggttgttgacctggccttgaagatcagccaacagtttagaaaataagttgtgcaaattgcattgctacacctcaaataatttaaagcctgacagttctgtacagaataagagtcacataagatgtgatttgttaaagattatagaaatctcagaagatagattatggatgaaaatatttgtttaatttagagtactaataataaaaatagtgcattttacattttaaaaagaaaacaatttttattgtgtcatattttctgtagtaacaaacagaattaattatcagtaatacaaatttcatctgctttaatttattgcctgtttttgaaattagaataatgatatatttggtttaattatccattacaaattgccttattatttttcattcatctttcaccattaatccagaaaccttaaaatagcttttattttgacccatgccttcagtagatatcaacagacttgagttcatctatggatcctattagtttaaactgtgacaaattttgactgcttaagctttagaaaagaatttattctttaaaatagccaaaattataaaaaatgaaataaagaaaaagctgtttgagagaatcaaatactctagtttaactaaaaataaataatatctaatcaatactgacgaaagaaatatctgatgcttagcattgtacttgttggtacatagtaagcaatcattaactgttaaatgaatgaatgatatgaagttgttgcaaaatttttttttaaatggacagccatcttctataaggaacaaaaattacattattttgctttgccttctggaaagaaaggagcacaaaatagtccttgtgtcttagatattatggaaatcttatctaaagaccacttgaagtttactagaacaaataatttattaaaaagtatctggcgccttccaaaaggggaacatttcattctgaaagaggcatttatgaactagaaaaaaaatgccttttagtttcaaagttttagaggcaccagagcaagattataaagtaattggaatgataaaaggtgcttgtaaaattgaaaaatgtaattttttggtgaagttagaatttctgtacactccattgaaactgtaatatcaaatactaatacctccaaaaaagaaacaatgctacaagcactgcttggtaatctaagaattgttaacacttatctaaattaatcaaccaaaaagttaaaacaaaatatgttattttgttatgttacctctagaattaaacacctatcacccataaatctgtgactgttaaaagttactagatggcaaacctcaggaacaagcaggcagttagcagggtttactgtactttccactttcatactttaatgatttttccaacactatagaagctggggcctcatcctagcacagtttgttcattatttttcagttgtagcattttttaaaagttggccttgaatttctgaattgaaccatttatttttttgtggacacagttttttaaatgaaatataccatttagactagaaaagagcaaaatgccaatactccctgtcctagtgtcattgtgccccctgggaaccctaatgcagtcctgtgggaaaacaaccattttattgagcgctgctcacttcagttcattctgctttgctgccacttagttctggttctgaccctgatctcccctcacatcactcacaacaaacattcaagtttaaaaattaagttaaaagttagttacatatatatgtaactaatgtgtatattaaatatactgatatatattagttacatatacagatatggcaacaacaaaaaaggttatatatatacatatttgtaactaatatgtatattaaatataatgatatatgtataaatacatatttgtaactaatataattatatttaatatatattagttacaaatatgtatatataatattttttgttgttgccagcaaaatgagaaagaaattaaatgttaacatctataacaattgcactgtaaagccgtcattgttgaaaagtactccgaagattaatagcggcagtgtttgttaaaataataaaataatccaggcactctgcctgtgacttccccatgagatggcttccagaaaaagataaatttttgtgtgttcccttacgagttcagtctgcagcttctgggcatgaagagaagcataaacaaaacaaacaaggctctaactttgttataatccttacgctactagtagaaatgtatggacaattcatgcatttcatattggaaaataaagctattagatttttctttgagatgaaccttttttttgtaatttattttttattttttattttttttcagtagagatgggattttgctctgttggccaggctggtctcaaactcctgacctcaagtgatccacccgcctcagcctcccaaagtgccgggattacaggcgtgagccacctagcttggccaaggtgaacctttttgataaatgaggctcactaatatttctaggatttacttttcactaacttgaactaaagaaagtataagacctgcataaagttgagcatacctctataatgtcccattttaaaaagcaatttgtttttaatgacttttatttgttaaaagcagttatttcaaaaaattatttttattatttatcatgtcatttggactgaaaatactataccatatttcagtgttagggcacacctatccctctttatcccagacgtcaattctaccatataacaagtatgtaaaaaagaaaacataaaagtgatgacagactccctaatcaacctatttattggttctaagcccaagcctgcagttcatttaaatagtgaaaatagattacttaattgtcttagaaaatatgtcttccatgacaagaattttaggaatgagaaaataactatttttggatgttttaacacaaattcccaaatcatgttttattgatatttgaagaacctctttgtctaccagttcttaagtataggcttattttgtaaggcttaaacatgtattggtgtttgactgttaagacttgatctataaccttcagtgtctttttcttttaaatggggtatggacttggtaatgaggccagaggagaataccttacaatttatagcatctgcatataatacaagaaccttcatgatttataaaattaaaatgatgatgatgtggaatgatggaagaagcatgtgtgggtggctatttatgtagaggaaattagaagttgaaagcaatgttaagaattaaaattaaattacacttaattttttgctcagttggatagtcaggaaagtacttaaatcagcaattgatttacgtaaaatcaaaactgaaaactgaatatacaatctaggaaataggaaaaaaatttttagtgtgttcatactgctaatttcaaaccaagcaaaaaacctggggaactacttttcagaggagatggcttaaaatgaaccaaaaatatagccatttctctaccctattcatttaatgcattcatttattatactgctaatacatgataaggtgaataggttaagcatcgtttgtatatgtgtatgtgattttaaacctgagtcttttgaaagattggtcaaagcaaaggataatgaaagcataaagatttagggggaagagtcctctataaaactaagacttaaactttgttatcaacttgaatgtgaagatagaataatctagaaagtgaatgagaattataaataaaaggacaaatcatatatctcatggttgagaaatacaatgagataaattgtatatctcatctcatggagggtcataatgaaagaagtaagagagattgcccttggatagaacctttcggcagacatttcataatggattatcatatttttgctaaactggtaagaatggacttttcaccacattatgaaaaaacactttagaagtcagttgcgatcaagcaaatataagtacctgggaaattaaaatcaaaagcacagcagtccaacaatagtcaaatgcatttactcactctcataccatatcatagcgttaatttgagataatgtctttatggtgtctctttatatatttactcgatttcccatttaagacatttaaccaaatttaaaaagcaatccttagaaactttaaaaatatttcctattttaaaccattacataatcatttaccctgcagttacaattctttttttgtgatgggtggggaagtatcccatttctcttagaaagtcttctgtaatagccaaataggagtcaatccaagttgcttagagaggtagttcaatcctgtgttgaaatagatgacttttggagtaattgtgctatatttactgagtatctgttgaactgtaggagtccagtcattcaaggcaagctacagaaatgattttattgctgaggcacttaagtatcttcacatctatatgccaatattaaatttctcatcatccttgatccccacccctttgcacagattggtatccccagcacattagggaatgcggttgttagcctgttagggtccattcagtagatttctcatgccagaaatctagaagcccttcttatacattcagctttcttcttcagtcagtcaccaagttctatcaaggcagcctcctcatctccagaatccatcccttcctcgttgaatttctagattttatttttgcattgtctcctgcttctaacccatcgttcatttcgcataatggtcagctttctaaagtgtaaatcggatcatgtctctgcagtgaatcccagttgtcttcacaagctgattctcgcacacctcacccccttactccctccggtgttccccaaccatcccctaatctcaaatcctccacaccgactttcagtttcctatccacagtttctgactttgaatgcctttgcttatgccctccctgtatgagaagtgccttttctttcctagccatcctgctaacttctaaacccttaggcctggtttgagcatcaccatttctctcacttgcctttctgttttctccctcccctttccataaagagttatgtgcccccattctgtgttctcctgaattcctgtgggtcctagaaaagaaacatcttgagggcaaggagttcatcttatttactttttatttgcacagcacctggtgtgtttgctgaataagtaaataccgaacaagatatcaagagacagtgctgccaattaactgtgtggctctgagcaagttaattaacttctctgagtcttatttttgttctgtaaaaaaaatgaggtttgacaaaatgagcatctctctctaaaattatgtgtttctttgatgtaattgtattaattggaagacttcagattttcttgccatatcaagataggtcaacttaagaaaaatgcatgtgagtaagtaccaagccaattcttgattatcagtatgataatatgaggaactgcccattttgtcgataataagttataatttttggtctcagtgtaggttctttctcaaatccagatgtttctggtgttgcattttttcattattattcagtctctcgcattcatatttctccaaagaaatttatggaaaacttgagacaaaaattgaatgtaaagtttaatatttaaatgctagattgattcaaggtctcactaattataactatatttggagggagaagaaggggaggtggtggtagtatgagctgaatcctcctctgttccttcctagaaggaacacaacgtcctacatcaagaaaaaagacagaagcatatcttggagatatgaaaagaaccaccaggtaaactaaaaagaaaaagagtgttaaaaagtcagcctttaaaaagcaggattggagatgaggaggggtggagtaggggaagcattgcttgtttatagaagctcttccatcttcgtatagtgtgatttttatttttttattattttttccttccttttttttgacctccagctttagtatagtacagttgacagaaattatatatgtttatggtacacaagatgatgttttgatatacatatgcattgtgaaatgattaaatcaagctgattaacataagtagggttttatttctttaacagtgatttatttgaatatatgttgagtcctttctatgtgccagacacagttctaaggacaaggcacacagtgccaaacaagacagaaatccagaaattcatggagcttaaatcatgtagtcttttcagtttttaaaattttcttgctgggcgtagtggctcatatctgtaatcccagtacttcaggaggccgagaagggaggattgcttaaacccaggaatttgagaccagcatggacaaaatagcgagaccccagtctctacaaaaaatttaaaaattagctgggcatggtggcacatgcctgtggtcccagctcttcaggaggccgaggtaggaggttcacttgagcctgggaggttgaggcttcagtgagcagcgattgtgccactgcagtccagtctaggcaacaaagcaagactgtctcaaaaaaggaaaaaaaaaatagaaagagaaactttatttttacattagccttttttaagttgaagaatcccatagctaaaaaagtacacaaatattaatgctgcaactttagtgatttatctcaaggtgaacacgtttaacctagtgggtggtcaagaaatagaacactggcagcactgcaaaagcatcctatctgccctttcttagttaggaccccttccctccactgtcatttaaaagatttcacaaacaacttttggattatatgtatgtcaattctgtgactcatatatatccacatagacaatggagcgttgactgaatgaattcattattccaaggtgctaataatgagcttcacaccagcgggaactctgctgtgtcagttgggctctaagctcagttcatttcagatattcctcactaaacaaaatactgtttttcctcagttgttagtaaaaaatagaaaacagattacattctcatttacttattacttatgaatgtaaaagtaaatattttgcttaataccaagtagccagggtcactgacagagacatgggagaaagaagtattcacatctgatgttatcagacatagaagagagaggtatagttcacctatttctccccactcagtttatacattgacatctgtatgtgtgttgttttgttttgttttgtttgtttgttttgagatgtggtgtcgctctgtcacacaggctggaatgcagtggcgcaatcatggctcactgcagcctcgacttcctggtcccaagctatcctcccacctcagccacccaagtaggtgggactacaggcatgcaccaccacacctggcaaaattttaattttattttactttttaaaatttttgtagagatggggtctccctatgttgccaaggcttgtccccaaatacctggacctcccaaagtgctgggattataggtgtgagccaccacacccagccatgtatatgttaaagcgtttatctgtatgagtggtcagtgtagaaagggcttcatggagcctgattttgatggcttgcaaattattatatttgtgtatgtgtaatcggaaggccttcgccgtgattatttcttcaaaggaaccctttgtccctccagggtgattgtacccatgttcataggaccaaacattgctggttcacataatgactctttttcttttaaaacataaaggacatatttttatggatttttgaggattaatagaataaaaatctaaagtcatattcagattcaagagaactggatcagtttctctgtatttgaacaaaagaatactaatctctaattcataatgcatgaggtctacttcttcctcagtctgaaaatatgaatattccaaaatggtactcaaggcagaggctatatatcaaaattaaaattctgtgatactatgtttttagggaagaagaaaactgtagcattagaaatgtagacgcaaaaggtcagaacaaagtccagtatgtcaagtccctttataatgccatctgaatgaaagacctcacaccatgaacagaggtattgaagcagtttttatgtggaaatggtaggcagcaatatctcaggagtgactttaattataacatttaaggttttatctaacttattataatccttagagaacttctctagctctacaagttattcttggcagaatttgtcctaacatagtattaataaaaataaattttacttgagtatgatataaattactcttaattacaatataattttaaaatgcccaaaacatcttttgatcttatgaatttcagtcagctatgattaagaagacaaccataggcaaaaatttctttcttatggaacacgttggaatgcattctaatcacttctctaagaaaatccctgtcccccatgattatagtgaatatgatacagcaataatttagatgcttctttcaggggggtgaggttatgtattctacagtctattgattctaagaggcacttttttctcccccaatttaacagttttgtttaattatatacatttcaggattttttggggatatttttctatcactggtttctgatttaattccactgtatttagataacatattccgcatgctttcaattctttgaaatttattgagacttactttatggctcgggacgtggtctatcttcgtgaatattccgtgtgtatttaaaaataatgtggactctgggccgggcgcggtggctcacggctgtaatcctagcactttgggagtccgaggcaggcaaatcatgaggtcaggagatcgagaccatcctggctcacacggtgaaaccccatctctactaaaaaaatacaaaaacttagccaggcgttgtggtgggcgcctgtagtcccagctactcaggaggctgaggcaggagaacagcgtgaacccaggaggcagagcttgcagtgagccgagatggcgccactgcactccagcctgggtgacagagcgagactccatctcaaaaaaaaaaagaaaataataataataataatgtggactctaaaatcattcagtggggtgttgtagacacactaggttcttttgattgacagttttgttcctaagccttctatatctttcctaccatggtttgaatgtgtccccaccaaattcaggtgttgaaacaggatgaccaatgtgatggtaggaaaaggtagagcctgtaagaagtgatgggattaggtgcccttttaaaagggcttgctggaggaaatttgtctcctcttgcctttccgccctctgccagttgcggacacagcattcctcccctctagaggatgcatccctcaccagataccaaatgctggtgccttgatcttgggcttcccgttgccagaactgtgagaaataaacctgggctctttataaattacccagtctcagctattctgttatagcagcattgacagactaagacatttcctgacactctgttgatttgctttgatcaattaccgagagaggaatgttaaaaatcttaactgtaattgtggatttgtcattttttccattagttctgccacgtttttgcttcatgtattttgaagctttgttaataggtgcgtacacaataagatcattgtttttctttgatgagttggccctttgattcttatatgcaatgttcctctttgtccctggtaatgtttattctcttgaagtctactttatctgatattttagaatgtagcctgcttttcttatatttagcatttgcatgatataactagcccagtgtaccatcttcatacatttaaactgtgtctttaatattaaagtacaattcttatgaaaagcgtatactttaatcttgttttttaaaaatccagtctgatcatctctgtcttctagatgagttcagtccagttccatgtaatattattattattattatttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccccatgtaatattattactggtatgttgggtttaagtctctcatcttggtaattaattatctatttgtgctatctcttctttattcttttttttctcctttcctgccatcctttgaataaatcaagtttagtgttttaaattccattttatctccttcattggttactttctaaagtggttactttaccactttagaaaagtatttgtttattacaatatgcatctttgagtctctaattaatgtgagaacttgacaatgttatacttctgtttgtccttctgtgctgttattgttatacattttacttctttatatgttataaactccaaaatatattgtcttgttttgctgtgaacagtcaatcgtctgtttaggaaattaagaaagaagaaataaaagtcttctgcttactcacatatttatcattattgatgctttttattctttcatacaggtccaagtgtctatcatttcccttcagcatgaagaacttctttttagcatgtcttttagcaggtctgctggtgatgaatactcttagctcttgtttacttgaaaatgtcaatttcacctttatttttaaaagatttatttgctgaatattctggaccaatctttttttttcttttatcactgtaaaggtgcctttacattgccttctagcttgtactgtatctaatgatcatcagaaacatcatgcttatcatgcttatcaattgttcccccatatataatatgtcctttcttgtcctttgctattttgggattttttttttctctagcattagtttttaacagtttggctgtaatatgcctaaccatggttttatttgtctttatccagcagagagatctttgagattcttggatctgtgggttgattttttaaaaatcaaatttataaaaattctcaactgttatttttttgaatattttttctgtcttttttctgtttctgggattctatgttacaaatacgtaagactgcttaatattgtcctgtaggtcactgaagctgtgttcacttctttctacctttttttctctgtaattcagtttgggtagtttttattgacctttcttctagtttattggtactttcttctataatgttaaatatgctaagtccatctagtgaaatttcatttcagttctaaaatttccattcttttttttaaaagaaaggtatgcatttctttgctgatattgcctatctgttctctcattatgttcatcttttcctttacattattgaccatatgctattagctatttttgtcatttgtgtcattttttttctcagtcttattttcctatttctttgcaggcttcattatgttttattgtacattgtggagagtttgggttttttgtcttcctttaaaacgtgttgagctttgttgtaacaggcagtgaatttactggtggatcacctagttttattaagataggtttagagtagcccttattttaggatgtttctaactcccatcgtgtggtctttctgaaatcacaactgaatgctcacaatgttcagtgatgtctttccaccctggattattacaaattcagtgtctctcagcactatatgatgtctggaatttccatttagctcttagatgcccagaaactgttttctattaggttttgcagggtcttgtcctacactatcacagcttggtatttggccagtgaccagagatgacccctatgtagatttctgaggctcttgctttttgtgtaaagcctttctttgtgatattctgcccattggtgttctctctttgggctctccctgtgtcatgatttggaaagtgtcctcagtcaaaaagtgagggcgaatttagaatttacctaaatcaccttataatatatagccctatgaagtccaatgtcttaaattacatctttaggtattttgtatggtttcacagttgagtatagcaaggagggaggttcagataactgttaatctgtgataactaaaaccagaatttgacattctgacaaacttgaaattgcagtgcttcttaaaattaatacagtattacttaaaaaacaaaaacaaaaaaaccagtgttttccaatttgccaatacaaaaaagcaaaactcccatctctactttttaggaacttctatccatttgagaagatgataaatatataggtaaagttagattgcagtaaaactatgctgtctagtgttaaatcaccagtatatataagttttatagatattatgtgactacagagctataggttataggaaaaatataggatttcttggcagaaattggatttaactagagccttgaagagtggatgctattgaggtagaaaagatggcatttcaggatgcagggcatattgtgaacaaatgtacaagatggaaatgagcaagtcattctgaatgattaatctgtctatcatagagggttttgattaggacatagtagtagttgatgcttataatatgatttaatataataatgtaatgtgctgagtggttgaagtctttggactttatcttataagtaatatggcaataatgtgaaagattcttgaagaggaagaaaccctgcagtgagggagaacagtacagagcctattactgtcattcagaggtgaagcaataaaggtctctcctaggatgttggaaagaaggggcagatccaagaaacaacatgaagaaaataatcagcagaaattggttattgactagatatgtgtgaaaatgatatattggcagaaattgcaaagtcaaaaatggggctcattgcagcaggaatgatgaaattgcttttagatagagaggtgaagggatttaaaacattaacttgttttaaaggtatcactgcttaaagctaacagtgatttattaatatttgcactctgaaagttttaacagttttaattttatgtatacaccacagtgttttggctactatacttgcctcttttgttcagttgggaattgagtaaactaatagagtaaaaaaatgagtacaaagtgggctttgactagaactctaacaaagtgtgatcactgaattaccaagataattaacccataccccacatatactccatttcccatgacacatattatattgcattgtttttgcctatttgccttcctacttcctaaactgttgaattagtttgcttttgttgcattaaaaaaaaggagaatcaccacaaagcaaattaaaagatactgattacttcttccaattctgtgggctgcctagttcatctggcctggcctgctttggctaatctctgaggtcttttggctacttgactggtactgtttgtagctactcagctggtgccctactgctgtttgtctgaagttgttttggctactcagctggtgctagggagcctcagctaggactgcctgtctgtgctccacatggtctttgattttccagtggctggtgcaggcttgtttgcatggtaacaatgttccaagaaagcaagaatgatcattgcaaggcctcttataagctgggtttagaacttgtacttctacctcttcctattggtcagagtatgtccgtaggtctgccaagactcaaagcacagagaaatagatgtttcctcttgttgagtggcatataaaaaaaagtgtggccattgatttcaatctgccacaaccgtaagctctgtgagtacaggaactgcatcactcttttgcactttggtgttgttggcatagtaggcataaatatttttaggtgaatgactaaattaatgaaggaaggaaaacattcaggtagtatttcaatatactgtagttttaaattatatatattatatacatttgacatagtttaatatataagtatatacacatatagttttcatatataagtatattatatattatataaaatatttatatgttatatataaagtatatatataaaatatatagttttaatatgtaagtatatgtatataattatatataatattataagtatatatacttttatcataccatcagtgagtatagacatggttcagggagaatctctttattctccttctatcttttgagatagaccaaagaaaatttttttttaaaaaaagaactatcacttgagttaacattgtttggtatttttatcttcataggtgattgccttgtgaataactcattttgtgtattgtcagaatcctattctgcttttcaggctgtgctatgggtagactagctctaaccagaacacttgggagacctgaagcaaagatactatattaaaataagtaatgttatatgccaaagaggaaaaccacttctgcctcctaaacaactgaaagaaccagagactgtggggtcagattagctagcattactatatgaacctgagcaaatgacttactctctttcagcttcagtgtcttatctaggacattggttctcaggattggtgtgagaattaagagaaatatgtgaagttctagctacagttctttacccatgaggtagtcagtaaagtttacttctttctccatgtgaaccaaagcactgtcatgatgtgatgatgttcattagggtttctcatgctcagcgttattgatatttagggttgcataatgctttattgtgaggggccattctgtgcagtataggatgtgtagcagcatctgtagcctctatacactagatgccagtaggaccacctatccagctgtgacaggcaaaaatgtcttcaaacgttgccaaatgacccctgggggcaaaatgcaaacagtttatctagcagtgacacatagccagccaccttagaaagggaattgtcagcgtacccataagtgtagaatgggaaacaaaatacttgagtcttctcagaatgtctaaaccttttgctgtctatattcctctttttataatttaccacaaacatatattgcttattatgccatctaataaaatggctaacatttgctgtgtattatactcggtgttaataagctttgtatgaactcactagctgaatgttgtatatgtatctgccatacctgttggattgacattccactgtaaacaggtaccttatctttaccagctccaagcacaatgtatttggtatatcaggtagctattctacatgttaattgatcacattgcacccaaatgaaacatggatgtggaagtggaaggaggagctttaaaacatggaaaattagtttatacaaatctaaatgttgtagtgcaccaaattgattcctttttaaaaactttcagaaatcagcttttaaaaaaaaaaagtaactaagccatgatcaacttttctttcatcaccactaagccaatatcagaaagttgtcaatcaacagctcttttaaagttgaaatttttctattgtatttcttatgaagatttcagtagtgcttagaagtttttggctcatttatcatgttttattcactgtatgtcattaattgttaaagatgtcagagtcaaaccttaaattcaggagagatttaaatttttcctttttcctatttaaatatatgtttctaattacataattcagttagaaaattacaatatagaaacatataacttagtaaaagtttccagttactgtatacagattatattgtatactgtattatttttaacagttgcatatttaacttataaatgtggataattataattaaacaatctgttatcaaaggacatacagattatttccagttccttgctgcagtgaatatccttgtacttatttttttacacacttgctcagataatttttaagtacaaattcctgaggtagaattgcagaatcaaaagatactctcatttgagtgtttcacattttatgcaaagtattttgtttcctccagaaaattcctctgtggaagaggcttcctcacattctttatcagtttattagccagcagagaaatgatgaaaagccaccccttttcttgtagtttcatcctcattgctatccaagatgaggtattaaaatcacacctaagtggtgtctgttgtggctgaatataatcttgaaagtagagacacttctctctgattcccaactgtactctctggatggcacctaaaattttattttttcaaactgaaaatcattttaatgagttcgaaaaggttttattttttaaaatgaaatcctatagaaagaatacattttcttacagtgggtcatggtcaaaagtgtgaatatctctgatcctagaaagtttccccagttacaaggacaggcgtgcccccaactccatccttaatggctcaattctgtggctttcaagttaatccactcagtcctacagccttcaccaagaagctcatgtgctacactttggtgttagtgggggcattgtcacacaggttcagaaaataacccattaggcattttatagaactcatcacatgttcagaactaagctagttgtaacattatgtttttcatgtgaaaaaacacaagcaattcactggctattttatttgttgctagctagctatactttctatttctttttccatggtgtgaaaatcttcctagaaacctcactactgggaaaagagatgcagagattagtcccatcttctcccctggaaatttactatcgcccttttggcttcaaggtccttcctcaaaagcaaagaattgaacaagggaaagtgaggggaagggctgggggaacagggaggtagaaggggttttccctggtcttttctaatcctttagttccagacgcttagttggtatttcaacattttagaaataaaacctgcttttataattaatgcaaatattacttagtgattcatcctttccaaatgattcttggtttcttttgacatttcatttttaaattgtgaattaacattgacatcaccatagcgttactgttacctcagctctttacagtgaactgtattgcaaaggctataaaagttcaaattttaactatcacccacgtgagccttggactgctgttaggcttttgaaactgtgatcctttggcaagaattggtgtataaatcatggggaggatattgaaggggaagatcatgtttaatttggcagttgggtgcctgcaattgacagattttcattaaggttttagctatagtagtgatcatgcatcagttctaataaagtaggtttcgtttgaattttaaaaattagagtgaggactgctttatgttaactgtttacattcagaagtctggaaaaccatccacaggtttaaatgtatataatcagtataattaacacgtcaacagcctcacctctgtttttgaggaccataggctaatattatttatgaaggttcaggagatcagtctagatcgacagaaagcttaagggcaaagatggttttaatatttttcttggaagtttgagcttctgtggtattctaaggatagggattttgacattgattgttctagctggtattcagtactgtatttaagtgtaatgtttttactagtattcttcttataactgaaaactatgctaatgattctttactatagatatatactcataaatacgtgtaaaaatccaagtttaccaaaaaatattaagacttaggggatatgttctttgaataggcatttatttgctaattaacatattctaatctcaacaaggttatattcttttcaaaaatccattccatcaaaatctgtcatttttacagatgaagaaacaaaggccacagtgagtttagttaatatccaagatcacacagccagcatgatagaactcttaaatttcaagcgacttaccctctttactctatcaggtcaaatttcccttttttaactgcttgtcttaattgagatttgtttaattgtggctgtctgtatatcttcaatcaatactttcttgttttagacaaatgtttccctgcaaatctgcatgaacttcatgttctgaaggactcagagctgccctttcctttttgttaaagttgtacactgctctgcatccccctagaatgctcatcagctttctcactcttcctcactcacacagtgctccagcaggagaggatttctttgaaaatcagattcttttttggagggctttgtgcttattggagtgttatgtgatatattcattacggtgagggctaaactctttgaacaaagagacctgacagtgcatttgggttaaagaacaaagtttatttctttctctcatcaccaccagcatgagcagcctggatggtcagagcagatctgtctcatggcattgttcagggatcctcattccttccctctcatttatctgccatcccctaggctattaatcatcatgtttttggtagaagccaggtcttctccatgtctgagtttttatggaggaagcatgtcaagggccttaagcccagacctggaagtggtatgcaagagttctgacattgcactggtgagcatttggtcagatggccatctctaactccaacgaagtgtagggtatacactaggtaagcagtcacatttccagctacaatactaattctatggaaaaggagacaacatattttgatgggtagctgacattctcatctgcagtcctaagtactcatgactgctagatagactttatgaaaaaaaaaaagaaaaataaccccaggaattaatatttaccctcagccttgtgtttctttaattttctcatttttcatgtcacatatctaaaatttgatctaaataaatttaaataaaattaacctttatttgaataataataaggacatttctcaaggaagtaaatctcaaatgatatgtgattttagatactatctttatctgaccatgtggttccttgcttctatcagggagggcctctgggtaatagaagattgctagggcctgcagtatattaatgtttagctggagttgattaaatctgagacctatagccttgataataaggacttttatttttgtatttttattgcacttttaatattacagagtttctgtaccagcttgacaacagcagaaacatggcttgcttctgtggaacacgctagagcagcagtccccaacctttttggcatcagggaccagtttcgtggaagacagcgtttccacagactgggggctgggggtgattttgtgatgattcaagcacattacatatattgtgcactttatttctattattattaacattgtaatatgtaattaaataattatacaactcaccataatgtagaatcagtaggagacctgagctgcttttcccacaactagacagtcccatctgggagtgacgggagacagtgacccatctggagacagtgacagtgatcatcaggcgttagattctcataaggagcgggcaatctagatcccttgcatgcacagttcacaatagggtttatgctcctatgagaatctaatgccactgctgatctgacaggacacggagctcaggcagtaatgcaagcgatggggagcagctgtatatacagatgaagcttggctggcttgcctactgctcacctctttttgtgctgcgttatccatagcccagggtttggggacgcctgcactagaggacagagcctggtacactatagcagtcctccccttgtgttatgcagagtactgatcagtcccttttgagcttctcaaccttgtataaaactttgagacagttctgggaccatcacaaggtttatgaagggttagaaaacaatacacttaaggaactaagactgtaaatcgttgaagttcagagggcgataaaaagaaatggcttctaagaatcccagtatgtatgattttttatacaaagcataaagatgatttgtaccaaactcaggacactgtggcgagcttaacacgagggtattgaatcatacgtaagtggtaattcctagattatgcaatctccttgctgttagatttagataccaaagaggaactacatcatgtcctcctcctatggtcttcaaaaaaggattatatttggtcttactggtataatacagtttattcctgcatgaattccatggtgatagaatttttaaagttcattctagtgttacagttttgttttgttttgttttaatacacagcttcagaatggcagaagatgatccatatttgggaaggcctgaacaagtaagtgtcataatctcactgataactttatttaaatatattcatatttcaaaaatatgcaaaggcaacattagtaagttagcattaggaaaattctaaaattagtaaatttttttttaatttcagtttctctgtcctttcatgtgaagttggagaggatatgtcatgtgaaatgagtaacttacacccgctttcacacatattgttgcacaaaaattgtatatgctacaggatagctattgtattagctttctagagctaccataacagatcaccacaaacctgatggcttaaaacaacaaaatacattatttcacagttctgggggctagaagtatgaaatcaaggtgttggcagggttggttccttctggaggctctcaggaagaatctgttccatgcctctcccctagcttctggttggttgctgggaatccttggcttgtagctttatcgctccaatctcttcctccattgtcacgtgcgcttcttcccggcgtgtctctactgtgtctctaaacctaaatctcctctttttttcttccaaaggcatcattggatttagggtacacccttatccaatatgacttcatcttaatttgtttatatctgcgaagaccctatttccaaataaagtcacattcacaggtaccggggattaggagttaaaggtgtctttttgggagggaacacagtttaacccactacagccccttgacatatttatttaatgtgtacacatggatgtagagagtggaatgacagaccatggagattcagaaaggtgagggatgggagggcagtgggatgggggtggatgataagaagttacttaatgggtacaatgtatgttatttgagtgttggataccctaaaaaccctgttttgactactatacaatctatgcatgtaacaaaattgcacttgtaccccatcaatttataccaaaaaaaaattttatttaaaactcatctagtaaggagacagattgttgtagtgaaaagatctttgaactcagaatttgaagatctttatataagtactgactactacagatcagctcctcagacttgaagaatcacttagtccccgtaatcctcacttttctcatttgtaaaatagaaatgctagcaccacactaacagggatgagtcaaaaatattcaatgaatgtgctttgtaagcataaaactgttcctatcattatattagtagttatgaaaggatagcagtgtccttttttctttttctcctatattttattttgaaaaatgttggaaaaaataaatagaaatgttggaataatctaacaaatctacattggttcttaaaaccgacattttcgcttttctctttgctctctttttcgtgtgtgtgtgtgtgtgtatatatgtatatatgtatatgtatatacataatcatttggaagcaattttcagactctggagcaattataatggcaatattaaattatttatgtaatgattccaagaagtatttaaaacatggagatttgttcattcatcagctatttattgaggtattactacgtgccagaacattggcttagtggggaaaaaataagtgatatatacactctaatttcaggaacctactattttaataggaagaacagagacattgttttcatatggtgatatatgctgtagtagtagtctgcgcagagcgggatagaaatgttaataagcagcatcactaggtgctaccttggaggaagagcagagttacggaggactttccgaaggaagtcttcgtaagctgtgttttgaaagatgtagtttgctagactagaaaaggtgaaggaacactaggtgccaggatagcctggtcacatttaaattttagtggcaatcatttaaaatagtggatttctgaaattacacgtgcaaagaatcagccagaaaaataaaaacagaagtggaatatgttttaaaggctctggtatcatttctataaataaaatggacatatatagcatttatcacttcgggtgatattctgattgatttagaaagaatgactgcattgcttttcacattaagatgctcctttctaattttatttttaaaatggtgatttaggataaatctaggaacattttcttttattgcagcaaagacatttggctaattgtattatcaaaaccgtttgttttacctttcgcttttaatgtgctttctctaacaattaagggcgaactaaccagcatgaggattgtgtctgcttgattttaaaccatcctttcctgtctgtacacaggaaatcttatcaacaagagatgattctttatgccacagaagagtaaaacctgctgaaaacattcattttgaaagtttttcttatgtgggcatctttgcgatcatcagtaacaggggtggggcatattctgacatttccatttttgaggcaagcggtcttgaagtttttttctttcttggcttgagcttggtggtttatatttcctaaagtttgcatgtcctcagtgttttagtggagtctggaatttgctctccaccctgacctaataaacaatgcaagctgcagcacaacacaacttctctcttagtctgaagtgaagagtatatctctctcctaaggtgagcccttttgcccactcgccagtcatttagccaccacaggaaagagttttcctgctaggttatcacgtttgctctgagactgttaaaatcctgtatgaaatgaggcccatttttgcagaacatggtttttcattcctgtatttccttttcagcaaacaatgaatagcatcagtgagcttttaatcttataagcattgaagtgaagcgcattctttgttcctcagttgaaaatttgcatccctcaaatggatctgaagtactgtttatttaaacgagatttttcttactcttaatttaactaggcatacgaagatcttcagtaccccagaactttcaataatttactactaagggcaggagacaaactgtaatactggctactaaaagaaacgaaaagctagttcagcacacttactagtctctcataaaaagtaaaatatggctggtttccatgctgtccacagacatttcaaacatataacttctttaggctaaaataaatagcaagctcagaaatacagttttaaagtcctaaatgagccagcggttacaatgttttttgataagtaatgaatagtaatttattaagataaaatgtactttcttcaaaatattctgcatgcccactctgttgctgccctaacacattaccacatacttggggcttaaaacaacacaaatttatacttctgagtcaggagctcagaaatctagaatcaaggtgttggcagggctgctttccttcttgcggctctcatctctttgccttttgagcttctagtggctgcctgctttccctgtgcaccctctcatcactccagcctcttgcttccattgtcatacttcctactattcagtgtgatttcctgaacccctctcatcaggcccacctggacaattcaagacactctcttcatcttattatcattaccttaatgacatacgtaaatttccttttgtcatataaggtagcactcacagtttctgaggattaggatgcagacatgtttagggggtcgttattcagcttaacacacccactaaattccaggtattttgtgttatgctaggaaactgaaggtaaaagaaatgagtgagctcagtgcttagttgtctactccttgtactgtcagttatattttcagttattctgtaaatagtcccagaggtgctctctagcattctttcaggccttgacattggatagctagatgaggggtatatttaccaccatagaggaaatactgatttctaggattatattattttgtttatacttctaagagagtacaagcttcaaatcattcattcaacaactatttaagtatctgttctgtgataagcatgtacttggccctgaagatataccagtaagcaagctagaccaggtccctgcctctggggactttatagccaagttatgcttctcaaatccctttgttacgtaaacgttgtccaaccctatgtaaagttttgtacacatgagaactacctaggtctcatgaagatcttttaaaaccctgatttaaaatattttcagatttttgtttttggctttagtttcattcctattattacattttaggtgtcccaacttcaaatttttcatataatataggaaaaataatgattgaaacatttaaatgttcttctttacagatgtttcatttggatccttctttgactcatacaatatttaatccagaagtatttcaaccacagatggcactgccaacaggtaagaaaactcatccctgttaccctgttgttctgctttcagtcttagtaaaatgcaggatttgttaatagtctgtcctagaaactcagttgtgtacctagaaaggaaatggtgatttgttttaaaaaccaatcttttaacatactttcttgaaatatatttgcacaaaaatatttcatctcaattaccccttgtatggtttactgcatttcatatctgctaggactactcagaaggaatttctttagtcaacataaggattttctttattatctctgtattccttttaagtcctttctcccagattcacacgaggcagtctccactcttcatttctgtttcaaacatttaagagggcctgttgtgtactaccagtgtgccagtcactggggaatcaaagtgtacagaaatcataaaaatcatctcattagaaaaatcatctttataaaagcttataactttgcactctgacaagttggataaaactcataatccttccttctaccatgactgtattaattgtgccgattggcaactgtttaatttcgtaagagtaataaaaaaaaaactctctttcttaaaaaaagtgatttatttgtatgtaagcttggtgtgatggctctttttatgttctgtttctctcctcacttcacccgtcaccagtgggacttaacagatgttcaaaagcagtgtgagtgaattatggaagttatgtgtaaaacagagtttggtaatcgctgaaggaggcatcagctcttttatttaccagggacttgcttgtcttcattgggggactttatcccatttgtattattctcatttaaaattatcatggttactacagtacttacttttcttttgttttagatcagaaaactttttctgcatttatatctttagtatttctaggagttcatgggagggaaaaaagtagatctactatactttcaccttcactagtaaaggtgtatttcagaggtttttctgtctttacccctacaaaacattatttttaggctgccatgtctgagatcttgtgaagtgctgtccaatttgagctctaggtcagcttcctgtgaacaagtaaatgtgttggtagtgtgtgtgtttcttgggaactttttaattctggagttcaaagtatttttcttagtattaatgtattactgaaaatataagaacttggttctgtccacaggaaatacacacattttcacttaatgtcttgtgaatacaaaacagtatcctgaggcagacgttttcttaattttattccttcggatttatgggcatgaaaataagattatcaagataaccatctcagtaaatattctgtggtcacagctttatgttgtagaaattattttgccataatattagaaaaactattcaaattacacctaaaaatctaatttgttagttgttgttacaccatcatttttacctgtatgtttttccctcttcattgcagtgtcatagtacaatttttatagtccaagatatataggatgttgtattcaaatttttaaagaggtagagaggttgattatctaaaccaatattaacttgtaactctaaaatggattattttagtcttctagattttttgaaatctaaaacctttagtagatctagtacttgttgaagactatgggatgcgacataactcttaggtctaaagttaaatttctctgcacagtggaatgtccttttcatggcacagaaatgtggccaaaagaatgttggccttaaaacaacaaatacatgcatatcaaatctaattttctagttgatttaactttaatgtgttgcctgaaagaggaaaaatggctctattttacatgaattttcacatatttaaaggaaattaaatcctacaggaaaaataatagcaaatttgcagttgtttttagcagagttaataaaaagtgagagacttgaagtttaatgtaaacatgcttccaactcctctgtatttttcatgacatccaaatattgctctgttagaggactgtcttgatatgttctttcaccattttaacagggaatgtttttataagtgttacattgtcatacaggctgtatcttagtgtgaaaatatttctatttctaatcaattttatttccatatccaaaattaaattctagccatttggtgggggaatttttaaattatgattatgtttctaaaagtaatttaaaatgtccaggggtgaatttcatacagacaaaagatggtaatttaatacattgaccagtgactcccccttttttttcttgtgtatgcttcatttcagatgcattcatttttcaactcgcttccttgtaaatttcttgaataataacaggaagtaattatacccttgttttctccagttctctagccttatcctgatttatcataatattgaaaagataaaaataaattctctggccgggtgaggtggctcacgcctgtaatcccagcactttgggaggccaaggcaggtagatcacgagctcaggagttcaagaccagcctggccaagatggtgaaaccccgtctctactaaaaaaatacaaaaattagctgggcatggtggtaggcgcctgtaattccagctcctctggaggctgaggcagagaattgcttgaacccaggaagcagagattgtggtgagccgagattgtgccatggcactccagcctgggtgacagagtgagactctgtctcaaaaaaaaataaaaaaaattttgagaaaattctcttttgtgttatagtttatttttaatttcaacctgaaggtttatctccttacaaatttatttaaaataagaggtcttgagcttctttctgagagaaaatgaagattaaaatggacatacaagcattctcctaaaatatttttagcaccaaacatcttaatttgcattcaaataaatgagaaccaccatatgcctttatttattgcaaagctatggattattgtactattgacataaaaatcagctgggaagcttaaggactttttcatattgaacagtttgtacttatgttgtcagagattctgattttcctttgaattttcaagtcagataccattagggtatggattaagcctctagttttctttgcgtttttacaataactaatttgcatgtacctatcttcaattaaattattttcagtattttataaaatgcctgagatgttttagaacacagtttatatgatagcacaatattcaaaattgcttataaacatcaaaagttatggattaatatgaaaattttaccatgtctgatagaccagattacattgggagtgtcggggaggaaaggggaaacaaactaaccagttaaggaatgaaggcagtactttcccttcaagtaaagacgggaacagaaaacctagtgtaaggaaaaagagatagcctgagatcattatctgtctatcagacgtatacatacaggttgctagatcagtatcttttaatttcacattaagcacactctctttgaggaaggaaagtcagtgtctaatgatgtgaaggccaaagaaaatgtcatagtgcccagaagtggttgctgcttttaattggtatttgtcattttaaaatgctttgttaggagacaagattatgaaggctgttgacatcaattcttgccggccatatgccttttattgggttaggaaatgtgccatcacctttcaacaaacatttacttattgtggttcgctaaactcgtaaaactattgttaaaataagggttaatttaatatttcagacaaggaagagaaattatatccttgtggaattttaaccaaaaattgatttgaaatttctacataaaaacataatttcagttttttacttgctttacgttttataccaaatttgagaagcctcacagtttcttttggtttctgtttgttgtttttgtttttagcagatggcccataccttcaaatattagagcaacctaaacaggtaagattaaaggggtgggactttaaatgttagattccagtgtctaatattgagatcataagcactgaagaatagtaaatgagttctatgaaggaagtagtttatctgaaagatcaacaacctgacaaattatgtaacagctttattcattcactttacatttctcttactcattgttcacactgtcctgagcctcagtatgtagttctgtaaaactgcagttaattacagtattagaattacagttaattacagtattctgctgtctctaccagcttaacttaccagccactcccaggaaaggcagaggtgatttccattcattttcatttataaggaaatacgtatgcatacagttcacatgcactgagcgatatccatctattatccttgcacatgtagtacctcttagccttcctccttcctttggtagccccagccttttctgtgctgcctttggaacatgtaacctaacatactgaaagtaccagtgggaagtaaaatgttagaatgaactattgaattctcttccctctggtgtcagcctctttggagtcaggagaggaacattttttcaggtgcttccccttaccactagagtctgtagagaatagctcagaactgaaatggcctcctcactgtatccaactctgtggatatttataggaaattggatgggaccaatgctgtgaaagagaaagaaaggcaatctttaatgtctgcctataggaggtttcagttattagggaatggaaataatggtgtagttccccacagaatgaggacagtcagtaaatctttggatggataaactaatcacatttgtgtgtgactgaggatatggatacctgtcctcttgcagctgtattacccaatacattttctaagtattcttttcattagctcaggtgagtgaaacacttttgcattttgtaacatttaacacatgctaactaggtcacaagcttaaataaagcatccactgcgttgtggtttccagaatcgtgacattatatatgtgttatatttggtcagcatttgatataaatgtcttaatgattgctgaacaggctatccttataaggttgaaattagatgaaagtttttgctgtgggggcaagaatgccacatgaaactttggggcatggttctagttcttgcaggtgtcacatcctgactcctcaggttgccagtaacactccattgctctacctccatgttcaactcttttaagcagttatttctcagagaaggtcatcaattcccagtgaaattttatcccttaaagttctgtgggctctggcatcctggaaaatttcccagcttttaagatctaggtagtctatgaaacagaaatcaactgaaatttgtctgcatatgccaaagtattttttccaatatcattttcataagcatagcactacaataagaatttttaaatgtaattccttattatggatccaacagttataaggaaaaattggcatttatgatttacctgaagggttaatgtagttccaaaattcaaaatttaattcatataaaagcttatgtgagtaaaacaatgtgtttaccaaagtgatgctattttgatatctgaattcagtgaaagtaagaaggttgtattcaagtcagactttctgactgaatggatgtagccttgcctttgaggttgatgactcattttaagcaaatggagttactgagatgagtgaatgtggattaaaggcaaaattttgatctcagaaatttagaatcagaaatgcatccagacaatgcatttgacgacatcttcctgaaaacagttgtaaattttcatcctcagattaaaaacttctgaggatttagatactcgtatgtaaccatgaaaaatatctattaagtattgtctatttgacaccactcccaataagatataaacacatacgtgtctatatttttccaactgtcccaaaggaattttgtgattaaagataatgaattgtgtgtgtgtggttttggggttttttttgttttttttttttaagttagaaaaagattcttttttctttgggacctcttagccacagattttccccagctctgacggagatgagtcatagcatagactactaatttttagaacatccagttctgttgcatattaatcagtgttaattaactaatactgttcaaaaactcaagttgtgtttaaattagcagtcaagtaaatctctattcttatggttagctaattctgcaggctattatacatgtgttgtttttttcatggttttagaaatttcatttaattatttaaaaaaccaacagtgtttgcttacaaaaggcatagggctgaaattgtaaattatttttaaatatgaattgtgtgagaaccaaaacaaaggaattacctctgaaacttcatctccaaaggcttcccttgtgtttagatctggaatctcccaaggaattgttttaggtctcactgtgatgagttgatcataaactttagacatttgtgtgcattaaggaaatttcccagaccggggaatttactttatgccttacttatctggtaaatgtgtttgaggactgatctttggaaatcaggaagtttttggataatataggaacagttccagatgcttcccagagatttaaatcagttcaaggcacctggactgctcagagactgcaagaccctacttggcataatgaaatgtagtatagtctaagtagtgcatacgttttacatttgttcatgagctcaaagctgtcaaaatctgcatgtttgctggggttccacaatttaatgagtaagggagtgaacccccaccagcagctagtgggtgtgatgagctgatgggcagatgatctagtgctgtatatgcagagttggtcccacaatagaaacaaaaggtgagaatgttccttaaaaaatcttaacgtattttcttttcaccaaaaagtgaatctgtaaaaagaaaatcatctgcttaagcgactatgtggttataaactactaacactaccacaaattgattgacatcattataaagttgaatcaggaaatacagcgaaacctcccttaatatgatgatgaggtcataattatccttgttttattctttgtatacaaatatgaataagttagctttataaatcataaaaagttagaactggagtagaccttaaagatggtctggtataatcttcccttttgtacaaatgaaaaaatatgacacttcttaggtgtttatcagcccacagtagtttatatagtgaaggcttccagctaacttcattaattaactatatctataaaatttctgggttagatagtatttaagggaactacctagttttggaatcattctggtaggttaatattcaatcttgagcttgaccatattaataatcataaaaacaaaaatcttatcctctgaaatgctgagagaagcttaacagatgcagggtctagcacagggtgtgttctacaacgctgaaacagtatatctaaataaacatgtctgtagtccctgctgaaccagctgtaatcagagtagataaaggaatgtctttaagtaagagtcaaggaagcataacttttattaatatggtacagttcagagcttggcagcagcaatttaagacaaggaagctctgactagaacaagccgtaacatgttaagtctaaagcctaaactcttcagcagattactctccacacatgcatagcatgagaggttccatgggcttaggtacctggctttttagccatatcttagtgtacaaatatcgattaataccatttttcgtagtaagattacgggaaaagtgattcttgtttacagagccctctttcagtttcatgtttttcttctctcatttagtagacataagatttaaaaatttgtatgtacctttgttgccgtaatttttaataagtatttctcaaacttaattggcttaacgttcacctttgcagagaggatttcgtttccgttatgtatgtgaaggcccatcccatggtggactacctggtgcctctagtgaaaagaacaagaagtcttaccctcaggtcaaagtaagtttgtggtagctctccttctatttgaattctggaaattttgatttcctacgatttccaaggaattgctttaaatgagtacgggttgccttcgctcctaagctgaagtgttcacatgattattaaaatttttaaatagaaatttgtctcctagcaatagaagtgacagatactaaaactttgttaacatttcaatttagtagaaatgtcttcagcattagctaacaaacttactatttcttgatcatcttaaatatttttaaaaattggatacttcctgaaactttagtaagtctttgaaagaaatggttgattttgactctttggagatttagtgaaaaaccaaacaagtgactgagtgtatggattatatagtatattatttaagattatgaatttggatccagactttgttattagctgtgtagctttgaataggtttaaccaatacttctaaacttcagtctcttaatgtataaaatacaaaaatattaatagtatatacttcataaggtcctttagagattaaatgagaaaatgtgtacatgttccatagagagcctgaaagtaccctagggccttggcctgagcagatgtgtggccctcttggaatgaactgctacgtgacatgctggtggtgtatttggtcataccttttaccatgttcaggctgtttgtttatttgagaatatttttctttaagttaatatgagacttttaatttcataatatgctatgtttcatagactgactgatgataaacatagactgataatcattttgcagataaacgcagtcaacaattgtaatttagttttttataaaagttattatttagtcagtaattcaaggcttggacaaaatagttctcactatgtgtgtgtgcccctcagggtgtaacatacttttggactcagtctttttattggtttgtttttgtaagtagatgaagctcagtagagcaggccctcagcaaagttgtgatgtaaagaaatctggccgggctcgttgactcatgtctgtaatcccagcactttgggaggccgaggctagcagatcacaaggtcaggagttcgagaccagcctggccaatatggtgaaaccccatctctactaaaaatacaaaaattagctgggtgtggtggtgtacacctgtagtcccagctagtcaggaggctgaggcacaagaatcgcttgaacctgggaagcggaggttgcagtgagccgagactgtgccactggactccatcctggacaacagagcgagactctgtctcaaaaaaaaaaaaaaaaaaaaaagaaagaaatcagtctttggttttgccagccttgcattttgtttcttccttttcctcttatccatcttctaggcccaggcctgttaaatttcttatccttattcccaaacaaaagacaaaatgttgtgacgtcgttctttacctttcaagtgaaactcacccattatttagtatgggtactactagtcatagttgcattttaagtctcttagctccaattgtggaatgaaagatgttttttctattaaaggtaattaggcgggtaaatatgatggcttaagtccacagaagcagaccacggtcttatggcctcacatcctttagaaccttgatgaggaatgaggagcagcaataaagaactaatttgcacttattaaacaccaaagacttgccaagtggtttgtataacattatctcttttaatctcttagaaatctcagtaggtaaaaagtgcaatgcctgtgaacccaaacagactcagagaatggaattataataactggcctttctcacaagactagtggctctatatcctgcagcaggctattgctcaccgaacctctcagatataatgtgtgcatttggggtactgggggcagggagataagggacaaattatgggcagacaatggtgtaaaaaggcatggtgaatgataactcttgaaaacaagggagagagaggctcactggtcaatgggtactcaggtattggggaagccaggcccagcacttacctttttaacacatgtgtctgtgtgtcacatgtataaatattgtgcctttatgtatgtgtatatttgtgagaaggggattgaaagacacatgttatcagcattgacactgactataatgactgaagaattaactttaagcgaaaaactgggagttttttctgactggcttggcacaaaaaatataaattatggtattttgtttacttctattgctctagtattttgtgactaagtaacaattcttgatactaacaaacacatggcattaactttcttataaatttattggctaagaaaaaactttatacatccatttattcccagtcttcatacatctttctcatgtagaggtttcatctactcaaaaacatattgctgcctcagtcacaaaataatttacaaatgaaacaacttagtgggcattagatgttcttgtagaatgaaagtttctatatcaaggagtttagtacttactgggaaatatagatatgtaaacgactaataataaagcaggttcaactacagtcacattatttcaccaaatcatttattttttattcactaattcagtatccatttattaagcatttaatcaacttgtaagaggaggaggaacttagaggttagagaatatgactatacaagctgtcattgttcccttagcttgtcattgttcactgaaaattgaaatggttctgctgttcctaacagttataggaagtaattttatttatccaagaaattcttaattggaaggatgggtaggagagaaagaaagagacaacggccaggtattttttttttccagagctcttctccaaatatcccttttaatagttatttctgctcaggatgacctttaagtttacaaaggaattttaaatccccttttcctctaatgtttaagcagaggaaaaaattgttctccatgcatctttctaatcaggaagacctttaaaattgtgcatgtcttttctgtggtactttactaagcacctgctcggcgagagactgtaagggaaacagtgggatagatacatctaaagtttctcaaacttggcattattgacatttggggcttgaaaattctgtgttgtgggaggctgtctgacacgttataaaatatttagcagcctccctgaccttgactcactagatgctaataggattcctataattgtgacatccaaaaagtctccacattgacaaatgtcccctggggggcaaaatcacccctctttgagaaccactgatgtggatgcaacaaagaatcaaccttaaccttacccatttgcatacttttctactataaagttgtctcgcatagattacgtagaatttccaagtgtattattttataaacgtgcctttcttggttattagtagatatttcttattttcaagatggtgatcatggtgtctgtataatttctgttagaatatcagagttagtgtacctggatactaaggagaaagatagaaaagataaaatatgtatcttcaacattttgtattctgtgatgaccctaaaagctaatgtgggagttctattgactgttataaactattacagaagaaaaagtgaaagtggagagttaggtccactgtgtgtgaacaatgggagggtctatggaatgatgctttcaggtgggcagaggcctcgtggagggtggccccacactcacccccagaatccagaagccattcccacaggaacttcagagggagagcatttacatttacaggaaagaaatgatacttctgagcctacatttgccacatattcattaagtgcatttgttcaggcattacagtaaaatgccatgggctgtgcttttcctcagctacagcctctctccctccaacctcacaccctgtcttcctgtcatgcctttgtgagagcgccaccactctgcggtgcctggagaggaacctggaaacgctgatagttcagtgcatactcggtcatatggagacagcaggaaagagtcaggggccaacttgaaagatttggggcctggctgtggtttgcaggctgtagacaccaaactatactttatagaacatgtgaaaatatagcctgtatgggttactctcttactgattgtctagatttgatgccttacattaaatcattttaaaaccaactctagaagtctactcaaatcctgcattttctagtggaatagtgtcccatgcataaaaccctgtttcgcataggtgtaggctagcttacagaccctcttaccatgttgagattatttctagaactcaggctactgaaccatctggtgctctgcctgtgtctttcacatagctaagaagaaaatttccatttagctttctgatatcttgctgtgcaagtcttcatgctctttttttaaaaaaaattttaattataaattctttcaagcatatagaaagtttaaaaattgacataacagacactatgtactacaacacaaatttaataggtattagcatcttaccttatttgcttttgatagctctctctctctctctctgtcctctctctctctcaaataaaatagttacagctaaaaccccacttatccatcactttgtcctccttccttctcttaggtaagctgctactctgaactttcactccccaagatgtttttatatttttactacataagaatgcatctataaatactggcattttcaagaaagttaatttttactaacttcaacccaaatttgccattgtataggatggctccttttcagggcaaacataggttcaaactggacgccattgaagattaactggtactcactttgatcctattgattcctctttgctgtctagataaaaatgtatttgtcacaatgtagtttgtactaactcttatagcaaaaaataatattcagagaaaaatctaggggaagtaagtatgcagactaactcttatatcttgtcctttcataagaaaaatttcccatcattaaacatttaataatctattatactgcctataaaatttccctttaaagttttttccattctaatttcatcacggagctcctaataggagaggctggcagaaaagcacaggaaccttcctctaggccaagcttgtccctgcctgcttttgactcagcaaggagtgccagggaaggctcacttccctatttttcccgaaagccacgcgtgaagttttaaaaatcaaactgtgttccctttcacagaggtgggtgacaagagaagcagccccatgggacttcagaaactctcaccaatcctcctctagagtgaccagaaagtaccccttcctatcctaactaatgtgacacgtccttctgtgtggtccactctatgcaaaaccagaaattgacaagaatgactttgattgtaaagtacaaatagcttaccagttagtattcttagtttctctttagttataaatatcaaatgcaagggacttgaaacccagctgatagaagtgtaactatttttaatcaaacattttctgaaagctggttctcacatatgttgtctttcctgagtgttttatgttgagtggaagacgtgttgaaatgtttaggtcaacaacagcttttttgttgtccccttccactactgatttaaaaaaaaaaaaaaaaggctccactcttcgtgcctttccttaaaaatcctaaatgttaagtttctgtcgaggtcgaatagagactacccgatctgctgtggcatttgaggatatcacatatccttgcataatctccctttcctttgtatagacttgtctgattcacgtggtttggatctatttggagtactaatttaaaataatttaacctgactcaattacttaaaacaacaggggagaaaatcaccaataatcagctatgtgtgcgtatagaacctagttcatatcatttattaggatttccattgaacccctaagctgttcactgcgcaagtatttaattagggaaaataaccatacccctatgtacattatactgtgtgttttgtaaaccatgagaaaagctgcttattgaacagaagggctttgtaacctggggtctatggatccctgttggtggtttcagacgctttttagattcctaaatttatatgcagacttacacatgtatgtatgtgcattttttcttgggagatgagtataactttttatcatattttcaaagggaaagatttaacatggttaagaatcatgctatagcttgtatcactttagctttttgatagcagctatctttttaaatgatctatgtaatattttttaagattttttctttttttattcttgcatttttaatcaattttaaatgaagtgaaatgctttatgttgctcaacacatagcccagaaagcctcccttcagttttccagtaggtggaaaaaagatgaaactgaattgatggccaaaagagttgaatgggcttcactgctttttctttcttgctcttccatacatttgcagattaagcatgaagctcaccattagtgattgaagccaaaagagagaaggcaattcattgaacaaatattgattgagcactgtgtgtcaggtactgctctagacaagcagacaaaactccctcccatatgtaaccacaattgagacttataggtaatttttgttgcaagtagttcagaagttttgtattttgtcctaaaacaaaatattactttgtaaaatatttttttaaatagccctctaaatccgctgtatatattcaaagtcactattataaagtggagaaagctactcattagagaaaacctatcacacagataatagctgggaagcttaacccttagaaattattaggagagatatacactccttgaatttaagaactgtctgaattttaaattttgttttgtcagttctggcttggtgaccttcctctattggccattcccatttttctgccctccactcttccttgacacatgattatttctgggaccactgttcaatccgaaacaaatctctggtggcttcttttaaacccagtggtctcagtctgaaggtatagtggggcaactctcggcattccattctggagtcttgacctcataaagtcacatattggcaattcgccttgataaggtcaagtgaacacacagaagcactaagatccccacatgtgttccactgcctcctccacagacaagttgtttttcaacccatctgcaggtccagaggtgaagctggaggctaccctgcagtctcagtcttttctccccaccctccagatggattccaaataagaagcctccagactaccttcacctccctggggtctcatggacatgggctggaaagtgcttgcagactttcacagacaatgctttttgcctttaggtccccttctacccaacagaatgattataataatggcttgatgtgcttacttacatcatctcatttaatcatcacagtaatccactgatgcaggttctgtgatccgcattttataaatgaggaaattgaagcctagagaaattaagaagcttaacttgggtctcacaggcttttagagatggagcccaagatttcagttcatgccatatggtttaagggcctgcactcttaaccatcgtggaataccattcattatcataatgttaaggatctgtttctactttgcaggaatcttttaaatctatggttcacaatcatgggtgggcttcagaatcgtccaaaaatgtttcaaccacagagacgcctgggaaccactgcacaattgctaaatcacagtgcatcatctagccaatcttggattctacaataattctatgacagtttctaagaatacatgccattatataatggcaacatattacaacagataattgaatagatattcaatgtataccgtggaatagaatattatgccactgtgttttaaaaagataattaagaggatacggcacaacgtggaaaactgcttataacataatattaaggataaacctcagctgggcatagtggctcacgcctataatcccaacacttttgggaggccaaggcaggaggattgcttgagcccaggattttgaggccagcatgggcaacatagtgagaccctgtctctataaaaaaaattttttaaagaaaaaaaacaggatttcaaattattgctaatatttgtagtgattacaaatattagcttctttttataaagcctgggtggaagcatatagatgtatctttagctttatttattcatccatgacttaaagaagattggttaacacctgactccaccttgagtagcagaacattggactgaaggaaaaaaaaaaatgtgaagctgtcttacttagctacagtttccagcatgttttctcaggagctctatgggagacagtgcagtgtggctctcaaaccttactacccataaaaatctgcttcaaaacctacttaaaatatcgattttattccatttccaaagcctggtagagtaggtaattctcccactacaatacacttagtaacactagaaaaaaaatataacattttctttaatgcatagctgagtttattagaaagtatgaaaactactggggcgccgtaagacaaaagaaaactttgggaaaacacaataggatatgggtggactttggggccacagctgccctggaaatatttgctgacctagataatcaagaagcttggtttttaacagcttcctagagacaaaagataaggccttgggcctttccaatctgaggaattgaaactgcaatcacccacttaattcaggactctctcagggctatagtttctgttgatgggtgatcctcaggcagagaggtgatgaggaagttgcctgtctcagcctagggggaatcagaagataaaatgcctctcttgagaatcaataactacaagcccaattcttacagattcagagttaagtgtatgctccctgaatagagtaggaaaccccaagtctagaaatgaatatgaagttgttccacattggggataccctcagagccttgcagaaaagcataaaaatgtatgtggctcaaagaatcatgagctcctgatcaaaaattagaaaatatgtatgcaaataagccactctgtttaagaactggcagaacaatgaaaagcagaattaaatcctcagaatcttcagataattgaattaccaattgtttgatatataaatacaaaataagtttggaatagaaaacagaccaggcagaatgaaaataaaaccaagtcgaatttttaaaattaaatgtgcgacactgaaaatgattcaacatagttaacatggataatttgaaagaaaggatgagctggcaggtacaaaagaaggagtaagaggtgtctagttgaagtcctagaaagaagtattacaactgcagatttctggctctacatttacagtttctaggtctggggtgaggtttaggtggttgtggaccacacttttaggttttaaagcattggctctgaagtcatttggttcagggctgggcatgatgttggttcctagttttgcgacttgcagtgttacttaacttggctaagcatcagcttccttatctatgaaactgaaaaaataatacctatgtcataggatatatgtgtaaatcaagttattcagtacatgccacacagtaagcacttaaaaatgacagttgcttctatttttatataaccaaatacactactacaaatattgagtggcagctttgctggttcatttatggattcatggagctacacaaaaccttcaccagtctattaatttatttttagtacagtctctctaatcagtattgcttccactgtatattgaccccatatcctttcttctgtctggggttaagataggagactgagatcagctgtgtcaaaagctttcttttagatgtaacacatgatttcttatgaaaatctcataggtaggataccagaaaggaatttattaaattcttgttaggctccttagttgtattagttttgtagggcagtgttttaatttaggatacttatgatagagagcaccccttccataatcaggagaaacacaagatggaaataaagattttattacttagtggtcctggggagcacacagcactccagggaaggccacacaccaagatcagggagcatgtggagaaagagagagaaaggaactcacgggccattgcctttactgggtccaggacattatccaaacaggtttcccacagggagttttaataggtgggtttcaagcaagcaggtatgagttccaggaggtcacagtgtgatgaagaagaagtcactgtggcatatctgcacagtccatgcgaggtgtgagcatcagtgaagaccagtcaggtaggctatatgtagctggcccatggggaggcgatcaccaggtggcaattgtataatgcagatatctagattggccacatagaggaaccgggaggaggtgtagtactggaaactgcgtcgacggtcactgagccctgctttaggtatgagaaagtccagcttatattcagaatggatgcaaaggcagcataaaattaaaagcattcactgccagctgccataacaagttaccacaaactaggtggtttaaagcaaccgaaatttattctttcacagttctggatgctagaagtccaatatcatggtcttcgcagggccgtgccccctttgaaggctctaggcaataatccttccttgcctgtttctagcttcttgtggttgctgacaattcatggcagtttgtgacttgcagctgcatcattccaatttctgtctccatcttcacatgaatactgtcttctctctgtgtccctgtgtccaaatctccctcttctttctcttagagacctgtcattgtgtttacggcatccataaccctatgtgacctcatcttaactaatcataattgcaacgaccccatttccagataatacaatattctgaggctctgggtagatgtgaattctgggggtacaccattcagcccactacaaacatattgtggcattgaggttataagccagtagccctacaagtataggatgatgcccatttcagcctgataatacactccgaaagagatcacatggtaacattgttgcctcagttaatcatagaaatactcaattagtatagaaataacaagaaaaatgctttgttattctcatgtgtcatttatcgagttcttactatgtatctgttattgttatccttatacacttctgcacaaaagatggttttatcccaagttttagcttagaaactgaggcttaatgagtaacttgaccaagaatggcttctctttctccatttccttcctctcatggtgttgttttatatacataaaataatatatattattctattaatatagattaatatatgtatttatatatgtacattttatatatgtataaaacttatgttgtaagttttatatacatataatatatattctgtttatatattgaatttatatatatataaaacttaacactattaagtcttaacactattaagtttcatggtgttgagttatatagttctattaattatatatatatggggggaggggtgtttctccagcctagacttccactttgaaatgtagtctccaggctcagccacttgtttgacattgccacttggatgtctggtagacttaacatattcacaactgaatttcaaatcttccccaccaatctgctctgcctcatagcttcccctttccggaatgtggttgctccatccttccagttgtacaggccccaaatcttggagttttccttgactcctctcttcttctcaaatcccacatgtaatccatcaggtagtcttattggctgtgccttcacacttttttcagaaactaattattcttcagcacctccaatgctgccaccctggtataagctaccatcctcagcatctttcttccagtggattttagcatccatgaatgattatttcctaaatcaattatcaataattgttataaatttgtgatttttctatttctatccttcctgtcacttttcctggtttttttaaaagagctttcttcattcttctttaaaaaaaattaaaattaacatcagtatgaactcgtggattcttttgttattcattgtactataagccattcctgtcattattcattttgattcttaaattgtcctattcttggccagtgggagtctttcatgctagctcctatgtctttttgatatgtccctatcttttttttcctaacactttccttatttctgaaattataagctattctaggttcaccctataccttcactaccccagtccaggcatcgtctgtctctctaagaagtcctagttccttttagcaggagaagtttttctagactctttcattaggcagagctacaaaattgattattttaaaaatctcgagttcatacactaattcataattctaattccaatccaacactgcaggcttcttccctccctcccctcatcccatacttgtatttggatttgagatatgaaatgtgtatctcatatcccatatttcttcagtaactgaaaaccctcatcatcaatgatagcagcatgcttactcattttgctcagtccaataattcacacacatttgtagaaaaatagaatagttttagaatggctataccaatatctgcaagcttactatattcggttcaaaatttctttgtagttcttttgaccaaatgtattcaacagagagcattcagtcagagtaatgtgtacaaaagttacttggattaaattttttccttctgtgtatttatgtttccattgagctatagagttaagctatttttttatttctattccattttaggggttttcccatccctgttgatttagtaattttattttttgaatatcaacatttgtcagtttcacatctttcatttatatgagattaactagaccctttagaaatcattataaagtcaggttgttctattaatttttaaaataggtgtataaaaaccaaagggatcaatcagagccttgatttaaagtacgttctgaattatttcagacacccgaatccatctaaacccagaacatttcatttgtagatttcaaagacttcttggccttcctaccttccttacatttatgtagcatgtgtttatccaaggcacaccacctgccaggcacagtgctgggctctgtgttgacacacatgaatgtgatcatctttctgtagcccccaggttacatggcaccacagccaagatacagacatgtgtgagagagtaatcagggtattactcaggatttgctggaggaatccctcttcaaaggatattctaaattggtgtgtgtgtgtgtgtgtgcgcgcgcgcgcgcgcgcatgtgtgtgtgtgtgtgtgttgaggtggactgggagaaaatataccctccttgagatcacctcctggctagatagtctctcccttctctgtttgtgatagaatgcaagtggaatttgacaggtgtacttctcaaactagaaactagagagctgctatctcagtcaccgtaagaagaacgaatcacaccaaacctacatcattgtcttctatgacaggatttctacaagggtgagatagtgagatgctggagatccctgttttggtagttcagggattcacagcatctcccatgctggtgatgtcaacctgaagagatatttctagtgataggttccagggatctttcaccgaacactttaatatattttatcattgtcctgaatacagccctataaggttcttactaaatttgcaggtgacatgaagtgatagacaacaaacaatttgaattcaaattaattttgaaagctgagacaatggacccaattcttcagcaattatatttaaaagatataaatacatgcagaaaacaaattacaagtacagagtggaagagagatgatttagcagcaacgcatgcaaagagatctaggagttttagttaataacagactcaacatgaaccagcaatgcaatgtgactacgaaacaagtaattcctcattaggctgcattaatggaaacacgatacataagaccaaggaagtggtggtctcatttgcactctgtgatgaaaggccacaccaggaatacagtgtagtactgctgggcaccacatttgtagagaaatagaaaccaacttgagtgtcttcagagcagaatggtgagagaactcaaacttcattcaaatgaggagtagttactgagcctgagaaatttatagcctggaggatttggttgtcttcaaatatatgaatggctgtgatggggaaaaaaggattaaatgtgtcctgttgtcacaagaggatgaaataaggagcggtgaatggaagccccaggcgatagaggtttcagttgctgctgacagtcagggctgtctgaggatggaatgtattgcctcaggacaaagtgagttcattgtcactgaattggttcaaaaatgaccaggaagactacagggcagggaagctaacttgtattacaataagtaatttttttcttttttatttgtatgcccttagaaagatgtttacttaacttgataaatctgtaacaagggataatcaagatttggttataggacaattacaattttctgacagatcccccaaaataatagaaattaatagcttacacactactttatccaagctgtagaatgtataacttacttcatatactttgtgtttagtcagtttatacaggctgaacaacataaagttaagacataaaagggttttttttgcaggtttaaagtactaccatttttccaaattactggctgatcctagaactttgagaaactttggtgtttccccccttcctacttttgtttacatcatagtacgtagatggtacaatattttggttaacctcagtctgacacttagattgtgttctcttttgccctattaatgtctagagtgtaaaaagaccagtaaagtagcaccaagaaatcaaagaaaatttcccagttctactcacttgtaattctcttaatttagtaggggctttccacaggaaatcacaatagaatagttgaaatgctctttatcttatgtactttccttctgaagaaagggacagttaattggctttgttcccaacatggtccaaatttttatacagggcagctgtatttactgtagtacaaaggagattctacaccgaatgatgtctctaagtattttcaataattaagaacctaattgcttctctagccagtgggtttcagtgaaagtgataaaatagattttctaagcaagaaaaatacataatgagggtggttgtatacctttaagaaaaaagaaatcagtgatattcaatcccaagtaaatttggatatcacagagtcagagatattcttaattattttaaattaaatttgagtcaaaaacaatgtgtttaaagactttaaaatcattttaaaagaatgttagaaatttacattaataatttctattttcaatgaataaatgagaaacctagaatttttgttttggacacactttgatcatatctaatgtgttctacttcctctaattatttttatgttattaggatttttaaaaaacctcttagattaaaatttctcagtgtatctttgtttgcgtgtctttttttctctctccacttatgtaattgaagcatttctgacatatcctcagaacacacagattcttatcaggacttaactacccagggcagggccctccttggatttactgaaaataaacactttgggtactcagtctcagttttaatgacaaaagttgaaatctttgcctaacatgaaggtttttctttgtctctaaattttgattttccatgctatcagaggtcccattgcaacaggtaatttgagtgttgattgtatgttttctcagtttgtaattgtggtgaaatgtatttaaaatgttcacaattttaaagttaagtttacctataaggttctttccaactcagaaattctgtgatggtaaactttttttttgtagtttgaaaatgtgatctttggatgttgtcttctgtgtcctatgcatatgactaggaatcatagaattttagagctggaaaatgagtgagacattatctagtgattctgcaaatgaagaattaaaaggcccaaagaggttaggtgactcacgcagtatcatagcagtacctggtgactagaactctggccacctactgcagcactaaaaattaacccaaatgtttttatctgaaaatttgcagacttcaggctaggcctgtaaataaataaataagaagttaaaacatatttgagaaaggtaagcttaatatgccacatttgggaaaagatgtgcctgacacaaatgtatttggtgtaatagagaacattcttccattataccgaaatgaaaattttgaacattctcaaaattcttgaattttgagacatttatgttaagcacagtttattcagactctctataaactgtgctgtcatccctgttgttttctccaagcggaatcatacttaaattacaactttagggagtttaatgtttcctatttttgcactcctgggatatttttcagtgactcagaagcataaactgacactgtgaagttaaggctgtgttccagtgggaatgacagcatgtctctaggacgctgatggagaaagccctcctcatgcagctgtcttgcggagtctccctgctggtggtgaatgtgagatcacacagggccagcagccagggcagtacatctctgagtctcgcttctggttttacctagagccaacccttggtgattgtttgcctccttggccaagcccccacacaataggaaaactgtgtctcaaggtcgaattctattaatacctgagaggtgaatttataaacatttaagatgttttagcatctctgcagccagtgtctctgtaaatgaaaattgcttctcgaagtagaaaagcataagggagtacaagggcttcaaaaaaaaatccttttaggaataagaatattgccagggttaggtgttcctaactggtttcaagcagaggagttagtaaaattccaaaagttaatcagcttcatgtactcaacttttgctaggactttgcagaaactcctcagggatccctcagagttagattagggagatgaaccctgccaaaggacagtaaccattcaacagctggatagcctgttgggccccactgtcctcagcctttcctaatgttgcctgggaacaccacttttctgctccctcctttttcagtgtagcctggagacaattatttatttattcactagctcttttaacaaatattgattaagtaggtactggttctgttctaggggttggaaaaacagagaaaattaaatagtgcctttgtcctcaggaaacaatccatttaatagagagacgaagatatgcccttaaatacctgaatcaccagcataaccagcacctgcggctgccatgtgggaattgttgaacaagataatttttgaatgaaagagtaaatgacctaattgctctaatgtaaagataaatttctaagagtcggctagttgggatgattatagaaggattcaagggagagatgtatgaaagcatagatctaacgagagaaaacagcacagcagaaaaagcagcaaaggctcaaaagtagaaatctctgagatcgaatggagaatagtaaataatttgctggaatgaagagcacgtggaaggcaagggtggtaagaaggctggagatagtagataaggccaaatcatgcaaggatttaaactgtatgtttttagaaaatgggtaagctatagaaattttatataggaatgagaaattatcagcagcattgtgctttaggactacaaatctggtagcaatctgctaactgatattggaagggaaaggcccagagacactagttggaagaattgcagtgattcttcatgagctaaactaagagttcaagctaagatagataaactaaggaatgagaatggaagaaagggacaaactgagatttttggggtggtactcagctgaagtttggcaactggttaaacataaaagacaagagacagagaggaatccaagatgaaaagacgattttgctgcacttttttagaaggcagcatttgtatttccatttccaggaggtggagtagctttgagaagaaaggtgattagttcagttttgggcacattgagctgtaacggtattatggacaggaagataccctacaaacagctggaaattttgcacatgcttaaaaagaagatgagaacatgagatttcaatttagccatcatctgcatggagtagacaattcaatccaggagacttgataagaatgtcaagggagtgatcacgataaaggtgagaaatggactgagcatcgatctctgctgaaacatctctttgagcaggaagaagagtgccttagcaaaagcagccagtgaaatggggagttgggggagactttcaaggagggaatggtaacatatcccattcccaaagaggtcaagtagggttgaggaataataaatggctagtgggtttggaaacatggaatctgtcatgacctttacacactttttcatttgatggatcgggggattacttacatttgcaaagggcctcagattaagtggtaatggttcagcattagtaattagagattttcttatgtactttgtagggagaaatagaatggcattcaaacaggtttaagttcctcttaagaacctttctcattggattgtagagaagagcaaatgaaagaatcgttcagtatttcttggtatcatgcccagcccataggtttcaattaatgttaacctttacagttgtcatcatcattatccagaaggggcttttttttagaataaggaagaaaagcagtgctcatctgtagacaagggaaaaaatcctttggaagagagaaagagaagggtaattcaagaagatcaggaataaacattaagggtaaaaacagaatggttagccctggaaaagggaacaaacatgtttctctgaattaggagaggatatgtgaagtaacagggatgttttgagcctcagtaacagtaaggagaagagagagtgaaggaacttgcacgcagtgacttctaccttctcattaaagtcaagagagaatctcaactgcagatatctgcttaaggtaggaagagagaaataagaattgctgtcatttattttgtggttttgatatagcaaaaactgtactagacactttacctcctttaatcctcagaaaacttagagattatatatttgtattcacattctacaaatgagaaagcaagtaaaaaagttaagtaactctcccagagtcccccagatggtcatgggagcccagattcagagccagctatgtcttactccaaagcctgtgctctttattgaaacatactccactagtttgagatcttggaggtgtacccctgcactactatcaggactacccctgataaagtcctgtggggtagttgttcctatccatcaccacagtgaatatcaaagaagggccctctcatttgaggaataacagacagtgaaattgagatggaccagaaatgcaaatcctggatccctgagggaaacaacaaaatgaagcatagaggaaatatctgagtctggtgccaagactcatcagtacaagagagaatgcctaatgggcaatagcagttagggtgggaaaagagaagtacaagggggtgtcttggaatttgagggaagaactgctgccttagttttcgaaggatgattattcgagagttgccctcccttcactttctcacagctggcagaattcctacctcttagtggttagattcctttttaccagatactgtagggccagtgcagcaaccagagcccccagccagaaaccctgcctccaatttagaccagtgttctgctctggtgtgtaataatcatattctaatttaaatagcctattgagatgctacattgatatctagccttttttttttttttttttacttttaagttttatgtgcaggatgtgcaggtttgttacataggtagacgtgtcatgggggtttgttgtactgattatttcatcactcaggtattaagcctaatatctgttagttctttttcctggtcctgtctgtcctcccaccctccaccctttgataggccccagtgtgtgttgtttccctctatgtggcaatgtgttctcatcatttagctcccacttataagtgagaatatgcagtatctgtaataatgggttttctgttctcgtgttagtttgctaaggataatgacctccagctccatccatgtccctgcaaaggacatgatcttgttctttttcatttctgcatagtattcaattggccattttttaaaagacaaaataacaaaaaaaagagtacagttatctccactcctcacccactacctgccacctaacccaaccctttatattttagtaattgccttccataaataacattttatcctgtcttaattatgcattcattagtgtattaattattgaatgcccacaatatgacaagcattatttcaagcactgaggatacagcagagaataaatcaatatcctcactgtttttattccatttttttaagagacagggtctcaccctgttgcccaggctggagtgcagtggtgcgatcatagcccaatgccaccttgaacttctgggctcaaaggacactcctacctcagtctcccaagtagccggaactacaggtgcacactaccacacccagcttccccactctgagcctccatcctaatggagaagagaggcagtaatcaaaatacatgaaatgtgtagttattagatggttattaatgtatagagaaaaattaagcagagaaaggagcaagggattagggggtcaaagttttggtaggggtagagtggtcagtgaaggccaccttgagagatggcaattatgtaaagcctgaaagcaggtaagaaatatacaggtatacagatgtccctggaaagagtgttctaggcagaagaaatagaaagtgcaaaagctaagattgctcacctggcaagttcaagaacagtgagaaactgatgtggctgcataggagtaagaagaaaaaggacggagaggacatgagatggtcagatagcctagggccttgtaagccattataacgattttgtcttttaatatagagaaatattaaaggtttttgttttaactttttaacatagaaaaatgtaatcgtatacaaacacagaatagtataatgagcccccttgcactaatcactcagctttaacagctttcactttgggaggattttgagtgaaggagtgataagacatggcatggcatgacatggcttgaacaggatcactcaggaaaataagccatggggagacaggacaagcagaggaaacacaggagcaaaagcttaggagacagatgatggtggctggaaaccaagggagtagcagtgaaggtggtgagaagtgatcagatagaggatatttttttgaagatttgaattaatattatatatattatactttaaagaagaatttgaaaatgcatgtagtgtagtaaagatggtaagaaatacagaaaagaggccaggcacagtggctcatgccagtaatcctagcactttaggaggcttaggtgggaagctcccttgaggccatgagttcaaggccagcccgggcaacatagtgagactctgtctatatggaaaaaaaaattaaccaggtgtggtggcatgcacctgtagtcctagctacctaggaggctgaggcaggaagattgcctgagccaggaggttgagtcttcagtgagccatgatcataccactgtactccagcctgaatggcagagcaagaccctgtccctttaaaaaaaaaaaaaaagaaagaaagaaaaagaaatataagaaatggcactagaatatcagtattatatacattattttctgtttaaaaatccacacaactggcaaaaaaaagtgacatacatgaacatttataagacagtgcatttataaattacaaactctctgctcctcccatattattttgcagtgatgaatgattaggccatccaaacgtaaagatttatttgtaatttgctaatgatggaatgacaccttttgaggtacaagttcccagcaattcttggaattagcaatagtgtgttacttctttctcgaaagaagcatgatttgtaagcagctatatctgatgtagtaaaactgaaagttaaaataaaaaaggaaaccgtgggtcaaagtatgagggaaaagataaaactttcagagcaaagttatacatagagattttattcatcgtctctgtgtaactcacgagaacttcttagcttatttattatgtcaaatggcagtttgctcttctaatcccagcctgatatcatgagccatatatgctgttggtcattcaaaaagggcactaaacaaggtgaaagaatgtcagtgaatcaatgcaactccatgagtactaccaggaaaagaaaaacaaaaaaacatgccattaatagtgggtcaaagaggatttttttcatgccatcccctaccttactgagaataccacatttatattcagaagactcataatgaattccagagtcctctgtgtcttggctgtatgactttgggttatgtcactttgttaatctgtttgaacttctgttttcttatctacaaaataggggtaatagagtcaactctgcctccctcacagggactttcggaggcccaagggtctttacaaataatagagaaggaaagaaactggcactttaatagtacctaccatgtaccagggactgcgtagtccccacggcagccctctgaagtcatgtgattggcccattgtgtagatgtagagcttaagactcagagaggttatttaatctgtgtaaggccacagagctaggagggggaaaagctgggattggatcactgactagatcaacttgaaatctcctgcctgacagagaaagaagagactaactttactaagcatctttttatgccagaaactgtgttggacataattctgtactatcttatttggtaaaggtcattctgtccttcctggttgccctggttgctcaacaagtaataaacaataaagcctgactgtttttcatccctgagagaagaaatattattaaaatagcgttattctctttctttctttccttttttttttttttgtgtgtgtgtgtgtgtgcgcctgataatctgacttgcaacctcacagaaaagaatgaatgcatggtttcatgtctgtggcatgactctgtgaaggagccttgcaaggggacagatacacctctaccacttcttatagccattcctgagacctctcttctcacaacacataccagcaaagccaaacaaacaaggtgtttaggaataactgtcatctatcaacactctctaggcaaagtagaactatgaaacactgaggagactgcacacacacagaagaaaaaatgatcatgtcacatggtagcacagagcaatgggaaatgtgaatagtttgttgaggtggacagacccaagctcaaggattgcctgatcgctccatttataggaaccatggcaacctaccttatcttactgagcctcagttcctccagctgtgaaatggggtacaacctctgaccccacagggctgttgtggggattatctgagttagcatgttccataaaacacagtaagttagaaagtatagctgtataggctctgggagtttaacaagcaagagaaatttgacagtaatcatttagttactgaaccctgtcttcatattgcgctaggttgcatatggttttcctgcctgtcccttccaatcacatttcagaaaaaggaggcagtagtggagccttgtgggctaaagtggtgaggagggtgtcatggaagattcaggttcaggtcttcctcttgaagaatgggtgcttctcaatagggaagtggaggaacaacctgggagttgtcagcttgaagaaaatcctgagacgtgataatgggtaggtccaaggaggtcctgagtaggactctgagcacagagcctttctttgcatgtgctgtttttcctgccagcaagaccctctaaaccctttggcctcacccacccccttgcctggttatactcctagccttctttcagatctccaccctcagtactccctcaggaagctttccctgacctcctgacccagtcaagtgcttcttatatatctcctttgtaagctcttctcagttacacttttacatttatttgtgagattatttgattagtgtcagtcccactctttaattctccacaagaacagagattgtgtctgttctgcattcaccatgcatcgcttcatcccctagtttactgcagtgtgtggaacataggacgggctttaaatactcgctgaataaatagagaaatgttggttattagtgaggtattacctaggtgggagagaggatttatatttgggattgctaatcccattaagtgccaagcactgcattaactcatttaatcctaaaaaaaagtcctatgaaatcaagtgtattattccttttaactttaaagacagagaaactgaaatccagagatgttaaccatctttccccgttgacacagctaagtggtaacagtcggtcttgagccgggcagcctggcttcagacttcctagactttaccacattgttctgctgcttagtgcagtagaggacaaagtgaggtgcacacgtgaagtcaggacagatttccgtttgaaaattgtgtattttcccctcctcttcttcattaccattgtcatcatcatcatcatcaatcacttcacaagcaaagctaagcagaaaagaactacttcatgtatcacctcttacattcatgttaactctacattctgccaaagtgatttggctgaatttacccaaagagcaaagtggacatttcaaatcctgattcctagaaaattatagactacatcctgtaaccacctttgaagaaccagcatgtactttaccccaacgtgacaaaattgttttaaataaaaagaggtaatttgactaagattggtatgatctgagacccatggtttctacatcttattcaaaaagcagatccagcatgtggtcatcagtaggtattgagtcataaagctcctggaagaaaatcttaagtttcatcaagaatgccaagaagtcctgggtgtctccaagaatgatagctgttactataataacataattactactggaaaattagcaaagcccaataaaatatggcatgcaaaaaaatatttaccctggaaatagaagtgacctaaatcagtcgtttattccagccacctgcttttagatagtacttaaaaaaaaaactctcaggatggtcatattgtttaaagttctctaggtggaagagtactttacagtaataaattaataaataagacaagttaatgcttttaaactactattatttgttgagcattgttgtaaaggctttacatgcattaatgtatttagtcctcacaacaaccctttgagatactattatcatcatctcccttttacagatggggaaactgagcagtgcccaaagtcacacaaccaggaaatggggaactatcttcaagcccagctggtttgcgcctaaagtccatgctcttacagtgtccctgggtagctgagtactcagttttgtcacctttgtctccttgactttaactgaaagcttaactctttttttttttttttttttttaaacggagtcttgctctgtcacccaggctggaggggcagtgtcttgatcttggctcactgcaacctccacctcctgggttcaagtgattctcctgccgcctgccgaatagctgggattacaggtgcacaccaccatgcccggctaatattttgtatttttagtaaagacagggcttcaccatgttggccaggctggtctcaaactcctgacctcaggtgatctacccgtctcggcctcccaaagtgctgggattacaggcatgagccaccacgcccggcccgaaagcttaactcttaataagagcctgcaatgttcagacgctttgaaaaaaacctaacagacacagttgctctctataaacttaattttcaaaggaaccactattcaaagaagtaaaagggagactgaataaaaagaactaagttctccgtagagcaaatgaatttctgaatcgattgcaaacagttctccgtcatcatgacatcctatgaagtatggtctcccccatgttagagtgccagtgtcttcatgtaccatataacttgcaaatagtatcactgtcttctcacacttcagctttcttctttcatcagtattttggaaagtccacaaaacccagggggctccctgtctgttgccctgtggtctctgtgaaaaccagatgatgcgatgctgacttggactctttcaaatggatccaacagcacatgagtcactggcagcatgttcagctcctttacctcaggaattacccagttcctcattcttgccacccttcagccgtgaagtagtaatatgaaaaatacatgagtactttttgaggatacctcggacctctttccttcagtaccagagactaattgcctcataatggtaacattgaagagcccagttatctgacgtgattgggctttaattatggattccttctggtgtcctattaaattggaaagcctagctgatttcacccaaatgaagcattacctcatgccttgctctcttgcattcctgtgctggtgtcacttaaaagtgtaattacatggtttatttcgtgttctttcactcttgatttattgctgaagaagcccctgtgggatatatcatcataacaaagactgatttcagatgtcaacaccaagaaacacaactggcatcagcaatctatagagagtatctagggacagcagtcagctttggagaaaacccagaacttctcattccccatcccacatttaagggcaaagactttctccttgttaaagggaaagcactgagttcataattagctttatacccagagttttttttttttaaatgttatacctgtttaagaaattttttgtgctttgaggtggtcaagatcaaatttaattagcaaccctcttcgtgattggcttgctctggggaccctgctctttgagaaggaggttagaaggtttagaagcaaacctttgcagcagttctagccaagtgcatgcatacaggccttgaggtggagctgcacagttgactgtaggggagtctgtcctttgttgacgagtgaaacttctctccctgcaaaccctctggggaataatgccaactctgatcagcttttcgactcttggatgaaatattgggttgggaaaaagtccctactaagaaaattgtaccaaaaccctgcttcaataaaatatgaatccatttaatgaagtttatagtagaagtaggctagtcgaaaaggattctgtctctttccaagtattattggcaggtttagggtcttcctcaagtttatatcattaggacttccatcaaagagttatctttaggtgtgattcccatcctccctccctctctccctccctccctccgtcccatcgttccttcctccctttcctccttccttttctacctttctttttctctctgtctctctttctttcaagctgtgggctgcttgtacagatttatgcattttgaattactgcatagttgagagatttggggcttaggttattcagttcttcaaaaagtacagtatgagctaaggagatagggtgaccaactaatctaggttttggctccaaaaaccctgtgtcccagaaaacccctcagtcctaggcaaaccaggatagtagttcatcttgtgaggagattatagtgcatttccaagtatttagctgaatttatcacagggctctgacttgataggatttaagagggttaaaataaggtcttttctgttatgttagtgtgactttagtcttggcactttctcaaggaaggaatccagtctactacaggggctaggtgactaaggagaagaaagaggatatctaagtgttttttgctaaaaatgtcattatctccatgctatttcctttttattgctattgtcatcattttaaagacataccaataagaaataaattactttaaatagaaaactctaattttatcaagcaacagcaaacaggggtgaaatctaaggatttgtacttaaggagtacacttttttgaattgaagaaacttactatgacctgagcatatgtaactcaattatcagaagtcagagagggctactgaaggctcaggttttctaagagatgactggaggccaagtcctcaggcttgagtgtttatagccaaacttcagaaccaggtccctggcaagattctcctgtctaatcacatggcacagagttaggatggactgtttctgcttacctgccttcttcctttgatttccatcaaccaccagtttctttctcatcaatcatttacccagcttttgtgaccaagaattttgatgaggatgcagaggaaggcatgttcttggttaataggaaaggaggcttcatgacaacacagcatcctctaagatgtgttgctccaactttcacaatacatattgtgttttaagtggcctgcttcttggagtgtatcttcccactacacaaaacaaccaccattaacattttcatttacttccaccctgtcatttgttcatcacatacttttaaaaacagggctgtaatcatgtatatacatatatgaataactttatattgtactttttatacttactggcttatcataaacatgtttccatgttgctggagagtcagatatgctaacttttggaatgtgcttcttatatagatctgcaactatgtgggaccagcaaaggttattgttcagttggtcacaaatggaaaaaatatccacctgcatgcccacagcctggtgggaaaacactgtgaggatgggatctgcactgtaactgctggacccaaggacatggtggtcgggtaagtaggggtatatgatgctgtggaaggtaggaacagatagaatatgggatgcaggaacttagaatgaacaggcccctttcattagggacctttctgagaccctcagatgacctcaaaaaactgtgtaaacttgtgctttcatttggactccaggaagtaaggtgaccacatgtctggatttgcttgagacagcccagtttgcccctgacctaattgtttatagcaccctcttctactcttaaaggtggcccaatttggatgatcacttatatgtggtcacttgacctacaaggtatttgtgccactattaattttttttctcctagaaataaaaataaggacaaatttaaagaaacataactatagcagaaatcatcactttatgtatatttttacattcttgatgatttcttcagtggatttatggtgtgaatatgtagggctttaagtgaatgcataaatatcatttcagctctctgctgcttagaaagtaatgcacagataagaagccaaggaatgcaaatttattttggcattcattaggcttgaaatgtaaataaaaaatgacgtattcatttaagggttgatcaaataaaacaagcaatttttaatgaatgaagttttatagaagtaatttcaatccaaaagaattaagcttttaaataagacatatttattgtgctaaaaaacatgtattttcatcttcctaatacactaaaatggcacacagaataatagtgtagcacacaatacaaactgatatgtgcaatcaataattctaaaaattgttgttttaagtctttctttggaagtccttaaatgcaaaagaagaaatttttaattttgtttaatttttaaaaacatttttcagggttttctaatcctggtttaaatagtttatgctgaaatcccagttaatctggcttattcactcaaaagaaaggaattgtttaaatcaactataattaagctgatggttgcatttcaggctttgaattccgatcaagtttcaaattggttattattttggaggttgtgctttcatgttcctaggtatttctttgtttgactgtgaaaatatttaagtgtgaaaaacctagagagagagctttcttttaagtcactaaaatcggattcttttgatgttagaaaaaaaaaagactctagattgaaggaagaagcttaaattgatttgaaaaattaaagtgtgctttatatgaacttgtttcaacatcctcttgaaagactggcgtgtctcctgttgtatgtcacagtttgttcatcatgtgttgtggaatacccttccagttcctgattgacctaggagagctttgaaatgcaggctaattatcacagttttagactgattgatcacttagtgtttctgcagatttattccagtagggttctgtcagtttgaagtgtttattttctttggtcttgtttaatccctattataatcatatcctttagaggaaattttagatgaagttttctactagtatttattattataaaacctccagtatggtgtctataatttggtgtttctgtggtttgctttagtaatctttcaggattttagaaagaactaatggttatttaaatttgagaccttaaagcgggaatagaagtaaattgtttctaaggaaagtgagggattctttcactcttgtagtgcagtggggtgtgggctcagtagttgggagaactcatcagtcattcactcattcaacaaacattttgagcatctcagctcctgaatttgatcattatgatgtctggttgtagagcagtgagattttctaaccctatataatttcagtgagaaatttaatcaagatgccacttgagagttacaatagactcagtagtcttaacgtttttagtgtttcctatgaaaagtcagtactcactttctaatttgatttttagctgagaaatttttgcttacaatgtttcccaaaatacactatttctttcataattcatttgtttctatctctctctatatatacatttttaagattttcaatgtcaaaacttattgcatttatgtagaaagaacatcgtgctagcattctggaaaccagtattttattcccagtactgttgctctcaacagaggactgggggcaagttacatgacttcttggggaccttaatgtcttccctcataaaatgagagagtttcactacagaatcttatcttcaggctgtttacatctccagaattctggactgaactaacattacgtaatattatgaaataacatgagcaaacttgccacacacatatttatggtatgacattgattattagtatttagttctgacttgtagataagagtatcacatagagaaacttaggaagatagccaaaattatgtcttagacttgtcaatactagaaatgaagctaagataacttgttttcaataatacagattaggcaaagagtatagattcacaagcaagacactaatccaacataccaaaaaagatatccaaaaaatggcaatgagaagacaaataacttttaaattgtcaaaaccaaaagaattactttctttggagtgtttatcttcatctttccctcagtatgaattcttaataaacttagtttctactttcaaaaggattttatctatgttataaatattcatgttttaaatagccaagtcttgattctggtttgattgctgtaatgtaggggatttgtcattttaatattttttaagttagctttaattttgtcttttttaaaattcatttatataattagcctttactgcctttcttggtaaaaaataataataataatcttagtttggtgttttattttaaaccctgaatatcaacaatttgtttcaacatattttagttcgttgacatttttattccatggaaaatatctgtgttccttgactttgctttaggccagttcacttaccagtaatcaccacactctctctgctttctggcagtttagagacatggaatttttttccaattaatacatatagcatataccaactggtaagcactaggagtagatatataaatatcaaaatacagaggagaaacaaggccttcttcagtgtctgttgttcccctttttgtccatgagttctcatcatttagctcccacttacaagtgagaacatgcagtatttgtttttctgttcctgcattagtttgctaaggacagtggcctctagctccatccatgttcctgcaaaacatatgatcttattcttttttatggctgcatagtattccatggtatatatgtaccacattttctttatttatttatgttattgatagggaatttaggttgattccatgtctttgctattgtggatactgccgcagtgaacattaacatgcatgtgtctttatggtagaatgatttatattcctttggttgtgtacccaacagtgggattgctgggtcaaatggtagttctatttttagctctttgaaaaatcaccacactgctacaaaatcaatgtgcaaaaatcacaagcattcctatacaccaataacagacaaacagagagccaaatcatgagtgaactcccattcacaattgcttcaaagagaataaaatacctaggaatccaacttacaggggatgtgaaggacctcttcaaggagaactacaaacccctgcttaatgaaataaaagaggacacaaactaatggaagaacattccatgctcatggataggaagaatcaatatcgtgaaaatggccatactgcccaaggtaatttatagattcaatgccatccccatcaagctaccaatgactttcttcacagaattggaaaaaactactttcaagttcatatggaaccaaaaaagagcctgcattgccaagacaatcctaagccaaaagaacaaagctggaggcgtcacactacctgacttcaaactatactacaaggctacagtaaccaaaacagcatggtactggtaccaaaacagagatatagaccaatggaacagaacagagccctcagaaataataccgtacatctacaactatctgatctttgacaaacctgacaaaaacaagagatggggaaaggattcctatttaataaatggtgctgggaaaactggctagccatatgtagaaagctgaaactggatcccttccttacaccttatacaaaaattaattcaagatggattaaagacttaaatgttatatctaaaaccataaaaaccctagaagaagacctaggcaataccattcagcacatgggcatgggcaaagacttcatgactaaaacaccaaaagcaatggcaaccaaagccaaaattgacaaatgggatctaattaaactaaagagcttctccacagcaaaagaaactaccatcagagtgaacaggcaacctacagaatgggagaaaatttttacaatgtatccatctgacaaagggctaatatccagaatctataaagaacttaaataaatttacaagaaaaaatcaaacaaccccatcaaaaagtgggcaaaggatatgaacagacacttctcaaaagaagacatttatgcagccaaaagacacatgaaaaaatgctctcattatcactggccatcagagaaatgccaatcaaaaccacaatgagataccatctcacaccagttagaatggcaatcattaaaaagtcgaaacaacaggtgctggagaggttgtggagaaataggaacacttttacactgttggtgggactgtaaactagttcagccattgtggaagacagtgtggcgattcctcaaggatctagaactagaaatgccatttgacccagccatcccattactgggtatatacccaaaggtttataaatcatgctgctataaagacacatgcacacttatgtttattgcagcattattcacaatagcaaagacttggaaccaacccaaatgtccatcagtgataaactggattaagaaaatgtggcatatatacatcatggaatactatgcagccataagaaaggatgagctcatgtcctttgtagggacgtgggtgaagctggaaaccatcattctgagcaaactatcgcaaggacagaaaaccaaacactgcatgttctcactcataggtggaaattgaacaatgagaacacttggacacagggtggggaatatcacacccctgggcctgtggtggggtggggggagggatagcattaggagatatacctaatgtaaatgctgagttactgggtgcagcacaccaacatggcacgtgtatacatatgtaacaaacctgcacattgtgcacatgtaccctagaacttaaagtataataaaaaataagcaagtttacaagggcaaaaataaaacaaaaaagaaaaagcaccacactgcttccacagtggctgaactaatttgcactcccaccagcagtatataagtgtaccctcttctccacagccgtgccagcatctgttatcttttgactttttaataaaagccattctgacaggtgtgagatcatatctcattgtgttttaatttgcgtttctctagtgagctttttccatatgtttgttggtggcatgtgtgtcttctcttgaaaagtatctaaaacagtcacttatcttttaaagaaactttttaaatcagaaaaaaggtgtttatatttaaccacgtatttatcatttgcagtgctgttcattctgtttcttaggtcaaaatttctatctggtatcattttcttctgcctcaggcacttccttttattatactgctgatctgatgctgattaattctttcagtaggtgtatgttttcatagctttttattttatctttgtttttcaaagatattttgaagagtatagaattttaggtagacaggccgggcgcagtggctcacgcctgaaatcccagcactttggaaggtcgaggcgggcaggtcacctgaggtcaggagttcaagaccaacctgaccaacatggagaaaccccgtctctactaaaaatacaaaattagccaggcatggtggtgcatgcctgtaatcccagctactcgagaggccgaggcaggagaatcacttgaacctgggaggcagaggttgcggtgagccgagatcgcacaattgcactccggcctgcgcaacaagaaagaaactccgtctcaaaaaaaaagaattataggttgacagtattattctttcacatccttaaactatgttgttccactgtcttctgatttgccttgtttccaagaagtcacctgtcaatctaatctttgttcctctgtatataatttttttttctctctagcagcttttcagattttctcttcctcactcgttttaagcaatttgattatatggatattagcatagtttccttcatgttgcttgtgcttggggttcatcgagatccttagatctctgggtttatatatttagtacgttttaaaactttttggccattattttttcaaatatattttctgtccactcctcttcatcttcttctggaaccccagttgcacatatatttggctatgtgaaatttcctacagctcactgatgacctgttttttaaaaaatcttttttttctctttcattttggaaagttttattactgtgtctgcacgttcaccaatatttttgtctgtagtgtctaatatgttcttaattccatctagtgtattttttcctcttagacattgtaatttgcaatttctatagatttgtttggggtctttttttttcatatctgccatgttactccttaacataccaatgctttcttctttttctgatcatatggaatatataatagctattcaatgtacttgtgtacaaattctgtcttctggatctatttttgtttagtttttgtcctaattatgaattatatttttctatttctttccatgcctgttagttttttattggatgacaggtattttgaattttgtatcgttaagtcttggattcctttttttttttttttttttttgatgtgcttttaaatacgtttgaggattgggatgaagttaaatttgggaacagtttgatttttttgattctttctaaacttacttttaagctttatcagagagaccagagaaacctttactctagggttaatttgacatcattgctaaggcagtacctttctgaattttcaacctgatgctccatgtattacaagatttcttgaactattccagccccatatgtgttacaataatttttctgcctccacctctgtggtggttcttttcccagctttgacatatttcctcacacacagcactcagctgaagactccagtgatctctgagtgtatctctgtttgcggtttcttcctttccggtactctgcttgtgagttttagcctccttggcttcctccaatatttaactgtgtctcctcaacctcagagattgccaggctctgttggggttcctccttcctgtgctgcagcctgggactctttaggcattaagccagagtaattacagggttcaccttatttatttcccttttcttaaagattactgttctgtgctgcctgttttctagtgtctaaaaaccatttcttcatgtattttagatatttaaggttcaaaccagtctgttttactctatcgttacctgaagcagaagactgacttctgtactgtttcatttgttaaccagagtaaatccttcattattcacataataaattaataaggatgatgtttttctcacagggactagattaggcaatatacatgaaaagcatattattgacagtaaagtgtaagatgctacacagatgtttatcattgctattacaaaggagataaccccgttttcctgcagttagggaagttctatatgggagtaaggctgaaagggccaaaagatataggtattgtttctgaaaaactgcctatgcttctatgcatataagtatgtcatgttgcatatttttctgtgctgtattaattcatgcattcctttatcaacagatacttattaaacactcatatgtcaggcattgttctagggactagagatctctgccttcaaggagcttattttctagtggtatattttctgttctgtgtcttagctatccacttttttcatctgcctggacacgtgacttattctgtctctgggcctctggtatgagtgctcatttcattctgccttataactcctattttcttccctactttatctgaccttcctaccttagcttgttcattctttccttcaatccagttgtcatgaaatctctttctttcctctactaattttttttttctttctttctttctgagtaaaagccagagatctggccccctgcttacctctctgaattctttacttacttctgacaacttgctcatttcactccagctacattgacctccttgcctttgttgtgttttgaaaacaccggcgtggtcctaccgcaggaattttgtacttactgttccttttgccacattcatcattcatatgttcatgtcttccccatcgcttccttcaagtttttgctcagttgtcatctttttactgagtgtccttcctgacctctccctactttaaaatgttatgcttttttctactacctctcctgttcctcattcctaccttatttttctggataacacttattgccttctaaattgtatcgtataatttacttctttgtttcttctccgttgtcacactagcatataaattcagtgaaggtagagattcttttactgctgacaaaagcatctaggacatttcctggcactgataaggatctgcataaatatttgttgagtgaatgaatctccttggtaaagtccttttttgtttgcctgttatatttattgaatagacttctttgtttcatgtactttaatttcaaaagtgaatggctggaacattttatatattttcttataaatcattttcattgctttttaagcttatcacatattttgttttataaatatgtagccttcgtgagataaaagattctccatccctgtttacgtgtatacttagatgacaactctaatggtcataaataattccaaccttatagataactcaggagaagatgagattataagtagactttaaatcccattcagaaacccaaggacaattcaaaaggaaaataatcattccaaatataatattcttcttattcttaagaagttgttagtattttgaattttgaatttttaatacagctcccatagaaaatactttaaaatgaacccggtaagacttcctcattaagacatatagacacatatgctcccactcccgtaatcaaatttggaagtcaaataagctctgaaaaccaaaacattcttccaagtttattgcagactcatttggtagtaaaaaccaatctgacctgatgtgtagctgtttatagtctttatttttccatttggtgagtccaattatatatttcgctgaggaaatactaacatgtttgactacattgtgtgccccagacctgcttagagtattatgtaatatgcagtataggccatatattgcctttttaacatcaaaaataccctaaattctgaaatgcatgtagccccaagagatttgtataaagcattgagggcctgtgtatttttttttaatttacaagtgaagccagattccctagacattaagtgcctaacttttggttgttgttgctgctgctgttactgttttttctccagcttcgcaaacctgggtatacttcatgtgacaaagaaaaaagtatttgaaacactggaagcacgaatgacagaggcgtgtataaggggctataatcctggactcttggtgcaccctgaccttgcctatttgcaagcagaaggtggaggggaccggcagctgggaggtaagcatcattttcctggccttgatcctccaaggggtccaggctttggttttcatctgtatgaattatatgttcatctgcatcccttccagtctctaccccacactgctgtcaccttttccttgctcagaaacctttgatggcatcctgctacttctaggataaaaactatagctccatagcctgtcatacaaagccctgcttctctggccccagcaactttcagcctcatctccagcccaccttgcatcctcctctcgccatctctgctctctgaataactgaggcatatttatacctttgtatgtgtcttcctttaccaaaaacaccccaccgtttccatttcaccctctcgaaaaccaatgcagaaatcaagactttgtctaaagaacacctctgttttaccttccccaactcaccttattataaggcatttttctttctttgggctctgcagacacattataaactattatctttatcataaaaattgtatgattttccattttcttgccttttctcaaatttttttttcaaccccattccctgtcccaccacatgccccatttctacttttgtattttgtcctttactctggccgtccagtcgtcatctgatactcatgtgattcaaaaccgattatcagttttccactaaatatactccatcttctgatacccagactcaaaaccttcccatcctcactgactccccctcctcgcctgtgctgcgaggctgtggtccagccattccgtgctctctggcattccacactacattccattttcattgttccacttatagtagtcttctccctggtctctgtccctccccacttctaatcaagtttacatcttgtagccagatagatattactgaagttctgtatcttgttgctgctccgtgtctccgttttgcctacaaaatccaaattctgtaagttggctttttggatctcccaagagctggcctcaggctgcatttccaatctatttcccgttttgccccttcaggtcaaagtctactacttggtaggagcaccatgatttctcactttcctgccttggcacattctttctatttttgctctctcctcttcctggaatgcctttatccactctcttatatgaatgtgttcaaattctgccaccttttcaatattcagagcaaatacctcttctgctccaaagccctctgaactctctccttctttgaaatcccacatcacttcatttgtagctctcttgtagtacttgtctcttgaatcactaccttttatgatattatagcttaattatgactatatccatcagcgtgaaaactccagcaggagggaaggaaacagatgtccctgagtcattcagttccttcagaagttgtttttgagtacctactatgtgccaggctgtctgcttggcactgtggaatgagctcactccctgtgcccaagcagctcttggaataatttgcacacttctcaatacagctggtgcctagtagggttattcaattccattccatcacatcctgtgtgcctttaactcttactgtagagaggaaagggaaaggtgggggaaggacaggagaggagggaggcgatctgatacacggaagagagtttttactgtaatccggagaaaatgcaggtcttctttgatgcctttcatattggatgacataaatgagactgtttttaacactttattagcaatatgaagagtttcaaaagaggaaaaatgggtttttattgtaagtttacattatttgggctttataaaagcatggtcttttaaatgttcacacttccctgggcatgaatggactgtgctgtatggccctagatcgggaaaaagagctaatccgccaagcagctctgcagcagaccaaggagatggacctcagcgtggtgcggctcatgtttacagcttttcttccggatagcactggcagcttcacaaggcgcctggaacccgtggtatcagacgccatctatgacagtagtgagtacttcacttccaacagggggcacaccaagaatagacttccagccctgccctgccatttacttgctagctgagtcctggggaaggtaacttaatcactttaagcctcagctttatcatctgtaaaatgtgaataggaaaatctagcttgaaaggttgatgtccaggttaaatgaggtattttaagaggggctcaatacatgtaattctttttcctttgatgtacattttttagtcttttacatgaaatgtcacatctcatcttatttatgaatgtcttgctataaagatatatggttgatacttttagaagggagaataatcccaattttctttggtggtggggggactctggaaaggagtttataaaagacaactattattcttacccattttctttcccatatgttactagctttatcaagagagaaacttgaagttaaatgaatgagtagcatagacagcatgtgacttcaaaatcctatttcaagccgggtttggcgtcatgccctgtagtctcacctacttgggaggctgaggtgggaggatatggagtttcagcccagcatgagcaacataatgagaccctatctcaaaaaaaaaaaaaaatatatatatatatgtatatatatattaatttatagttcctaggactttttaagagttttacagtaaccttcagcatttaccatgcaactttcttgtttgattatgcataggattgattagacaggtattttcaaaaagcctgcaagcatagtactcagactcattgaaagtttatagaatttggcctgtgtggaaaactctgtgctccaagtacaacaactaactgaattctctaatttaaacaagtttgaagggaagtgaaaggttataaaatgatacagactcataccgcagaatcaccttaaaatgcagctgttggagaaaaaaaaaaaggaagctttatgctattaccacaagaaagttttgcctcttcaccacacagaatcctaatttagtttgggaaaaagaaacataacatccccattttccttacctgtaaaataaaaggtagtaagtagtttaagaaaactgtacttttcctaaagtttttaggactcttgtaaatagaataatagcagaatcatggaaacaaatttggaattgaagtcttgacctcattgaaagcccagaaatcaattagcttggtacttcccaatacatcagaaaagctctttctctttttgtgtcagtctctctgtgttagagggagaaacaaatacctgttcctttctacctcatttgttttggtgatcataaatgacccatgcccaagaagtgttccgagaatttcagaagccattcttgttttatttactttgttagtgaaagcatgtatttaagctttgttttggtcatgtgtgctaaggggagggtcctacctaaaggactggcttgttgagctgaggattaatcatgttatttgttgtttttcccctgtgaacagaagcccccaatgcatccaacttgaaaattgtaagaatggacaggacagctggatgtgtgactggaggggaggaaatttatcttctttgtgacaaagttcagaaaggtaaatacattctgtgatctctgatctcaagaggtgtgatcttgacacactacagttctgagtgtgtctgtgagtcacatttcagcagtggacaagaaacatccctctgctgccacagaaagtcttaaaaagcatttacgttttacctcttccaaatgtaaattgtctgtgttattttttcctaagtcaactaaatcacttttagatttcccatggaagtaaaaagaaataagaaaaccgtgataattataatcagtgactttcagtatctttatacattaaaattaatatctgtactttgttaaacaaaaataaataatagcccattcttgacacacatacaaacacacacacagaataatgttttacatagtattaaattgtttttatttcttttgcaatgctttgatataacactgagagaacttctctgaacacttccacagatgtgatgtttaagaaaaggaaagaaaacagggaatacagggaaattctcagagcacatttctctcacaattttccctttgaggaaaggttcttggcgtttatctttcattagatatattacaacattgatagattagtaaaagctgaggaaaatgtgttattttctcaaactgcattctttttttaaataaaatgatagttggaaagtgtagtataatatctatttactacagggtgagcattttcaaagtaagcagatacctaactgaaaatataaataagtaaaataaatcaataaaagacatgtggcttttaaaaaaattatcatatgagattaaattctctgaggtatatagtcagaaaaaaatgggatcagattttaaagtaaacacatatatactttatccaaaaaaatttacaggccaggcatggtaactcatgcctgtaatcccagcactttgggaggctgaggtgggaggattgcttgaacccaggagtttgaggctgtagtgagctattatcatgctgctgtactccagcctagatgacagagcgagaccctgtctcaaaaaaaagaagtttacactttctctgcctacactagtgtcagccttcttccaatccactctgtccaagtaatactcatttccagattcctgggtgtacatactgtgagtaaacacaatctgagtacctttatttgtaaatgagatccttagtcattatcattacattggaatggcttagtaagaaatgtcttgtacttggcttaaagaatctcaataactaggtccagtgtagtcctacctgaaggcaaaggagattgtaagatgttttatccattcctagtatttctaaaattctacttacatagagataaaaactttgaacaaagtcaatagtgtggccctttctatgaaacggaaagtgaagccaggaagatgccaacctaagttacattgtcacatttctgtagaagtgaatagagtatttataaacatgctgaacatggagtatttataaacacactccatgactagagtgtgcaatttaagcattgcattttaattagaagggacctgattattatagtattttgaccaattactcaatatgaactaagagactattatagtgagacagtttaatagtgtgttaagagcctggactctgaaattatactgtctatgttaaaatcctggttcctccaagtactagctgttcagccttggataagtacttaacctctttggaccccagtttctcttttgcaaagtgaggataataatagtacccatctacatcacaaggttgtggtgaggatgaaatcagttaatatgtgtatatatgaagcacttagaatagcatctgccatacattaatagtaaaacttatataagttaattatttttatgtacatctatatattgaattgcactgcctcgttggattctaatattcttccaccatcgttcgtgtttctcaggattggcttaaggatggagaagcagtaaggtcaaagattaaaagaaaattcaagttaactaggtaaatctagtattctgtcattgtgaatgaaagttggggcgcattactgtggtaaataatgaaaaaagtcagtgatttgtgaagattttaaaagactgaaccttttgatcttgttttttaaaagtgtaaatagatagtaggtagaatattaaaccagttttatttttcagcatgtttataaatactatttacactatgtgaaattacacacttcaatgtgattgtttgcagatgacatccagattcgattttatgaagaggaagaaaatggtggagtctgggaaggatttggagatttttcccccacagatgttcatagacaagtaagtgatttattattattattaatccttattatttttagagatgggatctcactctgacacccaggctgcagtgcagtggtacaatcacagctcactgtatcccccaactgttgggcttgagggatcctcctgtctcaacctaccaaatatctgggactacaggcatgctaccatgcccagctagtttcttcagttttattttttttgtagagatgatgtcttgccatcttgctcaggctcgtcttgaactcctggacttaagcgattatcccacattggcctcccaaaatgctgggattataggcatgatccatattactatcatcattttatactttctgccttattgaaatttagtacttagcttccatctataaaaaagaaaaatcataaatatttaacttccataaaacagtactatttttaagactcatgcaggtcatccaaaaaagttacctactgtagagttatgggcaaggttctgttagatcgtttgctctgagatgttggcaagatatttaattgctgcctaatcccctaacccataagacagtgccccacaggtcctttaatgaaaatgtttttaagtgttctaccaaagtaattatgatgagacctattttatgatagcacctaattatgataacaccttaaaagggtgttctaggagtcatcttctaattgaagctgatgtcatcctgttaaatgaagatttcccaatggcaactgattaaatgatcagtttaatcatttaataacatgataatgctgagcccccaccttaattattattctcctatttacaagtaattgaagagtattctcctatttacaagtaattatctggattggaaacaatccagatattcatcagtaagtggccagttaaattatggtctgtccttttgatgaaatatcatgtagttattcaaaagaatgagtactctgcgaactaatatagaaagatctcagttatacagtgttaaaatattttaaaagatgggtgtagaacaaagtgtgtgtagaaatgattctatgttcatgcataaagaaattctggaaggatacctaagaaattaataacagtatttaccactggctggtacactgtaggaactgcatggatggggaacaagaatgtcaaagagaataccactgtatgcttttttatattttataagatctttatccctgtgaatatattacatagtcaaaaaatcaaactgaaaaatgcttaaatccctaacataccaccaagaactaatgtgttatgatgccaatgtaagcaatgtttagtttcttctcttcatcactggcctgtagccatctctctctttccatacccagtctttctgatgttgctctaaataatcttggaggcttttaaggctgctttggaagagaagaaagtatatgcagtgaattttataagcatgatatttacaactagaagacatttgaaatagacaaatgaaataataaagcttcgtagtacattagcatagcattgtattttgattttacagtagcaatttcataaaaatgtatcggtatagaattctgagtttggaactttctccaggacacggtgttttttagtacactgtgtctaaacattgggtataaagaaaagcataaggaatgtgtttaatgagtagcattactgcaaaaaaaaaaaaaatgtagtcctacaccaacatgtggttcttcgtatcctgcagtttgccattgtcttcaaaactccaaagtataaagatattaatattacaaaaccagcctctgtgtttgtccagcttcggaggaaatctgacttggaaactagtgaaccaaaacctttcctctactatcctgaaatcaaaggtaagtcagttgtttaaaatcttatgctcatattttattttattttatttttggtttttgttttgttttgttttgttttgagacagagtctgactctgttgcccaggctggagtgcaatggtgcaatcatagctcactgcaacttcgaactcctggcctcaaacagttctcctgccccagcatctcaaatagctgggactacaggtgtgcgccaccatgccgggctaatttttttttttttttacttttaatagaaatgaggacttcctacattgtccaggctggccttaaactcctggccttaagcagtcctccggccttggcctcccaaagtgctgggattacaggcttgagctgccatgtcttgccattgtgcttgttctgagaagaggacaagctaattagaaaagatcagttagtcacctcctttgaacagctttctagtaacaggtccctggatccatggtgcttatttttagaagagacagtagtatattattttgaggtcatggaattagtctagctttttaaaataatgttatttccaccaagcttatatgagatttagacattgagaatttgtctttgaatttgagaatctaacatttattgactaactcagagttcaagcagctgagatgaaaaaatcaggcttgctgtttaggagaatcagccagttagtcaaccagcctcaggcggtggaacagaaaacttggccaacatgcactgtgaaactatgaaaatgagtaaggcatcattctttctctcacaaaagatgctttaagaaagggcactcataggtttcttaaatagttataatgtaaattatgattttaataagtaccgaaagtgaagcatccataaaaatataagagaatgttgaagagagagcccttggtccctttattctaaagcagcctccaaaaagaaggcttcgtcaaggagatatcatttggccctcagcatttggggtatatttcagcagttgggtgttaaacagagaaggagagggttctctaggtttaagttacttgaggagcttaaagagagaggtaaacacagcgtttatgcagagggaaaaaagtgttctgagcgctcggatggacatgaaggccaatgtgggtaaggaaggccagggccaggctaaagagggctgtgaatggcagcttaagaattttgcattaattctggagagggatagccgggcctgcctaggtttggaatgatggctctgacttctttatgtcaccactgagggtaccatttaggaggcagatgatgagtcagaagagtaatgcaagaatccaagtgagaaacagtgcagttagtaaaggtcctagtgccaggaatgaaaggagatggtggacttaagagagagtgcagtgatactgtgatacagtgatactgtcaagagggcctagaggtcggaggtgtaggagagacggggagtcatagatgggtctaagactccctgaccaggaagcttgtgatgtggttgacttgatgaaaggaacaagggagcaaaagtagatttgggtgggaaaagaaggagctcagagtaaaacatgttatattttaggtccctgtgggaaaatcaagtgtaagttcttagtaggcagatcaaaaggcagaactggaactcaagagaggacagggtgagaaatttagcattagaatcatctcaaaacgagatataacaggcaccaactgagtcatcattcaaaggtatttcttaacctagagtccactgacccccaaagagtctgtggatagaaatgtactttgatatcatcagcttcttttataatcctgttttgtattttacatactgaaaaccatgattctgagaagagatccatagagttcaccagactgcagaaggggctgtggcacaaacaaaattagaaacccctcagttggagggaagtgagactgggaagggaggtcagtaaaatgattgccacggggcacccagatccttgctgaggttggaaaccgcaaaggtgcagcagcaacaagccacatgggtgggtgttgtctcctgtgagagcaagatgtgataggtaatctttgaagagggctttcctttcctagaattcgtgctgccacaggagtgtttagaaaacggttctacaagttcttgtttcttttctgaggttgtggcctctccattgtttggtcagatttgtagtgcactctatatcctggtggtttgaaaacattgtcagcacaataacttttctttcttcacatgagatttcatacaaaatcccagtgtatggacatggtaggctttgattaaaataggggtgaagggccctgccagctcggccttccgagaggctgtcccacctctccttacttccctatcaggagctgctggaggtcttttgaatgcttctgcctacacaaaatgatgtgaaaatcactgctttaatttaaacacccttctttaaaagtagacacagaagaaaaatatggataatttttttagactttctgaggaaaaaaatagatttcttctccagaaatatgtcttcaaataatgccagtttttgctaacacagagaatcatgaagaaagaaaacccaggttacctgtatgtgtatgaacctagaaacattcaaagctcagcttggtatctaggctgcctgtctccctttcccagtggtatctatgcctcagaaaagtatgttatagtgggggtatattcaggtgattactttaatgcctcgttatcatagtaggaactatccaatgcagggattagagaatggggtcacctgaaagttcaaaattgcacctgtatgcttcatgcacctaccttccaggctgtcattgatgaaaagcttcatacaatacaaagtttaagaactgtctggagaaatacttacccattgagctctgaaggaaagaatggacaacatatatatatatgaggacaacaaattacttgattctatagaaaccttctggattataaaaactcaagataataggaccaaggagaaataatctgaccaggcaatataactggtcagaaaagtagtaggccatttagcattagagtaagtagatagaaatggatccaaactgtacaacccagggaaacattgcatacatttctcagaagtcattgaacacacttttccttacccccagtctctgtagtcattccctatctcattgcctaattttatgttcttcattatttttatcaatatgtaaacctgtcttatctatttatttatgggtctattgtcttcctaccaccccgagtacaaagaatcttctttaggtcatagactatctagaacagtataagttgcatagaaaatgctcattaaatatctgtggactgacttattgattgaccagccaagctgccatccatcctcatctataaggctagtaatatgttgggtatcatcaggtaagacattatacataaatataaagcatcatacagaaccagcccggagctttgcatcctctatggtcatcaacattgtacttcacaaaaaattattggagatggttgggtccaggggagacgatcgaaataatcaagagaaggatgattggcagaggaggaagatagttgaggaactgctgtacaaaagcaaaaaaaaataaaaaaaaaataaaagagaccataatgatttttcagtctgaaagatggagattagggataaataatctttaaattatgaaaggtatggccaagataaatgcagtcacctttactggtaaactaaaacctgaaaagtgagaatgaggtacttttaaggcacatgcacagaaataggtagcaaacactaggagattatccatatttgtgaattgaactattatctaaagtcatcaactgttatgtaaagtcattgattattaaagtcactggttattattatacaaagctattttggagtgttttcaaaagaatgacagcctaacataatgaaaacatcactgcactttgagactgatcttgactccattgtgacctcagataagtcacctaacccctcctagcttcagtttcctctcctgcaaaaggagaacttgtagtaagtggctgctttggttccttctaaaataggttgatgtttcatagtacatcccatggtgccattgtcaaaagcagaccgcaaggataaatgatcccttgaatatggagtgtgaaagtctccatattcaattctgtggagattcaaacagcaggttcttttataaagcttatgtggaatgttctgtatcagtttcttgtcattggaatcttactagctgtgttataattaatattttgcccttaaaattcccattttacagtgaaatacagccaataaatatctctctgctttaaaaggtaaaatgaatacatagaaaatactaactagtctctttgctggaatccatgtcaatagataacatttatttctgaagataaataagttgcctgcttccctcttgtgtttcatatgtctgcagtgaacagtaatgagtatagctgtaaattagttatgatataaccgatggggaaattataaatctgaatctaaaacatatttgataagtaagtcaaagtttctccacttaaaggtcatccccttctagtggaagcatatttttctcaaaatttggcaaccttggttttttttttttcctgggaagtctggagatgctcagcttttaaacaactattaaagtgtactttgttaccctgctttcccctgcttcatctttcaactgcagttagatgatcatgagataatcagtaaacagagaccttctatctagccctaagatgactgaaacaaccacagaattagaaataatcgaagttctttctgaacataagcatgacaaaactgacattgaagaatcagaaatagaataattgttaagggttcagcactaatcaaaaaaaagaatacctcattgactgtatttaatttgaaaaaacgaaataaaacctccttaactgctccagcccaaaaaaagagaagaaaggtatatgatagaaaaagaagagaaagaaaaggaaacagaaaggagaaacaagaacacagtaacaccacataggcagtaacggaactcaaaagggcattggggctggtgagaagcacagatagcgagaaacagaaagatgaaaacaaaacaaaaagaaaagcaatcagaagtctcagagggcatcactgtattgtagtcaaatagtggtcttagacttttagccccagtatctcatcagtcaccagaggttacagatcccttggttactgtttttctggcatccaccccatttttattatcctggtgaccactaaggaatgggcctccatcacttatgtccgcattgtctctgcctctcactttaactctttagtatgtcccacacacacgtaaaagatgaacttcctaaaataccatcccctacacattatttccctgttcaaaaacattcagcagctttcttgcctgtaagttcattctccgggtgctccgcagtgttgtcccaaacagttccatttctcaggaattccttatacagtcatagcttgtttctttatattttgcaaatactgtgatttttacaaattgaaggtttgtggcaatagtgtcaagaaagtctattggtgccatttttcccacagcatgtactcactttatgtctctgtgtcacattttggtaattctctcaatactcgaaacttttccatgattattatatccattatggtgatctgtgaacagtgatctttgatgttttgggggtaccacaagaagtgtccatgtaagatgacaaacttaatcgataaatgttctgtgtgttctgactgctctactgactggcaattcctccatctctctccctctcctcaggcttccctattccctatcacacaaccatatggaaattaggccaattaataaccttacagtggcctccaagtgttcaagtgaaaggaaaagtcacacctctcacttgaaatcaaaagccaaaaatgattaagcttagtgaggaaggcatgtcaaaagctgagataagcccaaagctaggcctcttgtgccagttagccaaggttttagtggtctgagtagaagattaaaccagccacaacattcccttttaccaaagcctaatccagagaaaggccttaactctcttcaattctatgatggcttagagaggtgaggaggctgcagaaaaaaagttggaagctagcagaggttggttcatgaggtttaaaaaagaagccatctcgataacgtaaaagtgcaaggtgaagcaacaaatgctaacagagaagctgcagcaagttatccaggagatctagttcagaaaattgatgaaggtggccacaccaaacagattttcagtgtacaagaaacaaccttccattggaagaagatgccatctaggactttcataactagagagaagatgtagaaatgcctggcttcaaagcttttaaaaacaggctgactctcaggaggttgaggtgggaggatcacttgaacacagaaggtcgaggctgcagtgagctataattgcaccactgcactccagcctgggcaacagagtgagaccctggctcaaaaaaaaaaaaaaaaaaggcagactttctcattaggagttaatgcagctggtgactttaaattgaagccagtgctcatttatcattctgaaaatcctagagctcttaagaattatgccaaatcttctctgcctttgctctgtaaatggaacaagaaaacctggatgacagcacatctgtctacagcatggtttactgaatatttttaaacccactgttgagacctactgctctgagaaaaaagaaaaaaaaaggattcctttcaaaatggtagtgctcattgacaatacacctagtcacccaagagctctgaaggagatcttttcatggctactaacagccattctgcagcccatggatcaaaaagtaattttgactttcagtcttattgtttaagaaatacattctgtaaggctgtagctgccgtagatagtgattactctgatgaatctgggcaaagtaaattgaaaaccctgtggaaaggatttaccattaaccacatttgtgattcatggaaggaggtcaaaatatctacattaataagaatttggaagaaattgattccagccctcgtgggtgacattgaggggttcaaggcttcagtgaaggaagtaacagcagatgtggtggaaatagcaagagaatgagagtgagaagtagagcctgaagatgagactgaactgctgctcatgatttaactttcatggttgaggaattgcttcttatggatgagcaaagaaagtagtttcttgagatagaatctactcctggagaagatgctgtgaacattcttgaaatgacaataatttagaatattccataaacttagtaaagcagcagcagtgtttgagagaattgaccctagtgtggaaagaagttaaaactgtggataaaatgttatcaaaacagcattgtatactatagagaaatcttttgtgaaaggaagagtgaattgacaaatttcatttttgtcttatttttaaaaattgccacaaccacccagccttcagtagccaccacccttatcagtcagcagccatcaacattgaggcaagaccttccaccagtacaaagattacaacctgctgtaggcttaggtgatcattagcctgttttagcaataaagtgtttttaattaagatatgtacattgctttttaagacattctgttgcacacttaatagcctatagtatagtgtaaacataatttttttgtgtactgggaaaccaaaaacatcatgtgacttggtttgttgcagtaatgtggaattgaacctttcaatatctcagaggcatgcctgtactaaactttcacttcagccaaacttatctactcctgttctcaaaagcaccctgtgtacatcttctttttcctcttcttatataaaactgattctgagaagcctttcctgaatttcccatccctcagtgaactcctaaaaggttttccccaaactcctagaacactgatctgcaccatgaatttaatgtatgtcctgttatagtgctgtctcactaagtctttcccccactatcttaaaattatgttggagggttcttggcagcaaagacattatgtcatgcttttttttatttccagcatttagctcattgtagatgcataataaatgttaactttttaacatgagttattttgtgtgaccaagcaaaagggtcaataattttttaattcagcatcttcaggatctttttgatggataatcaaatatttcactagttttaacaacactggggacttaagaaactgttgtagagtggatttgggtgtgtactgctctgtggtctctctggagctaactttcagccttcatacccattggaataaatataacgcttcttgaaatttaccatctcttcctctttgagtgctttctatttccctttaagatgtttaaaaataccattagaatcagtggtctttctgtggctagtggtgggaccaaatcaatcttttctcctctggtttctcttcctttaaatacagataaagaagaagtgcagaggaaacgtcagaagctcatgcccaatttttcggatagtttcggcggtggtagtggtgctggagctggaggcggaggcatgtttggtagtggcggtggaggagggggcactggaagtacaggtccaggtacaaaaatacttattcttcctaaaactttttcatattggagagggtagaattttcttttctttggtttctgagcatgtctgtgagttgagtggctatgatattattgagtatattaattaaaatttcctgacaaatgtaaatttatttttcaaagaaatccatgttcattttacaatatgtaggtaatctcaaaagtcattaagaagaaaaaaaagtaccccaaagccagttatttaatgaataccttcctaaagattttggtatatttctcttttacattttttgacatagttgtcttgtttttgtttggaaacattgaaaagattgtatattatcatactacaatatagctatatattaaacatctctatatactacattgtagaaactttgaaaatacataaaatctgccatcaaaggttaactactactatttttatgtatatgttatagtatatatttgtaaattttaccctgaatacagctgtgatcatcattatgcattttattttaatccatttatttgcaatactattttactatcatttgcaccatgactgtgtgtatagagtcataggtgcaacgtttacctgagatgttaacataaacatttcctccagtaatatgaactttaagcataaattttaagcatcattttaatgactcatttcctcaagtgaacaaaccatagtataacttacttacatgtagtttcctgttttctatataaaatgctatactgaacctctgtccacctaacttttcacttattccagattacttttgtaaattagagtctttgtagtaaaattactacgtcagagggcatgacatctaatgccatctgttttcccaaagagttgtaccagtttatgcttccaccaaaaatgcctaagaatgaacagtggtggccatttttccattgaggagtcagtatgtttttctgtgctttgtttgattaagtttttttcctcaaggggttattttaatgtcttctacataggcaagtctgagtttggttggtgaccctcactattagcctctccccttcacataggagtgaaggctttctccattacaacccctccccaaatctggggtgctgtcagagttgccaacatgtaaactttaccaaagtggaattctgatagtcccatgacccccaccatgtgtcttagtcccaacagaaaaaccatgtgtgggcacaatactgtcctgtcacaccaaaggctgtgctcacctgagagacagacactaagttgtgctgagtctttgtaaaatatcttcatgatgtttcatttgttttacttgccgtttcagggtatagcttcccacactatggatttcctacttatggtgggattactttccatcctggaactactaaatctaatgctgggatgaagcatggtaagtaatgctttgttcttaataccaagaaaggaaaaaaataattaatgctaaaaagggtttttaaaatcattacttatcacaacagtattatcatcttgacaaataattgatgaatgcaaataaactaagaagatacttttcccaaaagatattatttcctgtggctagtataaactctattacttttatatattttatatatttactttgtaagtggcatgaacagaggaaagaaaagagcattgaaaagagacaacagagacctgactattcaaatattttaaacatcatcaaacttaatgtattctgtctctttttttctcaaatagtacacttctgaaatcattttgagttttataggatcggtcttttcccatcaagtcatcccctgagaagctgcagttaaaccacatgttgatagtttatattacaggtccattctagtgtacccatggaagaaataatactataaagaagtcttcccatttattgaatacctatttttgtgccaagtgcttttacatgttttaactgttatcttcatgactgctctatatggaaaatagtaactccattttgcacacaaaaggcatcaaagttcagaaatgttcgtactcactgaaggcacacagaagttagtggcagaacaagaatttgaagcaggtctcctgcagaaaagctagatgctctcatagtatctgtcagataacatagttgaacctgaaagagggtgatcaggaatggtacactggataactcccacactaaagaatgtgagtcgacaacacgtctttatgatttgctttgttcattagcattaggaaaaaactgctctgttttcaagaactttaaaaattcagctttcctgcaattcatagaagagctttatttcatttttctcctttacaaataagcaaaatgagatttaagattttagaagtatactaaaaatgatttttagaaatgagtttagaatatctccaaaacatggtatttatgatatgaccatttttaaaagaattttaaattattatttttcttttccttttgcagcaaacttgtctcttacctttatctgacctacattggaatagcgaattatcactaaatacattttactgagaaaaatctgatgtttttgcatttatcttaggaaccatggacactgaatctaaaaaggaccctgaaggttgtgacaaaagtgatgacaaaaacactgtaaacctctttgggaaagttattgaaaccacagagcaagatcaggagcccagcgaggccaccgttgggaatggtgaggtcactctaacgtatgcaacaggaacaaaagaagagagtgctggagttcagggtaagtgagcacacaaattacgttctgttggttggctggggaggggtcagtcctaggtgcagaaagatatctgctaatctaaagatgatatatcaatatctagtttagtgtactcttcaaagttctgtatgcctttggaaaagcatatgtcagatcattttattcacactgggatttccatttttgctctgttatctttgaatgtaaaggacagaaatttatatgtacattctccagtcataatcatgcagttttagggtattgtgagagataatcaacttcttttctggcacagataaatagagaagtatttccacaagcttaatagtcaccctgtctagattctggcttaaccgtcatactgaaatagaactttgccttaaaataggaacttttctttttatcttgtgccctctttgaagaagtaggattaggagaaaatgtacttttgcgtttactgtgaaccaatacttattagcatatgtgtcatgattctaggtcatcctagatcgtactaagaagacgtctataaaagcaaaggtagtaaatatttagagttggtggccacatgtggtgtctatcacatatgctttttttttacacccctttaaaaatgtataagccatgattagctagggagctatatgaaaagcaggccataaacaggttttggcccaaaggtcacaaatgccattccctgaccttaatggaacaaactttacaaaaacgtgagtggctcattgaacgtctctgtttatggcagagatgtgtgttttttcacacattgcctaacaagctaattgttagagattccaatgaaggattatttcaccaagatattggtgatttaaaatcatggtaaaatctaacattgtttggagattgttttccttaaaataacagataatggtcgttcccttaaaataatacatttctaaacttttttcctctaacaaatcatacacagattctttaagatcaatctctaactatatttgtcagtgacccagtgtccaattctgctttttctagtccacacaatccaaaagcattgaaagaacattttcaactaaaatgatatgtcaaggtgtcagaacactgatgctggtcagtttgtccttaagcatgccatacccataaaacaaaagtaggaacactcaactatgattgtggtcattgccttacagataacctctttctagagaaggctatgcagcttgcaaagaggcatgccaatgcccttttcgactacgcggtgacaggagacgtgaagatgctgctggccgtccagcgccatctcactgctgtgcaggatgagaatggggacaggtaagtcagaacttttgcatgataggttgtcctgggtggggaagaagaagagcatcgtataatgcatactgactagagataaaaataattgttcaaatatattgagtcctctaactggaatgatgaagaaaaataatgtgtgaataaggttaagtagcacaatttgctgctccatcctgctgctgtcatctgttggaatctgtagtagctggaggactcatctaagagtgaatctctctgggcaagaaaactaagatgtgtgtaggtaatggtactttttgaaaagccttgctttgtttattgaagtaatatttggagaattgttaagagtcctaccaaatccctgaagcattgttatcccagctgcatatttatgacagtgtactcaagaaaaagcccaataaaggcagcaacaacaacagaaagattaagagggactggtcattatttcccagttactggtttcttctctgctccctcttctgatggtcatcagtctatgactgtttcagacttttgtgactgctccagcccatatgtgggagtggaacattccaaacaccatgccttccattcttgctattactgagattgtatttgcaaagccacctggcttctttctaaaacagttctcttagtcctttcattgagacttctaaaatgatctcaaaagcctataaaaataacaagagacagcagccttcacattcaagtcaagtgccttatctaaaaccttcctaaaatagcatcaacatagagaaatccttttctgtggaagagctcttgagtgctgtgttttagacttcagtttaaaaattaaaccaagcactttaggaaagtaacaacctcagggtttcaagcagagacacctttgttctcattccttgcaacgtaaccaaggatgtggtataaccactggccttgttatacagtatgagaggaaccagtacaaccttcttggtataaagccatgaacagcagaattctttttcagggttaaataatccagttagcattcagtagcatacaaccacaagaaaaagcagttaaccaagacagtacagcagtgtttcaagtggcatttccagggacctgttaaattgataagtctaagaagatgagcacatacaggttagaaaggaagtgctgatatctgaagggaggattgttggaagggatacaaggcgaggcacatgcaagttccctcctaagacccaagcacactcacacaagccggctctcagagaggccacagatttgggacttggagagaccagaggatcctcataagagcataggtatagggcagcttttggccatcacagcccaagtctcttgttttaattcagctcgtcatatttggctaatagtttaaatcctgtggccattagtcatcatagaaaatataataaagaaaaatatataaaacttctgctattggggaaattcccataagggtgtgaggatttgagggggagggggaatgtacttctgctatgaaatgctgagcggcacatggaaattttcgagcagttttagaagtatgacctttttcttggtgtatgtgcatcatgtctatgtcagagtttaggcccttttcagaagtcttcttccagtatcacatttcaagaagcaatagtgaaaccctgagatcatccgttttaaaatatttctcaagtagcaaaatcacaatttagttttttaggctcttctgtgccggagttaatcccaagtacgatatacttgctattgctaaggaagaggcttgagtaaagtggcacctgatagcttattttagagaagatccagcctgtacctcgtgtcccagatgtagtgctgctgcgagatgctttagtgtgctctgcacctcaatctgtccatgctctggagtggtcatcttcttagacattcatctgaatgtctttagaacagtgcacatgtatcccctatgcaggattgcttaagggattaagagatggctttggagtaagacaggcctgggcttgaatcccagcttcaccacgtattggccttgactgagttatatgacgcctgcaagtctcagtttcattagctgaaaagtgaagataatattacctaactcataggattattgttatagtaaaaagacaatatatatcaaatgcttagcatagtctggtaaatcaaagctcccaacaaatagtagccactggtaaaatgattgttattgttattgttttgaattttaatagtatgttttttaataattaaaagaattacgctcctgtgagtgactttgacaccaccagtatgttcagcctcattagcgtaagctcttaagttccttctatcattcttatttttgtgcctctactgcatgctagggttgtaaggctgactcagacagaacctgccccagagatgacaggacagagaacgagaaaaatgtgtagaaaactgcagttgcataaccaagcagtaaatttgagagggacaacttgctccacctaggaggttaggaaagtattctctgaggatgtcaggtttgaactggaatataaaggatggagtaggcattgttcaggcagaagaaaggagcaaaaacattccaggcagagggaatatttgctggaatgtttgcaggagtggtgggaaatacaatcactttgtttcttcacaagtttactgcaagaattttcttccagtagttaaaagcttcactccattctccactcttgggatctggaaagatctttaaaaaaccaccacactgtattttggaggagggcagcagggctaagtgaggtaactaagtttttctgaacaattcctagtgccaggcattcattttacatagaatctgtgtgtcaggaaaagtcagggggaaaggtagagaagaaaaccgcccaaagccatggtatagaggcaggattgggatttaagcttaggtctttctgggctggaagcctcagtgtgtttatacatcaaggggtcaagacctgaatgctcccagaggccaggaaggtaccacaaataacgtagcagccttgggtaggcagttgggagggaccagtcctctggagacagcatcccacctcagattcaatgcattttatagattcaaaacattttagggccaaataaaactaggtatgagagcagattccattcttgagtctaatcacatcttgggaatcttttctttttcattaacattttagttaattattgccactgtgttttcattccagtgtcttacacttagcaatcatccaccttcattctcaacttgtgagggatctactagaagtcacatctggtttgatttctgatgacattatcaacatgagaaatgatctgtaccaggtaagcagaaatctcaagaaaacaactgaagaaaaatctgtagtttactttttcttctgttatgtttgggtgcatgttatttttagtaatgttaacagtagcaaaaacaaaaacaaacctttgtaggtaatatctaaaatcccattagttgagaatgttactttatgatgtaggatcctttgatctgtgggtataacagccatcaagccacaatgaaattcagcatcccgctgggggaaggcaaactttaaactttagaaatcaaacagttttttcatttaagagggagaaactaaagtaaaaatgtcacatctgtcaagaaaaataaagttaaaaaaagtttgaaaagccagtaatttataataattttgaagtctactgaaacataccttgacaacatccagattaaatgtatatcaaatgaagcattctgaaatcaccacacagaaaggttaaaagtttgcttgaggaggaaaaggtgtctttcaaaagcagaaagacagctccaagtgaggaaaagtgggaacaccagagttttgcccaaatcaggttttcttaggaattaattaggtgggctgaaaatacaagttgaggaactgttttttccagaggtcttccaacactgcaaagggagagttagctggagacacagcgaggccctttgatgggcatatgcagaattcagggagaggcaaggagcctgggagccacttcggcagaagcagagcttggacgttggtgatgggagcccagtgaccccagccagcctttctggctgagcgactgcactggcatgaaaccaagatggggttcggctcctgaggtttcctccttcctgcccctgattgcttttcccacctcactgtctttcccctactcccaccagtctgctgtatggggctcctgcccttgcccacttcttacctttccatttgtctccttcccttcatcgacccgaagcatcttcctcatcctccttggagagatggtttgctggttcacgtgtatctctcactccaaaactatggccaaaatcctgtgtaattatttacttagtaaagatatttgttcctgctctctcagtttttatagcagtgatgtgaatcatttctatttcctcactttaaaggaaaatgcttttattattttaaagaaaattaattaaaacttcattttctttaaaggaaattaaaatatctattttcttatttttatttccattctttaaaatgtgctttaggctgggtgcggtggctcacacctataatcccagcactttgggaggccgaggcaggcggatcatgagatcaggagatcgagatcatcctggctaacatggtgaaaccccgtctctactagaaatacaaaaaaaaaaaaaaaattagccaggcatggtggcaggcgcctgtagtcccagctactcgggaggctgaggcaggagaatggtgtgaacctggaggctgagcttgcaatgaggcgagatcgcgccactgcactccagcctgggtgacagagtgacgctctgtctcaaaaaaaaaaaaaaaagtgtgctttaaagtgcatttaaagcaaaactactaaaacgtttacatgtggctcttaatagtttttacctgtgactaggtaaaaattaataggtttcctgataggggaaaatgaccatttttcattcaatataagtcaccattaggcttcttcactggctcttgtgcttcttgtcaaaggaaaagtaaagttagtgactcttcactgcctgttaatataaaataactagtatgaagtgtgattgtagatttacatttaaaggatgtcttcttgaaactttcataccgttttggggtcattggtatccgtaaggtcattttgcctgtaaagcttgattctcgcagacttttggctgattgttccttgtagtcatcacaaatctatgaataaaaccaggaatgggacattgtagcttgtcagtcctcttttcaaaccctgcttaacagtcatattcaaggaattacttattttatgtttataaataggatctgcaaaggacacagcacaacaggattagtagctgtgatttttttttggagacagagtctcactctgtcacccagactggaatgcagtggcgcgatctcggctcactgcaacctccacctcccaggttcaagcgattcttctgcctcagcctcctgagtagctgggattacaggcgtgcaccaccacacccagctaatttttgtatttttagtagagatggggtttcaccatgttggtctggctggtcttgaactcctgatctcgtaatctgccagcctcggcctcccaaagtgctgggattacaggcatgagccactgcgtctggccagtagctatgattttttttttatatcctaaactctttactgtatcatttggttacatatgttgagactctccagtgtgttagagacaaaaaccctgaaaccgccaccattgatacttctatcccttctgatttggggactctcagaagactatacgtccatttttcccctaccttaccaccagtctgattaatgggcagtgattctggcttccctagtatgccttctaggtgtcaaacacacacccaatggcaactttgatttgagaattagaaactgctaagatttgaactcttgattatctgttgtaaaggttctctagtaactattcttaatggaaaatgatacagttctctaaataatttggattatttgacagttaagcattcttcccaaatacctttcactaatctaagtacatttctgtgaccatctgtcatgatcaaattcctctccccacccaccctctagaaacacactcaaaatagtccaagtgcaccgagttaggattttttatgaaaatattctctttaagcctttttctcctttcattctccttcccccaacatagacaaccactctatcgtgtttggtatggattgttttatttgtgtatgttcccataaaacattattggagggttttatgtatttttatgtttttaattattatacatatcatgtatattcatagttttaaaaatggtacagaagaatctacattggaaagtcaaagttgcccaccctgacaatgcccaggtctgctagcacaaatgtcactattgtgtttataggtagtttttcaagtactggatacaaatgtacgtatacttgaaatacatagatattttcatatactctcacatacaatccacattatattaaatgtacttctcttgccttgcattaacctttaaaatttttttaatttaatttaattatagattcaaaggaggttacaaaaacgtactaggaagtcctagtatttactgcaaggaaaccagaggtctcttcacccagtttcccccaatggtaacatcctgcataacctcagaacagtgtcaaaacctggaaatagacgttgatacaatccacagatcttaatcagatttcaccagttttacacacacttgtgtgtatctgtatagttctttgtgcatatattttttaaatgcctaagtggcattgtgctacatgttactgtatttctgccttcactgcttatccacacagttctacatatagctagtttgttgtttcagctcctgaagagaatctagtatgggtctttcacctataacatccttgtttcctagtagtagacatttaaccaacttctaacttcctacctcagtagataatactgcagtgactgtcctcacttatgtcctcttgtggatttgtgtcagaatttcacccagatacatctgcaagagttgggttgctgggacatttgtatatttggctttccagaatgtctgtgtaagtccccatgcccacagccatagcatgaaggtataattgtttaagatataatccttggatttaagaactagaaggtttatatcatggaaaaccattgattggactgtggaagaaaatattaaaaaaaaaaaacctctccgactcataagatattttttaattaaattcaagctacagataatttataattcctgaatggtatactatcttataatttcagatccttttttcacaatctcattctctttccttttcccatctccccaagtagcatttcagaaaacacagattagtaaacacagtttccattgacttatttttgagaagaaggctcttggcaacaatatctaaagttttgaggacatcacttcatttcaggccaggttgatagtcctagaaaatgaaagaaataagggcaagtaataatttggcaaaaaaaaagggtcttgtatagtaaataatcactgtagttgagatttagactaccctcccatcattcatcctgccagttatcatgtgctgtggtcacctacacagctaggaggttggtggctcacctgctgctgtagccagtaactgctcaatgaaaagggaattttaggcaaattgtcacaagactggctggatgtcatagttaggctcctgtgaaataaactgatttgtataaagatacattgctgttctctgtcagtgaactcagttatttgaaagatacgtttgtgattgtatttgtcttactcatttttgaaaacacacagtttgcaaaacatcttatttgcattcaccgaagtaataccttgtgggcaggatagtcaaatggactatttaagtacctattaggtatcagcagctcaccttttttattcagctgagcccccttggtgagatacttgtattatcctggttatgttatttagaatcttataataccttttatgaaatgggtgtaggaaagctatattgactggtctcaggagccagtccatgggacagtattttttaatttagtaaatttagtttccatgtcagcatagaatcatggcacttttgttaattggtttctattgagtactttatttaaatttcttcagtgaaaacatagccttaatttgatttgttaatataaaattatcagctggaggtaactcctaccagatatttaagaaaactaaatttactactaggtgtgctcaaaatcaacaatcagtgggttgtagtgagaaacaagaagctattaagacttgtaaatatgaaaataacccaccacagaaaaaattgtaagtatatgaagtgatggatttgtaacttagcctgatttaatcattttatgttgtaaacttagattaaaacatcacattgtacctcataaatatatacaattactatttgtcaattaaatttaagataaataagaattttaaaacatgaattattgaatggctaagtgttagtacagtatatgtacttcattagcatatagtatggaacaggataacttgggtgccaaggtcagaagttaatctgggaatgagaaatattcctgcagtatggccccacctattgcagtaacagctaccaagctgtgagttgtaagtaagtattcactgctgaccagtgaatctcctgccctttcactttccagacgcccttgcacttggcagtgatcactaagcaggaagatgtggtggaggatttgctgagggctggggccgacctgagccttctggaccgcttgggtaactctgttttgcacctagctgccaaagaaggacatgataaagttctcagtatcttactcaagcacaaaaaggcagcactacttcttgaccaccccaacggggacggtaagagacaatcacacatcattggtgtaactttctccaccttctaaatatctactaggtatttgataaacgtgtgttatttgatttgcacccaaaagtgctttccttagtcacctggagttcatcatctcttttgggcatttctgttgctcaccaaagctaatttttttaaagatgatttggaatagttagtaggaggagaaagcagaggcctgagtaaagattcatcttgaagtacacaaagcgtcgtttattcagagaatgtttatttatgttcatgtctcctgagaacataataggagactgtgggtcttcaaagcagaacaatagacttatagtatctttactgtccctccccatgattcagtttttgccatttccttcagcttcacaagggccatcttgtgagttagccatcccatcctgtgactgtccctttgcttggactctaggtctgaatgccattcatctagccatgatgagcaatagcctgccatgtttgctgctgctggtggccgctggggctgacgtcaatgctcaggagcagaagtccgggcgcacagcactgcacctggctgtggagcacgacaacatctcattggcaggctgcctgctcctggaggtgaagggcacacttatttgcttttgcattaaatttctgagggagatttaaggaaatcttttcaaagaaggaagtcagtagctgctgttctcccttacaatcagctctatttgtttaacatttatggagggcttcagagtaccacctttagacattcccccaacccccttgcttggcatctctaactggggatttcttcaatgacagagccagcccaaagtagcaattgggctagtaataggacccaaggagccatgcacactgggaggtggggacaaaagggcaaaagaaccttccactaacgctttcttgtgtgggctggattgtagggtgatgcccatgtggacagtactacctacgatggaaccacacccctgcatatagcagctgggagagggtccaccaggctggcagctcttctcaaagcagcaggtaagatggtgatctggcggtcattaatgaaaaatgttaccaggaatgcaaacccaacttcaatagagcagtcatgttgccttctttaagccacagacctactgctgaaaaacaagggtaaataaaaattatatggcaaatcacattttatctgccataaggcactgtttggactagtaatcttgggctttaccctgatagtcattttagtttttactttctgattcatctgtttgtttggggtttgattgtttagattgactcccatgacaaagggtcttttcaaagtagagtttgattccttatagaattctgagtggtattagtctcagatcatatcagaaggccccagaagaaaaagattattggtataagaaatcatttaaagacttcattttgaaagaaatatctcttagaaattgaagtgtaggaaaaagaaaatgggccatgtattaagacccattatgtggaaggcactaaaaatggctagcacttattgacctttctgtgtaccaggcactgtgatatgcactttatgtgcacagtctcatttaatgcccaatcaccccttgtgacaaataccattattccccatcttagagtcaaggaaacagactagagagactaccagatcccacttcagggttccagtaagtgacagagctatgaatcacacttcggcagtgtgaacttcaagactttattctctgtactatgtttctctctcctattttgctcataggtttgcagatgttattccatttaattctctagtcctgtgaagtatagaaaattatccatgctgatctttgaatctccagtgccttgcatatttagaacctcaaaatatgtgtaatgaaattggcatctgaagcctgccctgacatatctgatatactttagaggctttttttttttttaacttaaaaggtaaatgcttcataaattcaagaaaacaaagcaaaagacataggaactttttctttgggacaccatatttttcttttctcttttgttaaatagaactttttcttgaacaagaaactctgattgcagtgggtattaatagttttagaagacactgattaattaaatgccttccaacaagaagctataaccagccagacgtgatggctcacacctgtaaactcagcactttgagaggctgaggtgggagggtcacttgcactaggagtgtgagaccaaccaggttaacattgtaagacctcatctccattaaaaaatttaaaaagtagccaggcatggtggcatgcgcctatagtcgcagctagtttggaggccgaggtagaagtatcacttgagcctgtgagttcaagggtgcagtgagctacagtttcaccactgcactccagcctgagctatagaataagaataagaccctgtctcaaaaaaaaaaaagaaaaagaaagaaactataacccttttaaaaatgctttatattgaattctcagaatcccatgaaaggaaaagcaagtaacagtttctctgatatataaatgaagaaactcagatgaaaaaccaagtcctaatcttaatgtcgtggaaaaggtcagttaagtccgagtgtggtggctcacacctgtaatcccagcactttgggaggccagggtgggtggatcacctgagactggcagttcgagactcacctggccaacatgacgaaaccccatctctactaaaaatacaaaacttagctgggcgtggtggcatgcatctgtaatcccagctactcagaaggctaaggaaggagaataacttgagccctggaggctgaggttgcagtgagctgagactgcgccattgcactccagcctgggcaacagagcaagactccatctcaaaaaaaaaaaaaaaaaaaaaaagcgtcagttaagagatagctcatccctccacactttggtcctgtaaattgttcatcttaatttctccatggattacatttattgcctcatagatcaggccagaactgggagaataaaatcaagaaacagcatgaagatccttctttgtttcccattaagtactcctctattattgatattgacccatctgatgttctcccagcaagataaaaacaagttcctccctcaaaaatggcatcattagacatcaagctaaacactcataaaaatcatctaagcctctgagaagtaactctagctctagtctttgagttactttgatgttttgtttatttgtttgttgtttttgtttttgctggatgctaaagagcagactacatttcccaaaatatttcaataattatacatcctagtaggtttgtttatttaaagatcagaaccctggcattgctgtacccagcaatgaaactggccatgctgtcactagacatcaagcatctttgctcttttgagtgtccaagaaaaggggctgagaaatacacattgtcatgcataaatttgaacagttaggaccctaatcctgagggtgcaccctagtggctgtaatcatgctgtccatcagccctaagattaaagatgcactattcagttgagaaatatcctgtagagttaaatgtgaaagagtatttgaagtctttttttcttcaatagtatctttggctatttcaggtgtcataagacactttaacaatcaaagtaaattacaattttaaaataatttctctggatattccagtagaaatgttttatgatttaaaaattatccaggagattgcctcaagctgctacattgctttgcctttgggaatctgacctttgcaggcagttggaagttgacaagatctgggtttacctaatgctgtgtaatctaacttcgcaggagcagatcccctggtggagaactttgagcctctctatgacctggatgactcttgggaaaatgcaggagaggatgaaggagttgtgcctggaaccacgcctctagatatggccaccagctggcaggtgagtgccgctccatctgtctgatggctgcccctgagggagtcagaggttcaggaatgtaagaacagatggtcttcctggtgctttattccccaaagaacatgccttttatttttaagaaagtctgtttgtcagagaccatttttatcttgaaaaaccctatccatgaaagatctaggtcagctgagttctgagtacgaaagtgtatgcctaatcagatcagagttgagatgtgagaaaaggttagaagaaaaacacaaaattcacataaaagttacccattccaaattcacaccataattgtgaccatctcaatttctgaagctaggataaatgttactgtttgcttaggacttaggtaagtgatttcaggatgtaaaaataaactaagaattcttcttagaatttcaataaatataaacagagtaaatagatttaaagccttcctcaaaactccacagggctgagatctgaaggtataaagcagttactaggtcatttggccccaggaagaaaagccagagggaggaggtgggcagcatgcaagatctccaacatgacaagatcagttcttctagagacgagagctgctccacttctaaaactgctcatgtgcctcccacagcctgtatgtgtccagctcactgacgttagcagagactccatggttctccctttatgttagcacctcatttccccagaaggccttgccacagaacacaaaaagatgatgcactcagtgaccccacgctctccttacccaggtcagccagcaacagagtgactgcagagaacaccacaaatgcctcggcagctacagaataatttttcttttagcctaagacaattctggaccctcagttaaaatgtcagtattgccagagggttaacaccaagccttgtgaacatctagacatctcaatttgagcaagtttatacaattcattctcataagcttgttcctatggaagaagggagacagcttcacagctctgagtaagctcttcactagccttaggtctctgagcaggagatgattgacatggtggcctggactgcctgttccttccaaaaggctatagctctgactctctgcagtttggttgggtattctgacccagctcagagtttgtgcaaagcactatttcccagtaccagagcccctacagctgttcttcccccaaagggtaccatattcttggagggtggtcctgattcctcttgccattcctccatcattaggtaccaggccctcctaaggaggacatgctgagttgtttattataaagaaacagactgccctagtggtcccttcgatgtataacgatttctggtgtttttctttccaacaggtatttgacatattaaatgggaaaccatatgagccagagtttacatctgatgatttactagcacaaggtgggttgtgataaaaccagattctcttaaccattattatctccacactgtcatttaaagggaggaaccagcattatccagggtctactgttaaaagttcttatttcagaaccaaaagatgctggaggtagataaggagaatatccagttttaatctactgtaaatgtatactgccttctactcagctgggctttgaccttcaagtagagtagcttggttggttccactgggagttggacagcaagccaggcagcaatgatcagtccctccagagtgtctatggcatgttagaacaagtgtgttccttcttcatttccttcaggagacatgaaacagctggctgaagatgtgaagctgcagctgtataagttactagaaattcctgatccagacaaaaactgggctactctggcgcagaaattaggtctggggatacttaataatgccttccggctgagtcctgctccttccaaaacacttatggacaactatgaggtaacaccttaccttacagatttagcaattttcatttgactttactctgttaacatctctggccagggcataatctccttcccttttccttaactctgaagaagaaaaccagtcattgcccaaggcctgggagggtgacccaggccaagttggcagcccatcttcctgagaatgctgttttcagataccttcagattttccccgttttcaaatacctggagacttcctgtgaaaatgctacgtagagggtcaggattttcacagaactttaacggccctgagcaaacaatcgactgtaatcaacgtgtagcttcctgtccccaagaacacaccttaccccatggcagggcattgagtcatgttctgtgaggtgactcctagtggagccattacccggggatttttttttttcatttctaaaaataaaatgtagaaaagcatggggtgaagttttctgttgaaaatttcatggttagcttttgtttctgcatggatttcagagcttcagcttacagagggagactgtgtagacgtcactgtaggcagagtttcactgcctcagcgcttctctcgctgtctctctctctgcttactacaaaccacttctctgtgatttcctgagtggtctttgagccgaaacaggaaacttgattcgaagactgtattttcttagtcgctcttctctgccctttccatttcctcctggctcctgagtggaggaggcagcatggaagagggaagggtgggctgtcagtgcttacagcctgcactgggactcgaacacaagaacatgctcctccttcctttctttctcacaggtctctgggggtacagtcagagagctggtggaggccctgagacaaatgggctacaccgaagcaattgaagtgatccaggcagcctccagcccagtgaagaccacctctcaggcccactcgctgcctctctcgcctgcctccacaaggcagcaaataggtaaaaaaaaagacaaaagacagtggagatattttccagctcccccaggctggtgtcttcagctctttttggatatggtgtggcagttttctttctcgttttctggatacacttccctgtgtgtctctctaccccctgggctcaccctctgcctctcttgatagtaccattcagatgagggggtcgtacccttggaaaatcacattgacacatgaactacttagtaaacactaaataatacaataaatactaaaaacaacatgatgtgggtgattaaatttaacacatgagagaaataatatttaccttaaagagagaaccatctccttcttcctttgcctcctctctcaagcttatgacactgaccttgtcccccaccatatatgggactacgtgtcatgccaccaaaagtctcgcaaccatatgaaatggactctcaacccagcccagtaatcctatatttcctacaattttattctcccactctgtaaatgatgattccatgctttctatttctaaacccccaacactccttccctccccttactcatgcaacacccttgcttcacactctgttgaaaacagaagaaaccagaaccctctcacctttgcaccaagtgccagcccacctgtgcctgtgcccacattggcagccttccatccggacttggtgggttaaatttctttgcccagctgaggagccacctctcccctgagtctaaccccctcacctttactaggttgttgttcctgttaattcttacctctctctcctgtactagccgttcctcctccccactctccgactaggtcacctagcaagcatttcatgatttcctcatctttaaaaacaaaacacaccgaaacaatcaccctcttgatcccacatcccatttagctacagtccaattgctctattcccatacatagcagagctccttcaaagaattttttagagttattctttccagcttgccaccttccaccctctgcttggcctcctgcagttgggatcgcatccccaccgctccaccaggcctgctgtcctcacagtgaccggtcacctccacattgccagatctggtcacctccttttcaccttgaccacttgcagagtgtgtcatggttgacgcctaccttcaacttcagaccgtctccattcctggctcctccacagcacactcccctggctggctcttctacactcaccttttaaagtcacagccctccagggtcagtcctaaaccctccctgcttggtacctcacccaagcccaatactggctacatctgtcagaagcgctgccatcttccaggagattaagacaaaacccaagaattcctcaggagtcctttctgccactaatcacttcgtatgcgacgcatcgagtgtcatcctgtctgcaaccaccgccccaggccagcctgccgtcatttcctgcccaaattcttgcacggctcctactcagtccccttgtttccttcctgtccacctcccttcagtccattctctgcccaacagatggtatgattcttctaaaaaatcagtgacattgtattaattctgggttatgcccttcagttcattcagtcattcattcagcaaatcctgatccagcatacactgtgtgcctagcagtgttcgaggttttaaagataaaactgtgtccctgctttactcgtttgctttcttaaacattgctgtggaagctcttcctccacactgcgcctccattcccaagtgttttctctgctcccctggctcactagtctgaccaaccttttgactgtttcttcccattccctggaaagctcttaattggctggctctttcttgccactcagtttcagcacccatctcaccctgccagggggccttcccaggggagcaagggcagacgtcattgtccgcacttgagaaaggaataatgtatccgccggaaaacaacccagatctcctgagtcacagcccagtgctccttctgcacagatattaaaaaagaaaaaaagcaaatacttaacatttttttaaaaagtaaatacctaagcattaagcccttaatttgtagttatttttaggatatcgcatagtttgtaacccataatagacaccaaataaagattggttgattaaacaaatcagtcaataccaaaatgatagtcgtgccactggcattaaagtcttaatattctaatattggaatttggtacataagaagatagcattttgattagtgtatgttagacttctgtttccttcctcactgtataggaaataatttgtcttggtcatatccctaaggacacttataaacaaagggaattcaacctgattttccagtatagactcattttcaccaaaatcattttacttttattgctaccaaaaatgttttcaaggcaatgtatgctgtaatagcatatgaggcccagagagagatctcatttttagttcttgcttctgtcaccaatttattttgctgaggttcagcagtttccccagctatgaaatagataatacagtggttggaaaactacacttgatttctaagggaaaaaaaggtccactgtgagtcaagagaattcagaaaggattctcataaacacaagactagattgcaggaagatgtgaaagcatttggctaattctgacatttggctaataacatcctcacagtatgtcccaagtatcttctgcccttcccaccacggtgagcagtcatgacagtgagggtggcataggtgggatgtgtggctggcagaagccagtgggcaagagttgtccacagaatagtccatgagctttttagagcccggccattcccccagtgaatttgtgctttctcccctcagacgagctccgagacagtgacagtgtctgcgacagcggcgtggagacatccttccgcaaactcagctttaccgagtctctgaccagtggtgcctcactgctaactctcaacaaaatgccccatgattatgggcaggaaggacctctagaaggcaaaatttagcctgctgacaatttcccacaccgtgtaaaccaaagccctaaaattccactgcgttgtccacaagacagaagctgaagtgcatccaaaggtgctcagagagccggcccgcctgaatcattctcgatttaactcgagaccttttcaacttggcttcctttcttggttcataaatgaattttagtttggttcacttacagatagtatctagcaatcacaacactggctgagcggatgcatctggggatgaggttgcttactaagctttgccagctgctgctggatcacagctgctttctgttgtcattgctgttgtccctctgctacgttcctattgtcattaaaggtatcacggtcgccacctggcattccttctgaccacagcatcattttgcattcaaattaagggttaagaaaagagatattttaaaatgagagtcacttgatgtgccattttaaaaaaaaaggcatattgctttttctaatgtggttatttctctgatttgcaaaaaaaaaaaaaaaaaaaaaatacttgtcaatatttaaacatggttacaatcattgctgaaaatggtattttcccccttttctgcattttgctattgtaaatatgttttttagatcaaatactttaaaggaaaaaatgttggatttataaatgctattttttattttacttttataataaaaggaaaagcaaattgatgacctcaccttgtttgatctgtgcaaatacttttctaagatgcttccttataatcatgggatcattccgtatagcctggttatcacattcacattgcctattagagtcaattttttaatctagaaatgaacaaataattatcaaaaggaaagtgttttaacctaagatgaaagctttggatttgcctaatccttacccagctcatcttatttagattgtgccacctcactttcctccatctcatgcaatgctacacctcttcaatgtcttctccacacctctgtgataaagtattaagatttccatataccagagggccctggactaggagccttccagcatgaagctttgctgaacaacaggtgctggagaggatgtggagaaacaggaacacttttacactgttggtgggactgtaaactagttcaaccattgtggaagtcagtgtggcgattcctcagggatctagaactggaaataccatttgacccagccatcccattactgggtatatacccaaaggactataaatcatgctgctataaagacacatgcacacgtatgtttattgcggcattattcacaatagcaaagacttggaaccaacccaaatgtccaacaatgatagactggattaagaaaatgtggcacatatacaccatggaatgctatgcagccataaaaaatgatgagttcatgtcctttgtagggacatggatgaaattggaaatcattctcagtaaactatcgcaagaacaaaaaaccaaacaccgcatattctcactcataggtgggaattgaacaatgagctcacatggacacaggaaggggaatatcacactctggggactgttgtggggtggggggggaggggggagggatagcatcgggagatatacctaatgctagatgacgagttggtgggtgcagcgcaccagcatagcacatgtatacgtatgtaactaacctgcacaatgtgcacatgtaccctaaaacttaaagtataataaaaaaaaaagttgggaatatggaagaggaaaaaaaatcagtttttgagcgaggtactattgtcgacattgtgatgcacaaccaggattcccctttgacaaaggactattctgctggtggtgcactctagctgtcagctttctcatggaatgctgccgggagctgtgtcttcctaggccacatccatttccacaatggcacccatgcaacattgatcaatgtggacatatgaataagcctgtccaaccagggacaacactgaagggctgttgaagcttcagggttcccattagagaggctgaggctgcattgcactcaacttctccctctgcccatcctgcttactctctcacccttccatagctgttgagcttgaaggcactccagaaaaacatttaacataaatttccaactcagagtcagtctccccgagaaccttgcctgcacaaggtgcttggaaccatgcagaacaattttgcgcaacacattgagccattaatcttgaaaaacaacccaacttataaagaaggaaattgaggcttaaagtagaccatagctaagctgcttctgagtttacacccagctctgtctagctccagagctcatgatgggatattatcctgatgagaaggcagataaaaatcatttgagtccagaagtaggctccaaaatatataggaatttagtatatgatacagtaaaatttcaaatcaatgagaaaaagatgattactcaatgtattagtctgataaatgctgataaagacatacccgagactgggtaatttataaagaaaaagaggttcaatagactcacaattcgacgtgtttggggaggtctcacaatcacggcggaaggtgaaagacacatcttacatggcatcaggcaaaaagaaaatgagagacaagcgaaaggggtttccccttacaaaaccatcagatctcatgagacttactactacgagaacagtatggaggaaactgccctcatgattcaattatctcccaccaggtccctcccacaacacgtgggaattgtggaagctataattcaagatgagatttgagtggggacacagccaaaccatatcactcaatcaacagaggtcccaaccggctaatcacttaaaaacaatccatctgaacacctgcctccctcctttcatcaaaataatttccaaatatatcaaaaattaagccataaaaatattagaagtactagacgtcattgattgataaataatcttgatatagggaaggcttttctaagcaaaacttttcactggtataaaagcagtttaggttcttcattttacagcacctcccaaataaatagaatctcaaggagaatcctacttatgttttctattacattgccatttctccacccctacccagcccctacccagccccactgtaaagtgaaaaaatacagctctgattttcctcaattcttaattttccaacaagcagcccatgcctccacacctctgcgggttcctttctgtggcagatcattgttttccagctggccactacaaagcctcctgacctacaacatgaggctgacactcctcccactgaggggaggggcctgggttccttctctgagaatctaagcaaaagtgacaaggacggaggagatgctaagtgacttccaaggttaagtcataaaatggaatacaacttctacccccatcgtgctgtgccctctgtcttagaagctggtcattgtgttctgagggagccaagtggccacatggaggaaccaagtgcaggtgttcagtccacagacttactgaggccctggctgatgccagcatcaaccaagagatgtgtaagggagtgaagctttcagaagattccagccctcagccattgagtcaccccatctagccctcaaactgcctcagctgatgccaccatcaaccaagagatgtgtaagggagtgaagctttcagaagattccagccctcagccattgagtcaccccatctagccctcaaactgcctcagctgatgccaccatcaaccaagagatgtgtaagggagtgaagctttcagaagattccagccctcagccattgagtcaccccatctagccctcaaactgcctcagctgatgctgcccagaatagagacaagctgttctgcagagccctgcccacattgcagattcgtgagcaaattaaataatggttgaggttttaagccttaagtgtggagtggattgtcaccatgctccaggcttccaacttgacagctcacctaccagaagttcacttgaagtgaagctgacttgaggaggaggaacaactaagcaactcatgccaagatagaaaaatcacattccccttctttcataagaagccccatttctcttctgtcccaaaaacttactcttcctcccagatctcagtgctggcctgaacctctgtgtggtgctgcaacagcaaggccaccagtgctgtctgggtctctgtgaaagtatctttcatattgtaccagcagatggagataaaccaaaaggaatgcaggagatcaggtggaaagctataatgggcctgaaataaaccttcccagaaagcttgtgtcacagcaggaggccatttaaaaatagcttcctcagaacttcagtcatttttgaggtttctatactctgcaggcataacccagactttttcaggatcagcggtctttcttttcagcagaacgaagccctgctgctgctcatttacctatctgcgtcttctgaagtagctgaatgtggcacagacgttcctggtcaccactatggaatgcagctgcacaaactggactttgtacattttaacaggaaaaaaggaggaggggaaagatccagccagcatggagcatttattacatgccagcccttttggattaataatttctaatgataattctcaagacacccctattaggtatatatttaaccccagtttataaaaaggaaatgaatgatctgaagttattaaataactcgccccagattcaaatgccggcccatctgattccaaagactattctttagtgaggtttgcagtcctttgacaaaaacatgctttatttaaaagagaaagaaaaatgcatacagtcctgtacaaagatgatggagtcgtcacgtacccaaccaaaatgcaaaatgaacccaaagtataactaagaggacatattgcttggagacttgattttccccctaataaaaggcaaggatgccttaaatatgaattattcattgactggaagttattgcatttctttcagcctcctattttgtgcttttgggggaaattctgtttctgacttgtgcttccccagggaatggacatgggaggcacaggagtcaaaagaggatgaaactaaaattctgtttattttcttgaagatcacagaacttggggttggttaagatcttaaagatcaccttcctaaactatccaagtttttctgaatgcctacaaagtgagagtgtctcttctccattggcctcactgtggctggctgcttcatgtaaataccaatcctagagactacaagttcctgtccattggttttccaggtttgtcatttggttttggaattgggggagacactgaggagaggcttgaaattaaatggatctccttcaattaccatggatttcattatgtccacaatagcctttttctgttaccctggacaaatgaatagttccacaagttgttcaagcttcttaagatgaaagggaggaaggggctgagatagcatcatcttacttctgtcaactagcttttccacgttgatacctctttccaaagtgattatttcattgaactatcacaagagtcttcaaagaataaagatatgtgttcaatcaagatttcttgggcatctgttgcttgccaggcactacaatgggtggtcatggggaaactgagacacatgagaggcatgactgcaggatcacttgactccagtaacaacactgcagcagggtcaggggtgagtagtgtctctcttccacttagccacacatggatccaggctgacagtcattcttcctccaacgcttggctcctaaggtcttgctaggggcgatagccccagtcagccaggagaaaaatgttgagagaagtatgtgagggagttttgaatgtgtcacctcctctcatgttgtgctggagaaaaacttcagtcccttggtcacactaagagcagtgaagatagaagggtggtctacttctgttcccagtattaagagagctgttgattttggaacaggtcacagcctttggcacaggtaataatcccttcactgagggaggctgagccataaggttctttctagttgcaacttgtatgcagatattcactctgaaagtcacctgcaatcatggtaaatggccatcactaaaggcaagatcatttcgtaggattaagcatgaagattgcattgtaagcacaaagtcacagtttttcttaaggaaatcctcagagatgatcaaggatatgagggcaggtaggctggggaagaggtatagcagctatatcttgttgccctcgcactgattcacagagatctctgctctccaacctctatgctccgtagttccttaaacgctgcacaagaagtcctgggcttgtagacaccacagttagcgttcaagaggccctggccctttaagatcctacccaaaagaaagggacaagcaagtttatcttagttgtgttctgcagaaagctggaaagaccttggctcccattttctcagataaattggaaaggagcagaaattggttcttgtggaaataatattctcttcaggccagaaggatagcagatgaaacaaattcttgaaaacttttctcccaggattccttcttgggatccaggaagcagagctggtgatgaagatagtgagatggaaccctgaggactatgttggggacacatcagatcagggaaggctgtaagtcgatgcccagtagcagacaaccaggttactaggtctgttccctggcgaaaagagatcgatattttcttcatttcaaaactgtttcgcagttccctttttccttttcctaaagcaataatgcacaacttattttttggctttaaaaaattgaatgaaaaacttcatgtcgtgggttttttttttttttacatttccagcatccctttttatcaccttattcaaatgcaaatgttcaaaagtcttttgaaataatttttttctgtaattttgaaaaaaattcgcaaaataaaaaactttaaatgtaaatgttttcatttagaaaatattttcaagtactgactgtcatagcagcctgagaggtgaacagggaggggtttgaattcctgccattgtccacaggacagagttgctgatgtgctggaaggcccctggtctaatgtaaagagcaaaggctgggccgggactcagtcttcaatccccatactgtgctccttggcttcacgctgcagcagtgcgtcacggaacacacaactgtttcaaaggggtgggtcatgcccaggaaagggaagaagcttgccaacagggggctctgaagtattatccaagggtggccaaacagcaggaagccagcattccctcaacaaatgaactcagctccagcacacatgatgcttggcaccggtccccaagaacaggcccaggaagaggccttgagtccatgctgactttcttcctcctacccactccttccagccccactccttttgctttggggccctcagaagctttttttctccaccacttgcttctttctgccacttctttgtgtcccttcaccttccctcaacaattcaagccaggacccccaaaaagctatccatgggccacccacattaatgcagaatcctgcctcccagctgaagcaaagcctggcctagggaggccaaagggatcagaaatgacatccccgtaaagacccatcgtaatcccacagacaggtcctgctacaggagcagggctgccaaaaagcaacattcttgttctcttcctttaggtcctgaagctcctgcccctccaccactgctgccagcgaccacagtagcagggggaattttacctccccagtatatggagaccatatatgctcaggaagtgcatatatgctcacagatgagcaaacctctcaggcctgattgatgcaagcagtccttagcattcttctccatcccagttttgatctgggaaggtcaaagccaccatttggccccgccttcctttactgcctagccaaatgcacatcttgaatgatgagcaacatatgcacacagcgtgtgggccaaggacgattttggtccctccaccagcagaatgtaattcctttccccaaatcacgcccatagctcacagttttggccctttcctgattgttttgttactaagcctttaaatagctcatctgacttctcctctgtcaatcatctattcaggaggcttggtaccaagttttcatagatccatagtaagtaaatttgaattaaaaagcatttatatgccacacttttgccaaggtagcaacagtggatggaaatgaaatacacatgcttctccacttacaatggggttatgtcctgataaacccattataagtcaaaagtgcacttaataccttgataaacccatcataaagtcaaaaagtcataaaatcgtaagtcaaaccattgttaagtctgggacctgtctgtaaccaaaagacaggcagaaagtagacaaatttgctctgtggatctgaaccttgtgatccagctatgctggtgctcagcctttattagccctggatccatggaagaaaccagagctcagcaaacagagacgccctttgggttccttctttctccttccacccttcctcctcacctccctccttcctctttctccctttctctctccctgtgtctatctcttctctctcctttcctttctctccttttctcattgtcttcctttctctcccttctacttttctctctcccctccgctttctctttctctcttttctctctctcttcctttctctttctctctcaccatttctttccttttctctctcattcttcttctctcccttcctttttcctttctctttctctcctagtctctttctctcaactcttctctttctctttctttttctctttctctttttctctttctcccacctctttcccccttcatccctcccttcttttctttctctttatttccttctttaaggtactttcacattcatgcattcctctggggcactggcatccaactccctgaagcccagaaggtgaggggtttggggagcagccctgcaagtgtttccttaggctcccctcgcctcgctgaaggcagcaaatgccctgtactctggggaagcctccaggaagccagcaccctggcccagggcagtcccttctgcacaccactagcctcatttcctgagcacaagaggcctctgctggaagaagcagaactttgcacaatcatccaacagctggcttgcctattgctactcaattttattttattttattttattttattttattttattttattttattttattttattgcttctgtaaaattggaaaaaccttaccaaaaaaaaggaattagaaatttcttcagctttctgcctggatttttctccttcaactcagttcatgaagcctgttgattattttccctcagtacagaaggcttaagttgctctttccttttagcaagcggaatcaaagattcttaggcctgaacacttcagccaccaccagccttatcctttgagggatgatattgataaaccaacatttattgcatttactacatttatatctttattttatttaatcctcacaggaacactgtgagatagttattaccattaatctcaacttcaagataaggaaactgaggcttagaggttaagtgattggtccaaggccagtaccgggaggttcagtatcagagcatgagcccatagcccttgcaccacatgcagtcttcacacttacacacgcacgtgcatgcacacacaatttggatctttgacaaggcaaaatttcattcatgtttgtaagttgactagttaaaaatcttttcattccaataccaaaaatatgggtagggaagcatgccagtcacccactttggcttgagagctcattgtaaaagagcaggggcccttccttcacccactttggcaattttttttttttttttgagatggagtctcgctctgtcgcccaggctggagtgcagtggcgccatctcggctcattgcaagctccgcctcccgggttcacgccattctcctgcctcagcctcccgagtagctgggactacaggagcccgccaccacgcacggctaattttttgtatttttagtagagacgaggtttcaccctgttagccaggatggtctcgatctcctgacctgatgatccacccgcctcggcctcccaaagtgcagggattacaggcgtgagtcaccgctcccagcccacttcagcaaattatgtccccaacagccttcctcactagaggcaccactgccactgcagcatcccagcacaaggaagtaggtgacgcatctcccaacaggacacccaggtgcccacactgccctctccaaggcccagatatgtttgacctcaaagacccatgtctttatccacgaggatgcttttaatgataaaatgagaatgcctgactataagtgggctaaacaaataagggctttaaaaaataccattacaagatcagcgatagatacatcgatattttacatggaatctttccctttttaaatgttagcatgtaattcaactttttaaaacacagtctagaccatgacctgctggtcaaatatgacctaaatcttcaggatgacaaggcagggtgcggggggatccaggtcctacctgctcctctcccaggctcactgctgcccccgacacctccagctctcctgtctgatgctgttcacagccaccacccaatgcctgcacacgttcagttctgcccacctccctagatttcttctgatggcttcacacagaggcaatgatgattgtaatagctcacatttggtggatagttatcatgtgctatcaataatctgtgcattatctcctttatacctcacaattaacctatgaagcagatactgttgttattgttcccatgtttaaagaaactaaggcacagaaagactcagtagcctgtatccaatgaagaacagcctgctactggtggatctgggactgaaacacaagtaagtccgatttcaacgcccacacctttaactgctgtatcaattaggatgctttgggttgtaaaatcagaacacctgactacaagattaaacaattaagcctttattttttaccacattataataagaccacagttagatggttgcagggttaatttagcagctaaacatctctgacaccccctgtcaaatatgtttctttaagatcaccaaaaaaaggctgcagcagctccaagtgtcaggccctcaaatagcttctcaattttacccaacagcagagggttttgcctcaggtctatcccttatcaggcagggaaaccttcccccagaaaccccacattagacatcaacttatgattcattcttgaaatgtgtcatgggcctaaccctacatcaatcactggcaatggagactaggattagaataacaaattatgattcagtctctgaggctggacatggccacctctattagcagagaggaggaagatctggctgtgaggtggccagccaacactgtctgctccaactactggcagtggtccaataaattttacaaaaccaacaaaaagtaacaggaacagaatcagaacaagggggttgttcccacctaaattatgaggcagggatgagtgctagttctcaaacagaaattttcgtgagccagaatgtctcatttcctgagagttgtaggtaacttaggtgttactataatcatgtgtacttgatcactgcatagcatgatgtggcacacaggggagctcaataaatcttgtttaaagacagagaccaacctaaggggttaagcaaacttttctttcatggcaggattcagtaacccgtgtctacagaaataaggagagatatttataaggagagatatttataaaacacgaaacagtgatgcattggtcttatctttgctaagttcattcactgtttggccccacacaaggacttaaagatgtcttggcaggttagttcacccccagcttgtagatcacaggctcagagccccaactacataaccagctgattttgtgcttttctttccttatgtattaattacaatgaaggtctttaaagactcatttctcaactgaaattttttcacttattttttaccatatactttccaaaaagcttccctgaagtattgaacaagatggtgccttatctaacattgctcccctgtcgccatcacattaaccttaaggacttatcgccagctggaattgcctcgttcgctggtttaatgatccatgagaactaggacttgtctgcctttttcattgccatacccccagtgacaaggacaatacctgcccagagtggtctgcagtacatgcttgataaatgaatgaataaatccttaagttaaacagtgtctaggggcagaatataaacatgtcttaagacaacaccggttttgccagtgattttaaggttttgtatgctactctggttcatgcctctgataaatcaattagaaaacaagaattctcccattcacttgaaaatattactgtcttttctgcataacccttttaattgcatgtgcttattgaattaataagattgcattcagtcaaggcagactctggggatgttttcaaatgctttgaatttcccacacagacaatgcctacctgcttttctccctaaatcttaccaagctggggaataagtttcatatctgagagccagaggtagcccaagagaatattctttctatctcaggtctttgtcactttaggaatgttagggaaacatatctttatttctcctgcactccagttcaccttcattccaacagagaacaaaatctttctatttattttccaagtgacttctcatggtgtgaaaatgtctcacaatgaaaagtgaagtaaggaaaaaaagagaataagaagagttatcgtgaatgtgaatgagaaaattatgatttttattgttctctctgttctgaaatgggaagatataatcctgggaactgacctctcttcatcccactctctctggaatgtgctttgcaagagcatatgacagtaagacctggttctggtctttttatcctattgttcacacaactaaggatatggtttagatatatgtccccatccaaatgtcatgttgaaacgtaatctccaatgttgaaagcggggcctggtggaaggtgtccggatcataggcacggatccccttggtgataaatgagctcttgctctgagttcacaggcgatctggtggtttaaaagtgtgcggcacctcccacccactctctctcgcttgctcctgctttcgccatatgacatgcttgtcgctgcttcgccttctgccctgactgtaaactttctaaggcttcatcagaagccaagcagatgcccggtgcgatgcttcctgtacaacctgcagaactgtgagccaattaaaccgcttttccttataaattacccagtctcaggtacagcaatgcaagaatggacaaatacaaccactaacagaaaaaccctatcagaaactcaaagtcaagagtaagtgcatcagactgtattcctgcatggcaagataaatctatgaaaacagtaaaaatgactaactgtgctgccacacaagaactgcggaagaatgttttggctactattattccttaataggaataatatgtatacggcacatttcttttcttttagaagttgttgtcagcatatatttatgtcctttaatttattcttcccttacaaattattcttttctggtattattttcagaaagaatttgctgaagaacttacttaccatttgcctctcttcacttcatttttactattgctttctgtactaactggatgataatgaatgtgatgttaaaagtacaatcaccatttacttagcattttaatttgttccagaccctatttgttaagtcctcacacctacctttgaaggtgagggatcattagctccattttacagaggtggaaaccacagttcaaaaggttgaattgttgcccaaggacacacagtcagaagcttcagtacctggatttgaatctagagactgcggctggaagcctcaccctctccaggacaccgagctcaggcccaggatgatgcttccattacagagcgtcactatgtgccaatctggggcccagcccttgagctaaattattttatttattcttcaaaacaaacttacaaggtgggtgttaccactcccatttagccacaagaaaactgagcacaggaagttaagtaacttgattaaggttacagaactagtaagggcaaactacaaagtaaactctggctcatcagcttgaaagccccttctcagggcccctggcagaacatgcacaggtgtcaagaagagcagtcctccctgcctcgcagcaatgctttgctaaaacaggatttacaatagtcataagaacatgacataatatttaccaagtaagactctacggagtcccagccctaagtccccttatccccttgataaggctttgtgtgtgtgtgtgtgtgtgtgtgtgtgtgtgtgtgtgtgtgtgtgtacatataaaatgaggatactcttagatactgaagaagactggattgtctgtagttacttttagagtcactgaacataatgcttctcatttttaaaaccaaaaccactaataatatcttaattttaaagccaaacactctttgctggtccattctataaccaattacatgactgtttccagagaaaacctttcacatgtcttagtttagattcttcaaactctcccagtttaccaagcagaataataacgagaactaaatggaaattagggtccagcacagtattgggcaaaattgaatatttatagaacggttaaataagccacagatgaaatatcaagttgtcaatgtaatttatataacttttatttttatataatttcacatgtacagaaaaatacccatatacctttacccaaatagctaccaccaagaaatctctgttgtaacatttcaatcgccattccctctgaaataataacaaagcactttatttgagtattccgtattccccaaagctagctgtgaaagacctacatcacctcaaaaccttccatttggttccatagatcctgccatgtcacattcttgtaaccagctgcagggccatcttgttataactggttcatgtcctgctaaagctgagaggtgaagggctaaaaacacagtcctggcacagattccaggacaccccggcacaggcttgtttgaggacattgcctgggtaaacagcctcccctgaaagtgttcagtgtacaactcttcacagagcaatcgctcaaatgcgtggcagcacgcagacatgtctctcggcttctctccttgtctctgttgccttcctctccagtcggtgctttagaaatgctttattcccattgtccactgaaaatacaacctagattccttcagtaaatatctgttaaggaggtcacatgaaaagattgctccaactcattcttgctggtgggctcccaagggtaaaataatatagttcgtgtcttctcagtcatgaggaaaccattgtcactaaatctccctgggatgcttcctacatccaaccaaacaaagggagcgacagctgaggtctccaggtcaaaaacaaatatgtcaccttgctgagagatgatggcctgaaaaagaaaaaaaaaaatgaatgaagtgaaggatgagggaagagttatatagtctgtatacagttcctgtaaacatttatgtgggcttaacaaggagtccacttcccacaactttggttctacaactgctaaagtgcagtttcaaacacaaaacaatacatggaaaatgactacaggctatggaacgttaccaaattataatcacaaatcaaggaaatacatcgtctccaatcattaaggagaatatttcacaagaagctcaaagctttacatcttttacagtttttctcagagtatcatcaagagagcaacatttttacatacagcctgggtggttttaatgactttctaaggatatatctggacctagctacagagcccaactgtggagcttacattcaagtctcctgaaaagatccagcaatctagaaagtccactgccagaaatttacaaaagctctaccattagagcttatctcttttactgcatagttaagtaaagtcacattattagcattttttttacatgtgtgaattccacaaaatagcagcaaaaagagacagtgcaatttaaatcgtgttggctccattcctcttaagtagccgaatagcatatgcccagagtgaggatgcgctgctccccagagtgggagggtttgcaaacctctctttgtgtgagcacggagctgagtgcaacctggtttcttaatctgtgcatttgtcatgcaacatctcagtcttacattatatgttatgtgtgacataaagaatttcaaagggccattttcactatatataatttagccttacatatttgtgtaatatgttatcattcagggttctgagttatacacaaggaaacctatattgatagaagcagaaaagaagcttaataaagcgtatcaggttgctcttcaggatcagagactcaggcttgaatttggatggcaaattcccagatcgcaccgcccagctgttccagtgaaggtcctaaagcagccacaggaacaaggttcatgcggctcatgccagcctgcccaggaagctgccagggtagcatcagcttctgctgctccaagaccaaggccgaaagagatgctggtgtcatgcttatgctggttatcttcgttggattggaaatctcctctctgtatgtctgactgcagagcctgggattcaagcttgcaccctggcttcagggagacagggagaacaagtttctggcatctcccttgagaaaagaagccaaatacctagtctatattagccccgaattaaacattaactaacagtattattactatcattttatctctttaagaaggacaagtctcactgaaatcaaaatgagatagaacaaagaaagagccctgcttttctcccaccccaattacccacctcaaggtaatgaaggcctaactcaggaaagaaaaaaatttggttttcaaaatcataagtttagagactgaaaattcatccagtacatagtggttttttttttcttttttggaaaaaaatatatgtaagactgtcattttcttctgttctctattagttgttacagataacttggattttattatgtgactatagaaagaaggtatgttttcagttgttaggctctttcaaataaaacacaagaattaggtgtttttatatgattatttctaaattaaatgtagaaaatccctttctatgaagtaaaagtgtaaaacaaatttaaaattttctaaaaacagagaatgtaactttctagaaagatatttcctgagtgtccagaagataagataataaaattaaaaacatatatgtgtacatatatttccaactgctatgtgtaggggagaaggaaggaaaggttttcaacctactagacaaattccaaattctccagctgcacaatttttataacaacacatcctgatcatcccatttttatatcttggcaattataaaaagatttggtgattgagctactttgaagcaataaatcaaagagactagagtgaatattaatagactctacttaaaattagactgcgtcagctgggctccaatgcttcccagctacaggacctcgagctcatcacttaacctcctaaactggcttccaaacttacaaaatgcagatgataatgcctggagctgtggtgaaagtcagagactatgaggtgaagcacctagaacacagcctggaacctagtgggcatgcaggcagtggtgatgactcgagcttcctctcccatcactgcacctgcccactaaggaggggtgatgggacaaacgagtagtggtcaccagcaactctgacaaatcctggattcgaaatagaaatcatttggtgtttgcttttagtgggaagaggccaatcttcccccaggcctcaggtaaactcagcaccaagggggacacatgcaaatctcaggatgcaaggagctggcccaagagcaggagaaccccacaaggccacagtcccctgccctccgccatgacctgtgcttacagtgatctgcgccttgcagagccccacggcctccttcggtgaggacaagaagtggtagttggtcgggctcaggagttcatggtcagctgaaaggtaaaaggaaaccacacagctttcccgtgtgcaattcccacatctcctcagcaattcagacactggctcctcataaaggcagacagcctctcctcctttcatcacaaaacgttcagtcacacgagagcacacgggctccagggagctccatgtatggactctcacctggggagaaataaaacagaataaaaacaggcattcttggttgctatgtttttaaggaacaatagtagtaataattgctgaaagtcaggttagcagaaatggttaagagactatgaaacctgagttttaatcccagtcctgcaaaatactagctatgtgactaagtaacttctcagtcttcatttcttcatatgtagaatgaaaataacagcagtaatgtcacaggctgttgtgagaatttaaaaaataatccacggaaggcacagtacctggtgcgttgtaatttttctgtaaatgtgacctattttcagtgttattagtgtcctccaaactatagccacctaagactttgagtttctagcctttctttttacttaaatttgttttttaaaacaaatttgctttccacatgcgcattctgaatagttttactgattttcactataacatgccatttttaaccatttctttttataaagtttggactatttccagcctctcacaattataaataaccttgcatttaaggggcacattatagcatatgtgatttgctttcatctagttattttatttcctactcatagaaatcctgtaagaagagagactggtatcattttactgagaagaaattgaatcaacaagatgtgaagggttttgcttatggtcacatgattaatggcagggttgtagcctgaatatatgtattctaactctaaattaatttctcttttattttcccaaaagaatgtaaccaaacaactaaagaaatcatctaaaagtctccttcgatcttagaaaacaatccaagtaacttacactgagtgtcatcgaataatccgagtgaagatctgacacaccatagatatagaacgtgttttcattctcaaagcctactggcaacagtggagcaaagaaattctgagcaaagtaatgaagcattttccactttcctccgtactctgaaaataatcaagagtgtcaggagacggcaaggtcaagtagtcagagaggcactgtccaatggcccagctgtttgtggctcatcggggttctaagggagtgagcatgtgagggagagtcaacagtggagggcacccatgtttgtgaagcgctctgagcactctggacattatgtcatgtcaccctcacaacatctgggcaggcactaacgaaccagggcaggcattaacgaaccatgctgttaggcaatttcatcattgtgtgatcatagagtgtacttaaacaaaccaagatggtatagcctactacacacctagactatatggtatagcctgttgctccaggctactaacctgtacagcatattgctgtgctgaatactgtaggtaattctaatcatagaaatgggacagtgaaaatacagtattataatctcatgggaccaccatcatatatgaactgtgttgttgactgaaatgttatacggtgcatgactgtatataataacttatagattctaggtagctattgattgctttaatatataaccatttcgggtgataagagataacaaatacctcccctactgcacgcactagaagcagtggatttattgagccaatcaacatggggctgtgaggcccccagagcagaagcagatatagaaaacttgtcacagcttctcccggataacctttttgtctaataagtacaaggagctggtgatcctcctcaggcaggcaggatcctgccagggtttagaaaacagccaagctctggtacttgggttttcctactgtaatattattatatatacatatataatttttcttctacagttagatatggtttggctgtgcccctacccaaatctcatcttgaattgtagctcccacaattcccatgtgttgtaggagggacctggtaggaggtaactgaaccatgggggcaggtctttcctatgctgttcttgtgatagtgaataagtctcacgagatctgatcgttttataaagaaggagtttcctgcacaagtcctctcttacccactgccatgtaagaagtccctttgctcttccttcgtcttctgccatgattgtgaggtcttcccagccatgtggaactgtgagtccattaaacctctttttctttacaaattaccagtctcaggtatgtcttcatcagcagcatgagaacagactaatacaggttcctagctcacaactaccatagcccttgttacagactcttgttataatgttgagaagctttaggactcaaaagcaggcctcagaaaacagaatctatctctctgatctccttccctcctttcaccagcccaaggcaggtctctaatccgattgtgggtcataagacactcattcagaaggtgtcctgcctcataccctggaggaggaaatgcttcacagagaggccaagaagctgaatggacaggccttgctgtgtttccccactcagtctaatggtattagatcatacccgctttgtccaatcacatttctacatggttatcaatcatggctgtccaatgaagtctccctataacgcccaagaggacagagttcaaagaacttccacatagctgaccatgtgaaggctgacagaaagaggaacaagtattcatctacatgcctggagggtggcacaccccagcctcacagggataaagttcctgcactcaggacccttccagacttcaccccatatatctcttcatacggctgtttatttgtgtcttttaaaacatcctctgtaatacagcagttagaatgtttccttgagttctgtgagccattccagcaaattaaacccaaagaaggggtcatgggaaccccagcttgaagctggtcagtcagaagttctagaggcccagacttgcgactgctgtctaaagagggaaggcagctttgtggaactgagttctcaacctatggaatctgatgcaatctgcaggtagatagtgtcagacttaaattggagggcactcgcatggtgtccactgcagaagtgattgcttgcttggtgtgtgggggaagtttcccatatatttggtcacagaagtcttctgtgtggattgttgttgtggagtgagggaattaacaaagcacttttaggccaggtgcggtggctcatgcctgtaatcccaacactttgggaagctgaggagggtagactgcttcagaccaggtgttcaagaccagcctgggcaacatggcaaaaccctgtctccagaaaaaaaatacaaaaatgagccaggcatggtggtatgcagctatagacccaggtactcaggaagttgaggtgggaggaaggcttgagcctgtggggtggaggctacagtgagccatgattgcaccactgcactccagcctgggcaaaagcagagtgagaccatctcaacaaaaaaacaaaacaaaacaaaaaaccacttagagtttgagtgtcttgtttcccacagacctactcttcctgaggaactcaggaataatctgcatgggatcacttaaaggaatatttacaaaaattgggctctcccatttcttgaatcgaactcagtttcagtccacaacctcatccacagacagaaagcaggatcagtatccaagagtctctgaacagttatctctttgcctacctttccagcatcccagaaggattttccccccaattctacccctgattctcattcaatgctctcttatctggttggtgctgataaagagtttggtcagagaaatttgattagaaatccaattctctgtaagagtcatccatctggcactaatgaaaacatgtttggaatgaatttcttttgatctgcattcacagccagtttaagagcctcacccctgcactctagcctgggtgtcagaacaagactctgtctcaaaaaaaacaaaaagaacctcacccaacctttctactttgtggccttgcctcgtttttgaccccaaactattctttacattattaactgaactttgtttcaagtcatctctagtgaagggcaaagactattattccttaattttttttaatgtaccagaatagatgggataattcgaactgcaggttccatgccagtcatctcacctgttgctagttgaactgtttcaactggtcacctttcccattcgggattctgcctctactagcttttccccaagagctaaacagggcataataaagatggccttaagagacatcttcattatgtccttaaaggacatctttatttgtccttaaaggtgaatcagagaaagggaaactttaacacataagcgggccaaacttctacctgattgaattctccaacacagaagaagggatgcttaagttcatgcttctttagccctggaatgccctcttaaataaattcaaaattctatgcgtaataacaagacacatggctgagacttttgtataggaatctatcccatgcttagcctgctgttgcaactttgcacagcacagaacccataattaggttgaccctaaggctcatggaaaggctactaaggtgagttgggtggctgtagttcctaggcaggctttttaaagaatgactcttttggtcatagttctgcctgggctaatctgacccctccagcactgtgctttctcagtccctctccccacagtgttgctttctctcactcgcacaaagaacgctgaaatgcttaccaagagaagcccaggaaggagcttgccagatgtcattcaactgccaataaagtgcccccatcgtgtgcccttgctgatccactatctcgctgcgactacggcggtagaattcagtttctgttttgacacactgggcctgcatcacctgattcaggaaaacattcatacacaggtgttattgtttgatgtagactgcctagatctgagaaaaatacagggtttagttttgttttgggttttttctttttggagcaatttggataaaattagggaatttaattagtattaggaatacattatactagatctgtaactagccccttagcatgagagaagctgttgtctgtaacagtgggtttgtctggtagacttggtgtttcattatggtgacaatggaaataggatggtgtaaaaggttctctgctaatgatagtgtaggccgtaaagaaaaacaaagactactattccagagcaaatgctatatatagtccaaaactagattattttcactgaaaaattttgctaataccttcatagctatttttaagaaaaacttttactagaaaaaattctataagaaaaataacattgttattatgagtctgatattatccaatccctaattattttttctagtcaaacaattgttttgatgtcatgatttttggtaatgtaagatttctcatgaatgcaattccttcgttgtagcagaacagatggcaaattgcagcaatgagacaaatgaatttagttcttgtttaagagacactaaagaacttcacacaggacccttgattaccgacaccatcatggaaaaatcagtctcttttatcgctgccgttaccgacacatatgaatcacatgctcttagcctggagttgtgctgaggaggggctcatgaatggaccactgaggagaacccagagatggtcagagcagcgaggatttcagagaacaagaaggccttagaatagggctggggttttcacagaggaataaaaagaatggtgcatatggccaccaaaagactaagtcgagacgctttcccataaaagcaaaaaagctcagataaaggtagaacctttaaatagaggaaggctgaccagtaaggaagtcatagatgaggttatgacttacatgagtcacagccatcaaattccagaacggaagccagaagaaattgtggtcagtcaataaatatttaataagaacctgcaggatatgttacatactgagaatggtgggcacccctgccagaaaaaaatgatacagcccaccatatggagcttatcagcttgtgtagaagacagtccttcatcaaagaatcacagaaagatacgtaatcattaaacagtaccaatgctaagtagaagaggtatgcaatgttacaagctcatatggtggggcaattgggcagagctgtagagtgaggattggcctaaaagaagaggaatgggaaaaagagagagggcagaaccttccagagaggacaatacaccattggaggaggatgccaggtcagctaagaactgaaggaaggccaagaaggcctgagcacaggaagccgggagcaatggaagagaagctggtgagaattgcaggggccagaccctggaaggccacatgttgaaggtgttggtgtgcatcctaaaggcaaatggaggtcacaaaaggcttttgaactaaagggtgatgtgagcagatttacatttccaaaagatgactgagactactgaaggaggaagggcttgcaagggggctagagtggatttaggtagaccatttaggcaagagatggttttagctatgagcagacaaagcaatgtcttctcattcaggaaccagaccactaggaccacagcaacagtagctggaaaaaatgttctaaagcaagaatctcacaaagcaagcagcattggtgccacctcaaaatgaccatggcccctataaacatttgagttttcagtctctaaactatatcaattttcagcattatctgcaagatatatttatttctatatatccattctaacattaatctcctcactataagttattttttcctggtttaataggtaaaacttattagttccttagaattttcaaaatttgaaaaaattttaaatgcaagtaggattcctaaccctcactagcaatgaaaagaaaagagcacaaagtggctctatctagtagcctctcttacaggaaattagcatgaaagagcataaccaagactcttttgtgctccaggctctggcacagtgcagtacactccacacacagatggtaccatgctaataacatggacctgaatctatccaaaccagtgggtaccagtcaaggctaatgaatgacacctttgttcataaaaatgcagaaggctattgcccactaaacttcttaaaggggtgttgtacaatcctagttccctggaaaatctctagaacttccccttcccctttaaaaactgtacctatatttacacatccatgcatcctttcctaaaaagggcaatctttacacataagagggataaatgcttagtcattttctaggttatccagtccactgttagcagacaaatgaattttagttttaaaaatatgcctatttggctgggcgcgatagctcatgcctgtaatcccagcactttgggaggctggggtgggtgaatcacgaggtcaggagatggagatcatcctggctaacacggtgaaaccccgtctctactaaaaatacaaaaaattaaccggacgtggtggcacatgcctgtagtcccagctactcgggaagctgaggcaggagaatggcttgaacttgggaggcagaggttgcagtgagccgagatcaagccactgcactccagcctggacaacagagcgagactctgtctaaaaaagaagaaaagaaaaaaatgcctattctcagcagcttgcttgattacacttatgaaatgagtctcctatgagagacagatggtatggtgagaagaaattggatcaagatacgaagacctaagttccagttccagcactgccactggtggttgctagctgtcttccaaaaccaatatccctttcctccagagtgatggagttgtagctggactacattttccagaaacacaccccaacccctgggactttgagtagccatgtgactaagttccctcaatatctatatactttatttactaaaattatcccgacactaagaatcttccaacaaagctgttttaaaaccaagatataattcacataccataaaattcatcattttagaggttataattcattggtttttagcacagtcataaggttgcacaactctttccactatctaattccagaatattttcatcaccccaaaaagaaacaccatactgggaagcagtcactccccatcctcccctctccccggcttctggaaaccacttaatctacttcctctgttctgggatttgcctattccggacatttcacataaatggaatgataaaatatgtggcttctgtgactggcttcctttttatttctgaataatattttattgtatggagatgctacattttgcttgtctattcgtcagctgaaaaattaggttatttcccctttttggctactatgaacaatgctgctatgaatctgtgaacaggtttttgcatgaacatatgctttcaattttcttgagtatatatacctaagagtaaaattgctgggtcatatggcaaactctatgtctaactttttaaggaattaacaaactgtttaccgcagcagctgaactgttttacattcccaccagcaacatatgagggttccaatttctccacatccttgccaatactcattattttccttttttaaaaatttgtagatattgtagtggatataactggtatctcactgtggttttgatttgcatttctctaataactaatgatgttgagcatctttctatgtgtttactggtcattttctttaaagaagtgtttattcaaagcctttaccaatttttcaattgggttgtctttttcactattgagttctaagagttctttatatattctggatgctggatccctatcagacatatggtttgtaaattttttctttcattctggggattatcttttcattttctcgatagcgtcttttgccatacaaaaggtatttttgttttctgtttttgatgacatacaatttgcctattttttctttggttaatttctttgatggcaaatttaagaaactgttgcctaaccaaaagccataaaatttatacctatgtttccttctaagagttttatagttttagctattacatatagatctttgatccattttgagttaatttttgtatatggtatgaggtagtggtctgaatttattcttttgcatgtggatatccaattgttccagcaccacttgttgaaaacatgattcttcctcccattttattctttttaccatttggaatgtaaattagtacagccattatgcaaaacagtatggaggcttcccaaactattaaaaatagaactactatatgatccagcagtcccactactgtgtatctatccaaaggaaatgaaatcagtatgttgaagagatatccacactcccatgttcattacagcattatttacaatagccaagatatgaaatcaacagatgagtacataaagaaaatgtgatacatatacacaatagaatacgatccagccttaaaaataaaggaaatcctgtcagttgtgacaacctggaagaaactggaggacatcatgttaagtgaaataagtcatgcacagacaaacaaatactacatgatctcacgtatacatggaattgaaaaaagttaaactcatagaagcacagagtagaatggtgggctggatgggggaaagaggaagtaccaaggagatgctggtcaatgaatacaaaatttcaattaggagaaataagttcaagagatctattgtaaaacatggtaactataattaataatgtattgtatatttgaaaattgctaacagggtagattttaagtgttctcactacaaaaaagataagtacgtgaagcaatgcatatgtttaacagcttgaattagccattccataatgtacacatataccaaaacatcatgttgtacaccacaaatatatatttttaatttatcaattaaaataaagaaatattaatttttttaaaaaaagaaaatcagttgaccataaatgtatatttgttcctggattctcaattttattgaatcaatctattatatataccttgtcttttgtcattaccacactgtcctgattactacagctttgaagtaagttttaaaatctttttttcaacagtataagatttgtcaaatgctttttcttcatttattgagatgatcatgtgtattttttctttctttactaatatggtttattatactgattaactttcatatatcgaatcaatcttgcattcctgggatatttcccacatagttatgctatataatcctttgtatatgctgctggatttggattgataccattttattgaggatttttttctgtctacattcacaaatgatatgagtctgtaggttgcttttcatgagatatgtttgtctggttttggtatcacagtaatgttggcttcacagaatgagttaagtgtttcctcctcttattactaattttttagggagttaatgaggggtttcttttaattcttctttaaacattcttagaattcactagtgaagccatctggtcctggatttttctttttacgggaaggtttttttgtttgtttttgttttttaactaactcaatctccttagttgttatagggctattaagattttctatttcttcttaattcagttttcatgggttgtttctctaggaattcatccatttcatctaaattaactgacttgttgccatataattgtgtatatattctcttatcaccttatttattttggtaaggtgagtagtaatatttcctctttcattcctgacttagtaattcaagtgtcctctcttttttctgggccagtctaactaaaggtttgtcaattttgttgatctattcaaagaactaacttttggcttcactggttttctccagtgttctaatgaggtctttatttaatgtgccaaatttctgatgcccactttacttaattgctgaaaattactgttaacaatttaaccaaacaccattattgcaactgtgaagggatagaatattacagtttaaaaagcagaaaccctactccattcattgccctgagtccttaggcaaaatatttaacttttctgagactctgtttcctcatgtatgaaatggaaagagtgatatgggtgtctggagataatgtgagaattaaatgataagatttacaaagcagttcatgacccaggaccaggcaggcatttagtagatacccaaagaatgctacatattggcttgattattaaattacatgatgcctatacaaactcctaatatataatacacaatgttaatggtcactctttcattcccctcctttgcccaccctactctcatcttaaaagctcagtatgacctggatcttccatcgtgtctcagtgctacttaccaaacaaataaccattccagggcagcaggtatcatcaaaacctgggcctacagcatcacctaccttttgtcctagttcttatgatcaagttacttacagcacaggaagataaaatgggcctctaaagaaaatgagtttctcaagaacatccccaagccatcattagatattcaatagacacatgaagaataaacaaaagcactagaaaaggctgtaagctaagggcttggtaattaatgtccttggcctggcctgctctcttagtggccaataagaggccgtgctggtagagtaagacactcaaaagttagtttagatatgttcatttagatagttggtcctcaaactagagagtgagatctgtgtaacatagctaaagagggtgtgctcatgtatatgggctattgggaatacaatataacagggcaagagggagagtaaaaggtaaggcaagattatcctggaatactaggagaattaaagaggcaggagcccatagggatatctttttggctataagacaaagagaagatagggaaggatccaaacgtgaagaaatttactggacagttttctcagcgaagactttgctaacagttgcaaatattccttaattaataaatcttctaaaaagtggcacataggcaagcactctgttcttcagaacagtatgacagactatgagaaaaagaacaggggttggagtaggaacatagaaagtggaacagagaagggttttatttctaatacacagattaaagaggactgttctaaaatcaaagtaacaaggaaaaaccctaaaaccctaacatttcctgtctgtatttcagtcaagaaaatctgacactgaaaacaaaataaaataatcataatcctgatttctttcatcacagatagcatctagtatgttggaaagtgccaaggtagacactaacaagccacacgaggacaagtccaattctgagccaaagcctgagaggacactagtgctaaattctcagacaaaaccatcaccaacaaaaactggcaacaaataactccacttgcatgcccagttcctaactatggaccttgaatgctgataagttcagaaaagaaaaattatttctatcagttcttggaatataattttgaggaaaagaataaagttagagtaataaacagctggaaggaggaaatccagcataaaaaacaatagcagaaaagtctcttatacacacacacacacaaataataatcagcctattttatatgtcagaacactttaacagagtattatctgtggaaaacttgaaagataaagtgcaacacttttcaagggacagataccaacattgcctttaaccttgtgttctggtaagttcatgaattacatataaccctggcaaaactttcctaacctataagattatgattgaaacattaaaattctcctaatcatttcatcaccttctaaaaaagattattctttcagcttacagttttctgctttagtttctatcatggggtttgtgttttcatacaggagaaaactgatgaaggtgtgagcatgagtttggattaaaattcatacatttttagatactaagataggaaaatttaactgtgattatgtttttaaaaatttcctgtctacttcagatcaactttattattgggattaggcttttacctcctctctaagaactttaaacaagtatggcaaaactagcaggtaaataaacagcgactttaatggagtcttaagtgtggtcacaggttcatgaactaaaataggcaaatgaaaaaagtaaaatgaaaccattatccaaaattcagtttggcagtttcttaaaaaaaatacataaatttgttatataactcagaaattccatttctaccctttgaaaaggaaatctatgtccatacgaagatttgtatatgagtattcctaacagcattattcataatagccaaaaattggaatacgatataacaaatgtccagcaacagatgaacctgacgaatggataagcaaaatgtgtataaccataaaactgaatagtatttggcaagaaaaaggacatgaactatacatgctataacatggatgatcttcaaaaactttatgctaggtgaaagaagccagatgcaaaagatcacatattgtataattccatttatataaaatgttgagaaaagtaaaatctatagagacagaaaatagatttatgttgtcttgcagctggaggtgggaaaggggagtgactgtaaatgggtacaagggatctttttagaatgacagaaatattctaaaattggatcatagtgatggttgcaccactctataaatatcacttaactgtacccttaagatgtgtgaattttatgatatgtccatcaaaacttgatagaactgtttttaaaatccagcaaggtgcatgccataacattcacaaatcttttgatacatgcacacatccatgtgactaccactcagatcaagatagaaaacagaaagttctcttgtaccccttcctaatcattgctcacaccctcctccacaagtgtagttaatactactttgctctctatcatcttgattgtttttttttctaatatgtacttttttctataatatacttaaatttcaatatagaagaaatcagtacagttatgtatccttttatgtctggtttcttttactcaatgtaatacctgcaagactcatccaagctgatgctgattatcagtagtttattctttttttattgctgtggagtattccactgtatgaatatactacaatttgtttataaattctcctgttaaaagacatttaggttgtttctactttggggctattgtgaataatgctgctatgaacattatttgagatatccattggtggacatatgaactcatttttcctagtgcatagctaggagcagaaatgctgattcaaaagggaagcaaacatttagcttaggtagaaactgccataaaattttccaaagtggttaaacaaatttaaactcctactaacaatgtctaaaatttccagctgtctcgcttcctcaccagcagttgttattatcaatctttttaattttagccattctgctgggtgtgtaggggtatactggtatggctttaatttgcatgttcttgatttacaacaagattgggcacattttcagatatttattgacgctttggatatcttctttagtgaagctccagttcaagatttttgtccatttttaaatagattgtctgactttttcttattgctttattctggatacaaatctttttatcaaatatatgaattaaaactattggtccccaatttgtggcttgccttttctctctcttaatggtgttttttatacttaatggtgtccataatttcaatggagtataatttatcaatactttcttttctagttagtgctttttatgttctatataaaaactctcacctatcccaaaatcatgaagctattccatgttttctcgaagctttattgtagtacctttcacatttgagtcttcagtcattggtcaaatgaagtttctaaaatttattattattttttagagatagggttcttgacattttgcccaggctggtctcaaactcctaggctcaatcaatcctcccacctcagcctcccaagtagttgggactacaggtgtgtgccaccatgctcaacaatcaaattaacttgtatatggagtcaagttcatttcttttcccataaaggtatccacgtgattcaccactgtttattgataaaatgattgttctcatactcaattgtggtggcatcacagccataaatcaggtgtccatattatacagtgatctgtttctggactctattgtgtcccattgttctattttatccttgggaaatggcactgtcttaattactaaccctttagagcaatcttgaagtagagaatattttcatacacaatttatttcagaattttgtgagctgtttttgtaagagaggcaaatgccaaaaatgaactatttcatgtcctatgtgtcatcatatatgttctttgaagaaaataaattccttaaccagtggaatgaaaacctgaatatttttcaccatatatggcctacaaaatctacataatctcttacattaattgcaggaacctgttcaattctagaatgaaaacaacttacctgagtaaggtagatggtatctttaaatgtgcgtaatggatctgtgctttgggggagtttgaaatgaagtccagcctgataaagcatttgtttgttaccaccttcgtgatgttgtcgatgaagtgaaaacttgctattgaaagaccagtcctctgtagacgagacctttcaaataaagaataagaattagaaatctgaaagttggcagtaaaactacttttctataagttcctgacaaacctggaaagtatcctaaacactagagaagaccttgaggtttgttctgtggctccagtttcataaatgttttaccatcctacttgttgccagtgaaggactagccttgtggaaactggaatcacaaaaccagggtttggtacatatatcctcccttcctccaactaagaaagttatattttgatgtttctcttaagactcttgttttatcaaaacatattcctggtttttgaaacatccactatatgtatttttaaatatcattttatctacttaggtaaacattttatctagtattcgtttgtcaaaacttaatagaatgcaatcaacactgttaaaactgtcacaattcttaaataggaataaaacacctattacactataatagggatactatgagagtagatgctttagcacttacactgttcacttgtttctcagtgattactaaatgaaactgatatacatatgtttaatttttatatagttgaagacacaaaccaaataatgttacttctctcccctaaaaaatcaattttttatggtttaagccaggcccaaattataggatctttattttatcccctaacttacaggatctttcttttgtcgtcagctcaaattaaaaaacaaagtaaaaaaaactcacatatgttggagtataccttctacaaaaaaagagaaaaaagcaataattctggcttctaggcctataatttaatgcactgttagcatttaagaaagaagacaattgctggctacatctgaaaatatccagagttttaattcaagttacacagactttgaaaaaacatactctgcccctccacccaaaaacctgaaaattaaaaaagcttaatccctgttcataaagtatgacttttcattcccagtaatcaagcaacacatgggcccattaccttaaaaggaaaaggttatccttcaggaactgattcatacccaaatataagaaatgtacactagccatattaaatttggaagtttttcctaattacagatgtttttccaaaatgccaccaccagaattaaataatgctaactactcctattatgtatttaaaggagagattcacattgacaatcatctcgcacactttttagacacacatcctttatcaatagtcttcctacgcttcctcctcttaatttattttatttatgtttattatttttaattgacacaataagtgtacacatttatggggtaccatgttataatttgatacatgtatacaatgtataaggatcaaatcaggctaataagcaaattcatcacctcaaacatttatcatttctttgtgtcgggaacactcaaaattatctcttctagctatttgaaaatatacaataaattattattaactatagttaccccaaagtgctatagaacaccagaacttattcttcccatctagctatacttttgtatcaattaaccaactctattgtccctccctggcaacccttccaccctctagtaatcattattccactctacttctttgagctgaacttttttagctttcacattggagtgtccttcctccttttcaaagtctgaaatatacctttgggccatgcagccttcttatttgtaataatttgaatctatcccataatcagtaaacctgatctttagttacgtgggaggctttctaccttctcataactatggtgtgaaaatctttcaaatttcagctataataatattaccagaaagaactggaaatggccaggcaaagttctaattactttaagaatattaactttttttaaaaaaagaatattaacttatttggtactcataaaaacccggccggatgcagtgtttcacacctgtaatcccagcactttgggaggctgaggtgggaggattgcttgagcccaggagttcaagaccagcctggacaacgtagtgagaccccatctctacaaaaagaaaaataaaaaatcagcctggtgtggtggcacatgcctgtagtcccagctacttgggaggctaaagtgggatgattgcttgagcccacgagtttgaggctgcagtgagttgtgatcacgccactgcactccagcctgggtgacacagctagaccctctctcaaaacaaaaaacaaaacaagctctatgagtaggtactattatcaccccattttacagatgtgaaaaccaggcacagaaaggttagataacttcttcagtatccaaatctaatgcagtctagctccagtccctagttcattaaacccagaaggatctgaagaaaatcgaactgtcatacaaatcatatggttaaaatggtctatactaaaggtaaatagtttacatttcatgggctctcactgtgtcaggtagagtgctgagtgcttcaatgtattagttaacttaatctttactcataaacacacgcgcatatgcagatctacatgcacacacacacacacacacacacacacacacacacacacacacacaaggtatttactaccattaaccccaatttacagatgaggaaactgaaattcagaaagattaaataatctgtccaagatgatacagataatgaatggcagctgtcatattcaatccagttctgtttattccaaagcccaaacttttaatcaccgtgcaatattgataatcacatgttaaaattatattttatgaaaaatcaatgtatcccaaattaaagagatatgttttaatcaagttgttgaatacatgaaagagcttctaaataaaagagccaaagttttatttagtttttcttttggtttattttattttcccaatcacctattcaaattctcaactaagcagtgtagcttaaaaaaagatgagtaaatcaagagataacaaatgattcataatgagcagcacttatcctcaactttttctattttaaaatatagtgtttattatctctgaacatcatcaggcatttcacaaaaatatgggataaaaataattccattatttgaaggaggccagtagaaattattatagatttaaggaaaaggtttagcaatttctaacactaatctttctaaagcgtggtgaaaagaaaatctatcagctctggagacagagagtaagtctgaacccagctacttattgtcgagaatgggaaggaaggaatgaaggaagcaagaatatttactgaattattgcttgtgtgccaggtcctcactcttttattagacaatactctacccactccactttgcctgaggcccaaaaggaaatcaaagcactgcagggtgggagatctatctgtgacctcttgcagtactttgatttccccctgggtctcaaagtggagtgggtagattattgtcgaattaaagaatgagtacgtggtacacagcaattattcagtaaatattcttgcttccttcattccttccttcccattctcaacacttgttcctacctgcgtcaggatactgaacttcatcctccttcactctgaaacaacagtattcccaaaagattagccccacaatttgggagcaattaaaaaacggggtatggaatttcacaatgtatatatgtttcaaaacatcacgtagtacacgataagtatatacaatttttcgttaattaattttttaattttaaaaaaccaaaggtagagctaaggttatgacatcattaaagttaaaagtacaatataacttcaatgtgtataagcaaattatagttgtgttcaggtagcgaaattgaaaaagattttgaaattgtcttaaaagactttttttggttactttatacaactgatgcagggggagcaaaatcacataatcatttcaatagatgaagaaaaagcacttgaaaaatgcaacattctttcatgatataagcactcagctaactagaaataaaagggaccttccttgaccttataaaggacatctactaaaaacctattgtcaatataacactaaatggtaaatcattgaaatgtactccctaagaaaaagaacaactcaaggatatctcgtcttcccactcattttctacattgtatgaaaagttctagccagggaaattaagaaaatgaaataaaaggcttccagattggaaaggaagaagcaatattattaatatctctatttatagatgacatgatcttatatatagaaaatgctaaagaatatcctccaaaatattattagagctaataaatgagatcagccactttgtaggattcaagcgcaatatacaaaaatcatctgtatttttatacgttagcaatgaacaacctaaaaatgaaattaagaaaataatttatttacaatagcgtcaggaagaataaaacacttaggaaaaagtaaaccaaagaagcgtaagactggtacactgaaaactacagtgttgaaagaaattaaagaagacatcccatgttcatgcatcagaagatttaatattactagatggcaatactcacaaactgatcaacagattcaacataatctctatcaaaatcccagctagcttttctgcagaaattggcaaatagatcccaagactcatttggaaatgcaagccacccaggatagtaaaaagaaatcttgaaaaaaagaacaaaattggtggactcacacttcctaatgtcaaaacttactacaaagctatagtaatcaagacagtgcatagtgacatgaaatatgccactggaacagaattgagaattcagaaataaaccctaacttttatggtcaattgattttcagggccaaaagaatttaatgggggaaagaatagtgtttttaatacatgctattggaacaactggctatacacatgcagaagaatgaacctgaactcctaccttctaccatacataaaaaataacccaaaatgatcatagacttgaatgcaagagctaaaactataaaattcttagaagacaacacagaaataaacctttgccatttggggtgaggcaatgatttctcagatgcaacaccaaaaagaacagattggtaagtaaaacttcatcaaaatttaaattttttgtgctgtaagtgataccatcaaagtgaataaggtgacaacccacagactgggagaaaatatttgcaaatcatatacctgataaaatcttatagccagaatatatttttttaattttcataattcaataaaataaagacaaataattttaaaatgatcaggccatgcatagtggctcacacctgtaagcccagcactttgggagcccgaggtaggaagatcacttgagctcaggagttccagaccagcctggatgatttggtgaaactccgtctctataaaaaatacaaaaattagctgggtgtggtggcacacacttgtagtcccagcttcttggggatgctgaggcaggaggattgcttcagcctgagaggtcaaatctgcagtgagccgtgaccactccactgcacaccagcctgggcaacaaagcaagaccctgtctctatttaaaaaacaaaatggctaaaggatttgaacagacatttctcaaaggaagatatacaaatggccagtaagcacgtgaaaaaaaaatgctcaacatgattagccatcaaggatatgcaaatttcctgtaaatgtaaattcccagggaaatgtgaagaaaaaaagaaaataacaagtgttggcaaggatgtagaaaaattggaaccctaatcccttgctggtagaaatgcaaaatggtgcaatcactacagaaaacaatttgacatttccttagaatgttaaagatagagctaccatatgacccagcaattccactcctagatatatatattcagtagaattgaaaacatgtattcacacaaaacatgtacacaaatgttcccagcagcattattcataatagccaaacagaggaaacaacacaaatgtccatcaactgataaatagataaacaaaacgtagtgtatatccatgcaacagaatgttattcagcaataaaaaaaaggaacatactaatacatggtcaacatggatgaaccctgaaaacacagtcaaagaatcagtctcaaaagaccacacattatattattccaattatatgaaatatgaagaataaggaaactatagacacagaaagtagattcgtagtgcctaaaactggggaggagggatagggaaaaatagggagtggttgctaatgggttcagggtttcttttgagtgataaaaatgttctaaaattaaattgtggtgctggctgcacatctctgtgaatatattgaagactattaaattgtacacattaaatgggtgcattgtatggcaagtgaattatatctcaataaagctattttaagaagaacacacacaatgctgaaacggaatctttaggaacagagagagtgaaaatccatacagaaaataaaacacaccaacatgatgaaaaagagggagagagaggagtggggtggggggggggtgggcggtggtaatggaataggaggagaaagaggagagaaaaggtaagatgacaacattagactaaggtttatttatcacatttaccctcttcctgtagtgaaatatccagctctgaatatctgtaaacggtaaaacagttgcaggatatgatttacaagcaagagttattgtagcaagtaagagttatttccgtgtgtgataataagtcaggcttaagcaaccactgggtcccattcagtgctttcggtgctcctgaaggaacacagtaaaagcaatatagaaaagtaatccccaaaggtttaaaaaaattattttcctccatcttcttctcaaactttcatttaaataagacgtaggtttcatatgattttctgaaccagtgatcagaataaacacatgcccacagtctatcattctgaaacattagaaaatcaaacgatgacttaccttttctaatgtactgaaggacggccaggactgatatccatattcagatgcaaatcgagcttttgggaaaactttccagttccagcaatcactgatatagtcataaaaatgtacatcaccaaaataattgctattagggttttgagagacccaggcttctgcaacagtttcagccccatttgtaggactggacgtaataaaaggacgactcttgtctccctgagttcagaaataaaatgaattcaaggataatatattcatcctgtaaagtatgtatcatttacttctttaaaaatactaacaagtccctgaaatgccaagtagctgatagaaaattagtaggaccacttaccttcttccctattcaacaaccaccagcacctctctgctcttcgccaatcctttatatcttttcataagtaacacttagctcatccctcacagcagctgttcttaatcttttcaatcatgttttgcctccactctcatccatcatgggtggtgtacagtctagtccagagtttcttaactttgacactattgacattttgagctggatacgtttttgttggggttggctggggttgggggtgtcttatgcattgtaggatatttagtagcatccctggcctctaccaaacagatgtcagtacccctcccccaaccttgaaaaatgtctgcaggcactgccaaatgttccatgggggcaaaatcaccatcacttgagaaccacaggtctaacaggtaagaacagaagctactgagtcagatggacccaaacgtgactttaaatctcaaatctgaaccttattatttgtggacaggtctaagccttggtagatttatctgtaagatgaggataataatagtacctcctttagaggtattataaatagtaaataactctcatgtgaaagtaatggctaggtgtccaccaattcatgttctcgtttctgtaatatagagccatccctaggaagtggcttcctagcccatatggggccatgtgcctcattctcatcctctgcccccatttgcagctgagggtgcaagagatggtgcagctggaataaggtgtctatatctctgaaagaggagctgccagcagccctttcatagtgtcagtgaggaagaaatacacttttattatgtaaaccactgaaatactgtggcttacctgttacaacatctagcatgtaagcacttaacagggtgcctagcacactgtgagaactcaaaatatagttactatcatctcagtagatgagactacttcctatttcactgagaagattcattcatttagcaagtattcgtcaagtctattgtgtctggcatttttccacactgcagagggagggagagagacagagaaagagagagagagagaaagagagagaatctatgactctgtcaagtacttatacaacaaatctcttttgagtatttcctattggccaggcatgcagttctttctatgtgctggaggttcagcagacagccatggtgaccgtcttggaagagtagatggcaatttagtgctgaaaccagatactgaacaagtaattataagtatgatgaatattttgaaggaaaagcgcaaggctctttgggaatgtaaaacatattacagaaggccagtaagccttccctgagagatagacttccagaaaataattttctcaacttttcaccattaggtttcactttttcgtggtatatccattcatatttcatttcttgtttctattctgctattaagaaaaaaaaatccttaaccctttcctttgccagactctgtgttctggtcatctttctagtttgctttggtactatagccaacaaactatcttccactccatttttttcttaatctccctctactgcccttttcccttagcttccttaggactccctttatcctaataaaaagtccctttgatcccttgtagtccatcagatttctttaccatcctctcattcctaaacccctgacattcatttcctgatcatttcactccactgaaatgtttttcaaaaattacccatgaacttctacttactaaataaagcagttctttctgtccccacttattccctctcaggtgtgcaataaatgaccctatttaccacctattatttctgaagctctctccactcctggctgtttgttcacaattcttccacattccagtttcccccaaccttcctgattcttccttctccagctaccctctccatccccagatggacactctacctctctctcaggcttctccttgttctacaccctgtcccatggcttcccgtcacatggatgttctgattactcctagccacacctgcacacttgacctcatgttcaccaccacacattgctgataaccagctccacatttccacctgtgttgtcttgccaacatcgcaaatccaaccttttaaagcagaattctttatttactaattccaaacttatctgactatgctccctttcttgctgaacggtacccagattggagtcatcttcaatttctccctctcttacctcccacattcagtcactctgagtagtagcaactctacattcagatatttttttccatcaccgaatttccaatcccacaccactggactccactacctatgacctccatgaccttggggacttaatgactctaaaataaatatatcacctacactccaggtaacttctaaaaattaagtaaataaattatacaaagcacttacataattaactttttaaaaatttgttttttaaaatttaaaaaaaattgttaaaagacagaatgttgcccaggctggagtgcagtggcatgatcatagctcactgcagcctcgaccttctgggctcaaaataagcctcccgcctcagcttcccaagtagctaggactacaggcacatgtcactatgcccaaagaattttttaaatttttttggagacaggatctggctacatcacccaggctggtctcaaactcctggcctcaaatgttccccctgcctcagctcccaagtcactggggttacaggtgtaagtcaccacatccagctttaatttaatatattaatatataataatattaatataataattataattaatatattgatgcctggcatctcagtaacttggagttcttagttgttataactggtttccttgtttagaacctctcacctccctaatctttgctagtaatcttccataaacatggaccagataaagttcctcctctcccccaaaatgtccactagcttcccaccatctaccgaataagctcaactccataatatgatttaaagtccctctatgacctgcttccagtcttcactaccttccattctcccacagtaatccaggagtcccttgctcttaggcaccaggcactgcttgctgctcattatacataccacctactttcacatctttttacctttatttacattgttttcatgacctaaagtactactagacaatgctttgcctcaaaattctccacctgtaaggtttcccttgaatgtaaccttttactcgaaagcctttttagattctttcagttaaaattaatggttctgccacatagttcccagcattttgaagctacattttttatagcactttttttaactgcccaaggtctgataatttttcccatgtttccctttgacagcagagtgtaagctccacaaagataagagtgtcccccacagcatcgggaatgaggctttgctcttggcaataagtactcagtagatgttgggtgaatttaaaaatattaaaaagtatgatgaaactataggtgatactaaatgtttaaaaatatttttgctacaatggctttgaagaacattgaagaagaaggccagtcaattggccttgattgatcaagcttgacagatttcccttcattccttgagattcttgagaaatttggcacgctgagccatgcagtaaaattacaaacaagtctctacctaaaaatatctggctttgacgatgcattataatttccttccacttataaatcctttattcttgaggtgtggttatttgttgcaaatctcacagatgacatctttctaagccatgaccttaaacccttagttggaccaggaaataccataaggtgatccaagagaatggccataaaaagaaagcatgtgcagcaggaaaccaatcattacagccaatttgtagatgaatcaatttatggtactttccctttttatgatgcctaatactttgatggaaactaaaagcagtagtggttatgtagcttttaatactattcatctttgaaaaaatttacaaacatcagttattgcccatggctcgttttaagataaataagtccctaaaaagaaaggcatatctccatttcagaggtaaaaaagaaatggcacaaagaagctaattttttaaagcttaagaatgtagtgttaaaattaatgatcaaaatgtgtaagtatctgaagatctaccttgttgaacaaaagcaataaggatgatgatgatgatgatgacgatggctagttttaattaaaaggttactgtgggccaggcgtggtggctcacacctgtaatcccagcactttcggaggccgaggtgggtggagcaggaggtcaggagattgagaccattctggccaacatgctgaaaccctgtctctatgaaaaatacaaaaattagctgggtgtggtggtgcatgcccgtaatcccagctactcgggaggctgaggctactcgggagaattgcttgaacccaggaggcagagcttgcagtgagccaagaccgcactactgcactccagcctggtgacagatgagacagatgagactccatctcaaaaaaaaaaaaaaaaaaaaagttactgtgaaccaccatctttcagtaattcactacaacgatgacacgcaaagggaaagaggaaaggcacctgatattctctaggccttttagaaaatatggagttgttcctttggccatatacatgtgaatctacaagaaaggtgatgtagacatcagggaaatgcatctggttcaaaaaggaatgccccacaaacgttaatgtgggaaaaccagaggagtctactgtgctacccagcatgctgttggcactgttgtaaacaaacaagtgcaagattgttgccaagataattaatgtgttgagcatattaagcactctaggagccaagatagctccccaaaactcaagaaggaaacaaaggaaaagaaaaagaaggaagccaaagagaaaggagcctgagttcaatggaagcacagctggctccacccagagaagtgcactgtgagaaccaatggaacagagcctgagtttctagaacctgttccctatgaatgcatggcataacaggtgtttaaaaaataaaagagctctggactgtaaaaatatttcttttcattaagcagaaatgtgttgtcccctgccccaaagaaatattttaactttaaaaaaaaaaaagttactatgcgtcagactgagtcatgtgccttccatccattatctcacttagtccacataacagctcttaaaagttagctcctatttttaacctaattttatagatgggaaaaggaggattaagtaactcacccaaggttacatagacaggaagtggcccagccaggatttcaaagcctgcatacttaaccactatgctataaaatgaaaaccctcagaaactataaatccatcaaacatgaaaaacataatatcaatattgtgaataaaaagattataaaataagtgttctgtaaatattttttaaaatttgtatcatcacattttgtgaatagaaaaattcttcatgacacatgtcttagtatatcaggtaaactataaatttgaacccatgtttttcatgaattctcaatgaagtttcttctataaatggaatagtgccataaactgggcatgtttaggtgctaatatcacatactattttaaaaaatagatgccttttcaaattgcttctggatatacccagatatttaaaacatctatttacagacacaaaagtgtaaagacaaccagattattaaatcacatgttaaacaaagtttttcaaaagttaaaacttttgaaggcattactgaaaaaaatgctgctttttctcacaaaaaggccaatttatattaacatatgtctgtataatatgccaattagacaaacagtggtgcaaagagaaccactatagagcaagggccatacagcggggttggagaccagctctctcatctctctttgtcccttaaatcacataccaggacattcatatgtgatatataccaaagtctactactttaacacatacgattacagaattttagaagtggcatatcaataatcatcgaatctagagattctaaactttttgggatccacggatggactccaaggagcatgtgacaacctagcattgtaagcactgcattggtgtatgtgtggagagctgcacagagaagttaatcctccaaaaagtccacagcccatgaatcctttcatctgctgctgcactacaatgggataccctgtattcaaacgatactgttgaagacagccctaaaaaggggcataaaacatactataccagtattcaaacttatccactttaaacatacattcttttttttttttttgagacggagtctcgccctgtcgcccaggctggagtgcagtggcgcgatctcggctcactgcaagctctaccttccgggttcacgccatgctcctgcctcagcctcccgagtagctgggactacaggcgcccgccaccgcgcccagctaattttttttgtatttttagtagagacggggtttcaccgtggtctcgatctcctgaccttgtgatccgcccgcctcagcctcccaaagtgctgggattacaggcgtgagccaccacgcccagccctaaagatacattcttaaattctactgcattaaaaatcattacttactgccagtacgagctctctgatgtttttcacatagagtgtcacatagtccttgatgtagattggccggtcagtgaaactgatatgataccaattcatcatcagcgcctcctcattttcattattgccactccatatgatgatagaaggatgagatttcagtctcttgatctgaaaattaagaaaacataaaatgattttcaaagagttaacataaaaaattcagagctataattactcataaaattaaagcccttgcatttctgcacataaattcttatgtgccaaaaacctaatttgaaaatggctagtcatgttagctgcaggaatacattttaagaaatctctgagattctttttaactagattttataaacactgatacatagggtttctcttctctgctatataaaaactgaagataatataatcccttttttagaaagagaaagaaaaggggaatgaataaactcttcactctgtggattgccacaaagaaaactttcaggaaatacaaaaggcaggagacattatattttggggattggttcttaagagcaaattggacaaattggagttctgtgtgaagaaataaatgaagcaaagcaaacactaccactgaaagaaggacggaggttcctatgcagtcctcactgagatcagaaaaccagaaggggaactagagaaggttttacaaagcaagtgagtactagaggtatgctggcagttaaagacaaatatggaatactctaaaggaaaacagattagggcaatcagggttgatgtctcctgaaataactatcaatgtcgtgtcctgagaaatcaactaacattaagttactgaatgtacctaaatataaaagggaaaattagagaatctacctgaaaaccgtgccacacgaggcctgcataaactgagctcatctgggctggccctacataaagacaaaaggatccacttgtgttatgtttgcactggacagattcagacatgtcccttcttctaatacactaggacatgtgccccagtagagagcaattaaattcctctgagaatggcagagtgagtcaatggtcaagaaaaattcttttggaacatgttttggcaatgttacctcattgatatttataggttcaccttcgctgtgatgcatgattacactgattgccccccactgatgctctcaatgtgttctccattcaagaagctcagaaactcacatagatgaaatagagatgcactgaaggtatattaaagagatatatttcatttttaaaaaaattaagtcttgtgtttttctcagccagccatataaacactatttcctttttttgtctttgtacatgcccaagaaagggacagctgctaccaactgtgactgacatatttatgccactgatgaaaatacaaatataaatcctgaagtggcaaaaagcttcagtagcaccgtgttacacacaaccctcaagctgacttagagttttatggtaagctttactttaaaattttaacaaactttgcatgcaatggctctccttatctttaataatgcatcaaagaactgaagatacataaatgttagattttaattatttatacgaaagaaaactaaaaataaaactgaaatgcttgcaacctgtgtaactacaattaatatgtttacagttattcattcatccattcatctatccactttgtgaataatccacagagtggggacgcagaggggaatgagtcctaggcctcagggagatgacaatcttgcagaggtgacaaatccttgaacaagtaattcaaagtgtgatgtgtgtctcaaaaggcaaaagatttttcccatgcttaaggtaagaggggccaaaggagaacaaaggaggtggctcacaagggcagtggatggggaagatgttccaggacatagacagcaagatggagatggtgcctgaacaggtgcagacaccagctggccggagtcccgcattaagaggatcttacaccttacccagaggtcaagaagccacctcaggggaagtgttggctagggaaggagttcgattgtactttttaaaccttttattttaaaatgaaacacagttacagaaaacaaattatgacacggtcaattatcataaggcaatcacccttgtagccaccacccagtgcagccaggccggaagccatccacgtgcctcttcctaatcacagccccttcctccttccaaaagtaaccactatctagagtatcatagtgtaatagaaatcgcttccttgcatttctgtatggtttttcacaaaatatacatctgcagacactataatatgaactctagattttaacacacttgatggattcaattcattgacatccttatctttattgaatctcaaattgtcccccttttggttgttcagagtctctcaaaatccttttgacataactttgatagcttccttgttatctgcatgttgagatattccaggatcagggttctgagcaggaatgtggtatgacttaaaatgtgtcagtggaagatgactttggcagctctgttgagtatgcacatattgaaagagaccaatgctagggagtccaatcagaaaacaaatgcaatgattgaggagagggaaaaataggatttgaattagagtagtaagcacgggggtgagaaagtaaatacaaatactagtaacattgatatcaaaaaattgtctcaacttaaaaccagatggatgtgggaggtgagaaagaagaaagtatcaatgactttcatatttcctgctaaaaagaaaaatcttgaaagagtgcactggggaaaagataatagatgtactttgaagacacgctgagttagtgtgacagctgctattatttgttatttcttttgaactgcatgacttacacgtattatcctatttaatttttgaaacagtttcatgaggagtgacatcatactagagttatagatacagaaattgaggctcaagaggtaaagtgacctccctaaggttgcagactcaccattcaagaagaaatatcaaaatatttgttctttgtatatcaacattacaaaaaatctggcagacagttggacatgagaaattgaaatcagagtcaataattatccacattgtagctttacctgaggttaccgagaaaatggatttgtttccttctttaacatgttgcagagcactataaaaactcaatatgtctccacagtcttgcaaactctttacaaggtaggggtgatctcctggtgcagtgatcatttccaatggatgctaatgaatcagtccgatgtttcagtagtattttactagcatatgatacactcacaagttggtttctaaactgtattttgggagtacatcataattcagaattttcatgtattgacaagcatcccactctgattctacatggaaacccatgccatgcacttaatatttaggggagaggaaatataatgcaatctgtgtttcaaagcatgatcatcccctaaacagaccttgctgcaaaaataagtatattcagcacacagctcataaacctcagatctgtggctaaaattatcagttgataatattatattaacaccattgccatttgtgaaaagaagatatccaggatcattttatatatttcctgtgccagacctggagtcggccatttctctaagaagcttttctcttaacaggaaagattacttcaatataagaatactcaacactacaacgttgggcattatttctagatcttttcagtaggcagagaaagcatataatcacttccttgcatttatatatctgtgaatataaatataaatgtcaatatgtggaatctaaaataaatcaaggaatcaataatcaatttaaactttctcctgagcaattcaaacagtggtgttgctgtttgctgagatggagaaaacttcagaagaagcaagattggggagggggtgcaatataagtttagtttgtacatgttacatttcagatgcctgttaaacctccaagcagaggcaccaggtaggcagttggatataagaaagaggaattcagcagagaaatcaggactggggataaatctgggagtcatcagccaatagatgatggtaaagccatgacactgggtacaatcacctaggatgtcaattacctggctgtgtaatttttcatgggatttagtagagaacaaaaaccaaaatgaagcaagatttaacaaaaggcaatactaaaacatattatttgttttatttcttcttggaagggtagtaacatacctggtaggcaacttctgctgtcactgaatccaggaagccctgatcagttggataaagggcacaggcaaacataaaatcctgccatacctagcaaatcaaataaaagggaatgcaacacttccataagttttattacacagaagaaagtctttattctgagctctgggcattatctttcacacaaatgaaaaatccagttagcctgatgagtgtgatcactggggcgccattatgcataatttgataccaagaaatgtatcaaagacattaggacttcccagaactgcacaaaatctgagaagagaaaatcctaggcaggtatagaagaaagagaagatggaagaatttgaaaaagaaaaaatgtgtggaggggacacagaatgaggcttccctccagccccttgtcactcctaattcattccaattttcaccaggcatttggtattgagatgcaccagactgttaagaatcatacttcatttataaaggaattagcttttcatagacaaaaggattactacatgcacattttagtaatgaaaccatataagtcccttcctaaggaggctgtgtgatgcaatggttaagaacacagcccctgctgggagcagtggctcacgcctgtaatcccagcactttgggaggctgaggcggggcgtatcacctgaggtcaagagttcgagaccagcctggccaaaatggtgaaacccggtctctactagaaatacaaaaattaggccaggcacggtggctcacgcctgtaatcccagaattttgggaggccaaggtgggcagatcacgaggtcaggagatcgagaccatcctggctaacacggtgaaaccccgtctctactaaaagtacaaaaaattagccgggcaaggtggtgagcgcctgtggtcccagctactcgggaggctgaggcaggagaatggcgtgaacccaggaggcagagcttgcagtgagccaagattgtgccactgcactccagcctgggtgacagagcaagactccgtctcaaaaaaaaaagaaagaaatataaaaattagccgggcgtggtgacacacatctgtaatcccagctacttggtaggctgaggcaggagaatcgcttgaacccaggaggtgaaggctgcagtgaaccaagatcgcaccactgcattccagcctaggcaacagagccagactccatatcaaaaaaaaaaaaaaaaaaaaaaagatcatagccccaaagcagcctgtctgagtcggaatttcattccaccataaatgagttgttagagtttggataaaatatataacctcttcatgtgtcagtttccttatctgtaaatggggatagagaatagtaactacatcattgaatgggcatgaagataaaatatgtagagcacttagaacaatgcctggcactcagagaatattatagaatattgtcatcgtcacaatgaccatcagcattatcattattagaataattcctagtcttcggtggcactctttatattttagaacaacaataatagaactaacagaatatattttctttgctttatcctcacaattgcaaaacacattaaaagtacttaataacaatattagggccaggtacagtggctcacacctgtaatctcaccactttgggaggcagaggcaggtggatcacctgaggtcaggagttcaaggccagcctggacaacacggtgaaaccccatctctactaaaaatacaaaaattagctggatgctaatttactaaaaatacaaaatttagcacatgcctgtaatcccagctgctccggaggttgaggcaggagaatcgcttgaacctggggtggaggagggtgcagtaagctgagattgcaccattgcactccagcctgggcaacatttttaatttttaacaaattaaaaataaaaaattagaaaaaatttagaaaaacaatatgaaacacaccttttctttacttaattttattatttttcttctctttaggtttcgtcagatctcctttaagtgttttaaatattttgttttcttttatatgcatacctaaatatcacaaagaaaattattttaaaagtaggtatatgtatactgggatataaataatttacaggatatctatcatttaaaaataaataattatggtagttgatcacctatggctcttggtttacaagatgccatttattcctatagccccaaatggaatatcattcctagctctgagactggggcaattgcatcattcagaacattggcagtcaaactgaggatatagtaacttatcaatatataaaatgctatcaacttctcaccattattcctagttcatcacagagttcatagaattcatcctgctcataaattcctcctccccaaacccgaagagtattcatattagcatccacaacagactgtaaaaggagccgtaacctgtagaagacattttagaaacaaatcataatttggaaaaaaaaaacagattgtgacagataaacacatttctaatctgttagaaaaacacactctaaaatcatgatggtttggttacaatgtaaattaaagaaagtaagataaaattatatacacattaactataaccacataaaacaaataaacagaaaaagtatgggtgatatctttacctattaaattttcagtaacattattatactctttttaaaattaaatttatgttttatatttagtcttataaaaaatacagttgtaagccttggaaagtatgcactaattttatacaaaccctccaaactataaaacaaaatcaagacttgagtattagtgcctagcacccctatctccttttatgcaatttctccagcccagtatttctttctctagtaaatttcctttctactttttccaattcctattcacattaccctcaggaaaatctagaaacttacaggcagcttgagagcatgtaccttccctccattcccagaacagtgctcaaaccaagtaacaggctgggcagacccagagcactgtgggctcagcacaggcaccacggcaggcttaccaattggcccagttgggctgaaggaccacagccaacccagccccagctgggaggggagaggagcatttgaaaaggaaaaagatagagccaattatcccgtggctgtgtctggagaagaatttcattttcttatgaaatctaaaataatatacacattttaaagtaaaaggaaattactacaacttttggaaaaaatcagggtttagttactgatgacatttacattctaaacatcaaataatatactacaatgcacatttatacatttgtaaatatgctaaaatgttatttaatttagataataaataagtttaaatgtgtttattttcatttcataaagtttattttcagcattgcaaagatttaagtttacagatccaattaggaaatattattttcttccaaagttctattccttcagtcttggaaaaacattttttttcctagatctagaacttttaagattatattttgtttttaaataaattgtattgtgtatatttaaggtatatgacataatgttatgggatatatagatagatagttaaaaggttactatagtgaaacaaaccaacgtacttaccatcctacaacaggggtcccaacccccaggccacggactggaccatggatcaggtggcacagcaggaggtaagcagctggtgagcaagcattactacctgacctcctatcagatcagcggcagcattagattctcataggagcaggaacactattgtgaactgtgcatgcgaaggatacaggttgcatgctccttatgagaatctaattcctgatgatctgaggtagaacagtttcattccaaaactatcccctcatcccccacccccaatctgtagaaaaactgtcttccatgaaactggttattggtgccaaaaaggtttgggactgctgtcctacgtagttatccactcttttttgcttttgtggcacaagtagctaaaatctactcacttatttaccatgaatcctataaatagcacaatttttttaacctatattcctagtgcacatcagatctctggacttgttctcttgcatatctgctacattgtatcctctgaccaacagctcccagtttcctccccaccctcccacaaccgcgcctccactacacacgagattttgtttagttcttttgttgagataaaagtaaaagaatatgcaaataccttagcatagaaaggtaaatatggggttggcccggtggcttacgcatgtaatcccaacactttgggaggctgaggcaggtggatcatttgaggtcaggagttcaagaccagcctggcctacatagtgaaaccccatctctactaaaaatacaaaaattagctgggcggtagtggcctgcacctgtaatcccagctacttgggaggctgaggcaggagaatcgcttgagcctgggaggcggaggttgcagtgagctgagatcacgcgactgcactccagcctgggcaacagagcaagactccatctcaaaaaaaaaaaaaaggtaaatatgtgttcttatctttcaaaaccatgctcaaaacatttaacgtatcatttgaaaagctgaaaatagttgaatgtaatatttttttcggagactattcaaaatataaattactcattttcttatttctccagaataaacatataatagttttctaaaaatcgaatggcttcaacagtctcaaatagtttagctgtaagaccacctgtaacccaggagaatggaatatataatttttaaaatcctgtccattctgaagtttccatcgtctagaattctatactacctcttagttccttgcccagagactaaagaaagtaaaaatgagtaaacctcaagctttgcgggactgctaattaaaagaagaacaagaaaagaaagacaataacttacaactcagaggttactcggtcctggaatgaatctgctgggatccagtttgagccttttagaaatatgggaaatccattaattttgaaatagaaactcaaaccaggagacccttttataggctcttctataagttccactgtcctaaaataaacctgcaatgaacagaattaaatgatgaatatcaaatttaaacataagcaaaatagtttttttaaaaaaagcagacctttttgaaaaactacattcagtagtttaatgctaattttcctatttactatgaagcacataatgtggaaatgcacatttcaggaatatacacatataaattattgctagcatccgttatttctcttttaaaagagaaatatagaaaccactaaagagctactgtagtcttccacatgaaataggcatttgtgataacatcaaaaaagacaatttgaagataacatctctaaattaaaacaaaaacatgctatttcaaaaaaatagaaaaaaatgctgtctttgaaaaacacattctcatttcagtgttgttaaaaggtagccaaacatgcatcttagaatcaaatgttataacttaacaactttgcaatcttaataacacattaccataaaatcactttgtttaatgggtaatttaatcctaattacacattaaactcaatgtttgagcacgctctggtttcttgactggagatgtacatggtgttctaatggaagtagatgcagcaggaccacgcactctgtgctattggtgctctggagaggaagcagaggctccatcctagtgacagcctagccaggttttcccccagttaagcatgggcagcaagaccccagatagagaagctttgacatttttatcaaaatctttattcttgccagccataaattggatcaagtttatataagattttataccaataaagcctagccttaagccaaaagcacacatttctctaacttaaaaaatcagtgaatgaattagtcaaattatttcatgtaataaaagtgtccaccattctcctgcttcctgactcctgactttatttatatgaaatgacaaaagacctcagaattaactttacaagaagatacagaatatgtcctggataaggaggatcttgacacgcgatgatcactcctgcttcagggttgcaaaatgtcaagaatgcacagtgattttcagaggtgacttttaaaacaccatgatggtgggttccaatatctagaacagtgcatggttctttaagtgtggcctggggactccaggaggtcccttggagactgtcagtgtgtccttgactttacttagagtaaaactaaaacattatttgcctttatctctctcagtctctgagtgtcagtggaattttccagagactacatgatgtgtgcctacttcatcactctgacagctaatggaatgtgtgctgtgtattccactgtgatgtagctctgcggcagaggtttatggtatgaagcagtgcattttcagagattaactcagtttgttctcagtacttttactgtgctcttactattaatagctgtctttgattattcctgctgtaatctctgtaccctcattgttgttcaataaattcttactttgaaccccaaagtttcccttgcaacctacacaggagcacaaaaggagtaggtactacttattcctttgtttcacagcaatatttttaagttttcaaataaaaacaaattttaattttaattgaaactcattttacactttaataatattttatcttgttctaaaagaaaatttatttataatacttttttccaatttagggatgaattgtcaaaatgggattagaaggcttaccttctcaccagcctggccaacatggtgaaatcctatctctactaaatacaaaaattagctgggtgtggtggtgcatgcccataatcccagctacttgggaggctgagacaggagaatgacttgaatccgggaggcagagtttgcagcgagccaagattatgccattgcactccagcctgggctacagaacaagactccgtcttgaaaaaaaaaagaaggcttaccttctcaacctataactgcactatctgtctatatctgaggatgctgaaaaaagtgaaactgacatatcagacagtcttttgactcatggaagggaagaatctactctaaacaaactgggtaaaattatgaataagaagtgaaattatgatgaaagccacctttctcttgactttatggatgttaataacttacctttttgtgcgttatgcaatggaacatttaaaaataatatttatggtgccagttaagttgtagtgtctcattgagacaaatcattcacagtatgaagaaaagagaattgaatatttaaacttatacatgataagctcattaaaagtcaaacagtgtttattacatcttttcaaaccagacatgaaaaaacccagtgaagcatcttacagggttagttatgcacccctggctggagaagcacacatactagctgagagacagttgtactgttgacattgcagaatgcttactagatgaaaagttagtcgaggaaataacagcactgccactttgcaatgacagagtaactcgtccaattaagagatttgactgcaatatgaagactggcctgatatctcatctgaaataatcatacttttgctttacaaatgagtgaatctccagatatagatggacttgccagtttgcctgtatttgtctgttatcagcacgataaatcatcaaaaaacttcttttctgtgaatttttggcaacaatatacaagaggtgctgaaatattcaaagtactaaataattttttgaataatatcctgtaattactgtgttaacatttgcactgacgttacaaaagcagtggtgggttaacactgctggtgccttagcaggaatcaaggcagtagctccaaactgctagtagtcattacatctttcaccttcatgcattagcagcaggaaaatgaaaaaaaaacagtttcacttaagactgtccttgataaagcagtaaacattaatttcattaaatcccaaccctcagtatgcatcattttaatatcctgcattatgaaatgagcaatatccataaagcaccattcacaatagatagctggaggaaaagcctctgggccattaatagagttgtatgtaagctgaattggccttgttcacgacactccatttttacttgatagaaagaaggactgacagacaaacgatggttattcagacttggatacctggcagacattctctagaaaatgaatggagtgagcctatcatttcaagaaaaacaactagcagtatttgtggccaaggataaaattcaaactttcaagtaaaaattgggattagggaaaacttgtatctactacctcacggtagtagatactacttaaatacttaaaaactttttagatgacatcagtggtgatattaacaaatgtgatattataaaaggaaatgtttcaacatttggaagatctgtaactctcaagaaacaaacattttccaataaccaatgcattatattacaatatcacataatatgggtaaagaattcacacaaagtgcaagatagacaaatgaattttaatgtaacagagaacaaaaagtttaagaaactatcatttgttaaaagaaaactatcattggttaaaagaaaatccacaatttatctgaaaagactattttttcccttttccaagtacatctgtgtgaggtcagatttccttaatctgtttcaaccgaaacaacatattgcaaattgactgaaggcagatacagatgagaatccctttgtctcctactaaacaagacgttaaagtgacttgctaacatgtaaaactgtcattatttccactggtttttttggtcaatatattttttataaaataagtcatatataaaaacagtcatatgtgccatggtttattatggttatttaaaatgaataagtaaatacttaattctcagttttaatatttaatatggtaaatatcggtacatataacccatataaacaaaagcatgttggggttttcaataacttttgtaagtataatgcagtgctgagtccagaaaaatttgagaatcactactgcagaaaatagaatttatttgtttcttaatatacattaatgctacaaattgtattaactatacaacataacactttccagaatatttttcctttctgtgcaaatgttcttataaaaaggcatctctccctatcccccaactcttgcaataacaagttatgactggggtgacaataaacccaaaccacctgacagtgcctcagaggtgaagtagtaattaccagccacctttccctctgggcattctttcacaagtgaaaggctcccgcttctatgataagtgtcagtaattttccacgtcctctggcagtcttgatagtcacataaaagccttcttctacaacaggtattttacttcagagaaaataatgggttctaaaagatttcttgaaaagacccttgagtaacacatatttgcatccaaagtaaatatataatcttcatatgagactaaaattttttaaacagtccaacaaagcaaattattgtctaacagtaggaaaaaggtataaatacctaagaaactaaaaaatgtgtaagtcgggcagttagaaaattaaaaattttaacttctaaatttttatctatttttgaagtttctattcctcactagatcagtgtttttattagcttcaaaaagatttcattttcaaaatagaaggattaactttaaaagtgcaggatagttgaatgcattctttcaaacaagaattaaggatatctgaactaaagggcctaagaggtacgtgactgataaatacggtactcctcaaatttctttctctggcagaccaaacagatgatatgtaatgaatcattgattcacaaacccaaggctgcttctcagctgtttgtatcagatacttaaaaagctgtaatagcatcactacattttcaaaagggcaattttcttcttaaaaagaaatccacttatttctaaacattgtcaaatgtcaaacctgctaaaatccttttacatgtattttaagagacaaccaaacactgcatttctgtctttgttctgaaagtgctcccccatgtaaaagtattgagaaaacaagctctgggtctccacaaatagctcttgtcaaacaggtctgtgcaggatgacacaagagacattctttgtcgtgcccttgcaatttgcagacagcacaaccagaagttaacagattaacattgacatcggcacagttatgcatccttgtagccagatgtgtatctagtatatctgacaccagataggatcactttttaagacctcctcttccatatgacaaagttattttcaatagaagtaatgaaatgaaatgaataatgataatgtccagaaaagaatgtagacattaaaaattttctttccctgaactttgtataatcacgccagttttttaaaaaagtaaaacaaatattagcgtacaaaaaaggaaaagttaatagattcaagttttgattatattaatatatttaataaaattataaacaaagggaataacatatataatggtatgctatagtaagaaataataatatttgctattttcagccttaccttctaaaaatctgtcaacaactttctcaaaattgatcttctttggacatacatgttcaacaaagggtatagccagctcttttgatttatttgtcatagctgatggaaaaacaccttttattaattttaactcagaaatgttcttccagatgaggccagagatatgcaaatattttagaaaagtattaaacataataagtttggtagagattcataataatcccacatcacattaaactccaaaaaaatgcagtcatatccatgcctttgttcttttgactttcattcaaacaatttacaaatgcctctgaggtataaaaaaaaaaaaaatcccacttctcaagtatttcttctgtaaaatcagagaaaatggctaaatgattgtgaacacagatactatttgattaattgctgtagaacaagtgtccagttctcagggacaacaattggggcgtttggcattgctatgtggatttctctgagcaatggaaaaccagcaactctttgttgtttctcctggcactctccttcaaaatttgattcttttttctatgtaaatgttgatttccttatattttgttgttgcacagtaaataggcttcaccaaaatttctgtgcacttatcttcaaagaagaattttaaagtttggtatttcactgtacattgttcaagatggagtctatttgcaaatatttttgtatctgattaatgtcatctaaaactataccagaaaaaagataattccagagagaaaaccgcacacagcagagagaaatgtctgagctgattcacgtgtccacattttctttggattacatggtacttcagagttgagattaacttttcaaaatttttctactgtggcccagcttcataatgaaccttccatcttgtctaggaaagcttttctgcagcttttcccatcaatgaggtgagatgagaaagaatgaatacaatttgtccaaagttctaaaaaaaaaaaatcacacaggaaaaaaaaagtttccaaaaaagcaaattccacaaggctcagagaataatttccaagaggctgaaataaaattttggattaatttctttgatttttgcatgaactccacagtgaatactggccacatatgcagcatcttttatcctggcccatagcagaggtttatgaaataataatcccattccttgaagctattttctgtgcattctgcagcagttgttctggaaatatgagaatgactcctttatctccattctactaccttccctatgaccagttcacacatttgatctctgtttccagaaaggtaagaatgacttctttatttccactctgccaccttcaatataggcctatctgaccaattcacacatttgatctctgtttaaagtatccagagtgctgtcaaaaagaattccagccaggcagtggctcatgcctataacctcaacactttgggaggctgaagcgggagggttgcttgaggacaggggtgtgagaccagcctgggcaacatggcaggctgtgttgcaacacccacttactgtctgcacctaaggctaactactccccatctctagaaaaataaaataggcaaggcatggtagcatgtgcctgtagtagtcctagctactcaggaggataaggtaggaggatcactggggcccaggagttcaaagctgcagtgagctatgagcagcctgggtgacagagtgagcccctgtctctaaaaagaacaaaataataataataattctaaagcatttttttcagtatctgccaccccctactaaagcataccactgatgtcatgttttactttgactctttctttagtttcaaaacaacaaatttaaaaaaataaatttcaattctaaagacactattaaaattagtagaatatacttcatacatgaactaaaatatgcacttaccaagcaaaatattacacattacacctcagagtccatagctttctcaactgtaaatttaaagcataaaaataactccaagagatcacatcgaattgaagtaacttatgttgagtttctccttttttataatcactgtgctattgttgtttatttctaatctgcaatgcttttaaatgcaggcatgtatagggcagggaatggaagcacaaactgtgttcaaaacaagctcatacaattccaaactgttataaatttgctttcaaaatgactgtatgaagctgaatcttcatgtatccgggaatgactgtataactaagagtactccaggccaggtgcagtggctcacgcctgtaatcctagcactttgggaggcagaagcgggtggatcacctgaggtcgggagtttgagactagcctgaccaacatggagaaacccccatctctactaaaaatacaaaaattagccgggcatggtggtgcgtgcctgcaatcccagctactcaggaggctgaggcagaataatcgcttgaacctgggaggcagaagttgcagtgagccgagatcacgccattgcactccagcctaggtaacaaaagacaactctgtctcaaaaaaaaaaaaaaaaaaagtactccaaattaactttcatgtagaatataatgtctattacaggactggtaataaaaatgtgccaaatctaagcatacatgtatattattaacattcaagagtaaccaaacacatagttaaaacttagaccaacatatgattggtggagggggagggtaggagaagtattctatcactggcattatttattaataggattgccagtatatagtaataatgaaaaacaggccaatctatagtctacacacaattcacccacttactgtctgcacctagggctaactgctcccaaggcccacctggagaagtcactgcctatagccatcttggaaatatttaataaaacttctgacaagaataaggccaaaaggacagtgtactgggttgaacagtgtccccccaaaattcatgtccacccaaaaatacaaccttatttggaaataaagtcttcgcaaatatatttagtttagttaaaatgaggtcatactgggccctaacccaatggctggtgtagttataagaaaaggaaacaagagacacacacaaggagaaagctatatgatggtggagacagagatcagagtgatgcatctacaagccaaggattgccagcaatgatgagaaactggaaggggcaaggaagaattctttcccagagccttcggaaggaacacagctctgccgacaccttgattttggactccagcctccaagactgtgagaaaataaattttaagatactcagtttatagtaatttgtaataatagacctagaaacctaatacagaaggagacacacttcataatctctgtgccctctcaatacaaaaatacaccttgattattcctaattccatatctttggctatgtacttttaaggtctttagagagccaagagtagcacttagaaaaaattccactagtattatgttggttttttgccctgtgcaatttgcaaagatgaagacaggaatttaagaaacaaagaacaaagtgacattaaaaaagaaaaaaaaaaactgaaaaagaaaaaaaaatcccaattgtttttctaattgtagtagccatggacaatcattcacctcctctggcttgggaactatgaaacacaagttttaattgattgtagagtacttattattacatctattttcctacaataatttaattggagaatcttgatcccaggagcaaacgtacacagcaacagccttctgctgcttttagcaaaacgataccttatacatagaatacttgagaaattcttataaaataaattaggtgtaagagaaatatcaactaattggtttcctgtttttccataaaggcaagccataataagcattcaaaaatatgtattagttcattaaaacacgttacctagtcaattcagtacaatcaattagtaggataaaaacactcagttaacctgggcagaaaatggcaaaaactgattggtcagattttttattccatttacccagagtatcctctaccattcccacttatacacaaaactttttcttttgttaaaaaatcaatttggtttcccaaactgataaagctaactctcccagactcacattctaaggtccctcaggcaatgatttatttggcagaatttatgatatcccaacatttattttttattttgttatttattaatgtttaaattgcctgttgatattttccctatattacctcccttcttgcttaaaccatttgccccaatgtcactcaacataagaaaattctcagtcatcaagatattctgccatgttcacaaagaaatgtagtcggccctttcctctctctcaagtgtctgcattcttttcatgattccatacatttctgctgtatgggctgcattcaaaatctgtaacttccccaggaccttttgtctgagtcagatatgctgctgtctcctgatatactcagttaaaaaaaaaaaaaatcctaaacacgtttctaagctcagtggaagaggagaggcatgaaacaaagatataaaactgaagcaagatggatttcaatgaggtatatttaaaacagaattatttttgcataaagcaagcccagggtaacaataaacaagagcaatagaggtgaaataaggaggggctggtgatgagaaaacagtgttcaatgtcctgtctgacacagtaccaagtgctggcgagcatgaggagcctaggcaagtctcatataaccactttggatggcagtttagcataatctacaaagctgaactcatgcatcctccataatcatgccattccactcccagcagacatgccgttgggggcatatgtgctccgagtgttatatcagtaatgttcacagcagcattacttggaatagccaaaactggcaactactcaaattgcaacagcaaaatgtgtagtataataaaattttatacaacttaaatagacaaacttacagttacacagaacaataaacagcagtccccccttatctgcaggggatacgctccaagacccccagtaggtgcctgaaactgcagatagtaccgaaccccatatatactatgactttttctgtctgataaaggagaaggctgctgagtgactaacaggtggataatgtatacagcaaggatatgctcaacaaagcgatgattcatgtcctggacaagacagggcaggacagcacgagatgccatcatgctacacagaacagtgagcaatttaaaactcatgaattgcttatttctggagttttccatttactattttcagaccacagttgaccatgggtaactgaaaccacagataaggaggcactactgtacctaaatgtcaaaaacataatgctgagccaaattagccacacactaaaaaatacatgctatatggttccatgtacataaaattcaaaaagagacaaaagtaacctagtgatggatgtcaggatagtggatcttcgggaaggaaacaggggtcattactggggaggctcgcagaagggaggggagagtttgaggtgtgaagtgctagtaattaatgttctgtttcttgaacatgttgacagttacctgagtgttcattttctcataattcattaagcttttcacttatggcttgtgtatttttctgtatgtgtcatatttcacaataaataaaaaataaaatgttgtttgaccaaaactccctagctttctttctcaggcttactttttcaccctaaaactccactgacaaaagtgtttgccagtcttatagaaagaaaatatactttaaatggtcctagagaccttcaaaattacctccatcctcaagctgcatcctttcctcccatgtgttatctttcaccactattacaacgaaaacagagccccccatcccaaagtgaatccatcctcttcttatctcctacctcccagagaccttgccctctcaactacctccctgctttctaactctttttagtctttccctcgctactggcccctttccatcaggattttgctgttgctttccattctcttaatggtatccttttctatgttgaaatcattgcaaacttgtaataaagttccaacaataatacaaagaactcctatatataatacaaagaatccagagacccccccattcaagttttcatcagttgccccaataacattatgacaaaaaagatcactgcactgcacccagttcgtacatagtctcttccactgtaggacagttcctcaatctttccttgacatttttgaagattatagtagattgaagactgaagactgaagactgaaggcccttgtgtcctttcaatgtgtcacattattattgagtacctccttacttcctggaacagcaagatatttcaggctccagctcgagaatcagtcatttctccaaagagccctgattgctttcagcacagagtggtattccaaatcaacatatgggtcctaaatctactcactgctactagagagccactcttcccaggcgctctgagaaaggattaggaaatgtgtgaaaagaactaggaaatgtgtgtgtgtgtgtgtgtgtctacccacacatacacatgcatttacaaagacatttatttctctgtctacacatactgaaaatcataacttcatactattagctccaatttgaatccactgtagctttccccccttctatgttgataccacctttctccattcatgaaaaggctggcttccaccacttcaatatatttacttatttgttcagttgcctatgtgaagccaatctgatcccaactggccaccattaccacctggtctaagcatagtttccaatcagacgctttcagaagagttgcctatattcaccgtctttacttccataccttgagtcattcctcaacccactacaatttgatttccatgctgatcaaggtgaccagtaatctccttgccaccaaatctaaagaatctttctcaattcttttctaacttgaactcccttgcagcattcaacactctgaacattctttgcttcttaaaacactctttccctctggtttctgtgactccccactcaaattggttttccctccacctcgtcaaccattccttcttagattcttctactggcttctccccaaaccccaaccttactaattatgactgcctggggttctgtcctagctcttttctctgtgccatccctgaggtatttcatccgctaccatggctacaattatctacattctgctaacttacacatctatatccttaacccacatgcaatccctaagcttaagatctatctaatgaaacacctatcaaatattattccttgggtgtctctcaatcaccccacacaaaacacatctaacactgaaataatttccacccaaccccttcccccaaaccttctcttctttctgagtaatgtaactcaatgaacagagttgccctgcctgttcagaggctgcctgttcagcagcccaaaccagcagctgaggaaccattcctaactccttcttttttcccacccccacatcatcaagcctgctgaggttatatcctaaatctctttcagatttatttcctcagcagttctgtagaccaaccaatcctcattttttgtctgaatcaccaccacagtcttctaactggtcccctactcttgccatccttccaatctgatctacacaatctttgtaaaatatgcatataatccttaccccctccttaaaatccttccaagaatcctggcagcactcaggacagtgcttcttccttcacgtggctcactaggccctgcaggactttgtcctagctacttttacaacaccatctcttgttcttcaacttcaaactcaaccacaactgcattgaaatttctttcacttctgcaaacacacaacatcctttctagtccttgggccttcacgttcttttccctccgcctctttgctacattacttggccaaattctacttatccctcaggacacaggctctgggaatcttcccagaatgcccctgctctgcacttccatggcactctctacatctctagagtgctaatatattccaatggctcatttaatgattgaacttcccaatcagatcattagttctactaaggtctcagagagaaacagaaacagtgtcttagtcacagctctatcaccagcacctagcaaaatagccaaaacacagtaggtgtgccctaagtatttactgaatgaatcagcctcaaaaaatagcaactctacggcagccacagccaaagagcacatttcacacacatgcattaactcaaggtgtggggcagttaaacatcctccttaaagcaaactcctgttgctgctcgattcaaaggctggcatctttatgtgtaatgaacaataatacagtcatattagcctgaatgtaaaagaattatttcccttagaaaaagacagaagttcctcttctttctctgtagtaagttggaatgactcattattttttacattttcatgaaaacaacacacaacaaactcactgtgtgagacagcacacatcctctcagccaagaggggtacgacaagagtgaatgctttggcccttaagacgggtccaggatgttctccctgtacataactctgtgcatgtgtgcgtgcgcgcgcacacacacacacacacacacaaacacacatacactctcttcccctctcacacacacatacacactctttctctctctcccctccccccttacacacacacacacacacacacacacacacattcacagtgtctcagaaaatacacagcatgattgaacaaaagaaaaacagaaaatgcactcctgaaggacatatctccatccttagcatgttgtctggcccacaggagaggaaataccaaatgtaagaggtgacaccagccaactgtaaacaccgaagctggtgtctgggagaggaggagatctttgaagagggttaataccatttctactaactatatgccatgactcttataagccagatccaagccatctcgttcttattgtccctattttacatattttgagattaagtaagtagcctatagctaataaataacaaagtgcagttctttccaattcctagtgctatatcctaaaatgggtaaaactgaaaaatcagaaaacaccagtagaagcaccttattcagaaaaatgaagaagaatgtcagaggaaataaataaaagttaaaaatggttggttctggggagtaggaagtaagaataggaagtgatgggcaagaggtcttatttttcatataaacttactagtaatatttgagttttaaaattacacatgtattattttgatataaggtacaattttaaatcatagcaggagactacttattgacaaaataatatctaaagtatgatccatttaaaaatataaggccgggcgcagtggctcacgcccgtaatcccagcactctgggaggccaaggcagtagatcacttgatatcaggaattcaagacctgcctggtcaacatggtgaaaccccatctctactaaaaatacaaaagttagctgggcgtggtggcgggtgcctgtaatcccatctacttgggaggctgaggcaggagaattgcttgaacccaggaggtggaggttgcagtgagccaagattgcaccattgcactccagcctgagtgacagagcaagactctgtctcaaaaaaaaaaaatatatatatatatatatatgtgtgtgtgtatatatatgtatgtatatatacacacacagagagagaagcttttgaatgctgttactaaagatgatctctgatgggtggggacacaagagttttgacggtttcttcttttcccatgaagatctgtattactatttttaaaagaaataaaattatttcacaaaatattttaaattacttacttaccttagctgatttttcaatatttaagcctccatccagttcaaaaagaacagtcatgttgtacccagtctggtttccatgtccatgaggccaccaagtttctacagtaatattcttttaagaaaatttaaaagtcactctaatatgtcatattttcagcaaaaaaggctcaaagcattacatcaatttctcaaatagtcaagtacaaaactctaggttctaaaacaatgtaagtctccccacctatattatgcccaatcagaccaattcattgataatatttaaaaatcagcatgctgggaatctagcatggatcaatacatcaaaagcaaaaggaaagaacagaataacatgagtgttcagaaaaacaactctccctatccctaacaccgagcttacatttattccacattcttaacacttaaaatgggactctgaagttgactcttctttcaagccaaaaactaaaaatcattttgagttcttactttatctcaacagctactgaatgttattttgctccacctttttcagtacacaattatcaattagaggaatagaaaaaagaaaaagaaaagataaaaataatccgttctaccttgatatatgaaagatcatgagtttagaattaaaattgtgcatgtagaataagtatcaataatcaaaataattgacaagtatcaaaaataaccactgctatttaaatataatccatagaatgtattttggctttaggatactacaaatactacagaaaattaaaatacaatgataaaaataaaatgagagaaagaattgccaaattaataatatattctctattttcttaatcttaaagtttgggaaaatcattctttagctcatactcacagaaaatatatgagagactaaaatagagaagaaaatgacaaatataagcagagaaagtagaattttctttcatacttagtccctcctttctaatcatttctttagcacaggtattgcttttcatccagtgcttctcaggaagtaccatcatttaccttgctaatgttcacaaatagctcaacaatccttttcccaggttgaagttcaatgctgtatgtctgttgtgtttgcaacttagggatggctacgatcacttgaccaccaactggctttgagctgacaacatcaaatgtagactctatttccagattccactcctgggcactcttatctaaaatataaaaagaaaaagaaatatatatatatatatataatatgctaagcattatcactgcatttctcaggattcattgaaggtaagactaaagcagcttcaaacccagtatgtgctccacaatgctgtcataatcaaaacttcgtggaaattttcttttaatcttcagtttaatccttcattctgaagaagaataacaaaaatggtatattttacatagacttccactctaaaaatgttatgattgtaagtcataaaaactttatggagcataaacagaaaatgacaaatggaaagataaaataaattttccaagaataatacacatttgttcctttttaattaagtaaaaatactttataaagtaaaaagtaatagtattttactttataatgtaaatgggttttaaagttatgtaataaggtataaatttatatgtattaaaattaatcaaatgtgaaaaaataaagttatactttaaatgtagataatttatccaataaatatttcctgaggactttctatgtgccatatactctgctaagtgatgggaattaaatggtgaccaggataaacatggcccctactctcatgaactaaaagtctatagacaaattcaaaagcataataatatcaggacaggagaaataaaaggttgtcctgagaaataaaaacaggacatcagaaagcacagctaatacagagagggtgaaggaaggctttctctcttttctttttcctttttttttttttttttgacacaggttctcactctgttgccccgggagtcacacaatcatagctcactgtagctttgaactcctgggctcaagcaatcctcctgcctcagccttctgagcagctggcactataggcatgtgccactcacctagctaattttctttttactttttgtaaagatgaggtctcactttgttgtccaggttagtcttgaactcctggcctcaagcaatcctccagcctctacctcccaaagcactgggattataggcatgagccaccatgcctggccaaggaatgctttcattagaaagtggtatctagctgagaccagaaggatgcctcagctaagtacagaggaagatgataaggattctgggcacagagaagcatgtgaaggcccatgagtgagacagcaatgccataacaaggaaaacaaggaacttgggcaataacaaaattgatgagggggtcagcataattgaaaagttgagcacggtccaaatgacactgggtcttttcgaacaggtaaggagtctggcaatttcaccccagatcaatgcggagtcattgaagatttttcatcaaagagcatgaccagatctgcattttataagaattgctaaaggtcccagcacagtgatatacaaggatgaatatgaaagaagcagaaagatataaaatctctctgtgtacaaaaagccccagaaaatgccacttggaaaagccaggaacagagaggaggcaaagaagagtgttgatcagaaagaagagaaaacaagaccgaagaggagaattatagggaaagaagaaagatgagggatgaactttgggtgcagagtttggggttgtcagaatgtttcgaagaggttttgaagtagagttttatatacgcgcagtatgactctgtcctccatttcctgtcaaatttatattgtttgtataatgtctccgggtttggttttgtgtttagtttttatttttaaacaagatagagcactgggacagacttgggacaagagctgggtggaaaaacagaccgttttttaaagttacgcagaagaaactggtcatgagatctcaaaaaagcttggaggtacagggggttagagtcagcaaaaaaagttctcattctttgctgccacagaaagaaaggagaagagcagtgactgtgcagaggcatttaagtttctatgattcgtggcaaagtatggagggagttcctatttagtggcttctatttttctccaaaggaaggggagggggaaggctactagctgagaagtatcttagagacctttctcctacaaataaagaagagattaataatcatggctttgctgcaaaagaaaaaaaaaaaagctaggtttctatgctgatcaatgacaaaagacgttataaccggcactgtttacaactgtaggagcacaccaggcctgttctaaagatgaccccagcacagtttatcattcgcatctcccatcagccaaaagcatagatttgatgcacattgaagtaaaattaatcctggacttaagaactatttttgtttattaagtgatttattctgagaaatactagtcgatgagctctgagttaggtttgttctgatccagttaattttgcaggttacttaccgatagcctccaggttttgaatctatcagctggtagatcacctagtctgctcgctcaccagtgtttaatttcctctattcaataggttgtcaaactatggtctttgggacaaatctagcccacctcttgtttttataaataaacttttattggaacacagatgttatggactaaatggtggactcttcccctaaaattcttatgttgaagccctaacctccagctttttatgaagtaataagggtggggcagtaatctgttaggattgcagccttataagaagaggaagaaacagatatccgtctctctctctactatgtgaggacatagcaagaaggcatctgtctgcaagccaggaaacgagccctcactggaaaccaaatgggccaacacctttatctcggacttcccagctgccagaactacgagaaataaacttctgttatttaagccactctgcctatggtattttcttagggcagccagagcagactaacttaatagtcatgctcatttgtttacttattgtctttggttacctttgcaatacaacagtagagttgagtagttgtgacagatgcctaaactattttactatgtgatccttaagagaaaaagtttgctaatccctgccctagaatattacccccaaaaaaggccattccaacctttctttaaatatctctaatgacaaaaaaacctctgcctcacaaaatagccttcccatttttgccaggcttggctattgtaaagactccctttacactgaatttgaaatatacttctccttaatatccaactaaagattttagctctgtcctttgagcacctcctaccaacgaagcaggctcctgtgttgttttctgttacttcttctttagtaggagaatcagctgttagtgacagcctctgacaggaaaacaaataatgcaatcctcaaaggtcatcggcaaaattccccagtttctcttgctttgaacttggaaggttctcgagcaagtccgcactcctccagagcatcacccgttaacacccctgggaactactaaatgaaaaaactaaggttgtagaattaaaaacacagtatgaagatctacaagcctacaaagttatcaccagatatacttaataacatatttttcccctctcctcttctttcaaatagagtaaaccccttccttccagtagcacatggaaaagtaggtaatttaggttcacaaggcgcaaagtcttaaataaccagtagttttcctgatgttctttggtcactccttttcacttgctaaattaaatttataaattgcataatcctatttgtagttaagaagaactccatcttataaattaagccccatttctagaatacagcttcctatcatctctctcctagcattaataagtcaccatgtcttgaagaacacttatcatcaccagctctcctgaagtaaaatgcaagatcacttcaaaaatggatgaagtactgggggtgagggcaggaaagaaggattgctacatcttctagaatcccctacagagctcatccttccaatcacaccaccaagttctgcatcctctcttcactttgactaaacaactcagcacaaagaggacaggaattctttatcaaaacaggtgcaaaggcaatgctggcctgccctctccacaattcaaggccttgaggccctccctggcctgaaggcttattggtgtcctcgctgatgtcctaagcccaagcagaagagattatgttctacagtttgttcatataacctcaatcaggaaggcaacccagaggatggtagagaatgtggttctggccactaattcgctttaaggttttcccagagatgactcagtgagtgttctttaaaaaaagaaaaaaacaaagagcacaatgtgtctgacctggatgggaatttgtagaaaggtaaacagctacatagcctagattaatgtatactgctccttcgttcagagtatcacaagacaactctagctcatgtagatgtgtccagtacatcagccttcaaaatcttctcaaatacgccagcttcctcttatattctcatacagtctactcctttattaagatgtagttggaggggggacaaaaagccaaaaaaaaagaaaaaaagctttattcaattgtctaggagaaaaaggtataaggagagatatagaaagtagaaaaataagaggactcagttacattacttcaagtttgtcaaaaagtaacaggaagacatactcccaaactatacactgaaccttgctttaattgattgtaataaagactcaagtatcaatgttttcatctagtcatgtgatgtctagtttcaagaaaaactgggttgttccatacttataccctcattgggtggtaatgactattctaacttacaaacaaaggaaaagaaccacaaaatgttcgaggtagaagaaacttggagatgttctcatcactttgcagatgtttctgaggccctgactgcagcacttccctcttgagccagtggacaggccaagggtccaggtttcctaactctggtgctctcgactttccatgagcctctcgcagcgatgcctaccaaaaggaatgacactcacaggtacacaacgattgacatttgtatatgaataatgaggaaaagcaaaagcaaaggtactttttgcctttcagagtcctaaagccaaatgtcgaatatattcaatgtaaaacaaagcattctgggggcactgtaataataaaatgttagcctaagagggtctctgtaaaaaaagaatactgaaatgggcagggtgtagtggctcgtgcctatagtcccagcactttggtaggctgaggcaggaggatctcttgagcccaggtgtttgagaccagcctgggctacataatgagaccccatctctaaaaataattttaaaattagctgggtgtggtggcacgcctgtggtcccagctacttcagtggctgagatgagaggatcgcttgagcccaggaggtcaaggctaatgtgagctgagattgctccactacactccagcctgtgcaacagcatgagactttgtctcaaagtaaaaaaagaaaggacactgaaatctacaaacatagagaatatgtctgaccctctgctaaacgtgtatttatatgatgccacagttcctgtacttatcaaaatactgtctttgtaacctaaactagctgaaaaggcactaaaatagttatgtgagcatttgtgtcaagcaaatgaaatctatttcttgaataactactgtctgtaaaaccttgacaggcattataaattatatcccaatccaaaaaggcaaatatgttgtctctaactctctgaacatatttagaaagataaaatatacccaagtgtcgcagttaagaatacaggatggcatcaggaaccataaggactagcagggcagtgaaagttcagaggcagggcacattcaagtcagcaagggatgaatctgcaaacactggtagatgaaaaagatgcttcatctcactggggggaaaacctattcaaagatagctgcctggattagctttgccctgctgagctcctcacagctcccccttttgcaggctctcttcttcctccatctttaatagagtatgaaaagctgcagggaaaggtagttatgtgcatttaaagaaacagcaatgacaccaaatgaaatgaacaagccatggaatttataaattcaaacattagatattttccggtactcctgccagaatcatgggacagacttaagcagctgcttttcaaagagctaaccattgcgttagccaaaaatgttggcccacagttagttaaaacagctgttttccctcttcttcaccaagcagcaagatctccttacctactcagcagtacaaaatccttgaaactgaaatcaaggcaaaagagacgcaaggcaaaatgtttcctagaacaaggataagttagtaagctccaaagaagaaaatttactcaagcaatgaggagactaatcacaggaaaaattattcaagcaacctaccctctctatgggtatttcaagcaaaatacccataaagttattttcaaggattattttatggaaaaaataatttaaagatgaatgaaaaattgattccaaatgaatgcattaaaaaatgcatgcttatcaaataagcaagactgacaaatctttattttattttatttttttattattattatactttaagttttagggtacatgtgcacaatgtgcaggttagttacatatgtatacatgtgccatgctggtgcgctgcacccactaaacttgtcatctatcattaggtatatctcccaatgctatccctcccccctccccccaccccacaacagtccccagagtgtgatgttccccttcctgtgtccatgtgttctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccacaataaacatacctgtgcatgtgtctttagagcagcatgatttatagtcctttggatatataccctgtaatgggatggctgggtcaaatggtatttctagttctagatccctgaggaatcgccacactgacttccacaatggttgaactagtttacagtcccaccaacagtgtaaaagtgttcctatttctccacaacctctccagcacctgttgtttcctgactttttaatgattgccattctaactggtgtgagatggtatctcattgtggttttgatttgcatttctctgatggccagtgatgatgagcattttttcatgttttttggctgcataaatgacttcttttgagaagtgtctgttcatgtcctttgcccactttttgatggggttgtttgtctttttcttgtaaatttgtttgagttcattgtagattctggatattagccctttgtcagacgagtaggttgtgaaaattttctcccattttgtgggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattgaatagggaatcctttccccattgcttgtttttctcaggtttgtcaaagatcagatagttgtagatatacagcgttatttctgagggctctattctgttcccttgatctatatctctgttttggtaccagtaccatgctgttttggttactgtagccttgtagtatagtttgaagtcaggtagtgtgatgcctccagctttgttcttttggcttaggattgacttggcgatgtgggctcttttttggttccatatgaactttaaagtagttttttccaattctgtgaggaaagtcattggtagcttgatggggatggcattgaatctataaattaccttgggcagtatggccattttcacaatattgattcttcctacccatgagtatggaatgttcttccatttgtttgtatcctcttttatttcattgagcagtggtttgtagttctccttgaagaggtccttcacgtcccttgtaaggtggattcctaggtattttattctctttgaagcaattgtgaatgggagttcactcatgatttggccctctgtttgtctgttattggtgtataagaatgcttgtgatttatatacattgattttgtatcctgagactttgctgacgttgcttatcagcttaaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggaatggtgagagatggcatccctgtcttgtgccagttttcaaagggaatgcttccagtttttgcccattcagtatgatattggctgtgggtttgtcatagatagctcttattattttgagatacgtcccatcaatacctaatttattgagagtttttagcatgaagggttgttgaattttgtcaaaggccttttctgcatctatagagataatcatgtggtttttgtctttggttctgtttatatgatgtattacattgattgatttgcatatattgaaccagccttgcatcccagggatgaagcccacttgatcatggtggataagctttttgatgtgctgctggatccggtttgccagtattttattgaggatttttgcatcaatgttcatgaaggatatgggtctaaaattctcttttttggttgtgtctctgcccagctttggtatcaggatgatgctggcctcataaaatgagttagggaggattccctctttttctattgattggaatagtttcagaaggaatggtaccagttcctccttgtacctctggtagaattcagctgtaaatccatctggtcctggactctttttggttggtaagctattgattattgccacaatttcagatcctgttattggtctattcagagattcaacttcttcctggtttagtcttgggagagtgtatgtgtcgaggaatttatccatttcttctagattttctagtttatttgcgtagaggtgtttgtagtattctctgatggtagtttgtatttctgtgggatcggtggtgatatcccctttatcattttttattgcatctatttgattcttctctctttttttctttattagtcttgctaacggtctatcaattttgttgatcctttcaaaaaaccagctcctggattcattaattttttgaagggttttttgtgtctctatttccttcagttctgctctgattttagttatttcttgccttctgctagctttcgaatgtgtttgctcttgcttttctaattcttttaattgtgatgttagggtgtcaattttggatctttcctgctttctcttgtgggcatttagtgctataaatttccctctacacactgctttgaatgtgtcccagagattctggtatgttgtgtctttgttctcgttggtttcaaaaaacatctttatttctgccttcatttcgttatgtacccagtagtcattctggagcaggttgttcagtttccatgtagttgagcggttttgagtgagtttcttaattctgagttctagtttgattgcgctgtggtctgagagatagtttgttataatttatgttcttctacatttgctgaggagtgctttacttccaactatgtggtcaattttggaataggtgtgatgtggtgctgaaaaaaatgtatattctgttgatatagggtagagagttctgtagatgtctattaggtccgcttggtgcagagctgagttcaattcctgggtatccttgttaactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttgtggaatttatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcatgggagatgggtttcctgaatacagcacactgatgggtcttgactctttatccaatttgccagtctgtgtcttttaattggagcatttagtccatttacatttaaagttaatattgttatgtgtgaatctgatcctgtcattatgatgttagctggttattttgctcgttagttgatgcagtttcttcctagtctccatggtctttacattttggcatgattttgtagcagctggtaccggttgttcctttccatgttgagtgcttccttcaggagctcttttagggcaggcctggtggtgacaaaatctctcagcatttgcttgtctgtaaaggattttatttctcctacacttatgaagcttagtttggctggatatgaaattctgggttgaaaattcttttctttaagaatgttgaatattggcccccactctcttctggcttgtagagtttctgctgagagatccgctgttagtctgatgggcttccctttgtgggtaacctgacctttctctctggctgcccttaacattttttccttcatttcaactttggtgaatctgacaattatgtgtcttggagttgctcttctcgaggagtatctttgtggcgttctctgtatttcctgaatctgaatgttggcctgccttgctagattggcaaagttctcctggataatatcctgcagagtgttttccaacttggttccattctccccgtcactttcaggtacaccagtcagacgtagatttggtcttttcacatagtcccatatttcttggaggctttgttcgtttctttttattcttttttctctaaacttcccttctcgcttcatttcattcatttcatcttccatcactgataccctttcttccagttgatcgcatcggctcctgaggcttctgcattcttcacgtagttctcgagccttggttttcagctccatcagctcctttaagcacttctctgtattggttattctagttatacattcgtctaaattcttttcaaagtttttaacttctttgcctttggtttgaatttcctcctgtagctcgtagtttgatcgcctgaagccttcttctctcaacttgtcaaagtcattctccgtccagctttgttccattactggtgaggagctgcgttcctttggaggaggagaggtgctctgctttttagagtttccagtttttctgctctgttttttcccaatctttgcggttttatctacttttggtctttgatgatggtgatgtacagatgggtttttggtgtggatgtcctttctgtttgttagttttccttctaacagacaggaccctcagctgcaggtctgttggagtttgctagaggtccactccagaccctgtagaaaccactatttttaaggactaagaatacagaaaagaaacatagatatatacatatatataagtaaatgaattcacaagaatttcacgttaatttttaaatgtttaatagccttctttctgtcatacacaagttagggaactatggttggtcctttgatcttcaggagtaaactcactaattttaagtcaagatataaattgaacacttgaaaaagcacaaagatgacagtatctctttctagcctcaacagggggaaggcagaaagtgtcccatagacaaattagtttaggctttcatatcaagttagctgaagttactagactaaattagtttgttttaataactactttatccacttactgcatatacatatatataacagatgcccaatatagaaatttagaaaagacagttacacagaagaataaaatgcaaaccatttttaacactactacagagatagctactgtttgcattagttgttgtttgtttacttgtttgtttgtttttgagacagggtcttgctttgtcacccaggccagaatacagtggaataatcatagctcgctgcagccttgacctcccaggctcaagtaatcctcctgaaactgcctttgcaaagttataactgaggaaattatgacaatgaaagaaatcagacctaatctactccatcttgcttgtaacatttaagctgttcttattcattcctggcagtaggctgaactaactttgggaaggaattcagttcatggtttgactctgaaacaaaatggatagcagccctttcccgaaaagaccccttcttgcctggggacgagtctgcctttgcaggactaacaaattagctacaagattagaaattacagtttaggggtcatgcaacctctggctccaagagtctgaacctccccaaattgctcctggggataacatcactattgtaaaacctagatcagtgcttgagatattctgcagaccctgcactggatggatcagctgacaccacccagactggtaatctggctcaaccagttctgccatcccactcaggaaagaagacagcaagaaaaccttacttcgttccccctatgattccatctccaacctgatcaatcagcactccccactttgcaagcccctacccaccagattatctttaaaaactctgatcccacccagcatggtggctcacgcctgtaatcccagcactctgggaggctgaggcgggtggatcacaaggtcaggagatcaagaccatccccactaacacagtgaaaccccatctctaccaaaaatacaaaaaataagccaggcgtggtgtcgaacacctgtagtaccagctactcgggaggctaaggcaggagaatcacttgaacctgggaggcggaggttgcagtgagccaagatcgcgccactgcactccagcctgggtaacagagcaaaactctatctcgaaaaaaaaaaaccaaaaaatttgatcccaaatgctgaacgtctggggagactgatttgagtaataataaaactctggtttctcacacagccagctctgcctgaattactctttctccgttgcaattcccctgtcttgataaatcagctctgtctaggcagcaggcaaggtgaatttattgggcggttataatcccacctcagcctccgaatacttgggactacaggcatataccaccacacatggctaattttttttattttttgtagagacaatgtctgctcaggctggttcaaacttctggcctcaagtgatcctttgaacttggtctcccaaagtgctaaagattacaagcatgagccaccacgcccagccttgcattagttttgacccacctcatttcacacttaaattttaaaaatgaatacattttattttaaataaaaattatatgtacctttttttattatgaactaagcttttttaaaaattttcagtaactctcacagtgcctgcctcatagtatataccaaataaatacataaaagtatccagaccacattagcttattcttttattatttttcaatgtttaaacgtctattgatatcagtgataactgctgtcttccagataaaaattgaaaaaaaaaattctggagaaactcctaaaggtagaactcttttaatgctctcatgagcttacactctaattttattacatcaaacaaccaaattgataactataaaattaattagaaatataggaattactgcttaacatgcacaaagcacatcttcttaacaggaaacatatatttctctatgttaagtacaaaatatattactgtcataatatttcaaaaatgagggaggagcttcaagatggctgactagcggcatctggtatttgccacctccacaaagaagaaccccttcagatagatcacctatcaaaaaacactgaaattcaacagagaagtgacagaaaacacctaaggtaaggaaggagagaaaaggaaggaaccctgcttagcagggaccagctgaaagcctggagaggctccccaatgctgggagaaggtaagtgagtggcctccagtggtctacattcccattatggactcctgcaatcctagccatgagagagcacctccaccctcgcagcccccaggactagtatagggagctacaagatatgcaatggcattgctccagagagggagctcctaagcggttaaagcaaggcaccattttgagagtctagccccgaatggactgcaggctgactttgggcttaatagcccctacatctccacattcctggagacttactgacatccccaagtgtagccaggcactgctgctggctgctgccaccaatgctgaagcaactccaccccctcaggagcagggctgctgcacatttcaaaacaccctgtggaagggctaccctgcttatctccactacctggagcgaaagtgcatgctctccagtcacctatagctactgccactgaaagcaaccccatcctccccaggagcagggcagcagcacagtcactactgcccccacccaagcattccaccagtggtctggatatcatcccatgcctgcctaccacagccagctcccacatgcaccactagaggggtctgaggacaggcctgccctggctctacactcccactcagtgcctgagcaaatggtctggaagcctggggatgaccctgccccatccaccactgttggtacctcagcactcctcccaggagcctgaggacaggcccactaaacctgcagctactaccacagctaacatctgcctgcatgtgccacctacgggcctggggactagtgtgcccagcctgttgcagccactgtcaacaccaatgcagacttcttggaaaccagaggattgtcctgccactgctactgccatttcccatgccatacctgctgtccaggggcctgaagacccagccatccagaccagtggtctaccactgccactgccagcacccaagcaggccagtcacctggaggcccaagattcatcatgcttggactcactaacaccagtgccagcatatactgcactgaagcccaaggacaggcacactcagcctgctgctgccaccagtgaagtccaaggactggccttcttgatgaccccatccccagcaaaacttcactacagcctccactaacaactataccctaagccactgaggaaatcacaaacaccactgatgctgtttacagctgaagaaatcaaacagaaactatactattgcaagcactcaaaatcaaagcaaaagtgccctacccaaacaataccacagatacatcttcaggaaaaattcctcccctataaaagagaattcaaaaaaattagaagaagtggttgttataccagatgcgtggatataaacatgaggacacaagaaacatgcaaaagcaaggaaatatgacactttcaaaggaacacaataattatccaacaacagattccaataaaatgtatgaaatcccatataaagaattcaaaataaggaaattaaagacattcattgagatgcaagataactcagaaaaaaaaagaaatcagaaaaacaattcagagtatcaataagaaatttacaaaacagacagatataataaaaaagaaccaaacataaattctggaactgaagaatctagttattcaacaataactagagaaagcagaagaaagaatttcagaacttgaggacagatttttggaagtaaaccagtcaaacaaaacttttttaaaagaataaaaaagattgacaaaagactacatgacatatggaataccataaagtgactaaatattctaattttcagtgtgccagaaagcaaacagaaaattacaaagagagaaaacctatttaacaaaataatagctgaaaacttcccaagtctggcaagagatttaatatctagataaaaaaatctcagagattcccaaacagatccattcaataaggccttctccatggcacattacagtcaaactgtcaaaagtcaaagacaaagagagaattctaaaatcagcaagagaaaagcacctagttacttataaggaaaccctcatcacactaacagcagatcagatttttcagcaaaaacgtcacaggccaggaaaaaatggaatgatatattcaaagtgttgaaagagaacagctcccagccaaggatgccatacccagcaaatttatccttcataaataaaggacaaatcatctttctaagacaagcaaaagctgagggaattcatcaccactagaccagacctacaagaaatggttaagggagttctacatatggaagcaaaaggacaatatctaccatcatgaagatacataaaagcataaaaccactggttgagtaaacacaaatgaggatcataaaggacccaaatgttaacactacagaaaaacaccaaaccacagtgataaacaataatagaaacaaaaaaaggtatacaaaacaaccagaagtcaattaataaaatgacaggaataagccctcatatatcaataataaccttgagggtaaatgaattaaactttccacttaaaagatataaattgactgacaggattttttaaaaacatgaccaaactatatgctgcctacaagtagctcaactcacccctaaagacatacatggactgaaagtaaaggaatggaaaaatatattccatgcaaatggaaataaaaatgagcaggcatagctatatcaacatcaaataaaacaaagtttaagtcaaaaaacagtaaaaacagacaaaaaaggtcactatatcatgataaaatgatcaaatccacaagagaatataataattctacatatatctgcacccaacttggagaacccagattcatgaagcaaatattaccaaatctaaagacagatagattccaatacaataatagtgggggatttcaacatcttactctcagcattacacagatcatctagacaaaaaattaacaaagaaacactgtatttaagctgtactttagaccaaatgaaactaatacacatttaaaaaatatattatagctacaaaatgcacattcttctcattagcacatagcatattctcaagaatagataatatgttaggcaaaaaaatgactcaacaagtttttaaaaattaaaatcatatcaagtatcttttcagaccacaacggaataaaactagaaatcaataacaagaggaactttgaaacctgcacaagcacatggaaattaaacaacatgctctgaaatgacaattgggtcaagaaagaaattaaggaggtaataaaaaaagtcttgaaacagataaaaattgaagcacaacatattaaaacctatggaatacagcaaaagcagtgctaagagggaagtttatagcaacagatacttacatccaaaaagtagaaagatttcaaataaacaacctaacaatgctcctcaaggaactagaaaaacaagaacaaactcaatccaaaattagaagaagaaaagtgataataatgatcagagcagaactcaatgaaatagagacaaaaaaaacagcaaaggatcaatgaaatgaaaagtttgttttttgaaaacaagattgataaacccctatgtagactaatcaaggagaagacccaaataaacaaaatcagaaagttgtactttagaccaaatgaacctaatacacgtttacaaaatatactaatattttgtatattattatatacaaaatatatatatgagaaatgagaaaggatacattacaactgatactacagaaacacaacagatcaccagagactattatgaacgactatacgctaacaaactgaaaaacatagagaaaataggtaaattcctggacacatacaacctgccaatactgactgacaaaaaaatagaggccaggcgcagtggctcatgtaattccaacactttgggaggccaaggcaggaggattgcttgagaacaggagttggaaaccagcctgggcaacatagcaaggccccgtcaggaaggaaaggaaaagaaaggaaaggagggagagagggaggaaaaaggaaaaggcaaggcaaggcagaaaaggaaaggaaaggaaaaaagaaaggaagaaagaaagaaagagagagagagaaagaaaagaaagaaaggaaggaaggaaggaaggaagaaaagaaaagaaaaagaaaggaaggaaggaaggaaggaaggaagaaaagaaaagaaaaagaaaggaaggaaggaagaaagaaagaaagaaaaaaaagaaagaaagaaagagaaagagagagagagaaaggaaggaaggaaggaaggaaatagtgaacctgaacgactaataataagtagcaagactgaatcagcaataaaatcttccaacagaaaaaaatccaggactggatgccttcactgccaaattttaccaaagttacaacgaagaactaataccaattccacacaaactattccaaaaattgaagaggagataattctctctaactcattctagaggtcagcatcacgctcatatcaaaaccacacagagaggcaacaagaaataaataaaaggaaagaaaagaaaactatagctcattatccctgattagcatggatccaaagatcctcaacaaaatcctagcaaaccaactccaacagtatatcaaaaagataatataccatgagcaagcagaatttatcccagggatgcaaggatcttacatttgtacaaatcaataaacgtgatacatcacatcaacagaatgaaagacagaaaacagatgatcatctcaacagatgcagaaaaagcatttaataaaattcaatatcccttcatgataaaaactatcaacaaattagtcatagaaggagcatacctcaacataataaaagccatatataaaaacccagagctaacatcacaccaaatgaggaggagctgaaagtctttcctctaagaactagaatgggaaaaagatgcccacgttcaccactcctatccaataaaatgctggaagtcctatccagggcaataaagcaagagaaaaacataaaaggtaccaaattggaaaagaggaagtaaaattattcctctttgcagatgacatgctcttacatctgcaaaaacttggaagattcataaaaaaattctaggtccgataaataaattcagcaaatttgtaggacacaaagtcaacatacaaaaattagtagtgtttctacacatcaatgatgaactagctgagaaagaaatcaagaaggcaatcccatttacaatagctacaaaaaataaaatacctaggaataaatgtaaccaaaaaggtgaaagacctctacaaggaaaactataaacgtctgatgaaataaattgaagaggtcacacaaacaaatcgaaaaacatcccatgctcatgggttggaagaattaatatcattaaaatgaccaccatactacccaaagcaatctacagagtcaatgcaatcactatcaaaataccaaagtcactttgtacagaaatagaaaaaaaatcctacagttcatatggaaccaaaaaagagctcaaacaaccaaagcaatcctgagtcaaaagaaggcatcacactacctgaaaacagacacataaaccaaaggaacagagtgtaaaccccagaaataaaccaacttattaataactaactgatttttcacaaaggcatcttggtcagagaacatgcattggagaaagaataccctcttcaatcctcttcaataaatggtgcggggaaaattggatatccataagcagaaaaatgaaactggactcttatctctcaccataaataaaaataaactcaagatggattaaagacttaaacataagacctgaaacgataaaactactagaagaaaacatacgagaagcatttcaagacatcgatctagacaaagatttttatagctaagacctcaaaagcaaagataacaaacataaacatagacaaatagtactatattaaactaaaaagcttcttcacagcaaaggaagcattcaacagaatgtagagacaacttgttgaatgggagaaaatatttgcagactattcatttgacaaggtactaatatctggaatacacaaggaactcaactgaacagtaaaaaagcaaataaccccatttaaaagtgggcaaaggacatgaatagacatttctctaaagaagacatacaaatggccaacaggtatatgcacaaatggtcaacatcactaatcatcagggaactgtaaatcaaaaccacaaatactatcttactccagttagaatgactattactgaaaagacaaaaaataatagatgctggagaggatgcagagaagaggaaacatttatacacggttgtgggaatatgagtgagtacagccacaatggaaatactatatttctcaagaaactaatagtagagtcattaccatacaatccaagaatcccactaataggtaactatccacagaaaaagaaatcagtataacaaaaagatacttgcaccccatgtttactgcagcactattcacaatagcaaagatatagaatcaacctaagtgtccatcaacagatgaatggctaaaaaagaataaaatcatgtcttccacagcaacatggatggaactggaggtcattatgttaagtgaaattagatagagaaagacaaattttgcatcttgccactcacatgtcagaggtaaaaatgttgatctcatggaggtagagagtgaaataatagagacgagaggctaggaggggtatatgagtggcagagaggaatgaagaaaggctgatgaatgggtacaagcatgcatttaaatagaaggaataagttctaatgtttgacagcataatagtgtgactatacttaacaacatgtatggtatatttcaaaatagctagaagagaggacttgaaatattcccaacatagagaaatgataaatactagaggtgatagatacccgaattaccttgacttgatcattacacattctatgcatgtaacaaaataccacacataccccataaatatgtacaaatattacgtgtcaatttaaaaaatgtatttaaccttcaccaatgtagttgagaggaggaactgtttacactgaatctaaattgaattttaagcatcatttaaattaattcatataaaattcactcagtcactagtgactaataaagtgaactctaataactcaggaagaaatgtttagtttcatattcaaattgtaaattaaaccagagcagtattattcaaatttttttcaggcatcagggtacccagagcttataatgcattttgcagaccacccaaaatactgattaagcttcaaaataaataaataactttttgctaaatcggaccactttttttttttttttttaacagcatctcgctccatcacccaggctggagtgcagtggtacaatcacaactcacagcagctctacctcctgagctcaagcgatcctgccacctcagcctctcgagtagctgggactacaggtgaacgccaccaggcctggctaatttttgtattttttgtattttttgtcagagataggattttgccatgttgtccaggtcggtctctaactcttaggctcagggaatccacccactttggcctcccaaagtgctggaattacaggcatgagccactgcgctcagctcagaccacttctcacaccagattctgttatttatacctgagaaaacgtatgggtggtagcatgggatgaagggagattaaaccattatttgattttagtagcgaaaatctttagttggattacacctcagaagaatagtttgggaagcactaaactagagaattataagcacagccacatttacatgtgcaatttaaattagatcttttaatgcctttttaaagtttaaaaatatcaacagcaccaaataacctcctcaaatctaagcatctatcatttgctttcatcttctgccttcagaaaatacagatttggctcaattgaatagcaagctaaggtcaccagggctctcaagataacagaactcttgaactgacacaccacattctttcttactgatttcatctagttaggcctccgtgtgattacactgagcattgcacgctctcatttaagatctcacttgcctccatcttcatccttcatttccctaacttctcaaatcctcactgatctttgattttctggctcttatcttggaaggttatttgttttgtttggtaattgtttgtatctcccctccccacacatgaagggatcagtgtacctactctatttcttttatcaaataaacacagcgctgagcaaagaaagcaacaaatatttaaccagcttttaacttatccactgacatctgtgagatttctgaggttctatttcaatgctccttgatattgaatagttgcttcaacttaaaaagtactatttttcaccttagaaatatttcttttggccaggcgcagtggcttacgcctgtaatcccagcactttgggaggctgaggcgggcagatcacctgaggtcaggagttcgagactggccaatatggagaaaccccatctctactaaaaatacaaaattagctgggcgtggtggcacatgcctgtaatcacagctactcaggaggctgaggcaggagaatcgcttgaacccgggaggcagaggctgcagtgagccaagattgtgccactgcactccaggctgggcaacaagagtgaaactccatctcaaaaaaaaaaaaaaaaaaagaaaagaaaagaaatctttcttttgccctgtttaccttccagtttatttttaactcttcacaaggctgttgtgtcagggcccttgtgtcagggccctcagagtagtgctccgggttatgaagaaaatgtacagagacagaaagccagtctaacggtgtgagcaaagcaagaatttgacactaaaagtgactacagaggcagcaaaaaggagcacagccagcaggcccagttctttcaagaaagaatacttatctcaggaaaacttggcgctgctcttccattttattttttcctttttctgtaaaatatgctaaaagatacctacctacatatctgctttatattgtcaattttcatgtaaaatcagtttgtacctattttttacttttataaattgattgtaccacaaagtttttaaaaattctaaatctctgaaaaacatacctctgtatttcaattataaacccaatttttataacaagaagactcaaaaagaaaaaaaaatcacatctttcagcttaccatatattggggaaaatgtgaagtagttcaggtgacaaatattataggcttcaattctaacatctttccagattccctgggtaggaaaggaaggcccccagtcccaactaaaggaacattgctcctgcaatttcaaggagaaaaagaagatatattctgattatggtgaaatttaaacattatgaaaaacattttctttaaaaatgttacatatgtgtatataagtttgctatggcagccataacaaagtatcacaaactaagtggtttaaacaatggaaatgtattttctcacagtgaagtccaagatcaagctatcagcaggtttggttcctcctgaagccgatctcctctgtttgcactgtgtcctcacatggtctttttctgtgctaggcatccctggtgtctctctccattgtccaaatgtccccttcttaaaaggacactagttgtattggaatagggcccacactaactgcctcattttatcttaatcaccccttaaagaccttctccaaatatgattacattctgagataccagaggttaggacttcaacatatgaatttggggggaccacaagttagtgcaaaactgtgtgtgccccccaaccaccatacacagcctctgaggtggcccacaatgatcccccctttgaagtgacctagtgaatcacttctaaccaccagcatatagcaaaaatgatgtgattttattaattaggttataagagactaagccttgaattttgggtactctctcatgccctctcttggccaagagggaagccagcctctgtgtcatggggcagctctgcggagagacccatatgggcaatctgaggtctgccaataactacaagtgagctcagaaacagactcttcagccttgagtcaacttgagccaagccttgagacaactgcagccatgagaccttaagccagaggcacccagctgagccacactcaactcagattcctaactaacagaagctatcataataaatgttttgtttatattattttttagaaatcagaaaacctatagtccacatattttctttttttaacttttaagttcaggggtacaagtgcaggtttgttatataggtaaacttgtgtcatgggggtttgtcatagagattatttcatcatccagctattaagcctagtacccattagttatttttcctgatcttctctctcctcccaccctccaccttctggcaggccccagggtgtgttgttcccctctatgtgtccatgtgttctcatcaataaatgttgttttaagctgataagttttggcataatttgttacatcacaatagataactgatacaatatccaatatatccaatatatctatgttgcacgtaacctatgaaacagataaatttggcagaaatgttctaagaacataaaatctatgaagagttgtacatttattcttcaaatgcttactacattgaagcaactcaatagttcctctttaaatttctctataatatctctgaacctaaccattgtatttaaatctaatagttacaaagaatattgtgcttacatgtaataattaaaaagaatgaggaggccgggcgcagtggctcacgcatgtaatatcaacactttgggaggccgaggcgggtggatcatctgaggttgggagttcaaggccagcctgaccaacatggagaaaccccgtctctactaaaaatacaaaattagttgggtgtggtggtatatgcctgtaatcccagctactcaagaggctcaggcaggagaatcgcttgaacccgggaggcggaggttatagtgagttgagatcgcaccactgcactccagcctgggcaacaagagtgaaactcagtctcaaaaaaaaaaaaaaaaaaaaaaaaagaatgaggaaacatattgaaagacaaacacttataaataggttttaaaaagctctggctaaacttgccaacctcaggtatgaattcagaagtccttgtttctgaacgtgaagcccaaaagcaatcagttcgatctttagcccctgaaacaggtggccaaggcagacattttatccaatcttatttgacctgggtacctgtctctcccttgatgacactcaacttccatattaagttacagagttcaaattcaaaaataagaaataattctgtaaaataaatccctttcacacagaatgttttctaatttctacttcttaaaagaaaaaaatattttcagaacagttaattaaaatgtgtaaagctataagttcagcttttaaaaaggaataagtttgggtcatacattttatggggggaaaaaaagtaacaagcaccagaggaaatactaaaatccttctagatggagtcatttgtgaaatagaacctgaagatttggccaaactgttgtcatttgggtattatttccttagctctgtactcacctaagatagagacaaatttgtttttactatggagaaaaacaaagaactaaagttactttatagcatccacatctgtctaaatttaccacttaagcaccagattctcatattcagaatgaaaaccatcttggggacatttatgggagaattttagtatctatttgtaattttttcattggagatagggaaaagaaggagagcaaaataatcaacatcttatgagggagactattttccccattaagagctacaaatcactcttaacctcttcaagaagtatttattaagtgccttctatgtttcaggctgggagtacttcaatatacacaacagacacagctcttctgcttataatgctcacagtcaagcacgaaattcaagcattgaataaataattacaagtataatgagttttacaatggaaataggcagggaacatacagtgagaggttgaggaggatgggtatcaagatgagttttcctgaaaaaaaaaaaaaagaccctgaagggtgagtaccgtttatccactgtgagcaggcaggaactttttttttttttttttgagatgtctcactctgtcacccaggctggagtatagtgacacaatcttggctcactgcagcctcaacctccaggctcctcccacctcagcctcctgagtggcagggactacaggctaatttttgtatttttttttagacttggggttttgtcatgttgtccaagctgatcttaagctcctgaactcaagtgatccacctgccttggcctgccaaagtgctgggattacagtcatgagtcactgtgccggcccagaagcattcctttcagaaggaacagcatgtgcaaaggtctggaggtgcaggacagtctgatgcattccagaagctgaagagagaacaatgggaagaggcagggagatgactggagaagtgagcatgggccagacagagctaagacccatggacactggcctaaaggcaatgagaagctgttgaagagtttgaagaaaagcagtgctgtgatcatttttttctgaaaagaccattctagctgctctgtaaatgattaactagaggaaggcaagtgaagtttcagggatgccagttaggcaaccagggcaatatttcatgcaaggcatgactgaactcaagacacagtggcagaaatgaaatgtgaacagactgaagagctattgaagaggtactattcacatcatcaagaggactaagcaatagattggaagagagaaaaaggagagaaaggtgtcaagaaaaactcaagtttctggcttgagcacctgttgtggatagtattccattcagcaagagacagaaccctgggagaaggacttaaatcacaagtgcggtgtggcgcatactgagctttaggtccctgtgaatcagacaagtgatgatgctaaataagcatctgaatgtaaggtctggaattgaagacaagttggacggaagacacaatattgggagacaatggcaaatagatttgttatggaagaaatgaaaaatgagatagcctagagagggtataaaatgagaaaagagtctagaacagagaaaggccctataatataacttttaggagaacaaggatgtggataaagagacttacaaggaacggccagagatgtaaacggaaaacaaggaagatggcatcaaacactggtaagagggtagcagaagtgatgagtcccactatccattctggacagaaaaggaagcagagacaataggggacttaggttgctacagggaaagtggaggttcaaagaactggtgaaagagaatatcaggggaaccagcccccaatatttcaacataggttcttttctattttccctaagtgtcagccagtctgagaaataaacagaaagagtacaaagagagaaattttacagctgggcctctggggatgacatcacatattggtaggaccgtgatgacgaccccaagccacaaaaccagcaagtttttattagggattttaacaggggagggggtgtacaaacagggagtaagtcacaaagatcacatgcttcaaagggcaataaagatcacaaggcaaggcaaaattagaattactgatgacggtctatgtcccgctgtgcaaacattgtcttgataagcatcttaacaggaaacagggttcgagagcagagaatcagtctgactagaatttaccaggctggaatttcccaatcctagtaagcctgagggtactgcaggagaccagggtgtatttcagtccttatctcaaccgcataagacagacactcccagggtggccgtctacagacctacccccaggaatgcattccttccccagggttactccttgctgggaaaagaattcagcgatatttctcctacttgcacatccgtttataggctttctgcaagaagataaatatggctctattctgcctgaccccacaggcagtcagatgttatggttatcttcccttcttccctgaaaatcgccgttattctgttctttttcagggtgcactgatcatattgttcaaacacacattttacaatcagatttcatattgttcaaacacacatgttctacaatcaatttgtacaatagtggtcctgaggtgatgtacagtctcagtttatgaagataacaggattaagagattaaagtaaagaccccactaacttcatataacctaagctgagcatcttgttcattacccgtaattatagtaataagcctccaaaatagatatcaccactctactttttgaatggttgtatagcactttacaacatgcaaagtgcatttacattgttatttcactatatcttcatatcagggattagctccatgtacaaatgacgggcatacctcaagttattctatgttcacaaagccagaattcagacccaagactcttcacttggtctccaactcaggtgtcttcccactggaccatgtcaatctagtcagaaatacctagatgcaacttgcaattgttctggaagcctacccagaggttagtgtccaaaacattgtgatagcagaaaactggatctgattcctgatgttagtgacaaagggctatgttctatctagataacttgagagtatgttttaaatgccacaaattgaatagagggtggagcaaaatagcatatggatatatgtataacatttatattatctttattgatgacttgaaaagtaacttttcacattaggatccaggatagtttcagttttgataaaggttaaaaatggaaggggaagccagcacagtagctcacgcctgtaatcccagcactttgggaggccaaggtgggtggatcacctgaggtcaggagttcatgagcagcctggccaacatggtgaaaccccatctctactaaaactacaaaaattagccgggcatggtggcaggcgcctgtagtcctagctacttgggaggctgaggcaaaagaatggcgtgaacccaggaggcggagcttgcagtgagctgagattgtgccactgcactccagcctgggcaacagagcaagactcagtctcaaaaaaaaaaaaatacaaaaattagccgggcatggtggcaggcgcctgtaatcccagctactcgggaggctgaggcaggagaatcacttgaacccgggaggcagaggttgcagtgagccgaggtcatgccactgcactccagcctgggcaacagagtcagacttcatctcaaaaaaaaaaaaggaaggggagagggaaaaagtacaacctctagcatttaaaccactgtgtcattggaagccaaaggcaaaagaatcaaaagataaatcttatccagacttataagcagacaaatattccatggaatacttgactactgaaaattgtcaaagcaatactctaaggctgttattacagtaatttgaacaaatggtcaatgggtcattgacacaagtttaggtaggttgaatcaaacaggaggaggtataattttaatcctagtacttatattaaggaaacataatttaatagtaaatcaatccagctgaaaaagagccatttaatttaatcagaacatattagctaatgtaacagttctacctaaagagtattgggaaaatatgtttagtatcttcacaatgagcccaatcattacatttgttgttaaaactaaatttcatggctcacgcctgtaatcccaacactttgggaggccgaggcgggtggatcacctgaggtcaggagttcaagagcagcctggccaacatggcgaaactccgtctctactaaaaattaaaaaattagccaagtgtggcagtgcatgcgtggaatcccagctactcagggggctgaggcaagagaattgttttaacacgggaggcggaggttgcagtgagccgagatctcgctactgcactctagcttgagcaacagagcaagactccatctcaaatacataaataaataaataaataaataaataaattcaatccatcaaaaaattaaaaatagaattaccatatgatccaaccatactatttctgggaatatatccaaaagaactgaaagaagggtcatgtaaagatatttgtacacccatgttcatagcagcattattcacaatagtcaaaaggtggaagcaacctaaacgtccgtcaacagatgaatggataaacaaaatgtggtatatgcatagaatggtatgttattcagccttaaaatgtaaagaaattctctcacatgctacaacatggatgaatcatgaggaaattatgctaagtgaaataagtcagtcacaaaaagacaaatactgtatgattccacttatataacatttctaggggaatcaaacacatagaaaagagtagaatgggccaagcatggtggctcacacctgtaatcccggcactttgggaggccaaagtgggcagattgcttgagccttagagttagagaccagcctgggcaacatggcaaaatcctgtctctacaaaaaaaatacaaaaattatctgggcatggtggtgttcgcctgtagtcctagctactcaagagacctaggtgggagcatcgcttgagcccagaaggtggaggctgcagtgagttgtgatcgcaccactgtactccagcctgggcgacagagtgtgacccagtctcaaaaaaaaaaaaaaaaaaagagaaagaaaagaaaagagtagaatgctggttgcaaggggctggggagaaggaaatggagagctattgtttaaacaataatgggtataatataatataatgggtaatgggtagagtttcagttttgcaaggtgagaaagctctgtggttacttaatgtaaatatacttaacactactaaactgtacacttaaaaattattaaagtgataaattttatgtacagtttatacaattaaaatttttaaaatatgaagtaaaatgaaataaacattaaaaaaccaaatgtcacatagaatactgattcaatcatgtagtaaaatagatccaagtcctcttagactggaatcatactctaagaaaaataattacttttgtggactttgttatctttttgttagattttatgagaacctgacagtaagatgcaagaacatatcatcaaatatactaatatttgcagagggcttcctagaaacaagaatcactaatacattttcacaatctggtgaaaagtttgataaacttaaatgttaaaaaaataatttgtaaagttccattatcagccacatatttttcctttctttttctgttacctaagttctgaacacgcttcaggaagaaaacttagaaaaagataaagattctccacaatatttcaaataatcttttggttcttatttcaaattttcaaaccccactaagggatcaggaaagagattcctaacttctgaaatgccatgggagtcttcaaataagcatttcatatgccagcacaccccgtcctcaaaaataaaacccgacctgtttgagagaccattaccttccgaacaaagttgacatggcattcacccttctgcacaagtggagggcagtctgggggaacctggtagcgagtgtgagctttgctctgctgtgctgcatacaacaccgctgactggaaacgcagctcaatggagttcacgtccctgaccacgttggtaatatcaaagctctaagttaaagggaacaatcagacaaacccatgatgtggaagtagtcttgtgtgtaaaattttagataaaggcattttgtatgaaagacacataatataatgccgatctaggtttagcctccttgcaggagggaacacttctctgaaacactgtagtatctatcacttagttgcccacttttagttaaaactaagcatattttcctacccaatccaagtttctaggcttctccttctatttttcctggcaaaatgatggtcctagggaaatggatagagcaaaaaataactttagctctggaatgtctgctctgtctacttatatgtggccttgaactgccaagggtttcctagacacttcatgacaacctgcctctccggtatgaacagcatgcatttctaagtaatgagttatttttgttttgaaaagtctacctttgaaaggaaaggaagatcagcatataatctcttaatataactattccagaaaggaaatgacattttattttaaaatcatttgtccaatgaaactgtatcagcagaggagggattggcatgttttgaacacttcctatgtgccaagaacttgccaacattttatacaattagcttactaaatccccacactaaccccatggggtttgtaaggtttccattattccacaaatgtggcaactgagaaatcaagtaactcatccagtgctttaatgagctcatatttgtcacatggccaattatgcatttacttttctctactcacaaaagcaattaacataaacacacataaattttttttaacctaatgtcattatatacttacatatctattgaacatattgtctgtttccccaatagtgacttcattgaacaggatttttgaaaccgtatccactccctcaagaatcaaatttactttttgccatttgctaaaaaaaagaaaagatttttaaaacaagatgtgtaaagcattaacttagataagtctcttttttattatttaaggcctaaagaaataaatattccacaaaaaatatatgttcttaaaaggcagtttccagtgacattttcagaagtactgctttaaaacatacttacgtcctttgagtgatccagcttatctttctctataatgtatcaataaatcaccataaaaccaagagcacaacttataatttccaaatatattgactttttctagttaatacttcagaaagctattatgagaaccaagttaggccaggagcagtggctcacgcctgtaatcccagcactttgggaagcctaggcaggcagatcacctgaggtcaggagttcgagaccatcctggccaacatggcgaaaccctgtctctactaaaattacaaaaaactagccaggcgtggtggcgggtgcctgtaatccaagctactagggaggctgaggcaggagaaacacttgaacccaggaggcggaggttgcagtgagtggatatcccaccactgcacttgcaagattccgtctcaaaaaaaaaaaaaaaatgagaaccaagttaaataatagacataaaatgttctcacaaactacatttactgaccctgtctaagagaacacgttagaaaactatcatctataagtgaatattatgcacccagcactctgctaagccttacaggaaactataacagtgcctgtacttaaggagtctgcaatctggttggcatttggtggctggctggcaatattgttgaacaactacaagtgctatcagagtttatctcataagaaaagatttcaaaatggaaacaagaacttaatgaagagaagaataaataaaatgtgttgtattcatacaataaaatactattcaacaataaaaaggaatgaagtactgatacatgctacaacatggatgaactttgaaaacattattatgctaagtgaaagaggcggtcacaaaggcccacatattgtatgattccatttatatgaggtatccagaacaaggaaatccagagggacagaaagtaaattagtggttcctagggctggggtaagaattcaggggcaggaggagtgggcaatgggaaatgactgctaatgggtgtaactttttgtggggggatgaggaaaatgttctaaaattgattgtggtgatggttttgtaactgtaagtatactaaaaaccattgaattatataccttaaatgactgaattgtacaatatgttaattatatatcaataaagtattttttttaaaactaggtagaaatgactgggtggaggcatttctactccccttataccctttgctctttgcaggaaccccttacccctgcaaagagcaaaaccaaaacaaggaagtgctgacagcatgaattacttttaggtaatcgactcatatgtgtaatttgggctggggagctaaggaggaaaaagctggacaaatccaaggggcagagaggtgcgggcagtgttacagggacagacatctttcagctgtattttcacagacaagtgagaagtttatacttgatttgccaagtaaaatagacacttgctattcttgaacgaatacctatcttggcacaatcaatattctgtgatgattaatctaatgtttctaaattgaaaagattggagaataaaagaacaaagcaagaaatttgattaggcagctttggcctctttcctggcactcttctaggcaaagatggaaagatggaaatgagatggaaggggccaaaccaagagaaatgttaaacaaaaatttgcaagacccacccagaacagactgaacacaggaagatgaagaaaagatgtaataagcccaaagcaccttagacatagactggaaaatggtgttacattaagaaaaacaatgaagctgttagaatataaagttagttttaagggggaaaatcaattggatatgttgagttcaaggtgaaatagaaccattacgaaagatattctaaatattatctgtaaataaaagcctggagcacagcagtaactccatgatattgataacaatattctggccttttcccccctttaaaagactagtaaataattaccaaaaaaaaaaatcacataaaagggacagaaggattttttttttcatttagcagtagtggtggtacctttgggtaacgttctacctcatatggaaatatttgcttataataacagaacattactgaaaacagtatctgtgcttcacctcctggcttcaccacatagtataggtcaaggtcatagtctcaatggctggttagcactacatagggcataaccactggaaaaatgactccataagacacaatttggtgactgttgattagtagcaccatcctcatatacaaaacaaaacataaataatatattcacttttatagtacaaggctttcatcttacttaactctcagatatgtaacctaaacaaacaaaacaaaacaaaacatacaaaacaaaaaaaaaacaaacaaaacacaacatttttgcccagatagaaaaagaagaaaagttcaaataataataaaaatacacccacaaacatacatacctaatttcaaaggggattttaaattctttgctataggtccagttatccaaagagacccatctgtagttaaggtcattaaatctgtagtaagaatcctgttgatacaaggtaaaaattatggtagatggttaaatatgcacaaataaattaataaaacaaacataaaataaattattaacaacagctatttatcacctaaaaattaacgaacttttagcctagtagtacaaagaggggacagatcgttaatactgaaaaatgtgaagggaaaattccaacaaattacctgaaatgaaataatcctctgagatataaataatacagcttcattatcaaagaaaattggtgggcattaagattggcttccccttggagacagggtttcaccatgttggccaagctggtctcaaactcctgacctcaagtgatccacctacctcagcctcccaaagtgctaggattacaggcatgagccatcatgtccggcctacagtttatcttgtgtactaacctgtttcactctctaaatgagcaaagtgggagatcactgtcacggctgaagttacatggccaagacaaactatggtctgggagtcccaggttctcctgtgtgggcactttcctggaagatgctaaatgataggaaaatctgggtttcatgtttctgtgtggtcctcacctcacttgacttctgctctttctgtttgctctgggcttccgtgctctcattgatatagttctcagttttccattggtctgtatcccattctgccttggacatctttacttcttgctgctcactgatgaatcaggaggcctgtcctggagatgagcttggtataggccaattgcacatgggtctcagagcactccatcttcaaggtccagataacatgagaaatgagtcttctcacatcattattggggatgaggggccgtagctgctggtttagctgaatttcaaactgatcacctggggacgagagcaatgggtaattgaagcttttgggctcgggagacaggccagtgcccatgttgttgtattcccattgtgtttcacagtcttctctaagttgaacgcagtctcagcagaatctccctcaggaggatggttgtaggttgtgttttcagagatggtgccttctggcatagtagtgttttccataaaaatgttttgttcaaaggcatttcttgcagtggtgcttttaaaacattctgatggagaaatacttccggaaaaggattttcctgaagactcaggtctcctaaagatgaaaaagccccttgtgaaggggcatttatgaggcttttcactgcagagaatggaggcctctttgcaagcaaagtctactgagagaacttttctggaatgtacgattggttttaactcaactttgcattttctaaaaccaaaatgggtaagtctttcaatctgtttctgaccacaggtagggcttttgcaggggtggagatagaaggcacgcccatggagaagggtttcagcaaagagaagactgctgccttatgctcttggttgaacgaaggcttggtatagatggcgtttcctgctaacttctcatgcccctgctctatgtgaggctgttccagctcccttggggctggactcctgagccttttttctttggcagcattctccacaaatgcccaggcaccctgttccttcctgttgctctgctttcccacctctttgaagtgacttttctggatgctccttgggcccatgaggattctgttcactctctgcaggcttttgcctacactttgaatcttagccaggctgttttcctgtggttggacagtttctaatttcatgagtttttggatgcagattgaagagagggactctttgtatggtttttcggaatacccatctttcacatttgaaaaaaacaggtaactataaggttagctgttggcagagctagcagaggttttattttggaccaaaaaaaaaaagcaattgaattgttttgtagctgaaggcataggcatggggggtccccaggtagtaaactaccctgtgggtgggttgagggctagggctgggcctcaggtgggtctcacgttccctgtgctcccttctgctctctgggagagtcgcaggaggggcaggctgggaggggctgccgcagctgttcacttgggcaggacgtcagaggactaggacaccagcctcccatcatgggtctcgatcttcttcacaaccactgccctggtggtgctggtgcggctgaaggagctggagcccacaccagagccaaagctggggcttgggaggcccccacaggccgagctcagatcacctgcataaccactggtggtctttgtatggatactcatgttctgcatcccagagtccagctggctctcctcgccctccagcagcttcctgtaggtggctatctcgatgtccagggccagcttgatgttcatcagttcctggtactcaagcagttgccatgccatgtcctgcttggcctgctgcagggcggcctccagcttggacagcttggcgttggcatccttaacagccagccccctgtgctgcagacatctgtgatggtgccctccagggaagccctctggcctttgaggccctcagtctcagcctggagctggctgatgttccggttcatctcagaaatctcagtctttgtacactgcaggtcatcctcgtgcttcccagccagcatctgcagctcctcatccttgatctggtacatgctctcagccttggcctggctgcagttggcgatctcctcgtatggtgccttgacctcagcgatgatgctgttcatgcccagggagcggctgttgtccatgggcagcaccacagatgtgtccgagatctgggactgcagctcctggatctcctcttcatacagctgcttgaggaaattgatctcgtcagtcagcccttccaggtgagactccagctctaccttgttcatgtaaccttcatccacatcctcttgatgaggacaaattcattctccacctctgtacacttattgatctcatcctcatacttgttcttgaagtcctccaccagcccgggcatgttgccaagctccgcctccagcttcagcttctcctggcccagagtcttcagctgctgcctaaggttgttgatgtagctctggaacatgttgtccatgttgctctgagccatcttctgctgctgcaggaggctccacttagtctccagcatcttgttctactgctccaggaaccataccttgtctatgaaggaggcaaacttgttgttgagggtcttgatctgctgcttctcctgggtgcgcacagcctggatgttggggtccacctccaggttaagggggctcagcaggctctggttgactgtgatggtggtgatgccacccacgctgctgccctcaccatagcctccgcccagacaaccttggaagctgctgctgcccactagggagaagcctgaggagcttatctggacactgggcccacttgtgtaggagtggctgctgaaggcccggggcccagaggtggacaccttgtaggacttctgggtcaccctgatggacatggtggaggcaggagtgggggcaggaaggccgaaccagatagagatcccagaaggagtggagaagctgcttcttggtcttttcagttaactttaccacatatcgtctcatgaccggaggaatttacaagagggtataacttagatttatccacatttctcatgaccttccctgtgccacctggagggctgtaagcagggtttgcttagtgtagcaagtcggcaaccttgctgtggcacctagataagggttcaggaatgcagctgcagagtattcggggtaagggtcagctgcactgcgggggcggttcctggggcagctcgtccctaacagtaacaacattgattctacatcttatagatttttctatgagaaataaggcaagacgtaatttagtgcgtcattgatgtctagctgctcactcccaaagcctgacaagttgatgccattgctgtctgaggccgcctccagctcagtagtcagctcagtgctcgtgtgcttcttccgggcttgtaataccttcatgaacgctccttctggattccctacagatagatgcttcttcaactgtcaggtaagacacaataagtctttctgagtttctcttatagggtttagcttgttaatttccttatcctttgtcctcaaactcaactatcttgttcttccttgcgcctagttaccataaacagcctacccgcttcccgtcagctctaatcaataactcacatctgttcccttggttacctgcaccccatgttcccctgaaactgcacatctcacacgctccacctctgtccccctccccttctatatttaaaaaaatatgtacaagtagccaattgggtcagctcaaactgtgcagtccaaccccagcccaagggggagtagcacagagatagggactgcgttgaggataaaaaccccctggtctcctttgttctctgtgctcttgcgatcttgattgacgcaagtggcacccttctgcagaagtaaattgccttgctgaaagaattaaaaaaaaaaaaaagattggcttccccttttaaaaccaaacacaaaaccaccagtatcagcagagaatgaaagactgaatctgtggtgtgtagccagcagtctctcattgccctgtggttctcactgtgctgtttgcgccactatcccagccagcctccagggggaatacttctctactgcccaaaagtcagcacaactcccttccgctcattggattcacttagcatttccagttatttttcacttagctaagtgagcatgaaaaggatctctacagagaatacacaggcagcagagatacttcaaaacttattaacatcaggtttcttatattatcctacctcaggtcagcaaactgccacccacaggccacattcagctcactacatgtctctgtgtggctagcaagctaagtaagaatggacatgtgcccataaataaagttttactagagcacagccatgccctttcctttgcaatttacatatggctgctttggtgctatagtggcagagttgagtagacatgatggagaccatctggccctcgaggtctaaaatatttagtatttagctatttactgaacgtgtttgctaacccctgcccaagatgactggcctcctagatgttcatagatgttgctccatctgagtgtctagacccaagtctgcctcttcataaatccttaagtctttcttctcctaccccctttccactctttttacacttttttttttgagatggagtttcactcttgttgcccaggctggagtgtaatggcgcaatcccagctcactgcaacttcagcctcccaggttcaagcgattctcctgcctcagcttcccaagtagctgggattacaggcatgcaccaccacacctggctaattttttgtgtgtttttagtagacatgggttttcaccatgttggtcaggctggtctcgaactcctgacctcaggtgatctgcctgtctcagcctcccaaagtgctgggattacagacatgagccaccgcatctggactctttccactctttatctcccagaggaatactcaagacaggaggcagaacagaaagtggcaaacaaatcttttcagttcatctatccatgaacaatatatagaagggaattgtgcaggcatggaggggcttcccctcctttgtcagggacagatccaagttatttccttagggaccgtaactccaagtcaagaaggaaaagccaactctgtctaagttccacacaggtaagagccagatgaacacgttaggctggcaatggccagttaggcagttgcccagggcaaatctgtaagaagcactacaacatcagtgggagtgtatcaagatcaagataggtatctgccagaaactgatccaaactggaagaaatattttgataagctactagaggagagagtgactgatgagatttaaaacaacacgtaatcaccaaactggcttttaaggtctggttaatggtaaggttttgttctgttaaatgccgtgtgccaagcccagccaacttatctcccacacaggactcggcctctccaatgaacaaacatggaacacatatttacagacacagggttgaagaggcacctaattattagcatgaccatgtcactcccccaagacctatttataactctacactgtggacttagtccaatacagttaaaaatatcatgagaaggaaggtgtgagagcaattcagccacaacacatcaacacactaagcccgggggctggctgatgatctggttgacggggcacaagtccccttcctttctcccagctccctgaaggaatctgcaagttggttcaagagggcaatcttcccagatatattttttcgacacaaacataatttataggttaaaattttatcttaaagaggccaatctgaaaaacctaaataatgtatgatttcaactatatgtcattctggatgttaaataaaaattacaggaggccgttgttgactgagctcctatactaggcctcagcagaccagatcaaaccaaaacagtcactcatgctaagtaccacttaatcaaactgaaactttaacgaaggaggtagatccgcaaacagggcagtttttcctgaaaacttgagattcctgttcacctgagtaaggaagtcctctctgcattttttttttttttttttgaaacaggtcttgctctgctctgtcacccaggctggagtgcagtggcacaaccatggttcactacagcctcaacctccggggctcaagcaaccctcccagctcagcctcctgaggagctggggctacagatgtatgccaccactcccagctaattttttatttttatttttttgtagagatggagatcttactatgttgccaaggctggtctcaaaatccttagctctagcaatcctcctaccttggcctcccaaaatgctgagattacaggcgtaagccaccacactggccggttctctctgcttttaccctttctagaaaagtaacctgaagtaatctgatgttaatcaatcagtttttttcctactgttctgtttctttgttccttacaaaacccactattcttccatggccccatgaaagtgctcactgtattttgtagaatggatgctttcctgattcatgaatcacaaataaaaaacaatttgatctttaactacatttgttgtaattttgtcttttgacatggaaaagaaaaaactatggagacagtgaaaggatcagtggttaccataggttaagcagaggagaagaatgaataaacagagcacagagaatgtttatggcacggaaattattctttacaatattgcaatggtgaatacaagtcattatacatttgtccaaacccacagcatgtacaaccaagaatgaaccctaatgtaaagtgtggactttgactgataaagatgtgtcaatgtctgttcattgattctaacaaatgtaccactctggtggggaatgttgaagaatgggatgctgtgcatgcaaggaggtaggaggttatgtgagaaccctctgtactttctgttcaattttgctgtaaacctacaaagtctactcttccgggggagaagggcagcagcgtgagagttggctctgaagagtggtgagtcagaagagacctcaggcagcaagcgacttgggccatggcctctgacctagacttctcacctctggaggtgcctgagcccactttcctggagaacctgctatggtacggactcttcctgggagccatcttccagctcatctgtgtgctggccatcatcatacccattcccaagttccacgaggtggaggctgaaccatctgagctcagaagtgctgaggtgacgaggaagcccaaggctactgttccttctgtgaacaagaggcccaagaaagagaccaagaagaagcggtagaagaggaggcccgaggagccagacaggcagggagagggccttggggacagccctcctgggaatctatatcctgttccccctctccatcccaggttcagggtctgaggaggctgtgacaccctctgacctcagagatctagacagtcatgacagtccccaggctccagctgtgcagtccaccacttcctcttccttctgcttctgtgatggtttagagtcaaggggactgaaacacactgtgactgtattaggaggtttgtttagaagttgggtcagctcacagagtcacattttcttacttagtcatgtgtccagccttgagtcaccccctccttgtgagtttacattacattttggagtcattatctaatgctgacaagcccaccctctcccattatttgtgcactacagatctcctgctaatcagtcaccttttttgctgctgtgtagacagagccaggcctcacctgtttgtttaggccaaaacgccatggccatgcaatgttagtgatcccactagctgcgacagccaggcccagaaaatgcctgacatgagagccagcagacagcccaggccagggtaggcagtgcctgcttctgctctgtcaggtgcaagggatttggctgaaggcatgcatatttcctggacacaaacttcctgagcttctgaaatgggaggctcatcaatttcagaccaacctcttttcaacccttcaacccatcatagcacgttcaaggtgtgccttttacttccacctgtacatcccccattccttcaattctttcattccctaaccagagagagttcctgggggaaatgtggcgaataaactgcatgcatgctgaaaaaaaaaaaaaagaaagaaaagtctactaaaaatttttctcttactaagagaaaataccaaaaaaaaaaaaaaaagttatagaggcttaaattacatttaaaataactattccaaaggccaatcaaccaacctaatttggttccaggttggtctgaccctatttgatcatactgaaattctgagccttatttatagcaaacagcagctcagggttacctctcatgactaaggacccatgtcagcctgagttgttaagcaaacccatgaaccctaaaacaaataaaagtatcatttgtcaaccatttactatacatcagcctctaaagtaggcactcatacactcttatcttcataataaacacgtacagtaaataccatttaatagaggaagaaactaaagctccaaaaagtgaagtagctttcctgaggtgccacaactaagcagaagtatgtacactgaggaaagaaaccaatctagtctaacaccaaggtctgaattttttggactatactacaatgcctcatgctacatatacttacacgtttataccagctggtaactgcaacaacaataataatagttaaaagttactgcctgtgaccctagtggggtaggtactattatcatacccatttaccaacaaagactctaaagctcaactcaaatggctattaagtggtggaggactgactcagaaccaggaaagatggctccagggtccatatacttagtcattacctagtactaccattaacatcacaacaccaccaatagttacaatgtcagtgcttataaagcagcagccatgaaataaacatgccgtgtgtgcctcggctagtgatttataattgatacttaccatatttactatgtttactgtacatcaacaaaccatgtgtcatcagagcatgcaaatgacaatatcatcagtctcattttctcagtaagcttctggactccatcattatacctgattatagatacagagactacttaaccaggtatagcttttccactccccagttctgcttcagaccaatgtcagactttaccccagatacaattacttcgaatagaattaaatggagaaagttttttcaactatcttgtttacaggcgttgttttcttagacacttgggcaaaaataaataaatagatgttaagaaaacacttatcaaaaacaagcaaaatgtggattaggatacataattatctggcaaactgagataaaacggcagataggagacaggactaacatgcagctcccacttggatgaacagaacagcatgtggagactcacactgtgaatttttgctccaagaaccaccacaggaacataccgggaaaaccaaaagaattcaagaccctttgaaacaagtggtttgccactgcaaattctgtgaaacagccaaaaactgtgagttcccaaagtgtgagagggaaaaatgtctgcctccaaacacacatcccctctgggaacctgaaaattcagatcacgggagaaggatttaaccttacctagagctgaaatggatttcaggagccaagcaaaatataatagtaccgagaaaagaagcaccggaaagagcgagtccccagcttgagtccagggaagccattcctggcctatctcacagaggtctttggggaagggaaggcacccagcagaactggaggggagtcacagggtgaaggaagctcccggctgaactttgtaatattttcgacaagcatgaattttcctgagcagaatccaggagcttgggggtggtgaacaggaagaacagatatgagcacagccaaaggtgtgagcaggtggggaggggtgaggcctgagagccatgtttgctttctcagcagggaggcttatagcctggggcaagatctcagtcctgctcaccggctgcctggataggaactgatataaagtcagtgctgttgggggggcacagtaggagtgagactggccttgctggcttcatggaagatgggtaaggcctgtggtgttttttttgtttgtttgttttttttttgaaatggagtctcgctctgtcacccagactggagtgcagtggcacgatctctgctcactgcaagctccgcctcccgggttcacaccattctcctgcctcagcctcctgagtagctgggaccacaggcgcccgccaccacgcctggctaattttttgtatttttagtagagacagggtttcatcgtgttagccaggatggtctcgatctcctgacctcgtgatccgcccgcctcggcctcccaaactgctgggatgacaggcatgagcgactgcgcccggccgggtaaggcctgtcagtgctggcttttccctagcgaactgtatgatgcagcagaggcaatcataatccccctggcaacataattccattagcctgagaaccccatagtggccatggcaggccccacccaaaaagagtctgagctcagaccctaaccctgtcctcacctgatggattttctctaccagacctggtcgccaaagacaaatgacataaacccttgggacctctatggtcctgcccatcacctgagaaacccaagtactcatcctggccaatgtagggcaatattatatccccccttctgctactgcagctagtgctttcttgacagggccacctcctggctggagaccaatcaactcaaactgataaaagaacaaccctgctctaaagaagaaaacaactaattccactgcctaaagaagaaaacaactaattccactgcctgcaatatcctggttaaccagaagtactgagtctgttcacatgacaacttcactgctagcataaccagcatttgagaaagccagtgcactaaatgaagctacaaccaaggactcccactttactcccctgccacctccactggagcaggtgctggtatccatggctaggagacctgaacgtggatcacatcacaggactcttggcagacagtccccagcatcagcctgcaggccagtagctccgctgggtggctagactcacaagggcaataacaatcactgcagtctggctctcagaaatccccgtccctaggggaagggggagagcatctcatcaagggaataccccatgggacaaaacaatctaaacagtaacccttgagttccaaatctttccactgaaacagtctacccaaatgagaaggaaccagttaaagtaattctggtaatatgacaaaacaaggttctataacacccccaaaagatcacactagctctccagcaatggatcgaaccaagaagaaatctctgaactgccaaataaacaattcagaaggttgattatcgggttactcaaggaggcaccagagaaaggtgaaaaccaacttaaagaaatttaaaaaacaataaaggatatgaatgaaaaggtctccagagaaacagatatcataaagaaaaaacaatcacaacttctgaaaatgaaagacatacttagagaaatgcaaaatacactggaaagtttcaacaatagaatcgaacaagggaagaaaaaagataaatgaaacaaaaactggctcggtgaaaagataaatgaaattgatagaccactagtgagattaatcaagaagagagaagatacaaataagctcaattagaaatgaaatgggagatattacaattgataccacagaaatacaaaagatcattcatggctactatgaacatctttatgtgcacaaactaggaaacctagaggaaatggataaattcctgcaaatatacaatcttctcagattgaaacaggaagaaatagaaactctcaacagaccaataacaagtagtggtgttgaaagagtaatttaaaaattgctgaccaaaaaaaagtccaggaccagatggattcacagctgaattctatcagacattcaaagaaagattggtaccaatcctactgaaaatactccaaaaaatagagaaagagggaatcctccctaaataattatatgaagccagtactatcacctaccaaaaccagaaaaggacataacatacaaaaactacagaccaatatccctgatgagcatagctgcaaagagcctcaacaaaacactagctaaccaaatccaacaggataccaaaaagataatacaccatgatcaagtgggtttcataccagggatgcaggtacatatgcaagtcaataaatgtgatacaccacataaaaaagaattaaaaacaaaaatcatattatcaactcagcagatgcagaaaaagcatttgacagagtctagcatcctttatgattaaaatcctcagcaaaattggcatagaagggacataccttcaggaaataaaagtcatctgcaacagatccacagccaacattgtactgaacagggaaaagttgaaagtattccccctgagaactggaacaagacaaggatgcccactttcacaacttctctttgacataggactggaagacatggccagagcaatcagacaagagaaagaaataaagggcatccaaatcagtaaagaggaagtaaaaccgttgctgttcactgatgatatgatcatatacataggaaaccctaaagactcatccaaagagttcttaacctgataaataaattcagcaaagttttgggataccaaatcaacgtacacaaatcagtagcactcctatacaccaacagcgaccaagctgataatcaaatcaagaactcaaccccttttacaatagctgcaaaaaataaaataaaatacttaggaatatacctaaccaaggacatgaaagacctctacaaggaaaaccatgaaacactgctaaaagaagtcatagataacactaacaaatggaaacacatcccatgctcatgaatggataaaatcaatattgtgaaaatgaccatactgccaaaagcaatctacaaattcaactcaattcccatcaaaataccatcatcattcttcacagaactagcaaaagcaaacctaaaattcatataaaactcaaaaggagcctgcatagccaaagcaagactatgcaaaaagaacaaatcctgagatatcacattacctgacttcaaactatactataaggatatagtcacaaaaacagcatgctacaagtacaaaaacaggaacatagaccagtggaacagaatagagagcccagaaataaagtcaaatacttacagccaactgatctttgacaaatgaaagaaaaaaataaagtgaggaaaggacaccctattcaacaaatgatgctgggataattggcaagacacatgtagaagaatgaaactggatcctcatctctcaccttatataaataaatatcaacttgatagatcaaagtcttaaatctaagacctgaaaccattaaaaaaaaatctagaagataacatcagaaaaactcttctagacattggtttaggcaaagacttcctaagaacccaaaagcaaatgcaacaaaaacgaagataaatagatgggacctaactaacctaaaaagcttctgcacagaaaaagaaataatcagcagagtaaacagacaacacacagagtgggagaaaatcttcacaaactatgcagccgacaaaggactaatatccagaatctacaaggaactcaaacaaattagcaagaaaaatcaaataatcccatcaaaaagtgggctaaggacatgaatagacaattctcaaaagaagatatacaaatagcagaaaaaatttaaaaatgtttaacatcactatcagggaaatggaaatcaaaaccacaatgagatactcctttactcctgcaagaatggccataattaaaaaaacaaaaaataatagatgttggcatggatatggtgaaaaaggaccaattttacactgctggatggaatgtaaactagtacaactaaggaaaacagtatggagattccttaaagaactaaacgtagaactaccattgatccagcaatcccactactgggtacctactcagaggaaaagaagtgataatatgaaaaagacacttggatacacatgtttatagcaccacaattcgcaattgcaaaaatatgaaaccagcctaaatgcccatcaaccaacaagtagattttttaaatgtggtatatgttatacataatatggaatactactcagccacaaaaaggaacaaaataaagtagagttggagaccactattctaagtgaagtaactcaggaatggaaagccaagcattgtatgttctcacttataagtgggacctaagctatgaggatgcaaaaggcttaagaatgatatagtggactctggagacttgcagggaaggatgggaaggtgagggataaaagactacacattgggtgcactgtatactgcttgggtgatgggtgcaacaaaatctcagaaatcaccactgaagaacttcatgttaccaaacagcacctcaggaggtcatggtttttttcctggtaaagtgacccaaaccttcattcctgaagggtctgggccatttgtagtcctgcccagattgggctgttgtaatttcccattgaccttaatctcagggcatggtaatactatgagacaccccaagggatctcctgtattccacgcatactcttccttatctccattgtggagcagtagactgattttgtcttgatagtctgggtcaatcaccctagccaacactgtaactcccttcttagcccactgacttaaacttaggaggagcccgaagtgtccaggtggcaatcttaacttctagtttaatggaatcattgtgtctcctggtggcagcgtttctccctctggaactaagacttctagaccagcagaacgtaatgtcgcaggaacaggaagcaaaaattttgctagtggatcactaggggtgatggtgagtggtaccacttccacttccatcccttgcttcctggacctatgaatcttggctatgggagaaacagtaccatatattgaatgctgattcagagcatacatggtcttctggagaactttgccgcagccctgaaaagtattgtcacccagttggcattgtaattgtgactacagaaggccattccaccattctatcaatccagctgcttcaggatgataaggaacatggtaagaccagtgaattccatgagcacgagcccactgccacacttctttagctgtaaagtgagggccttggtcagaggcaatgctgtgtggattaccatgatggtggataaggcattatgtcagtccatgaatggtagtcttggcagaagcattgcgtgcaggataggcaaacccatatccagagtaagtgtccattccagtgagaacaaacctctgccctttccacgatagaagcagttcaatataatcaacctgccaccaggtagctggctgatcacccccaggaatggtgccatatcgtgggctcagtgtcggtctctgctgctggcaaattggacactcagcagtggccgtggccaggtcagccttgctgagtggaaatccatgttgctgagtccatgtgtaacccccatccctgccaccatggccactttgttcatgggcccattgggcaatgacagggatggctggggaaagaggctgagtgttgtccacagaacgagtcatcctattcacttgattattaaaatcctcctctgccaaggccacctgttggtgagtactcacatgggatacaaatatcttcatagtttttgaccattcagagaggtccacccacgtacctcttccccaaatttctttgtcacaattttccaatcatgcttcttccaagtcactgaccacccagccaaaccattggctacagcccatgaatcagtatataactgcacatctggccatttttctttccatgtaaagtgcacaaccaggtgcactgcttgaagtcccacccactgagaagatttcccttcactgctatccttcagggatgtcctagaaaggggctgtagtgctgcagctatccactttcgggtggtgcctgcatatcgtgcagaaccatctataaaccaggccctagtcttctcttcctctgtcaactgataatagggaactccccatgaggccattagtgcaggctgggggagagacggcagggtggcagaagtgagccacttctgcctttgagccacttcctcatgtaacttaactgtgccttcaggacctgctcgagcccaatcatgtatataccacttccatttgatgagggaatgctgctgtacacaacctactttatggctagatgggtcagaaagcacccacttcatgataggcagttcaggtcacacagtgacttgatgacccgtagtcaaaggtttggtttccaccaaagcccagtaacaggccaagagctgtctctcaaaaggagagtagttatctgcagaagatggcagggctttgctccaaaatcctagcagcctctgccatgattcagctatgagggcctcccagaggctccaaacaccatctctatctgccactgatacctcaagcacaattggatctgctgggtcatatggtccaagtggcagagcagcttgcacagcagcctggacctgttgcagaaccttctcctgttctggatcccactcaaaactggcagccttttgagtcacttgctaaatgtgtcagagtaacacaaccaaatgtggaatgtgttgcctccaaaatccaaataggcccacaggacgttgtgcctctttcttggttgtagaaggggccaaatgcagcaacttatccttcaccttagaaggaatatctcaataggccccataccactggacccctagaaattttactgaggtagaagttccctgaattttggttggatgcacatgtctcaccaataagtccagtgtgtttggtacttcttgctcactggatccaatcagcataatgtcatcaatgtaatggaccagtgtgataccttgtggaagcgaaagagatcaaagtctcttcgaacaagattatgacataaaaccagagagttgatatgtccctgaggtaggacagcaaaggtatattgctggccttgctagctgaaggcaaattgcttctggtgggccttatggacaggaatggggaaaaagacatttgccaaatcaatggctgcataccaggtaccaggagatgtgttaatttgctcaagcaatgaaaccacatgtggtacagcagctgcaattggagtcaccacttggttaagtttacaacaatccactgtcattctccaagatccttctgtcttctgcacaggtcaaataggagacttgaacagggatgtgatgggaatcaccacccttgagactttcaggtccttgatggtggcactaatctccacaatccctccatggatgtgatattgtttttgatttgctatttttctaggtaggggtagctctaatggtttccatttggcctttcccatcataataactctcaccctacaagtcagggagccagtgtgggggtttggctacctgctacgtatgtctatggcaattatgcattctggcactgggaaatgaccacagggtgggtccctggatttccttccaaggaaggaagtcagacctgtaagtcagacctgagctaaaactccattaattacctgatctccataagcctctacttcaactggaggaccacaatgacattttgggtcccttggtatcaatgtcagctcagagccagtgtccagtagtccccaaaatgtctgatcatttccctttcttcaatgcagttaccctggtaatagactgggggtctccttggggaaggatgggagaaatattaacagcataaatagtcactagcatagtggggtccttttcaaggggacccagcctccccttcattcaagggtttctgggcctataaattttgtggtggagtgactgttgttcccaccgttagatctgacatacagagaagagcaattacaggactcttcagagatgcagttgccgccatcacaaatccatttcgcaaagcgttggtcaagggtgtatcttctggaccctcccagctgggatgggtaggtccaaagtgaccaatccactccagcatccaatctccctaaacttttggatcccttcctctacattaaactgagagagatcaggcatttccagcttgctcacagtgggccatcttttatccatatttcagctaaccaagcaaataaactattagaaccattaaaaccttttttaactccctgagctgcaacatcaaaagcagaatctctacttagtgggttcaaatcaataagtccagcctgatccaactctatattccttccgccattatctcacacccttaatatccattcttatgactcttctccagatttctgcttatataaattagaaaactcaagcagttcttttctagtgtagcacatctcctcaagggtcactctgaacctcacctctaggggtctgctgggactttagtctaggtataggtctagaagcaaacaggggtgttgggggtggctcctgaggagaatcaacgttattttgcctggcaactgcctcagaggaggccatcactgttgcctccaggcagcgcatggtttatctcctcagacaaaggtggaaaggctgatggcagcatgtgttggggaggggatgttgccactactggggatgaagaagctgtttcttctggcaaaaaaggttcatcagagttaacaagctcagtgtccccagcttcattaggccctccaccacacatccccattccaagttgcagggtcccattcttttccagtcaatcccctcactttaacagtagacacctggaaaggctgtgcatgcacctttcgttgcaggtcagccactcacatgataagagcttgtgtctatttttccacaatttcagctctttctctataggagataagactcttacacagggtaatctagcaggtgtgaggctcagtactacttctgaagctgaaaatgaatccctgagctcatcatttttctttcatcactttgtccagtgaacgtaggagcaaccaaccagctttattatgttccttggttctccacatatggtcaaaggtattatgtttcaagtcactaaactccttgcctctcacgagcagtgaatcaggagtatcagatgcatttattttgcataactctctaaacagttcatgccaaggactatgggtgttctccatactattagaaatagaattcttaggccgggcactgtggctcacgactgtcatcccagcactttggcaggccaaggcgggagggtcatgaggtcaggagatcgagaccatcctggctaacatggtgaaaccccgtctctactaaaaatacaaaaaattagctgggcgtggtggcggtcgcctgtagtcccagatacttgggaggctgaggtggcagaatgccgtgaacccaggagtcagagcttgcagtgagcagagatcgcgccactgcactccagcgtgggtgacagagcgagactccatctcaaaaaaaaaaaaaaaagaaagaaaaagaacctttagcattttttggtctaatcacattaagcagccaactccagaaaccccaaaaccaataaaagaactccatccttaatattctgttcctctagaaccacttctggtaccaaaatctgtattagtcagggttctctagagggacagaactaatgggatatatatatatataaaggggagtttacgaaggagtattaactcacatgatcacaaggtcccataacacgccatctgcaagctgagaagcaaggaagccagtctgattcctaaaggtgaagaacttggagtctgatgtttgagggtaggaagcatccatcatgggagaaagatagaggctgggaggataagccactatagtcttttcatgttcttctgcctgctttttattctggctttgctggcagctgattagattgtgcccatccagattaaaggcaggtctgcctttcccagtccactgagtcaaatgttaatctcctttgacaacaccctcacagacacacccaggattagtacttcgtatctttcaatccaatcaagttgacactcagtattaaccatcacaatgtttcattcagaagctatagtctccaaacttcagtttctcctctgtcaaataggatcttcagctatgattcttacttcaaagggtacacaggtacaagagatccccagcccacgagtctggcaacatgttttggtcagccttaacattatctttttctaaaatccttaaattagtaaatattgcttcccatctaacatagctctaagtgaaaaaagttgcagtttaaggagagtcctaattttctgaccaaagagactaaaacttaaaagggaaaacaagacaaactatttgcttggcccactacaagtcccaggcattatgcaaggttttcaaggagacacagagacaagtgacacctgactgaagtgtagcggtggggttcccaggactggacctcatgaaaggttagaataaatgcctgcagacagattcctagctgataggaagagtcagaggagatcacacttgctcagggagtgaggctgggcagctacatggttccactgcctctgagatgaagccaggaggtgactggagctgacatgtggaagaggcagttggtgaaaccttttctgcatgggtttgatccccagcttaatcctaatacctgtgagtctttgtgaagctcaaaaaacatctctgtacacctgttttctcagttcttgaatggagatagtaatcatacctacatgcctcacaggatcagtacaaggagtgcatgagacaattatgaagagtgcttagaacagttcttggtacatagtgtgcactcaaaaatgatagctatcttttctattacatgtactgatctgaaatgatgtctaagatatattaagttaaagaaaaaggtcaatataaaactatatatatatatagaatgcaatcatctgtggggggaaaatacatgtatctatatatgatatctgtctgtatatgtttataacatctatggaagaatacacaagaaaccggttaatcatggttgtttctatagaagggaactggacctagaagacagggatgcttttcataacatagcctacctttaaaactgtttactattggccaggcaaggtggctcatgcctgtaatcccaacactttggggggccgaggtgggcggatcacaaggtcaggagttcgagaccagcctggccaacatgatgaaacaccatctctaataaaaatacaaaaattagccaggtgtggtggcaggcgcctgtaatcccggctactcgggaggctgaggcaggagaatcacttgaacccaggaagcagaggttgcagtgaggcgagatcgtgccattgcactccagcctgggtgacaaagcaagactccatctaaaaagaaaaaaaaaaacccatttgctatttatatcctttacctgtttctaaatgtcattaagattaatttatctctttttttaaaaaaaagaaaacaatgagctaggttgatagcggtagaaatgttaaggaatggttataagacagtatagatgggacttaaaagatccagtacctaacaacagacgtgagaaaaaaaaacaaaaaactgtaaccaagattctaggcttagtttcctgagaaaatacttatgcttttattataaataggtaaaataagagaaagtaagggttgggagaattgagagaagaaatatttggatatatggagtttcatatgccatgaagacattcaggtaggagagttgaacagaatttctagctggaaatcaagtgagatgtggtggttagacacaagcatttcagcaattgtggcacagaagtgatggctgaaacaaagagaattccaagagacggagaatacagaaagaagtgatatatgaattaaccctgagaaaatgtttacattttttgagagcttttagcaaatggggtgcttttagtggcatattttgaacaaaagtatattgtactcatgtctctattttcatcagacacatttaaattaaaataactgttccatttgtttactatttactgtttctgccaataggcagcgtgcaatggtgaaaagaacatcggggtttgaatccttgctccaccatccattatatgcatcatcttaggcaataactttgctgagcctcagtcactgtgaattattataccttttccagagggttgttgctgaaattatatgaacaagtgcacatgaaagggccaagaaaagtgcatcacacgtggaagacataaaataaatgttacatgaaaatgaattgtataggctgactacatgcattaatacttatacatgataaggaccagccaacgcttacctaaaaatttagctctcaggtggtcctttgattttcagttcggggccacgcaaagcaaatcctcccataccctaaatacacctcatgtggcatcaaacaagaaagtatatgtccaggtttaaggatcaggattttttaaactatctgttttttttaaatgagggcttaaaaaccttggacttctctcttcccagaaattgagcaacattattaattgatgactatttctgtttaaattaaatttcaaatgcagagtcattagctattttatctccttaatgtcacacctgatagaagcagtcaaacttttttttttaattttactttaagtcagtcaaacttttagaagaagacatacatatctttaaagggtcatttcctaaaaagcttttgagatcatttcacatcataaaatgatcacgtaaagccaaatatttccttagttttttttttatttaaaaaacattttttatcattctcagtattcaaacaaatatttcatccttacaagtcttaagatctctgtggaaggttagtataacaaccagaaaaccttctgttttgagaaaaaatgtatgtttagtcattttggattataataatgggactctcttctctgaaacacatcaaaaatatttcacaagtcataatggttctgtggttatgttgaagaaaaaggaactccctatcttttaaagacccatactgaaatgtttgtggatgaaataatgtgataactgggattactttataatactaagggcgccaggagcagcggttcacacctgtaatccctacactttgggaggccgaggtgggaatatcgcttgagcctgggagtttgagaccagcctgtgcaacatagggagactctgtctctacaaaaaagaaacaaattagctgggtatggtggtgtgtacctgtagtcctagctacttgggaggctgaggtgggaggatagcttgagtccaggaggttaagcctgcagtgagccatgaccacgccactgcacttcagcctgggtgacagagtaataccctatctcaaaaaacaaaaaaaatgataacaaaacaaaataataagggatggcatagtggatagagaagaaacaaaattagccacgaattgatcatgttgaagccaggtgatggatacatgaaatttcattttgcaagtatctctattttactatttgtttgaaattcacccaaagtttaacaaaattcacatagaaactgcttatttgctacttaaagaatacaaaagtagaatgtacactgatgcacatatattgttagaatgtacttatgagtgataacctgcagattggagactccatagacagactcatggctccttagaaagaatgattgtgggtggagcagacccaaggaggaaaagcagagtccaggcttagactgcagcttctcgcttacctgtgcagtctaattttgagcggcctctttgtagttaagagacaggagctcccattctctctctactaacccaaaagtcttgtgtgtactccttgccttggctcagctccaaacacatttctacaccgataacaagaaatatgctgtaaatgatgtttccttctcaatccctgccgcctctgaatttgctgaccttagtaacatcatcaataaattactaaaggacaaaaatgagttccacaaacatatggagttttatttccttattaagggccagtttctgcgaatgtccttggtcaaacacatggaactggagaacatgtcatcagaagtagttgtggaaatagaatatgtgaagtacacagcaccccagccagagcaatgcatgttccatgatgactggatcctttcagttaaaggggcaaaggaatggatcttgactggttcttatgataagacctctcaaatccggtccttggaaagaaagtcaataatgacaattgttggacatagggatgtcttaaaagatgtggcctgggccaaaaaaaaagatagtttgtcttgcttatttgtgagtgcctctatggatccaactattctcttatgggagtggaatagagagaaacaaagtgaaagcccgaccgtgctgcagaggtcatgctggaagtgcagagtctatagctgttgatagctcaggaactaaattttgtagtggctcctgggataagatgctaaagatctggtctacagtccctacagaagaagaagatgaaatggaggaatccacaaatcgacagagaacacagagcagctatgactcccatagtgaccctctctggtcacaaggaagcaatttcctcagttctgtggtcagatgctgaagaaatctgcagtgcatcttgggaccatacaattagagtgtaggatgttgagtctgacagtctgaaggcaagctttgacaggaaataaagtgcttaattgtatttcccattctccaactttgtaaacgtttagcatctggaagcacagataggcataccagactgtgggatccccgaactaaagaccattctttggtgtcactgtccctaacttcaaatacaggttgcgtgacattagtaaaatggtctcctacccatgaacagcaactgatttcaggatctttagataacattgtcaagttgtgggatacaagaagttgtatgatctggctgctcatgaagacaaagttctgagtgtagactggatagggacacagggctacttttcagtggacaagcagacaataaattgtattcctacagatattcacctaccactttccatgtgggggcatgaaagtgaatgataaattgatcatagagattctttatacaaatgaacttggtagaaaatcatgaaattatactgatgcagatgcagaaagcagccgtttgaaatttatataatgttttcactcttcataacagctaacatttaactatctttttcttattttgtatttataatagtttgtgtttataaaataaaaagaatgattgtgactagcttgttaatcacatgtatagctactatgatgtactcttacagtttatagttaattaacttacacatctaaaatatatctttctctggccatttgtcccaattgcatgtgaagaatataaggtaataataaaatttacggaaaaagtactaagtatctgttgcctaccactttttagtatatgtgtatatttatatacttataatttttattttcaagtgtagattttgaataagaacacatctttataatggggtgtatgaagctatttgcaataatcctggatctatatttacagacacagacaaatatattcatgatatgttttaaatgttaaagtagctaataaaaccaccttaggggatgatttcatttttatgttatatttgtctctatatacttagaaaaaaatgtggaaagataaacacttttttacagtggtctttttctgctttatattatgtgttttattggtttttcttccttctttatattttctgtatttcttttatccaatgaacactacataaatacgtatttttaaaagaattttaatcatgtaacctttctaaagattaaaagagaaggaataacaatattatatcagtatatgcgaatttagtgcatgataaaagtaatatatcagcggacaaaagagaaattcttcaaatcatgagttataggcaaccaattaactatttggaagaaacctcaaatgaatcaaaattttaaatataggaactataaagatagctgagaggaattatttttaagcaaactaccaaagacagaaacaatcataaaaggaaaacaaaagatttcaacatacacagctttaaaacatccatatgacaaaatacttcattaataaatgggacatttggggatttagttttaatttgaatttttgaaaatatataacaaaggggccttataaatctatattaaagaggccacccatggtggctcacacctgtaatcccagcactttgacaggccgaggtgggcggattgcctgagctcaggagatcgagaccagcttgagcaacacggtgagaccatgagaatcgcttgaacctgggaggcagagaatgcagtgagcaagatgatgccacttcactccaacctgggcgacagagtgagactctgtctcaaaaaaaaaaaaaagaaaaaaaaaatcaccattaaagataaatagccaaaagaagatgaattagaaatgcccatgtcaccaataaacttatgaaataaacgtataaaggtatttgaccttactagaaaataaattgattttgttttgtttcttaaataatattcaaatctagcacctaagataagcactctgataaaataatggtggcagtgtacaactggtacaatgtttatgaaaagcaacttagaagcacgtactaaatgactaataaaagtacatatcctatgaatcagctatttaacttttaaatatttgtctaagaaaataaagatgtacagtaaaatttagttaaaaggatcctcatcagaaaaatagaaaaaaatggagtccaatctaactatccaacaataagtaacagattataactgatggtaattgtatataacataatttttaaaaagccactaaacatggtttatagaaacctgtttaatgcaggtaagagcatcacaatacattaaatgtgaaagagttgttatttattttattttatttatttatttttttttttgagatgtagtcttgctctgtcacccaggctggagtgcagtggcgtgatcttggctcattgcaagctccacctcccgggttcatgccattcttctgcctcagcctcccgagtagctgggactacaggtgctggccaccacgccggactaattttttgtatttttagtagagacggggtttcaccgtattagccaggatggtctcgatctcccgacctcgtgatctgccgccttggcctcccaaagtgctggaattacaggcgtgagccactgtgcctgcccaagagttgttaagctgtatatttaatacttataaaagtgtatgcattaaaaaaattagaatggatgcactgaatttttactttaatagtggttatcctgctcaatgaaataaaagagaacacaaacaaatgcaagaacattccatgctcatggataggaagaattaatatcatgaaaatggccatactgcccaaggtgatttatagattcaacgccatccccatcaagctaccaatgactttcttcacagaattggaaaaaactactttaaagttcatatggaacccaaaaaaagcccacattgccaagacactcctaagccaaaagaacaaagctggaggcatcacgttacctgacttcaaactatactacaaggctacagtaaccaaaacagcatggtactggtaccaaaatagagatatagaccaatggaacagaacagagccctcagaaataataccacacatctacaaccatctgatctttgacaaagctgacaaaaacaagaaatagggaaaggattccctatttaataaatggtgctgggaaaactggctagccaaatgtagaaagctgaaactggattccttccttataccttatacaaaaattaattcaagatggattaaagacttaaatgttagacctaaaaccataaaaaccctagaagaaaacctaggcaataccattcaggacataggcatgggcaaggacttcatgactaaaacaccaaaagcaatggcaacaaaagccaaacttgacaaatgggatctaattaaactagagagcttctgcacagcaaaagaaactaccatcagagtgaacaggcaacctacagaataggagaaaatttttacaatctatccatctgacaaagggctaattaatccacaatctacaaagaacttcaacaaatttacaagaaaaaatcaaacaaccccatcaaaaagtgggcaaaggatatgaacagacacttctcaaaagaagacatttatgcagccaaaagacacatgaaaaaatgctcatcatcactggccatcagagaaatgcaaatcaaaaccacaatgagataccatctcacaccagttagaatggtgatcattaaaaagtcagtaaacaacaggtgctggagaggatgtggagaaataggaacacttttacactgttggtgggactataaactatttcaaccattgtggaagacagtgtggcaattcctcaaggatttagaactagaaataccatttgacccagccatcccatcactgggtatatacccaaagtattataaatcatgctactataaagacacatgcacatgtatgtttactgcagcactattcacaatagcaaagacttgtaaccaacccaaatgtccaacaatgatagactggattaagaaaatgtggcacatatacaccatggaataccttgcagccataaaaaaggatgagttcatgtcctttgtagggacatggatgaagctgcaaaccatcattctgagcaaactatcacaaggacagaaaaccaaacaccacatgctctcattcatagtgggaattgaacaatgagaacacttgggcacaggatggggaacatcacacactgggacctgtcatgaggttgggggctgggggagggatagcattaggagatatacctaatgtaaatgaggttaacgggtcaacgggtgcagcacaccaacatggcacatgtatacatatgtaacaaacctgcacgttgtgcacatgtaccctagaacttaaagtataacaaaaaaagggaaaaaataaaaaataaaaataaataaatatataaaactgttgggggcattagtcacatgaacagctgtcaaaaaaaatagtggttatctctgggagtgatgtttccaaccttcttcttacttatctatatattttaatgttggcatacagagactatctaaaaaaaaaaaaaaaaaaaaaaaaagaagcagttgcttcaaaacttacaccagtgagaaattccacagaaaagctgagaacattcctaacaagggtccctttatgtatgcacttaacataacatatggaaattatttagttttctgcctcactaaagtggcctcccacaaaataggaactatagtctcactctcaatttctttttttattcctaatgcctattacactgtgtggcataatagcaggctgagggccaggcacggtggctcatgcctgtaattccagcactttggaaggccgaggcaggtggatggcctgaggttgggagttcaagaccagcctgaccaacatggagaaagcttgtctctactaaaagtacaaaattagccaggcatggtggcacatgcctgtaatcccagctacctgggagactgaggcaggagaatctcttgaacccaggaggcagaggttgcggtgagccgagatagtaccattgcattccagcctgggcaacaagagcgaaactccgtctcaaaaaaaaaaaaatagcaggctgaaggaataacttttcacagagaacccaaaagactctctaagaaaccaaaggtttagattctgtacagaaaacccagagaatcacctaggaaatagccaagactagccacagaatctctcactaaatacaaatttcatttaaccagctcagataaaaaaaatcctggtattttcctgcacctcccccttctgtctcccaatccattaacaaatccaactgaagaaatcctcttgtttctacatgtaaaatgtgttctcacaaccattctcaccatttcactgccaccatgcttgtccaagccagaagtcatctcttgcccatacatagaccagcaatagtcccctggttggtctccaggcttccactctcctgcactgtagccttcacacaacagagtgacctttaaaaaggcaaatctaatcatgctactctaagctcaaagcctccaataacttcccatcacatgtagaataaaagccaaagtgtttcctatggctcacagcctttcatgatgtgccctagactttgaactcctctcctaccctctggttcccaggtctccagccacactggcctgctgactattcctgaaacttgtcaagctcgttcctgcctcagggcctctatcctccccactcctgtgtttttcctctttgctggaaatgcacttctccttaaaagtgaccttttcaaacaggtctttttgtttagaagtcaccttatcaaaatacctatcttgaaccactttttaaaaaatagcaatgctttccaaccagccttcactgtctcttcctttaacctgctcaatttttcttcagtgtgccacctgccttacattatttattaatttggtatatatgtctatctcctccattagaatgtccattagggaaaggactttgttttctttaccactcgatttcaagtacttagaatagtgcctgccacattagaggtacaaaataaatatgagataattaactaggtgaatagataaataaatgaatgatatcaccaagatatgtttcaagttcttacacaaacacaatatttggcccagtgtctactataaacggtagaatatttcctcaagtcaacaccaaaaagggatgttataataaagcaggtcggacaacagtctcacattactgaataacgatactgatctgatgttgatgattgcttctttactttttttcttttttttttttttttgagagagggtgtcactctgttgcccaggttggagtacagatcacggctcactgcagcctcaacctcctgggctcaaacgatcctcccacctcagcctccctcgtagctaggaccacaggtgtacgccaccacgcccagttaattttttaattttttgtagagacagggtctcgccagttgcccagactggtctaaactccacctacctctgcctcccaagtgctgggattataggcatgagccactgtgcccagcctgatgattattttcaacaggccttgtgtttcctaagccccaaaagccttcccatttctcattccactgccatttgagacccatggccacctgattgaaacctcaaggttttgctaagaatttatgaagagagttaagaaatctcttcaaattgttcctatgaggaagttatttcatactatgagcaaattcattttcattaagtatctgttgtaaccaaacgttgtttcttagcttcttagctctgtaatatggcacaataatctgacttactgaagccactcattatttcccattggcttaattctttctttcttttttttttttttttagagatagaatctctctatgttggccatgctggtcttgaactcttggcctcaagaaattttcccacctcggcctcatagactctttctatgttggccatgctggtcttgaactcctggactcaagggatcctcctaccttggcctcccaaagctctcacgtaccagcacccattggcttaattatttcagtaaaatcaggcaaggaggaaccctacaaaataaacacaggcattctcaaagcagatataagtgaaaactcagagtatactgtggtcagctgtgttctctatcacaagtagtttgtcaacttaaaataaagtactaaagtttgggaatgatctactctaaaaatacatcggacaatggtcaatgtcatttacaacattcacctcctttctgatacacatctcaggaaaaaaaaaaaaaaactactaagtaccaggtcagaaatttggcacaaccctagatgaccaccttgtcatgcaaataaacttagaatggtgctcctgaaagtcagccacagtgcttcaaaaacacatgattttttaaaacaccaaactaagcataccacatagtatagagaccaggctatggagttgagaccacctgggttagaattccatttctttccatttagttgctgtcaccttcctaatttctctgtgttccatagttccatattatccataaaattcagatatgaacacttactatacagagttgttatgaggattggacaatgtatgcatcccacaagtagatcaattacaagtacattttgccccaagtaaagacaacacgtgggaacgctgtgcaagagggaacagcaaaagcagttggaggatggaagtcagtttgcaaacctatgcgcacaggcagccaaacacgaaaacgttccccacaagtagtctgtaaattggagactccattgggatacacacacacacacacacacacacgccctgagaggaaatagcacctttcttcatcaccaagttagccttaaaaattatttacccgttgttagccacactagcactgacaaacccaactttactcttgtaggtcattctccacaacgtctgtgctgcgtcaatcccaaatctgactccctgacgcttaacagcgaaaataaaaaaccgagacattactcaatagagttaacccttacttaacaaaacgctgttgtcccctgtggcgtgcagacagtagagacagtaattcccgaccttatgcttgtcagtgacggcatgccctttgtatacacgcttcagtagagaacgactgcagtaagtaaactgctagtagcaacactgttcccctatctaaacttcccctttccagagttactgatgtcccaacatgggtcggtcgctcagtctccgtcaagcccgtaccccatagcttgggcatttccccccgcagatcacaagatgcaaaggggaagttactaccaaaccgacgagaatggcccagagctgggggctgccaggcggttcctgggcccctctcagcaccagaagaaggcgggcgcaggctcgccgcgggtcggccgcacgccatacctggatcaggccctgctggaacaaggcgctgtgcacgcagccagggaccgccccgggcagctccagcgagccgttcccattgcagatgctccagttgccacgcaagctgtaactgagctccgcggcggtggtgcctgcaccgcacagcgcgagcagcaggagcaggtggaggcgcatcttgagatcccgcgccaccgagatgtggagagatcgaaaggcagcgctgcaagggaccggcggtgaagccactcaccccctcggaagtagccgaggctttaggtccccgccccggccccgcccctaggtcagctgagcgctctccgggcgcagccgcgggcgggaggggaacgaggaggctgcgcctgcacccgctgaaagccgggcgtcgcgggtgcgggagctgcagcccccgagaatagctacaggctggggggcattgcggtctgagccttccctcggcgcttcttcccgccgcctcagtacatacaactggaggcaagaatcttgcacggtaattgggacagaaagatccctgggcgcgcagtggcacaaagcctcgggagatcagagaccgactgtacgtggagaccatagctggagagtcccctcactccttcagagaacccaaactgggagacaacccaccacttcccttccgccaaatttacacagaccctcgtctacctggtagcgtaacactcaccccgctgcagctcaactcgcgggtctcagagcctaccccgcccttcaaagagtaaacaagtactagcagtatctccatcagaaggttgttctgagggctaaccaagaaaatgcgactatagcatgcagcatggagcctggcccagagaaggcattcacgttagctattgttactagcggcctgcgtccttatgtttcataaagccccacggaggtttctgaggttctggaacttgcactaggcgcgcagctgagtttaaaatcctctgcactcactagctgtgggacctgggcaagccgcaaaatctccatctccgtttcttgaagttttcaaggtgttataagtataaaatgagtaaacatatgtgatcgtccctaacaatgccagagtacccaagaaataccactgacttatttcgggtcttgtagtcaaatggtctacctgagtcccatttttgcaataggatgtaacagtaatcctagaagttaagacggaattttacattgcataaaatagactgcctttctcctgtgttgacgctatctgccgtatatttatgcttcggaagaagtccttgaaaagaaattttctctcatcaaatctgagctttgtttcgccttacaatggccttggaattgcctgattctgcagacaccgggcaatatcttactttgcaaagtcagcattatttacaagccctgaatatcttggcttaaaggacagtatggattatccaacccaagccgctggctttacagatgagggaactgagttcaaagagatcggggccaggcgcggtggctcacgtctgtaatcccagcacttctgggaggccgaggcgggtggatcacttgaggtcaggagttcgaggccagcctggccaacatggtgaaaccctgtctctattaaaaatacaaaaattagctgggcgcgtggtggcacgtgcctgtagtcgcaggtgctcgggacactgaggcaggagaaccgcttgaacccaggaagcagaggttgcagtaagccgagatggcactactgcactccagcctgggctatagagaaagactctaaaaaaaaaaaaaaaaaaaaaaaaagatcaggtgacttgcctgtcacatagtggcagacaggattagaaccctcctcttcaaggtcctactgtcagagcccaatgatgctataggggaaacgctctcactgcttcaaagccttcctcactcactccagaagcatttttacctttgatagaaacaaagctctcaattcaaattatatgccataattcacggcattaaatggctagccatggtctgtgcaacactgataacacaaggtttatggcaacaagagcggcaaaggaattttttcataattcccagagatttcattaagccaaatcagaggaaaattcatccttgatgatacatatggatatattctgtttattaagaaatacttaagaaatataatttttagaaaaacaataatagaagattctcattcctcctttcattccaggatgcaagcataacatcatttaggttacttcactttgacaacagagaacatcaaagaataatcaaagccctaataagtactcttcctaaaattgcaattggcacagatgacatgatgttttcattttgttataggataatttttgtccatgattttctggtaaataaaccttatttagagataacataaaacttctcaacttatgtaatttaaagtcatgataccaaatgcaatgtttaaaatagttatgggtatctttaacttacactgtataaacagatttcattttgatcatttcatttgatgcttcccaaaacttgaattatttagaacaagtgatcgttccctggtttaaaaagataaataatgcccacggtgattaaatgatgtgtagggtcagtatcctgtcacaacagaccaatggaagtagttaggccctttgctatatgacaacatttccttcatatctaaatatataaaattggtaaactcattagaacaccatggtatataccaaggccaatgatattccaatcccatgatatattacagaagttataataagggaaagaaaatgaaagagtaatcagatgtggagtggacatttgcctttagactcatagtgtctgattaaaccccaggactggggataatagcccataagtatcctgcccaaaggtttgacatacttccccagagtttgaagccccaaatgttagaacaaagagagaaggtagtggaaactatgtacaccactagaatttggtgtgtcaaggatgcatatgcatgagtttcctataaaccaagaggacaccgtaggaagtaaccaggcttgagccagtataatgggattctacccaagagagtccaagaagtgaactagaggacacatggcctatgtcagcaaactgtgtatatatatacatatactgtatatatacatatatacatatacgtatatatatacatatactgtatatatacatacatacatatactgtatatatacatatatacatacatatacaaatatatattttaaatatatataatttatataataatataaatatataaaaatatataatataattatataatataatataattatataattaggaatataatatattatattcctaaataatgcatgggtcaaaacaataatagatttccaatttctggcctggcatgtaaggaccttggaagtcatcactctatcctaaaaagcaagtaaaaagctgcacaaattgaaaatagacaactcttcttagatgagtcaaagaagtgaggtcacagggcagactgctgcccccaaaattagagatgtagacaggtagatacaggcaattacaacttaactgagtagaccacacacactaccccacaaccattgtcccatagctgaaatctcagtgggaaccagtacagagtaggaagacctggactataattgacaaattactggaggaccaatatgcacaaatttgagagttaaaaactccaagggggcccagtcttaggggagcagctgtgcttttgtaagtttgcctccaggagctccacaaagctctcatagtgaagattgaagaaaaatcctctcgtgtttcctgcaagggaggaggaaagtaactattctgaatgtgccagagattctgtgcttcttaacaagacccactctcaaaagaaacaattttaccagagctgaaccaactggggttttatcagagtctcgccagcctgggagaaggaaaatacccaactccagccccccatagacattctgccccatctaagggggtgaaacatagctgagaagcactgtgaagttcacagtccaggggactgggctcactagatgactgagacctaatcagaggaaaatagaccattttccctctcccaacaccttcccaacacatcactgaaggcctatttatggcaattcctttcacccaggatgtcatgtatggctttcaacaaaaatttacaaagccaaagatacaacttggaaagacaaagcaaatgccaaaaccaaactcacatatgggaggaatgtcagaattatcagtccaggaatttaaaataactatgattaatatgctgagagctctaatggaaaatttacacaacatacaaaaacagatgggtaacgtaagcagagacatggaaattctaaaaaataataaaaaatgctagagatgaaaagcaccataacagaaatgaagaatggcgtattagtagatggaacacggctgagaaaagaatctctgagcttgagggtatgtcaacagaaactttcaaaaccaaaaagcagagaaaaatgtatgcaagaaatgaacagaatatccaagaactgggggacaactacaaaagatattgtcaatgaaaagagtcaaactctataaatatttgaagagatttattctgagccaaatatgaatgaccaatggcctgagacacagccccaggagatcctgagagcatgtgcccaaggttgcccaaggctacacagcttggttttatttattttagggagacataagacatcaatcaatacatgtaagatgtacattggtttggtccagaaaggtaagaaaatttgaagtgggggcttccaggtcatagatggattcaagaattttgttcatcagcaatcggttgaaggagttaagttattgtctaaaaatctataattaataaagggtaatgtctgggttaagataagaggttgtggagaccaaggttctcattatgcagacagaatcaatagaagggactgtttcttatctgacttaaagagttttctatgagtcttaagttctctgttttaatgttaatgctggcaggtatgcctgaattccaaaggaagaggggtataatgaggcatgtctgacccccacttccatcagggcctgaactagcttttcaggttaactttggaatgcccttggctgaggggagggtccatcagtcaattgcatggctaagaattttatttttggtttacaatataatatacatgaatagagactactagacggagaagacagaaaggaacagaagacacatttgaagtaataatgactgagaatttccccaaaattaatgtcagacacaaagtcacaggtccaggaagttccaggtacatcagcaggataagtgcccaaaaaactacacctgggcatatcatattcaaatcaaagatttaaaaaaatcttgaaagaggccagagggaaaaaagcaacttacctatagaggagcaaagataagaattatatccaacttctcctcagaagccatgcaaacaagatgagagtagagtaagatatttaaagacttgcaaggaaaaagtgcaccaacctacaattctgtgctctgcagaattatttctcaaaagtgaaggagaattaaagactttctcagacaaacaaaaatttaaataatttattgccagtagatctgccttgagaagaatgttaaaagaagttcttccaagagaagaaaaataatatagaaaattagaaaatcagatccacatgaagaaaagaagagcattagagaaggaataagtgaaggtcaaacaaaaactcttatttttgccaaggcatgctggttcatgcctgtaaccccaacacttcgggaggccaaagcaggaggatcatttgaagccaggagtttgagaccaacctaggcaacaaaacaagaccctgtctctacaaaaaaaaaaagaaagaaagaaagaaagaaagaaaagaaaaaggaacttttattcttcttatcatttattgacctaacctataacagcatgctcaaaatagtaatagcaacaatgtgtttaattatcaaatctatgtataagtgaaatgaatgatagcaataacacaaggggtatgagacaaaaattaggaatattttattattataaagtaatgaagcagtacagcgctatttaaaagcagatttacgctgggcgcggtggctcgtgcctgtaatcccagcactttgggaggctgaggcaggtggatcacctgaggtcaggagttcaagaccatcctggccaacatggtgtttagtctctactaaacatacaaaattagtaaagcgtggcagcatgtgcctgtaatcccagctgcacaggaggctgaggcaggagaattgcttaaactcgggaggcggaggttgcagtgagctgagatagcgccattgcactccagcctgggcaaaaagaacgaaattccgtctcaataaataaataaataaatgctgatttacagccaggtgcagtggcccatgtataaataaacaaacaaataaataaataaaagcggatttagggccaggtgcagtggcccatgcctgtaatcccaacattttgggaagctgagctgggaggactacttgagcctaggagttcaagaccatcttgggcaacaacgtgagaccccatctctacaaaaaatagaaattaaaaaaattagctaggcatggtggtgcgtgcttgtggtcccagctactggggaggctgaggagggaggatagcccaggagattgaggctgtagtgagccatgattgtgccattgcactctggcctggatgacagagtgacaccctgtctcaaaacaaaaaattaaaattaaaattaattaattaaaaagtagacttgaccatactgcccaaagcaatctgcaaattcaatgctattcctatcagattaccaacttcatttttcacagaataagaaaaaatgattctaaaactcatatgaggccaggcacaatggctcacacctgtaatcccagcactttgggagactgaggcaggcagatctcctgaggtcaggagttcgagaccagcctgaccaacatggagaaaccctgtctctactaaaaatacaaaattagccaggtgtggtggcacatgcctgtaatcccagttactcaggaggctgtggcaggagaattgcttgaacccaggaggcagaggttgcggtgagctgagatcacgccattgcactccagcctgggcaacaagagtgaaactatgtctcaaaaaataaaataaggccaggcgtggtggctcacacctgtaatcccagcactttgggaggccgaggtgggcggatcacaaggtcaggagatcgagaccatcctggctaattcggtgaaaccctgtctctactgaaaatacaaaacaaaaaagaagtagctgggcgtggtggcacgctcctgtagtcccagctactcgggaggctgaggcaggagaatggcatgaacccgggaggtggagcttgcagtgagccaagatcatgccactgccactgcactccagcctgggcaatggagcaagactccgtctcgaaaaataaataaataaataataaaataaaataaaacccaaaaaagtacctgaatagccaaggcaatcctaacccaaaagaacaaagccagaggtataacagtacctgacttcaagctatactaaaaggctacaataaacaaaacagcagggtactggtacaaaaatagacacatagaccaatggaacagaatagagacccctgaaagccacacacctacaaacaactgatctttaacaaaattgacaaagctaaataacgaggagaggacacccaattcaataaatgttgctaggaaaattggctaactatatgcagatgaatgaaactgtacccacacttcccattacatataaaaattaactcgagatggaataaagacttaaatgtaagacctcaaactataaaaattctagaagaggccaggcgtggtggctcatgcctataatctcagcactttggaggccagggcaggtggaatgcttgagcccaggagtttgagaccaccctgggcaacatggtgagacctcatgtctattaaaaaaaatgctagaagaaggcctagaaaatactcttctagacattgatcctggcaaataatctatatgatgaagaccccaaaagcaaatgcaacaaaattaaaaaatagacaaattagacttaattaaaatgaagaacttcagcaaaagaaactctcaacagactaaacaaatagcctacagaattagaaaaaaatttgcaaactatatctctgaaaaggactaatatcagagtctataaggaatttaaacaaatcaacaagaaaacaaaaaaccccattaaaaagtgggcaaagaacatggacaggcacttctcaaaagaagttataaaagtggccaagaaacatgaaaaaatgctgaacataactaatcaccagaaagatgtaaatcaaagccacaatgagataccatctcacaccaaccagagtggctattattaaaaagtcaaaaaaataacagatgttggtgaggaggcagagaaaaggcaatgcttatatactgttggagggattgcaaattagtgcagcctctgtggaaagctgtttggagatgtatcaaagaactaaaaacagaactaccatttgacccaataattccattactgagtatatacccaaaggaaaataaagttttctaccaaaaagacacatgcactcatgtattcattccagcactattcacaatagcaaagacatggaatcaatgcccatcaacatcaacagtggttaccaacagtggattggataaagaaaatgtggtacataaggctgggtgctatggctcacgcctgtgaccccagcactttgggaggccgaggcgggttgatcgcttgagctcaggagtttgagaccagcctggggaacatggtaaaacccaatctctaccaaaaaaaaaaattgtttttaattagctgggcatgctggtgtgtgcctgtagtcccagctacttgagaggctgaggtgggcagatcgcttgagcctgggtggcagaagttgcagtgaaccaagatcatgtcactacactccagcctgggtgacagagtaagaccctgtctcaaaaaaagaaaatgtgacatatactccatggaatactatgcagccataaaaaaaatgaactcatgtcctttgcagcacttggatacagttggaggcagttactctaagtgaattcatgcagaaacagaaaaccaaatgttacatgttctcacttataagtgggagctaagtcttgagttcacacagacattaagatgggaataatagacaatgcagactccaaaatgagggaagaagggagggtatcaacggttgaaaaacttcctattggatacactgctcactatctgggtgatgggatcaatagaagcccaaacctcaacatcacacaatatacccttgtaacaaacctgcacatatacctcctgaatctaaaataaaagtgaaaaaatgtgtttaagtgaacttggagtcactctaaatgtatactgcaaactctagggcaaccagtgaaaaaaaaatttaaaggaatgcaactgatgtgctaagaaatatgattatataaaatgttcagttaaaaccacaaaaggcagaggaagagtggaagacaaagatagaacaaagaacaagggcaacaaacagaaaagagtaacagggtgatggttgcaccaaaatctcagaaatcactgctagagaacttatccatgtaaccaaaaatcacctgttccccaaaaagtattgaaataaaaagacagtaacaaatgtggttattgtcagatgttatagatattaatccaactctatcaatggtctaaatacaccagttaaaggacaattgtcggagtagatgaaaacaataagacccagctatatgttgtctataagtgacctattttcattataaagacacatctagattaaaacttaaaagaaggacaaagatataccacacttacattaattttttaaaaagtgagtagctatattaatttcagagaaagcacacttcagagcaaagaaaattatcaggatacagagggacattacataatgataagtgggtcagttctcccaaaagaccttacaatccataatgtgtatgtgcttaattaataacagaacatcaaaatacattaatcaaaaacagagagaactgtaagaagagaaagataaatctactaatatatttggatacttcagcagccctccatcagtaatagagagatctagcaggcaaaaaaatcagtaaggacaaagttgaactcaacaataccatcaatcaactgggtatagttgacagctgtagaccatttcatccaacaacaacagaatacacattcttctgtaggtcacatagaacattcactgagatagaccacactttgggccataaattacaccttaacaaatttaaaagaatataaattacaaaatgtggaattaaactagaaagcaataacagaatgaaagctggaaaacctcaaaatactggatgattaaacagcacaattccaaataacacacaagtcaacaaagaaatctcaagataaattaaaacatttttaatacattaattaaaaaacaattttatcaaaatgtgtgggacccgcaaagcagtgcttagaaatttacagcattaaagtcatgtattaggaaaaaagaaagatctaaaatcagtaatcaaaacattcaccttgggaagctagaaaagaccaattaaatccaaagtaagcagaaggaaaggaacgataaaaattaaagcagaaataatgaaatttttcaaggaaatcagggaggagggggtaagaaaaaaatatgaatgcatttattactactgacttttacacttaaaaatggtaaagatggtaaattacatatgtatattttacctcaataaaaatttttacaagaaaataggaaatcaatagagaaaatcaacaaaaccaaatgctggttttttttaaaagatcagtaaaattgataagcctctagccaggctaagaaaataagagagaagacacaaattattcatataacaaatgaaagagggaacatcattacagatcccaatcagacattaaaatgataaaaaagaaatactatgagcaaatttatgttcacacatttgatagcatagatgaaatagccaattccttgaaagatacaatctgctgaaaacttacacaagaagaaatagacaatcttaataggcctatatctattaaagaaattgagtcaataatcaataatcttgcaaaacagaaagcaccaggccagatggtttgctagacaattctaccaaacatttaaggaagaaattataccaattctctacaatttcttccagaagacagaagcagagggaatatttgctaactcattctatggggccaatattaccctcatattataaaacaaagacattacatgaaaataaaactacagccgggcacagtggctcacgcctgtaatcccaacactttggaaggccgaggcgggcagatcacgaggtcaggagactgagactatcctggctaacacggtgaaaccccgtctctactaaaaatacaaagaaattagccgggcgtggtggcgggcacctgtggtcccagctagttgggaggctgaggcaggagaatggcgtgaacccgggaggtggagcttgcagtgagccgagatcgcgccactgcactacagcctgggcgaaagaacgagactccatctcaaaaaaaaaaaaaaaaaaaaagaaaacaaaacaaaaccacagactcacccagagcaatatctctcatgaacatacatgaaaaatttctcaacaaaaaattagcaaattgaatccaacaatatataaaaagaattatacactatgaccaagtgggattcattctgggtatacaaggctagttcaacatctgaaaatcaactcatcacaccaacaggctaaagaagaaaaaaaacacatgatcatatcaatagatgaagaaaataaagaaaaagcatttgacaaaatccaacagccattcatgacaaaaactctcagcaaactagaaatggaagtgaacctcctcaacttgattataagaagtaaaataaaaaaactacaactaacatcatatttaatggcgagaagctagaaaactttattgctaagatcacaaacagggcaagatgtgtcctatcacaactccttttcaccatcgtactggaaaccctagctaatgcacaaagactaggaaaggaaatacagtcatgtgccacttgacaacttttcagtcaatgacagattacatatacaacggtggttccataaaattgcaatggggaagaaaaactcctattgcctagtgaggttgtagcgactgtaatgtcatagtgcaacacattactcatgtttatggtgatgctggtgtaaacaaacctactgtgctgccatgcatataaaagtatagcactcagttatatacagtgcataatacttactaataaatgactatgctattggtttatgtatttgctatactatactttttatcattattttacggtgtactacttctatttactttttttttttttttttttttgagatggagtattgctttgtcgcccaggctggagtgcagtggggtgatcttggctcactgcaagctctgcctcccgagttcacgccattctcccgcctcagcctcccaagtagctgggactacaggcgcccgccaccacacccgcctaattttttgtattttttttagtagagacagggtttcaccgtgttagccaggatggtctcgatctcctgaccttgtgatccgcccgcctcggcctccaaaagtgctgggattacaggcgtgagccaccgcgcccagcctctacttacttttttaaagaaagttaactataaaacagtctcaggcaggtccttcaggaggtattccagaagaaggcattgttatcacaggagatgacagctccaggtgtgttattgcacttgaagaccttacagtggaacaagatgtggaggtgggagacagtgatatcgatgatcctggccctatgtagaactagaactatgcagaactaactatgtaggttaatgcttgtgtttgtgtcttagttttaaataacatctttaaaaagaaaaaataaaacaaaaatttaaaaaaatagaaaatatcgtatagaatatgagtttaaagaaaatatttttgtatagctatacagtgtgtttgtgttttaagctaattgttatttacaagagagttaacaagttgaaaaattaaaacatttataaagttaaaatgttacagtaagctaaggttaatttattattgaagaaacaaaaaatatttttcataaatttaatataccctaagtctacagtgtttatgggcgacaggtatccaaaatatacaaagaacacttaaaactaagccataagaaaatgaacaaaaaaatctcaacagacacctcactaaagaagatatacaggtggcaaataattatataaaaataagcatacaccataagagaaattgcaaatgaaaacaaaatgagataccactacatacctattagaatggccattatcccaaaggctgtcaacagcaaatgctggtgaggatgtggaggaacagaaactgtcattcattgctggtgggaatgccaaatgataaagccacttcggaagacagtttggcacttctttacaaaacctaagcatactcttagcacatgtgatcattagttttatgtatcaacttgactcggtcatgggttgaccagatatttagtcaaacattattctgggtgtttctgtgaaggtgttttgggatgagggtactatttaagttggtagaccaagtaaagcagattgccctccgtaatgtggataggcctcatccaatcagttgaagacctgaatagagcaaaagattgaccctctctgaaggaagagacaactcttctgcctgacaggcttcagactggaatactgtctcttcctggttctacagcagcctgccagcctttggactcaaactggaacattagctctacagattttggacttaccacctctgtaattgtgtgagctaatttcttataataaatctctttataatgtatatacatcctactggttctgtttctctggagaatcttgactaatatgccatatgatccagtatttggattccttggtatttacacaaaggagctgaaaatatatatccatccaaaaacctgcacatggatgtttataagagctttagccataattgccaaaatctggaagcaaccaagatttccttcagtaggtgaatggataaaccaggtgtctggtacatccagacaatggaatattattcagcacttaaaaaatgggctcagtcgctcacacctgtaatcccagcactttgggagtctgagacaggcagatcacctgaggtcaggagtttgagaccaatctgaccaacatagcgaaacctcatctctactaaaaatacaaaaattagccaggtgtggtgatgcatgctgtaatcccagctacttggaaggatgagacagaagaattgcttgaacccgggagacgaaggttgcagtgagccgagattgcgccactgcactccagactgggtgacagagcaagactccatctcaaaaaaaaaaaaaaaaaaaaaaaaaagagggctatccaggcgtggtggcccatgcctgtagttgcagctactttggaagctgaggcgggagaattgcttgaacctgggaggcagaggttgcagtgacccaagattgcaccactacactccggctttaagtgcatattactaagtgaaagcagcctatctgaaagtctacatactgtatgattccaactatatgacaatctgggaaaggcaaaactatgggagacaataaaaacatcagtagttgccaaaaattgcagggaggaagggatgaacaggtggagcacagaggatttttagggaagtgaaaatactctgtgatactagaatggtggatacatgtcattataatttgtccaaatccatagaatgtaaaacaccaagagagaaatctaatgttaactatggactttgggtgataatgatacatcaatgcaggttcataaattgtaacacatgtattactctgctaaggatgttgattaagaagcaggcggtgggggagcagagtctgcatgtgctgagcagggtgtgtactggaattatgtactatccactcagttttgctgggaatctaagattgctctataaagtttttttttaaatgagcaaatgatttggataaatatttatccaaagaaaacatatacatggctactaagcacataaaaagatgctcaacattattagttattaggctccttggtccattcaggctgctataacaaaataccataaactggatagcttataaacaaaagaaatttatttctcacagttctggagtgtgggaagtctaagatcaaggcaccagcagattcagtgggtggtgagagcccactttctgcttcatcgatggcaccttcttatggtgtcctcacatgatggaggggacaaaggagcacttctcaggcttcctttataagggcgctattaccattcatagggtagagccctcataacctaatcatatctcaaaggctttccaacccctaataataccaccttaggtattagaatttcaacatattaatattggggtcagggagtgggagcagatcataacattagggaaatgccaatcaaaaccacaatgacataccatttcacacccactaggatggctataataaaaaatatggtcaataacaggtgtttgcgaggatgtagaaaaactagaattcttgtacatcactggtagaaatgtaaaatggtatggcttttgtgcaaaagaggttggtggttcctcaaaaaattaaatgtggagttactatatgacccagaactttcaatcctacatatatacccaaaagaattaaacatataggctcacacaacaagttgcgcacagatcttcacagcagtattatttataatagccaaaaagtagaaacagcccaaatgtctattaattggctcatgtataaacaaaatgtgatatatgcatgcaatggaatattattcagccattaaaagaaatagaatgctgataatgacatcatattgtatgattccatttataggaaatgtacagaataagcaaatccatagaaacagaaaagagataagtgcttgccagtggttgggtattggaggaatgggaatggctgctaattggtacggtgtttataatgtgatgaaatgttttggaaagagatactggagatgattgcccaacctcgtgaatatattaacatcgactgaattgtaccctttaaaatggtagacttcatggtatgtgaattatatcttaatttgaaaaaattattttaaggtacgagtaatgtagatttcaggaatccctttatgtcttaaaatgaatttattttgacactacactttgttgatagtttgactgagtaaataattctaggttcaagaggaattatttttttttaaaccttgaagacctttaccctaccatattctagctttcattatggctgatgagatgtctgattttttccccctttctttatttgcttatttttctttccctccttccttccttcttttctttttttaagaagaactagaaattcttcctggaaacttttagagtgtcctctttatctttgtttttctgaatctcacagttatgattctgacagtgagtgttaggtaggaagggaaataattcatctttatcaacatgaatattgcttctctgttcaacttataaaaatattcttcttttttaaaatttatttttattgaagactagtttatatacattgaaattcacacatcttaagtgtacaatttgatgagttttagcaaatgtacatacttgtgtaactaccatttcatgtgctttttggtcatttgtatttttttcttttctaaaatgtttgcctaagtctctttctcatttacagtggatccaatttgtcaattttttcttttacagattgtgcaagaggaagatgtatgtcacgtcaaagaattatttgctagtcctaagtcctgaaatttctattttttcctaaacattttatggttttatattttacatatgagttcataatgagttaatttttgcataaagtatgcgttttaagttgagcttcttttttttgcttacaaatgtcactttgacaaattttaaaactgagttatctttattactgagttgtaagaattctttccatcccctagatacacatcctttgtcagatgtatgtattacaaatattttcttttggtcctggcttgtttattcatttgcttaacggtgtctcttatggttttacattttgattaaacccaatgtgttagtttttttgaggttggtacttttcggtctcatggaaaaaaatctttgccaaccccacagtcatgaagatattcttctgtttttctctagaagccttttagttttagcttttgagtttaggtccatgatgcatctcaaaattagttttttgtgtagcatgaggtaaggattgagactaatctttttccatatgtccatctaatttttccagcaccatttattgaaaagatttttctttcctatataatttcctatagtagcattaagactaatatggctatgtacttgtttaggatgcccttgaactcctgtaggttgggatgatgaccactggtatgcctcattatcaaaagtgtcaaatccctgctgcctcatgtcattggctacttgcacataataattttgtctatcttcagggttctggttttccttctctttctcttcttcacaatttgggtaatagtcatctttgcagccatcagattcctagctgttcatattcagaggtatcttgatgtgatgggatactttgtttacccccttcgcaggcaggaactggagtggttctttcactctgcccaccgctggccactcctccgctcaggagggagggtgcgagcgagcaagtgcaggaactgaagcgaacaaacactggaactggccagagtccaagcatgttatgaccaatactctgtcagatcagccgtccagggacaggggagtgccaaccagctcactggagggtcaaggtggcagcctctgacctctcagcacccaggttcttgtccagcatccaggaagaatcaagtcacatgaactgtttgagaggttgatgaatgcagaagactttattgagcagtggttggctctcagcagaaaaggagactgaaaagcggtcgggaaaatgatctctctctccctgaagcccggctgcccctctctgaagcagccctgtctgaagttagccacatctatccatagtctccaacgttcagttgcttctctcctcgctgctcagccacttgtgttgctctgccagctgaagtcttctatgggcacaggataggagcatggcaggccaaaaaggtaacatttgggcagaaaaacggggtcagctgttttcacttggggccgcagtttcaggcatatgggtggggtttagctgggagcccagcccttctgtatcattgacagccaagtttcagataaaaaaagctgcttccttccctcaccctctaactctttaaaactttattacttcctcaaatgcattagaaatttgtgtctgtatttttcaaggtcatacacaaaggtattactaaaattaccatatgattttcattgagaactcaatcttttggcagctaagcattaatcaggttagccaagttgttccttccaaggagggttccgggagggtacaggtcacagccatagaacaggaaagaagcaggccaaagctgatatgtgatccaggctgctttctccttctcttgttccgtcatcattttcaggtaacttcatcttgacattctgcaaaacataattctggtcgactacatgagtggcatgatgctaatgtgacttatgagcaagaagtggcaaataccctacatgcccaagtaagtacatagtgagaaataattccatagagattcagaggcctaccatattgttgaaattttgaagaatacaacaatccaatacatgtgttataaggtaaagacgggtggtagaatattgcgccatctatgataaataaagaggcataggccaagcctggtggctcacacctgtaatcccagcactttgggaggccaaggctggaggagtaggagtttaagacttaaactcacttgagcgtaggagtttaagactagcctggacaacatggcaaaactctgtctccacaaacaatacaaaaatttgccaggcatggtagtgtgcacctgtagtcccagctacttgggaggctgaggtggaaggattgcttaagcctgggaagtgtagtttgcagtgagcagtgagctgtgattgcacttgcactccagcctgggtgacaaagcaagaccctgtcttaaaaaaaaaaagaaggaaagggaagaagaggaggggaggggaggggagggaagaggagaggggagggaaagaaagaaaaagaaagaggcataatggtttctgggtttctttggattttggagaaagcaaatactatatactttgagtggggaccagaactacaagcaggtcaagacaatcatgcaagctgttcaaacacttgtgtcatgacatcagcagatctgctactgctggagataatcctgaccctgaaactgctgactaagctaggttaggaggtacagagttccacccaattagaagttatgactaataagtgtaataagtggagtcactttgggttactcattctattgagcaaacaggtgaaaaatggagttaatgcactggctagggtaatgaactctgagctagagttactactacctaattaaagcagggaggatatgtctggaaccgaagggagtcagtggagcatctcttaccatttccatgcccagtgttaattgtcgtcgggaaattacagactcagatgaagttccatgccacagcaaatgggatcgggcttttccagtaactgcccaaatgttcttcccctctttctcagcctcacttcccttttcttacactcttactattctgagatggaacctcgccccccaaaatattaacaattaagctttgtttgagtctctattttccagaggactcaggcaaaggccccttccaacttctagtctttagtcattcaatcattctagggctgtccagtaaaaattagacagcctgaggctgagctgttcaatagaaacaatatgagtgtcatataaaatttttaaatttctagtagtcacattttaaaaagtaaacaggtgaaattaattttacttaaaccaatatacctaatatgttgtcatttcaacacatatttaatataataatgaaatagtttttttatattaaggtttcaaagtctattgtgaattttatacttacagtatatctcaatttgaatgttaacttatcattggaaatacttgatttatattagatttcataaattttacaataaaaaagattcacattcccaagttgttccaaaatattgggagacaattctccatgggtctctcatatttccgaacatcttgtgagcagaggcactggttgtctttgttctgaactatctttaaaggatgtctgtatatcaaatagccttggaagactgacatagtgtctccctctgaagcatgaggtaggtatgcttattgtccagatcataaagttaatgtgcagctgtgcttgcaggacagttctccaggtagcgttatgccacccagttcctcctcctttctggcttgtagtcctcaaaaagtgactgtagaatgtactgggaatgcaacactctaagatgaggagggactgtgtaggctctattatagtctctcttccctagccctcagaacaggatgtccttcaaagctctggccctgtgtgttatgaccccaaagtatataacccaaggtgggctgcctttcagggtccctcagctgtggtgcaagtagggcacacattgttgagactctatttgccctaggtaaatagagctttcaaggactggctcacaatggatcctgggcttcttttgtctcttgctgcctatctgcaattaataaatcatttcatgtaactagtggcatatgagtgtgttatttcttaactcaggtaagttggtaaccagtgtacagtgaagctgctttgcattgtttaccaccattgtaaaatatttaggttccctgaactaaggattccttacctataagacaatcagctgtgtatacagatgtcatttgaccctctttgtattgctctgtaggaatcaggcagaaattggttcaaagaaatactgattctctgactattgctattgctgtgattaatatactcctttgtcttgaacccaggggttctgtgcctttttaccagtatctataaaactgtggaaggttgatttatcttataagcagggtaccatctcagaccacttacagttcttgacacaaaaatacttgaaagttttccagtaacctaaattgagtaccagaaaaaaaaaatcactttcctttaacagtcacatccatattaaaaaaaaaactgcctcatattttttagaaaataattgatttgactttgaaagcaaaagcatatcaatttcaaaactatgtgttcaagtaaagtacattcactaaatcttacgttgactcagtggtattgatattgaattcaaaaagagtatttcataaattgaaaagcaacttgaaatttctctcaatatcaatagtgttcaaatttttcttgtagttcttactgttaatttatataatacttttgatttaattaaaatctcctgcatactgatttgttagaaaatgtaaactcttttaaaaatgcgtaaaatcattattattggtttgtattaccaaaagtttaaatttcaatataaatccttgtacttgtctaaataggtcacgagcttttgattttcttggagtttcaaatttagcttgttcacatgcactgtgatattgataagaaagcataaatcacacggctgtatttttctctttgattatggaatatttgtacaactttgtaatgtttatagaactcttccataactcaaccaatgaatattgagaaagaacacaagatagctaaattcattctcttctatttctttcaattgtttcataaactggcaatgactcacagaatttgcatggatacacggaataatttcaataactatatccattacctcttcatagagtttgcttcagaaaattgagcccagatatttttaatatctatcatacagtggaatgaagcaataagaaatcatgagtcacttatttcaaaatgccaataaatttagattttgacctaacttagctagagctttgtctctgatgatataaattaactttttttcctttaaattattttccaacaactgtaaaaataaaaaaaaaaaaagaattggctgggtgcggtgactcatgcctgtaatcccagcactttgggaggcagaggcaggcagatcacttgaggtcagcagttcgagaccagcctggccaacatggtgaaactccacctctactaaaaatacaaaacttagctgggcatggtggtgcgtgcctgtagtcccagctactagggaggctgaggcgggagaattgcttgaacctgggaggcagaggctgtagtaagccaagatcccgccactgcacttcagcctaggtgacagagtgagactccgtctcaaaaacaaacaaacaaataaacaaacaaaccgcatcatgagtttgattcttaggccatgaattgatatttctctgtaaatttggaagttctttgagacacaacatacccaaatatgggcagtatttcttatattacctgatttgtctatagctaaagaaacctatttgcaacattttaaattttgaatcaattgatttttgatagttaaaaagatactgcattctacagacacttgtttgataatttaattgaaaatcttttactttttaaaaatagtttttagccatttcttcataattttctaacatttccataaatgatataatagtttattttacaatctctccatctaaaaaaattgttagagggtgtgtgtgtgtgtgtgtgtgtgtgtgtgtgtgtgtaagaatccaagaccttttataactggccatatttacaaacttggatcctgtcagatatcatttaaatttttttgttgtacttttaattctgaattcaggcaattaatttgatcaattctttttgactgctgagaggaaagttcttatgatatttactatgtttttgctaaaaatgtctctcatgactgtgtattttataatcttaatattgttatacaacagataaaaagtcttttcattttgctctgccctaataaattgcaattgccattcattgtgaattttgtaacataccctcttccagaccgtttattcattccagtcatagtagtacctttgacatctccactgaatccaatttaaatgtaaaaatttgttcttcctcttctttttttttttttttatgagacggagtttcactcttgtcgcccaggctggagtggagtggcgatgtcagctcactgtaacctccacctcctgggttcaagtgattctctggcctcagcctcctgagtagctgggattacagacacctaacaccacacccggctcattttttgtatttttagtagagatggggttttgccatgttgggcaggctagtcttgaactcctgatctcaggtgatccgcctgccacggcctcccaaagtgctggaattacagacgtgagccaccacacccagcctccaccacctcctcctcctccacctcctccccccaccccaacctcctcctcctccttcttcttcttcgtattattattattttttggagacagagtctcagtctgttgtccaggctggagtgcagtggcatgctcttggctcactgcaacctctgcctcccaggttcaagcaattctcctgcctcagcctccctagtagctgggactacaggcacgtgccaccacgcctggctattttttttatttttagtagatgttggccaggctgctctcgaactcctgaccttaggtggtttgcccgccttggcctcccaaggtgttgggattataggagtgagccaccatgcctggcctattttttaagctagagaaaataatttgatgatataattaaaataagtatttaaattttattaccaattaaaatttatatctttgtaactttcactgtctgcaaaaatatttaaataaatcagtgcataggaacaaaacatccaaattgaaaaacctgtaactgacaatattgatgatatatttatatgtaatactagagttgacctacatgctcaacatacactgtataacaatgtcttatatgatgcaatggttaaagtgaaatgttgccctaaccaaactgtaaagttgggtttcatggaaaacatgctacttttcttcagtttttaattttaaaatgtgacactagccacatttcaagtgctcagtagccatataaggctagtgaccctcatactggaaagcacagctgtaggcaacagagattcagcagtaaacaaagcaagagaaaaatccctctccccttgggcctcaagttttctgtctacttatattttatttacttaaaaaacaacatagagctgtattttgaatttttattgagtctgaaaatctttgtactttgattggataatttaatccagttacatttatttattatgtttatttattggcagggtctcaccctgtcgcctaggctggagtgcagtagtgcagtagtgcaatcatgactcactgcagcctcaacctccccaggctcaggtgatgctcccacttcagcccaagtagctgggaccacaggtgcatgctaccatgcctggctaatatttctgtatttttttgtagagatggggtttctctatgttgcccaggcttgtctcaaactcccaggcttaagcaatcctccagcctcggacttccaaagtgctgggattacaggtgtgaacaaccgcacctggccccaattactttttgaataattacttatacaatttggaattttacctaccatattgtgccttctacttgtcctgccatctctagatctctctcatttgcctttttttctcctttgtctattgatttcttctcttctaatttagaaattatgcaccttttctattttttgtgtttaccctacattttaaaaggctttttattttgagataatttcggacttatagaagaatccacaaaattagtacagaaatttcccctatacacactgaccagattcccctaatatcaacatattacatattcatagaataatcaaatgtaattaaccaacactgaaataatattattaaataatctaccactcatagggtggaatgcatccagagcatttaggctgcacaggaagttgcagagggactggtagatctgtgtagagcactgggccacaggtgagctatgcacaggttgtgcagaggctggtaaagagtgacttcagatgtgtgagtctccaggccacaaacgtcagtgcaggccatgcaagagctttggtttccttgtgaagaggggtgcaaaaaggttatcagcaggccaaagctgcaaggtcacagacagattgtgttttgggcctgtggatatttactggttgtcttcatactcacactagccaaccctcagcccataacaggaatagcaggagaacctcttcctctgtagtattcctccaatgccctttacttagaaagattaacatcgtgcccacgttaaaggagggactctgaaaaaaattcagttgcctatcacagaagatatacagtaacagatgttccttgacttatgatggggttacatttcaatgaactcattgtaaatacaaaatatcataagtcaaaaatgcatttaatacacttaagctaccaaacatcatagcttagcctagcctactttaaatgtgctctgaacacttaacattagacttgttttggattattttatcttactgtaggctattttatagtaaagtgttgactgcctcatgtaatttatcgaatactacattgaaaatggaaaacagggccgggtgctgtggctcatacctgtaatcctagcacttttggagactgaggcaggagacttgtttgagcccaggagttcaagaccagcctaggcaacattgggagacactgtctctacaaaaaatataaaaacaaaaattagttgggtgcagtgcatgtgcttgtggtcccggctactcgggagggtgaggtgggaagactgcttgagcccaggaggtgaagtctgcagtgagccatgatcgcaccactgcactccggcctgggtgacagagtgtttcaaacaagaaaaaaaaaagaaaaggaaaaaacagaaaaattgtatggctactcaaaagtatggcttttactgaatgcgtatcattttgcatcatcatgaagtcaaaaaattgtaagtcgaaccattgtaagtcaaacaccatctgtagtatccctttatctatggtttcattttctacagtttttcttacccatgattcaccatggtgtgaaaatattacgtctctactcttgtgctttgggaacattattaagtaaaaaaagttatttgaacacagcactgtaatactgtgatagtccatgtgattaccaagatggctactaagtgactaacagaaatctgagcaggaaggagtgggatggcatgagatttcatcatgttactgagaacacagtgcaatttaaaacatgaattgtttatttctggaattattcatttatgtcatcatgcttatgtcattcacttcatttaggcattttatctcatataatcacaagaagggttagtacagtacaataagatgtattgagagttcacattcatcttattacagtatattgttataattgctgtattttattattaatctctgtggctaacttataaactttatcatatatatatataggaaaaaacatagtgtatagtgggtttagttctatctgtggtttcaattatctactaggggtcttgcaatgtatctcccaaggataatgaggaactactttattgaaaggcgcatttggagcctggaagcagtaaattgaattcgaattcaagctccaattagccatgtgttagaccaagttatttttccatggttcttaagctgttactttcatcttcatcttcgtgctacattcagaatgattttttcatatctttcattcctctaattctttacttagctgtgtcaactaggctattaaacctatccttaagttttaattagtttgttttctaaattctggaagtactgcttttggttatttttcaaatctgattgatcattttaatagcctcttgctctttattcatattttaaacttattttatttctcccataatgatagagaggtaagattctggaatctgattatctagatttaaatcccaacctctaccattagatgagtaactttgggcaaatagtaacctcttttcctcagttgcttcatctataaaatagaaataatataagcatttaaataagtacacaagtttgttatcagaattaagagttaatattatgtaaagaattggccgggtgcagtggctcctgcctgtaatcccagcactttgggaggccgaggggggcgggtcacctgaggtcaggagtttgagaccagcctggctaacatggtgaaaccccatttctactaaaaatacaaaaaattagccaggcgtggtggcaagcacctgtaatcccagctacttgggaggctgaggcaggagaatcgcttgaacctgggaggcagaggttgcagtgagccgagatcataccattgcactccagcctgggcaacagcagcgaaactccgtctcaaaaaataaataaaatatctgtgtgtgtgtgtgtgtgtgtgcgcgcgcgcgtgcgtgtctgaagaatttagaaaagtgcttgacacttaaaagtattacataaatgttggttattactatcttttgccactgatattttaaggtgaaattcacatattaactattgtaaaatgcacaattcagtgtaatttcatgtgttcacaatgttgtatagccataataacttctagttccaagacattttcaccacccacaagagactacatacccatcaagcagtcattccccatttccctatcttcctagtagctgaatctgctttctgtctctatagaactattctggatattcatataaatgaaattatacaatatgtgaccttttatgttttgctcctttcttttagcaaaatgtttttaaggcccatccacattatagcatgcatcaatactacaatctttcatgtggctgaataatataccatcgtacggaaataccacaatttgtttcattgtttccatcttttggctattgtgaatagtgagtgctgctatgaacattcatttacaagtatttgtttgaatacctgttttcagttgttttgggtacgtaaccaggaatgaaattgctgagtcatacaataattctatgttcaactttttggggaactgccaaactgctttccacagaagctgcaccatcttacattcccaccagcattgtaccaggtttccagtttcacaaaatcctcaccagcacattttctattttaaaattttacagctattctatggggtaaaaagtgatacatcattgtggtttggacttgcatttctctaataactagtatgttgaacatcttttcatttacttactagccatctgtttatcttatttgggaaaatgtttaaatcttttgcctgtttttaaatagggtcatcttcttgttgagttttaaaaattctttattctgaatactagagcctaatcatagatgacttgaaaatttgtgtccattctgtaggttatcctttcatttttataatgtcttttgacacacgtttataatcttaatgaagtccaatttatctttttcctttggttgtttgtgcttttggtgtcatctctaagtattgccaaatctaagaacacaaagatacactctcattttcttctaagagttttatggttttagtagctcttacatttgtgactttgatccattttaatttttgcataagatgtgaggtaggggtccaaattcattcttttgcatgtagatatctggttgtctctacaccatattgttaaagagactattgtttcccattgaatggtcttgtcatctttgtcaaacatcaactgaccgtaaatgtatgataatttctggcctctcaattctattccatgagtctatgtgttcctgtgtatgctattttgattactgtagctttgtattaacttttgaaatagggaagtatgagttccttactttcattctttttaaagattgtttagctccttgcagtcctttgcaattccgtatgaatttttacactttatcatttctgcaaaacagtcattgggattttgataggggttgcattgaatgtgtagattgctttgagaatcactgtcatttcagcatattaaatcttcaaatccatgaacacaggatgtcttttcatttattcaggacttctctttcagaagtttgatagttttcagtgtacatgtttttgcatttcccttattaattttttctttttttgaaatagagtctcactctgtcacccaggctggagtgcagtggcatgatgtcggctgactgcaacctctgcctcccaggtttaagcaattctcctggctcagcctcccgagtagctgggactacaggtgcacgtcaccacacccagctattttattttttttgtatttttagtggagatggggtttcaccaagttggccaggctggtctcaaactgctgacctcgtgatctgcacgcctcgacctccgaaagtgctgggattataggtgtgagccactgcactgggcccctattctttttgatgctattgtatatggaactttcttaacatcatttatggattgcttagaataattatttaaagaaatacaactgatttctgtgtgccaatcttgtatcctgcaaatttgcctaattctatgagcgctaagtggtttttatgatttaggattttccatatacaagatgtcacttatttagtcttcctttacaatttgactaatattttttaaatattgatatttaatgttttgattcttgcaaattggttggcaactcatggtgctacattaccttgtactttttcttgctggttttaaaatgtgagctattatgcaattcctacagtgtttgcttctgccagtagctggttgttttactaatttggaatcactctaaaaattaaatcctctgcttgaatttcctgggaccacctaagcctgcaaatcttcacaaagcccaaactgttattacaaattctcacaatattctcctgtcacagagcaccaagtttcaagataggtagagtcctagttgtactaggaatgggtttctcgtatttgacaccacttttgggtgcatcctgggctttgccagagtcatgaaaattaaaggtcagctgggcatgatggttcacgcctgtaaccccagcactttgggaggccgtggcgaatggtcttgagcccaggagttcaagaacagtctgggcaacatggcgagtagccccaactactcaggaggctgaggtgggaggattgcttgagtccaggaggtcgaggggtgtatcactgcactccagcctgggtgatacagcaagaccctgtcttgtagaaaaaatgaaaaaagttcacttggggtaggtacttcaagtgttttcaaaatgcaatgcaagctggttctgggtatgttctgttttcttctgggttcttggtttcagtttggttttggtgagagtactccttcctttcttgatagaacattgacacatcgaaaaaaaaaaaaaaagttttcccccagcaagtggttgctttttcaaaggatttatcagggtaatcatccaggctgacagaatctgaactgcattattttacttacaataaagaaggtctgattaacaaatttttaatagtatattagttttctttgttcttttggagttagaaatgaagcaagcaaaagattaaacattttccctaagaagatatacaaatgacgagtaagtacatgtacctttgacaggctaccatttggctcagtcatttgtgttaaatatttgatcacctaaaatgttgcaagtagtcatctcgtcattgataaataagagaaaaaaaatctgtcctcatagaactggggtggcgctgagggtgagacaattattacctataagatagataatactgaatatgccatgatgtactctatagaggtgatgctgtgttggtgtatttatagaatagtcaagaaaaaccactctgataaggtatttgaatagagacctagttagggaaaaggaagctgtatggtatgtggggtaagatcatcctaggcaaaggtaagaacaagagtaaacatcttcacacatctttgcaagtctcagcagtcccatgtgactgagctgagagagttggaatggtggtgagacaagcaaggaattggggattaagctgaggcaaaggtagggaagaaagttatctacagccttgtagattacttttaataccttgtgtttttactccgaatgagatgggaaaccattaggtttggaggaaagccatgccatctgataaggtttaaaggggttgtgtgtgggacagacagattgctgcaacgtggggagatcactcaggaggctactccaataatccaaataagaaatgatatagctttagatcatagtgctaacagtcaacatgataaatgggcagattctaaaggctgctgttaagtctgattgaaggtggagtgtgaaaagtcaaagatggtgcctaggttttaggccattgcaatttaatgttgacatttactgagcatggggtaatagtatatgtatatgtgtatgtctttatagacatatggccagttttagacattttaaaagacgccctttagcttgtcatgtggataatgaatagaagctatatgggagctcaggagaaatagcttgaaggttagtaaatgacggtggttaactgggctcctaagatagtatgacatgaaagttcattgtttagccttgactacaaatttgatacggtaaatgagaaatcaagttctatagaggatcagacagtagtacgtaaaaatgtaaatttcataatattttttacaatacagaaaagagggctcttaaaaaatctcattcataaatagcatacagtttgggaagagctagatactgataatgggactttaatggaagcatcccaagtaaaagaacaattgtcagaaacatcttgtatacctgaatcatataaaatttttcaaacctgaggccagaaatgagcaagtagttataaggtagcaacaaataatgcaacacagtaataatttctagggacttaagacattcggccaacttcaatatatttaagtctttttgttaaaatggttcctcaagtttttttggcagggggtggcactgtcatgttttgaagccatttccaaatacctttaaccgtttatttttccattacaatgggacagcacgagaaatcttaatagtcaccttagggtacctttaatatctgtcaaacactgcaaacacccttaacatagcatcatttccacttggaaaaattgcctagtgtcaggccacagaatgggatctgggttcaaatttgttcagctagccaacacaatacttaggtagatctttgcacctgattacttttaaatacttgacgattggttgaattccatgccagtatggttattcaaattagccaactgtaggacgttaatgtattttaatattccaagtgtaaatgtggaaatcaatgtactgtattactattcaaagtactaggaaattgtcaggtatcagaaacgtaatacttaaacacattctctaaagccaaaaacagctataaaaaaatagctgtagagtcaaaggattactggttgtagtctgttacaagggaatgctacgaacagacttctgaaaacggttctcaatcttcactattcatcagaatcacttggagggtgttttaatataggtgactgggctccatgccagtttgactcaggactgggatggggcctgacaacttatattataaagaatttcctaaatgatgctgagattgttatctcaagaaacattttgagaaccaccttattcataaactgtataaaattaaaaatcgagctcacacacattaagctcaagtgtggatttcatgttagctggaattaccgagtaagaccaaagtgtctttaaacacagactttaatggtaacaattcctttaagctcaattaacttcagctattacaagtcttatgcagatgtcactattagacaatatttagtgacttgcactgggttcctcataaaagacaaattcacttaaaagtgtaatcaacaatcattaacagttttgttatgccaacacaaaacatggctgagttacccccctccccgcccaaattactaacacagcatgatcagtaccttaagtatacttcaactaagccatttcaacaaacaaacaaaaaaaaacaaacaaaaaaaaaagtgagtgtttcactacccctgagaccactagttaactgtggttcatactttaaaatgtgagtacacccacacaagaaagcaaattaatcagttttaaaaaatctgattatcacattgcaaactcgcccaggaaaaacaaactgagtcatttaaaatgtaaatttaccattaacaggccaactggaccctaattcggtttatgcattaaaagatttaggaaatacaaagacatagtcaaaactgattctaatactcagttgggtcctatacatggcactagtaatgtcaaattactgggtggagtggggcaaagagggcaaattcttagattcttttaagatttcattgtacatatctcatgtccagtgtccatacattcaaaaatgttggttttccaggtactttactgttcttttaaacctggagaagcctctatggcttattcccttagaagcaacaaatgaaatgatgtataaagcatcaagtcaaagatacagagaactggacacatccactaattgttatgacaatcaaagaagtcatctccgtaaatacctaagggttgtctaaggctataaaggtcaatttgaaagccagttagggatccaccgtgtttcataaaagtgtcttacactcatgtttggctttcaagaagtgatatgcctactaaagctgttattttgagactatatgcatctcagaagtaattttgaaaatagagccaaagagcagtttttcttaccttgtggagcagaatgttaactaatttctcattcataatttgaatccaaaaaagttatgcagtatgacatctaccctgaaggagccgttttaagcaaaacacaaaatgaaaaaattcactcattggaaaaactgcgtagctggttttttccccaatgaaatgattacagaattaacaaagccagaacatcttcagaaggcatgcatttcacttccagtttagagaagaaccttaagtcaataaatcatgtccaaactacatattaaaatgtttataaaaagtaagttttaacatttatttctagctttccacatgtgtgtgcagacaaggaataagattgcacgtaagtgtaagcagtgcaaaaatgtggaagtggaggagtcacagatgtgctagaactttaagaaataaagcagtgaacaaaatcaaaataaacaggaaaaatgtaaaactatgggatcagaattaggaaaggtgaagaatggtaatgcccttgttactacagaagttaaatcagtggcacagatagcacttgtcaaacaaaaaacaatccaatagcattgacttttattcattcatgttaagtcacctgaaatgatatctgttgcatttaaatgctcattaatgtaaatggctgaacaaatccatttcaatggatactcaatatcccacatagataagtcacttcaacacagcctcatgacaactcccacaccaaaacagtactttattttgcaaattttgacccattattactcccatgttgttttttttcagctgtcaagtgtacaaggtgaagagaaatttcagttagacaggggctgcacctggaaaataaatttcttaaactccataaacacatttcaaaactgctgggtcccaaaagtccatctatgaactctagggctgccagtatcatgtgcagcacattaaagctacactatccaaatagcttattaattctgcataaatcaggtcaagcaatgtgtcaacctgtaacagactgtgcactttaactgaacatggcaaaatattcactctttcgaactttacatcatcatttgatgtcaaacaatgaagcaaatcccaacagtatatacaaaaaacagctttgcatttacaaaagattgtttcccatactgattaatccaggcagctaactcattggtttatgcaactttattgaagaaaaataaatcaattactagcagagctattagttgatcactcatccattgacaacttgcatcatttattcagtgctatattaaacagtgtattggaagatagattaactaatagctccaagcctcctaacaatttaaatgaaaattacaaaatgtttgagaccctattttggaatacaaagggtgtttgacttccaatttccattctctgtagaacaagaacaggtcattcctttattgacatgcataaaatacatcacattttctgttctgctgatgctataaattcaataccaattctccagccacatcagttatgagcataaagcatatcatgtaacctcaaatctctaacagtggaaggcttaaacaagaatggatgctgctagaataatgctgtatcctttgatgtgacaactgagcatccatctccctccccctcagatgatttcttcagcatgttagagcagtgaggaatggttttagtctcataaccaagttagagtgaagacattggccacataatacacatgctccatttttttttttaaaaattctgagtcttgggcaactgttctcttgtaactactttacagtttctaaaagcagttattgtccaaagctggaagaacttaagtcttctcagatgagcatgtgaatgaatggagggaggtaaacaaaaaataaaattaaaaaagatgaggtctgataggggagcagccggataagaaaatcaaaaaaggaacagtaatttaaagtttattccagctataatgcaggttattctgactttaaggtagcatcacatggcatacttctgagtccattcccgagatattctgttgtacctgtaaataaagatgttatttttaaaagttaaaataaagaattcctaatactttaaatggaagggaaagatttccattttatcatctccagactcatcatgaagtcatctctaatgactatgattagaataaaagccaacaagggagaaatagcactggtactcaaagcaatgtgggaaatgagagcctgatgctctgaaagtagtattttaaaaacaactaagaaagcagcactgaaaattgggaggctaacaaaaatcaaaagaccctttctttctctaccaccgagctcatgctctaattttaacgtgaagaaatttttacagttcattatggacaaatgttaaaatagtatacacattctatctatccacagaaatttccaccaaggccagaactaggcttttactagaacaattttatctgaatcctagagtttgggaaattacttggtcctggatattacaagaaaaaatggctttgggacttaggtagaggcagaaggggaagatgacactgggcagaatgacaaagggcagtaattttcaaaaggggtgtgtgtgtgagtggttgtgttcatcagaatcacgtgttacttttaataagtgtggtaactgaggctaataagcaccactgagacctgttgagtacaacaagggcatcttcgtttaaaaagatcaacaggtaattcacacacaagcaaggttattactcaggaagactactaacattgataaatactatcagcttccccctggattatactcatgccatagactacttacaacaacaaaaaacagtgataaccttaagaaaggaatatatatatatatatatatatatatatatatatatatatatatatgcacaggagaatttttatattgtttaaatattaactagctttatttcaaaccaagaaccaaatatggtccaacaacttttctaaactttttaaaaagttctttctaccaattcattgtcatctcctaaggatactctctcaaaaagccagcactttaaaacaaaggctttatttagcatacagggagccacaaagtacagctgacgctaatgcatgcttgtcagtaatgaacatttagtttagatgcttaggcttaaaagtgtttttcccttacattactatctcctggcaaaatttgaactaaaccaccacattctgtataggattggtacaaagtctcaagctaaaatttaaacaccatgatagtttgaaaaaaaaaaaagatactacataaattcccatttcttactagtgctattgtaactgctttgccatgcaatactttcaagcagtaacggctaccagatatttactttcacgttaaacagagaccaagcagttaaatgtacagttttcagaagactgccatatttgttaccttttgttagttaatacagtgccttaacgcatgcagcactcaagtgctggcagtaccataataagcgcaccatagagtgcagatcctcttaccctacaacatagcgtatttctctgtccactctcttgctaacctattgtacctaattgaacaagtacacttagcattaattataacatatgaaagttataatggttaagttgaacataaatataattcaaatatttgagaaatttagaccaaatttttacaatagtactaacatttttggaaaaacatgcttggggtaaagaaaaatttgctttcttccccaaaagttgagaataaagtgatactgtttaacacgctaggaaaaaaaaaacaacaataaaacattttagaggggagcattcactgtcacataagctaaagcctagttaagtttttttaaataaccacatttcaatagctttctccatattttaactattatcttactaaatatcaagtcttcttggcactgtcacaagcaaagtataagcctaactcattaagtaaaaccacttttataataactttttaacatacttacttatctctgtctgttttatagatccgtgcaatctctggcactagggggtcatctgggtttggatcacatagcagtgaacaaatggataaaagaactgcaagaaaacaaaaacatctgttacccagtttcaggagtttggataaataaatttttctaaaccgtgtattacaaaactcaatcctcaaaagacttttattagtttgtatctttatctcaatgagacacagttttacagagattttgtttcacagaagacaagctcctggtaagtaagaagtgctaaaaacagggttttgtggcatgaaattcactgcagactagccataaaaatagtttctaagataggcaactgatgccatattaatatatatattttaaataggcataaatgatattagaacttgagtttcttggtactctgtggctgggggggggggactttagcaagaatatgcaggtaacactcatgccatattcatagccattaggcatgacgaaaaatccattcttagccgctgtcttggcaatttctgagaaaaaccctcaagtgctccactaaatgtctccttgaacttgtaagcaagaaaccatattcccaagagtactagttaaatacaatgccaaaatctctttagtactaagtgagtcatcagctctagttcttaccttaaccagctcaacatactgatgcataagatgtcaagcattaaagaacatagatcgcattcacctttgagtgccggtatgtgccagcaacatatatgtggggtgctgtattaaaatgttaagatataaatgctctgaaaggttctgaccggttttttttaaaaaaagcaatagtataaaaaagcacccttgtcacatatttattgactacagcaaatttaatttccaaaccccaaatacagcagaatataaaattacctaatataggagacttggctatacaataactcacagaaaaaaggtagcttcagttgtgactgctagtttaataagttagcaaagtatggctgccaaaaaagtaagttgctttaacgacaaaacaataccaattcaatctgcccttacaaaaacagttttcagtgttactgtacactcccagcagtagtagaaaaacttggaaactgatatttaggtatgtagcatgatttgaaaagaaattagaaagcatccaagaaggtgaaaaacaggtgtaaaattttaaaaacactcgaattatggcagcatctgcctaagttgtttctttttctcccttaagtgattctactcaataaagtttgggaaatgctactgctacagtctctctccatgagattcaagtgcagtatatacacatatgaaacttttatacaatgccttgccttttgaaaaagcttttttgtacttactgaactcataaaatcaaaaaacaattaatggtgaaatagtgttaattattacaacttcacctgggatattcatgcggagaccggaaaacttgttacatataacgtaacagatgcctattaagagaccagaattgatctacagatctttcgaagattatataattttagactgtcattaggtagaaacaacctatcatggttacataaaacatgactgaagatttgtctaaaaattaacccaggaaagcaaaatcagaattttcctagagtggaaacctcagaattcaaaagctctattaagtttaggtatatcataccattcttggtaaaaaggccgcaagttagtgtgagatgtccaagtggtttgggattgaaaaatacagaagtctattaaaataaattttgctattataagatgagatgaaggtaactcattaggcaaataatgcctactcaccacaatttgaattttaacaacttctcacaaagtatctttaatcaacaccactaaaagaacaaaaattataaaaataactttattgcttccccatctcttaccaaaaagctgccataataaaaatactcagataagtagatctaagaatgaagctttattagacaatgagaacagcttatttcactagaaatatttacctttagaaattgttaaagcaggcgaccactgtgatcttagaatatcgagacaaatgctgccattactgttaatatttggatgataaattcttgttgtaaatgcaacctaaaacaaaaacttttaagtattttattcaaataaaaacaaacatcttttaaagcaaaacttaaaataatcaagccacaatgttaaaaatgtcatctattagcatagaagttctaaatattatagaaactgatttttacaatctgaccacaaccccctgcctcctctttttacaacagaaacctaaacttttggataaaaatttcattactcatatgatgtaaagttctaaaggttactgtggccctaccatatcatgaatcaaagggcaatttaaaggtatttaacacattcatttataaaagccctaacttttggatgtaaccaaaatttgtagaccatctcatttaaagtttcattaagttacacaggtacacctgagtctgcatttccaccgtacataaaacataaacttgaatcacaaaaatggaaaccatcacattgcacctataacattactagagattgttatagtgacatgtttatgacctttgtatattaccttttctagttattcatacaggttgaatttatgttaatgactgaaaagtgaaggataatatgcttttaatacctataaaccagtgcactaagcaactctaagttttcacaaatttacacttacgtatacaaaactataagcataataagcatatgctgtaacaatacgtgcaaatataaattgaagttggacatttgatgcttacaagacaacaaaagcccaaaaatcagaatctgtgtaacaataatacagatgagggcggaagcttccacatggtctgaatcttgcaacattaaagaaaaggcaaaccttattcctatttacaaagctcaaactgaggtctagctctttaaaccaaaggttaagagtcagcatctatacatgagtgcaattcaacatatatatacagcctacacagaaccctatcttccaagaatgctctattcctttgaaataaagcataaatctatactaacagattttgagggaaaatacttgccttaggtggtttgaaggggtagtctgtaggaaaatgaattgtcaaaaagaatacaccgccttgatatgggctgtcattctgtaaaaagaaaagtatgcttaactcaaatttaaaatattattgctaaatattccgtaacatttgtttccaagcatttctctaataatgaacccaaatcacctatttacactgcaataaataatctattccatgaaaattcagtctatagtaatagaaaaaaacttaaaacttatacagtaataaaccctaatttacctagtcattttacacgtcaccaaaatgtttttttaaaaagttatccagaaacgcaagtattctagatctcaattctcaaaagtacaacacagcaataaagcctacataatcatgtttcagaataatctgtaaacaaaattttacacatgtagattatttcttccaatagccagatgtgtacaaatggcttcacaacagtccattctgcccactggcaaaccaaatgttagctattccaggtaacacacacacaccaccttcaagaggagaacagagaaaagcctaagcttctcattttaatcaataccagaaaatacatgcattgcccctattttatgcatgagaaaaatgaggcttaaagaacttagtctagtgtacaaatggtaaatgatagaaccaagattcaaacacaagtcttttgaagaccacttaatgatcaaagatactgacctactcaggaatttaaagttaaaatgtggaatgcctaactgcttctgggtatgcaaagaaccaatccgaagacatgttttacaacttacatgaactgggtttttaccaacactgactcccctctattagaaaggctttgtatatacagctatatatgagcctttcactatgcccattctggatgtcaggcacataaaaaacaggcctgacactaacacagctcatctaattcctacccttctgtaaaataaataaacattaattcaattaatctaaccccttgctatatactgtatgtgtgttaagggatccaaagaacaattttttttatcttgatgagcttacactgatagacatgtaaagtaactgcaatgaaatgttataggtatcatgaaatatgaacaagggacacgagttcaaagaagaaaggtcaatttattaatgaagaatcaggttcaaagaaatatacaactagtaaatggaagagcttttatttatttgagacggagtctcactctgtcgctcaggcttaagcgcagtggcacgatctcagctcactgcgacctctgcctcctgggttcaagcaactctcctgcctcagcctcccaagtagctgggattacacatatgcaccaccacacccagctaatttttgtatttttagtagagactgagtttcaccatgttggccaggctagtcttgcggcctcctgaccttgtgatccacccatctcggcctcccaaaatgtgctgattataggtgtgagctactgtacccagccagagcttatttaaagtgagtccttctccatctcccaagtcttccccctttttttttgtaggggtggagggcggggggaatgggaacgggaagggggacaaacaagacgtagaatatcatcttgctgtttgttgcccaagctcgagtaaaatggtgcaacctcagctcactgcaagcgccgcctccccaggttcaagagattctcctgcttcagctgcctcagtagcttggattacaggtgtgcaccaacgtgcccagctaattttttatttttagtagagatggggcttcaccatgttggctgaactcttaactcctgaccccaggtgatccgcctgcctcagcctcccaaagtgctgggattacaggtatcagccaccgtgcccagtcctttttcatattttctacaaaatatggaactagaaaaacactcaggtcacttagaatgtgacctgagtttattagattaacatgtctttattaaatagttatattaattttgaatagatgcttcaaatagcatatactttcacctgatccaatactatacaagatatgttttttctgtgtaaaattaacaatttaaaggtaatcccaaacactaaagttgtttttgttttttttgagacagggtcttgctctgtcgcccagactggagtgcagtggcacaatcttggctcactgcaaccctctgcctcctgggatcaagtgattctcccacctcaccctcccgagtagctggaactacaggagtgaaccaccacagttggctaattttttttgtctttttagtagagacggagtttttgttgtctttttagttgagaggctggtctcaaactgctgagttccagtgatccacccaccttggcctcccaaagtgttgggattacagtcgtgagccaccatgcccggccccaaacattgaagttttaataacctaattccagaagttctttgtaagctttcatttcaattttcataaaatcaaatgctgtctatgactgcttctgaataaaggcaatctgctgatgggatttaggcaaagccaaatttcgtttcgtttgttcgaaaaaagaactttataaagaaggcaaaatatttcaatgttacaatttaacactaaagttctgccatgccaaaagaggaagaactacgaggttcagagataatgaaactaggcaatataaaaaattgagaccctatgatatttaaattctattatgaatcagcagcaaactacaccaaaaagaaacaaaatccccaaagaataaggaacactgtgatcagcaaatcgactcaaatcgtacaagtccagaatttatgttagattttttcagaaaccttctacttcttttgctctcatcagtgcaaagttgctccctcacagtgcctcagctcttctgtggcaataaaacgttggtattcttttttttttttttttaaagtggtgctgtcgcccaggctggagtgcagtggtgtgatctcggctcactgcaacctccacctcccaggttcaagtaaattctcgggcctcagcctccaaagcagctggaattacaggcatgtgccactacacccagctaaaaatgctggtattcttataggttgattttctactcttaactgctgacccataaaaatttgagttgcaaaatatatctctggtcagttattcattccagggcatatattcaaatgcctactgatatttctacttggatatctctacttggatatctcatgtcatgcgtccaaaactgaaacttgtctcaatcccttttttcctgttttttaatagcaagccataactgaaagccataaaccaggatctcatcatcaacttcttcctctcttatctcagaatcaagatagttatcaagtaagatctttaaaatttcttgaattagcttctcctttatgcccactgtcactaccatcttagttcatgatgttatcttcagcctagattatggcaatagcttactaatgattatccctccatcctaatgataaagtggtcttttaaaaatgttactcccctgcttgaaatctatgatagtttttaagataattccaactcctaagtacatacggtgctttatgatctgggtgcccatctagtttcatcttctgtctcttctatagaacatgttctctactgcacataaaatattatatggataacatatctttttctcttccctacttggaatattcttccttataatatagcccttcctttgtcttatctgctccctacccttcttttatacctctttaagcacatagttaccattatccacccatatatctaacatttacttatatttctcttttattagactacaaagctcctcaacgagtaaggttaaaggtggaaaaagtcttcaggtatcagtaacctacgtgggaaatgacataataatacacttgaaaaaaaagttgaaaaaataatccttatggaccaaataaaatagtacctatggaccaattattttaattcagatagtttttctggttgactatgctcaggctgccaaaggttacatttttcagatactttcacatttttcacaggtactctcttctacatctctgtcatagattaggtgggagttagtgttgttctctaaatccactttttctggatttccaataaaaaaaaatttaagcaagtaaatatcagaggcaataggtaaggaagtcaatttcttctaattacatcaattcttgttggaaactaaccttaatacagtaccccacgcccccctccccaaaaaaaaccacgcacacaaaaaactagcaatgctgtcatttctttcgaaggtttagtttttagtcaatagttgtgcttccgaagtagcttaccttcagaaagaataagccagtacatatgattattaaagccaagcaattttgctgcataactaatgatctaaaggatttcccaacaactcactaaaatcaaagttactctattgaaactcaaaattagatggtatattccctacagtcaggaatcttcagttctgtggcactggcaccactttaagggacctaagtagtagtccaaagcaaaagtgacgttgttaactgtccagttctcccactaaatctgtaatttatgggttgctttaggtcacaactgcttgctacatagagcaaccatactcacaaaataagctactatttatcttatacagtgatgctttgtcacaaagaagtattgagaagccaaaagaacaaaatgagttgtttcattggtgcactccacagtaagcatatagttaactatttaaagctggcatctaaattatgtgcttacttatgtacaagacaatacccgtactttgggtggatttttataatctttgactccttcttgaaatttacccaaccaacagtgagaactaacctttttaactgaaaacatatttcagtgagtactgctaccaaagcaaaacccagcagttgtggttaatcaggttaatatttaaatggttctgaaaatcacatgcttctgtttgtaaaagcagaaaactgctagtcattatattaaaaggttgctgaaaaagttcagcaaggaatagccatcacctgaaatatatatttaaaaaatgaaaaaaggtaaatgttttctcaaaataacagcaaattaagtaaactgctaaaaaatctgtcagaataagcaacaccattctctaaaaaaattactaccatacactcatcattcatgtttccttttgattgtctataggtatgttccttgccttttgggaaaaactagtgtgttgttcaaaataacaaagtctaaactgtcaagcagaaaaaccaactagttttaaagagttagtttattctgcacaccatccaattagaagttttaattaccaacgcttctgtgctttcttagtattgacaatttttataatgaaactatcaactaccctctgaatcaaagatgagctttattttaaggcattttatagcattctttgaaaactggtaatccaaaatgggaaaattctagaggttgcaaaagcaactgctttacaaaacactaggcagataatatggaattgacctagtaggcactgtggtaaacacatatcccatctaaaaaagggaggcagctgtcattccatcccaagccattactgcttatggaatgtgggcctactcagaaggcttttatttgaagactgccaactttcaaaaatatcgtgtgggccaaactgggtaactcaacatttaactgcgtgtattaaaattaaacaatattgctaccaaattagataaaagtaagtacttttaataactacaaagccaggattgtgcatttcgttattacaggactatttttactgttttaaatgttactttgttttaaaatgatccaggacgtttcaaagtattaaacttaatatttgcacccctgccatgtcttactttgatttagtttttctacctttagggcactaacattttaattactctaaattaatcctccctgctacaatttcccattaatttatcctactcagcacttcattcaccaatcacttattttccatcttgtcacacttcagcacttgttttaggtatctgtctcctctaatacagtgtaagttccctataagatcgacagggatgtttattatgttcaatttgtatccttattacctggcacacagtatgtactcacatttgagacagaaaaatgactaaagttagaatcagaattactaaataaatacttgttgattcgactcatctactaactctaagagcattttttcctttagaattctaaatattacttactgaccattatctcacctagtacattattgctctttatgttgcttataaaaccaccaaaaagggaagacagttttcaggaagatacacatgtaacttagaaaacaaatccttaagcgccttagcaagttaaaaaaaaaaaaaaaagttaaatatttgtgtaagatacagtcttaccccaggatgttttagtgcgctctaattctctgaaattcttagatggtatccataattctgaatattcaattatccagcatatagttgcttatctacccaggatagaaaggaattttgctatattcaaaatatcactttctgcctaaatatattcaaattttgcataaactgaagttctataaagaatcaaatatcaaaatacaattaagctagattattggcagctgcagtaacagaataagatctctgagtaacacaacgcatggcagatcagagccagtaactttgtctctataaataacaggaagttccatgacaatgctttacacagtgctatgtagaaaaactgaactgagatacagagatgtttggtaggtcatagagatggctatactctagaacgtgaacacagggatagacacaaagtacacgtaacaaatgactaactcattatgttttttctttcaaatgcagtacaactatggaatatccaaaatagaattaactatatgataaaataaacctacagaccaagttaaaaattacaaccaaatcaatgctggattttcacttaaaactaaatttaaaaattcttaatacttacaggtcccataattgtggcttgccaatgaaacactagaaaaagaaaaaaaactctggttatctaaaaatgcacaagcttaaaaaaaaattaggcataaaaatcaacttgcaagttacttactatcatccccaactggacctgcagaacattgtgctggagggtcacgggccaaatcactaagttcctacaccaagacagaaaatgggtgagtcacataagcttaatttaagaaaacaagcgagtccactgctttcagttactttcaccctatttttaaaggcacactccatcacaattcacataaataatatattccattaggagagagaacatgcctgaacatatgctgagacaatcatcttagctagagttcgtaaaaatatatatgcaaacacattgatacaaaattttttatttacataaaagccaatctcttacaaaccgaaatagctataattagatattctcatagtttaagagcttagaccagagagagctcaacattcacgttatttgttgaacttccaagaccactttcagaggccctcaactgtcttaaattctttgttcttcctgaaccatccttcctccccaatccactaactctattttctacctgaaaacaaaccaaaaaaactctcatggggctaagtaccttttttgttttctaatctccttattctctcaactcaaccttttttttttttttttttaaactcagcatccatttttaactattgaaatttttttttttttgagacggagtctccaggctgcagtgcagtggcgcaatctggggtcactgcaagctccacctcccaggttcacgccattctcctgcctcaggtgcccgccaccatgccaggctaattttttgtattttttagtagagacaggatttcactgcgttaaccaggatgggtctcgatctcctgacctcgtgattgaaattctgaccctgaagagcgtacttctgtaagtagaaagacgtttgctcttaacatatagtctgcacaattcaatatgaacgttttatttccaacaagtatgtagttcactgttccatgacttgtgcataacaatatgaattatctactatgaaaatatagtttattagaatatttttaagatggtacagctccatcttaccaatgatataaccaatgtctaataatcacaagttaaaaaaaaaagacaataaatagaaccaatgttaatacattactgccttcaacattttcaaactaacagtttctcttaagtttagtctatggcataagtcagtacacccattaagtctagggactactatatcttctatatcccctttctcatataaacatggaaataacacagaagggtaaggtttgggattccatttgaacagcagaagaccactaggtacgtggctcatgcctgtaatcctaacaccctgggaggcaaagacagggatcgcttgagcccaggagtttgactgagaccagcctgaacaacaaagggagacccccgtctcttcgaaaatgttagctaggcatggtggtgcatgcctggggtcctagctactcagaagactgaggtgggaggatcacttgagcccaacaagtcaaggctgcagtgagctgtgatcatgccactgcactccagtctgggcaacagagctgtctgagacagaaaaaaaacacaaaatcctgtctcagaaacaaaaaaacaagaccaaaaaagctagactgggcacattggctcacgcccgtaatcccagcactttgggaggctgagaagggtggatcacctaaggtcaggagttcaagaccagtgctgctaacatggtaaaaccccatctctactaacatcacaaaaattagccacacatagtggcacacgcctgtaatcccagctactcgggaggatgatacaggagaatcacttgaacctgggagggagaggctgcagatcgcgccactgcactccagcctggggaaaagagtgagactgtctcaaaaacaacaaaaaaaaacccccagaaaagctgaacgtattcatatacaaaagaccaagtactagaaagcaaaagaaaggatgcctaaataaaaaagatacaacagagaagcagaggcgagaggacagcttgagcgcaggagttcgagaccagcttggataacatagtgagaccccattctccataaaaagaaaaaaaaattacgataaagccagtatcaactgtctaccacaatatcaatgcatccgtgtataactaaaaacattaatcttcttttggtctactagaacaacttattccctataactacaggaatttaaaaatggaaacagattttcaaagtgggtacatgcactttttttcctcaactgtgatcttttgccttcctgtgcaaaatcaaggacacaaaatgcagaactttcagtataagctctctcagaagggtgcagggaatgggaagaagagctacaaatcttaatttaacaaggcatagtggcatgtgcctgtagtcccagctactcggaaggctgaggcaggattaagcccaggtgtttcaggtttttgtgtgttaaatgatcatgctggtggagagccactgcactctagcttggacaacaatgtttaatgcctattttatactggcttcagatgattattttcattcactacatcaaatttaaacacagtgacaaatttatgtaagggtcccactatggcactgacttggttgggggaaataaatgagtcctctaaattttgttcattttgttaaatccaccggaaatctttaaaataggctctcaacaaactgaggggccagaacaaaaaacaacccagcttccaagtcttttagaaaattagaatcattgaatagatagcttgaaaaatcagataatgttgacatctttccctgcaaaactgaggaactgaacaaatcaaacaatgtatgcaccaacagtacacaagcctgtaactgtgctttaaatatttcaatttgtgggaaagctctttcaatggagctgctatttttattgggtaagtttgtattctgtagcagcatggaataaaattgaaatttcgagaaacactgaaaaagaaaagagactacataaagtgtttttgtcttattaaaaaagaattgagactttgtcccatttaacaggatttgctctaagcttttaagacaccttagctcccagagggcattttgccatttaaaaaattatagtattatagactacagtcaatgggggttattaatttaaaccttattaacctcaaaagtgctactttcaacaagattaagtaagactattagagatattagcaaaacagcactgagaaacagggctaggaaactagagtacacaaatcggactaagaataattgtactacctttaaaaatgttaagatgatcaacacaaagttttaactgctctaatagtatcttttttaaaaaatgaagttttgattaaagttgtttagttaaaagtccaccaatcctctccccttttaaaaaagtgatgggaatctcactatgttgcccaagccggactacagtggctattcacaggcggaatcacaatcataaggcactatagcccagaactcctgggctcaagggatcctcttgcgtcagcctcttaagcagctggagttgcaggtacgcatcactatgtacagcaatttgttgaacaataaatgtacatttttaattgtaaaattaaacaatgaattttgttgattgactccatgtgggaagaaaaggtgacgctaagatttttggcctgagcaaagcatgagattggcattaagtaaaatggtcaacttacaggtgaagcttgtgggcagatgtagagataaagtaagtaaaataggataatgtaagtaaagactcaattcgaaaagtatatatacaagttgagaacaggctgggaacaaatacaaagtatcattaataaacaaatgatgtttatagccattcaacttggtgagagcactcctggaacagaaggtcctaggagttaacactggactaatttaacgctaagaaagggaaccttggccagtaacctgaaaagttaaaaagaaataaagaatgtgaagaaaggctttgtcacaataaacaacactgcaggaaaattaagaggcaaatatttgcctcttatattcaaaatacacttcagaaaatggccagttgttcgggaatggtcagtctagattaatgccataaaacaaacaacaaaaatagagtagacaaggagaattgtcctgatatgctgtgccaattcactttggaaactcatcacaactacttacaaggttgccagagatcccaagattcacaattttaagactgtatatcacacaccctttatatgcttgtctgtatagatataccctcatgtcttccacatattcagaaatggaagaaaattcattccaaatactattgattctgatcagtgggaattacagaaattcatatcgcagttcaacaatctgtaaaagaaactacatggcttttggccttcaaaaaattgtaacagaaaatattaactgaaccaaatcagtatttcagaagcttttttttttttgcaacttaaattatccactattaagaaaatgactttttttttgagatggagtctccctctgtcatccaggctggagtgcagtggtgtgatcttggttcactgcaacctcctcctcccaggttcaagtgactctcctgcctcagcctcctgagtagctggaattacaggcacatgccaccacacctggctattcttttttttttttttttttgtagttttactagagatggggtttcaccatggccaggctgatctcgaaatcctgacctcaagtgatccgcctgcctcggcctcccaaagtgctaggaatacaggtgtgaaccactgcaccaggcctgcagtcttacttttaatcttacacaggcctactttttctcatggttctcttctcatctctgaaataggaatcactacctggcacataatggactggtacttaacaagcagaccatgtgtagaccacccatcctgaaccaagattcctgggcaaggctcttaattcatctgttactgaacaaaagcaaaactgctccacacatgggccacataatatagccacttgtttatttaaatttttgacctatgtgataaatcctgatgctcagttgtctaaaaatgtctttgtaagcatctgaatatacctaatactgaaataagagtttaaaaagctgacaacacaatccaagttttacatttatttactcataattaactcaataaacatactagattttacatttaatatatgttaaaatggctgaacaaaaatatttagcgtaattttcttttttttggagatggagtttcactcttgtcgcccatggtggagtacaatggcacaatcttggctcactgcaacctctgcctcctgggttcaagtgattctcctgcctcagccttccgagtaactggaactagagaagtgcgccaccacacccggctaattttttgtatttttagtagagacggggtttcaccatgttggccacactggtctcgaactcctgacctcaggtgatcaccttggcctcccaaagtgctgggattacaggcgtgagccaccgtgcctggccagaataaatattaagataaaatattttaattttaaaataaaaatcaatgtaatcatggttgttctaaacacaatacccaataatgttggaatacttcattataaataaaactaaaggtcagaaaactatgaagttgacctagaatataaacaccatactacttcaacattacacatttcaattacaaagaaagtaagaaagtatttcttatagaataaatgagttttcggcacactgatatttatccatcactaagcctttaaatgctagcattatcatccttttagagtgaaggtataatttcagctagttaacactgggtttcagctcttcactcctgtaatttcaggttcttgttactctcctaacatttctaaatgccttactttcgaagttctccatcaccaagacatctctttagtaataatcaaagagataaaatcagcccaatacacttacctactttaaattcaatatagaaaaatgacctaagtattttaacaatcaaaacaaaggtcttttttaaagatacaaatgctgttcttatttcaccattttctttcttgccatttaaatagtatctaatattactatttaaagtaccacttagtacccaatagtaacaaaaccatgcacaagcacttacctttgagctaccaaataatttttgtaacattatatgcccacagaatgagcaagacagtatcgtaggaaaaaaaagtgagaaaagagtaagtcatagcagatgctctttgtagctagcagacattttgtctactcaataaaccatcttactcatgaattccttttcccttactccaaatcatgtgactgtagtcctgggtcagccatcattaaccaattatttggacatgactaaccacagaattttgttccctcagctgggacccaactattagtccattgtccatcccaacctaagagtttccaaatcaaagggacattcttccttctataatcaagagctataagaatgtgacccatagctgttgacaggcacgtgtcatggacttacatggtaaagtcaaaagctaaagagaccatattcaacagcagcaataacaaagagctgactttccatacagatgtgcaattttggttcctgaggttgtagcttgctctggttcctacacctattccattcattgttaactatcccagtttccttctaataaatcccttatttaatctggattatattaaggagttaaaaaatatatacagcagtagtgagagaccaaatctgaataccaattatgtagattttatgccacttcaaacacaatttagtttttgagttttgctgaaaaacatgtaagaaatctaaatgaagctaagtcttaaaattgaattaggagtaacaaggttaactttcacactggaggttaatttaaatccatttctaaaatgaaaatgtaatgttaatttcaccatcaaaacattcattcattcataggaacattgcctttttggtgccatgcatgttaggtataaaaacaccaagataattaagatagaaatgcctcctcagactcagctaacagaaagcaggtgcaagacaaaacaaaaattatactttaacaacctacacgcttaaaataaagggactcaaatgctctgagaatcctgaaaaaccaaccactaacttttcctgggtttagaggagtgccatttgagctggctcttgatggaaaaataagcaggcatttaccaacaacaaggagtaagagaagcattctaggtagagaaactcaaagtcaggagtgtcaaagaacacagggcataaaaatttgccagaacaaatactgcagagtttggtataccagacagagtacactaggagagtggcagatttagctaaaaaggcaggttatgacttgatcttttaaaagagcccttgaatttagtcagactattccaaaggcaatgggaaatcactgatggtttcgaaatagaagacaaatgagttttgatttttaaatatactagcagtcgtacaccacaagtgtttaactgtactcttataaccactttacggaaatagagctcatcttctctgttttacagttgagtcccttaagagaggggaaagaaatgattacattcaagcatagaacatgttcagctttaggataggtgaactaagtgtacctactaacaacttaaaaatttggactaggggtaagtttcaaaaaggttcctttctcaacagggtgtccttgcaaagataatttaatgtttggcaaactgagggaaaaaaattctcaactgcaccaaactattactcaatgctccagaatgaacacgatatggaaaactaatgttttccttagtatttatttccgcataaccatccaccgttagtctgtatctcattattcgtacgtagtgtgaatccagtactatttttcaagttacatggcctgagaaaatgattctatcccacagcaagaccatttactggactggaaatcaatttccaacgacacccatactcagcatttttaaaagtaattttgtctacgatagtcacctaacaaaatgtttttagagcctaaagtttcacaggcttcagggacaaaaacactaaaaaattacacaattgaaattttcagcttattccttcctagcagtctagaggaagaggaacagtgccaagaaccagaaggaacagctctcacacggcacctgtaaaatttttttatactgtgctgactacccctcacctaaggggaacagcattactcaactattaaggccactgaaacaggaaaatgtttggttggggacactgacttactttaggaattgctcaaggttccactcacgttgaagggacactaagatcaagcacatacaatcagggtacaacactaagaaactgtactagctataaaaagaacaaaaggttggacatttcttttccacagagtgctcttttaggaaactttctccttttagtgtcatcttcctctgagctgcttctcctcaaactttctgcacacttggctagtgtgagaatccagaccttctcactggaaaaaatacttgtatttaaaagccttaaaaaacctataggaaaagaagtcaaggagacccctctgccttctttctaagctaggtaaatgagaccctctcaaagctctcacatggtctagttcgcctcattagttaaaacactacaaagaaatttgagacagcaacagactttacacaactgagttgtttgcctatttcctgaagacctggtgggcaccatggtagaaaatagggcaggatttttttcaccaaaaaaatctctctaaaaggcaaccaacaggtacagcttaagccactggtgagtgttctcatctggaagtacatgatttaagcagtaatgggtttggtcactatttttttttttattctgaaacattccttacatgagatttttaatacaaagcctgcaaatggtttatcttgaggaagacctttactgtagtcactatgggatatgggatttaacagttgattgttggagatgttaaactatgctttctgcttctctattctctatcttcctcattcaatgataagtggtactagcagtggtgaccaaccacaggctacaaagaacagtaggccaaggtattgaaaacattaaagacctgaaaggatgctaggagaaacataagaatgtcccctcccttgctgggcgtggtggctcacgcttgtaatcctagcactttgggaagccaaggcaggcggatcacctgaggtcaggaattcaagaccagcctggccaacatcgtgaaatcccatctctactaaaatataaaaattagccgggcatgatggcgggtgcctgtaatcccagctactcgagaggctgagacaggagaattgcttgaacccaggagacggtggttgcagtaagccgcagttgcgccactgcactctagcctgggcagctgaccaagactccgcctcaaaaaaaaaaaaaaaaattccctcctttcaaagagcttataaattggaaatactaaaaatatttattcacaaatatttatgaatattatgaatattcatgaagctacagagcagccatgttccaggagcccaataagtatctgaacattcggttaactttctttcaatgacagccagtatctgttcatcagatcaacataaccaaaaggtagcatttatgaaaacaaggttttaagtgtcaaccctattaaagcgtaacgccataaataacttattctaggtttcatccccccaaggcttgtcaaaattcaaaagcctatatagtggcaaggccaagttcatggattctacctttaagacagtaaaattatcaccacgatgttccacaaatcatttgttatcccaatctctaccatctattttgcacgtcatcacacaaaggtcatacagaggacagaacgcagtagtatagatacatttcctctcagcactttccggaaaactaaaagcttatgccattactaaaggttaatttcttgtattctatttgagagtctatttctttcagaactaaagacaagatttacatgactcaaaagacaagatttgtatgactgtgaatcagcattataaaaacagcccttgcctcaaaaacctatactgagcaacacaaaacactgctttggggactggaagagatgataaaatgaggtgggaaacaaagggagtaagtgccttaagaaattttaagaatcatcctcaagaagactttacaaccaacctagaaaaatacaaaggtgcgaaccaacaatagaggtcgaagtgcagtgcaattagctgtccatcaggcagacagtaactactgtaactgttcatataaagatctggtttactataaagttttattaactttaatgttatgaaatgtctgtataaaatatgtagatgcgaatatcaaggcagggaacaacaaacttcagaaacatggttatttcaagagaaggatgcttggcaaaaagatatgaacaatttcacaaaactccaaatagtccctttaaaacacattttaatttgaaatttcttctgagaaatccttttttatcttaaggattaacagtaggcactgcacagtatctcactgcatcactgacaaggtattaacttcctgtttagtcgtaattataggtgaaacaagcatgcgtgttcattacacaaggtactaagaatggattgaatattactaattttctttcgatcaccactgaaggtaaagtcacttaacattattcaaagccattcttttgtaagcattatttaaaaatgggcaaagaaacccaaatttagatttgaagctctgctccatgaaagcaagaagggtgttttatggacattaaaacaaacaaaacaaacaaacaaacaaaaaaaacaaagattaacagccaaacagctgcccagtagtagaaaacattcgattacacattagccatgaaattacagcaaggttaggattaatgtaagtatttcatactgaaaaaggtacaagaaatcatgattcacaattgacaaacatttaaatacgacaaattcagctatgaaaagttgaaggtctcttttacaatagattatgttgaaagtatcattaggagataaaaatcagatgtttcaacaaagtataaaaatacttccctaaacttttcccttccctacataacaaggttgaggatacaattctgaataaatcttatctaataagagaaactgggcagtaagatatttggtgaatgcattcatttttaattatgaaataacactgctatggtagcaagctcaagaccacaacatttccaagaatggagagttttatttcattaatttcaaaatactggttttggcaaggggaattaagtcattataataaaagacaaaccacattgtaataatactagtacaaaaaatacagtatagaaaatttattttaaatacctcccctactagatctaatattcttgaaaggtaaattacaaagtgacaaacaactattcatgtgtttacatgcttattttcaccactgaacgcagagattaccatagataaggaccatcttcctcatttattccctgggactagaatactacgtctaatgcagattaggacctttactcccctgtatctgtggttcttaatcagagaggagcttcagaatcacctagaaaattttcaaaattatgtgtttccagggaaaatgatttagtaagtctaagacccccatgcagctgtatttttttttaaattctaaacaatctgacatttaaaaataagtaaacaagtataactggattgtaacacaaaggataaatgctcgaggtatataccccatttaccctgatgtgattatgcattgcatacctgtatcaaaatatttcatgcaacccataaatatatacaccaactatgtacccacaaaatttttttaaaaactccaaatgttctggaatataaatgtaattcatgtcacacccaacaatatataatattcagtaagctcttctatacgctaacagatacaagaaaactgctatttaaaaaaagaatgcaaaaaccaacctaggtttgagattttaatctgaaacatttttttatctcagtgttacgaacctagtttcttttttaatagatagattatagcaacatgctgtggagaatcctcaaagattgcctgtcttggataaaaagggtcacctaaactcaggggcaaagtttgacagagcaatctagtgacacagtagttcatcccagtgatggagcattcaactttttatttgtataaataacaaaaactagaatcaacactgcagatgagcatgatgaaagaaaagtatgcagtgtcagtaatgcatcctttttcaaattaaacaaatactgaggtcctattattatcagcatccttcagtcacaactatcctacacagaaagtgagctggctatcaacaagctttgaggaccatatatgaaacacatgcaagacagtttacccagcctatatactagttggggacaataaatatattttgttcactctaagacatcctaagcagttaactggcacatgttagttttcagtgcttgaagagactaccccaaaagaattaaatccacttctactttcaaaatattattagccaaaatcttaactcacaaattagctataacctaagagtaaagctaactcccaattacttagatgtataagtgggagagcaaagcagcttatttcaggtaacaaactaaaatcacatacattataaaacaggaattgaagggccaggccacgtggtggctcacgcctgtaatcccagcactttgggaggctgaggcgggtggatcacgaggtcaggagatcaagaccatcctggttaacacggtgaaaccctgcctctactaaaaaaacaaaaaaattagcctctactaaaaaaacaaaaaaattagccgggggtggtggtgggcgcctgtagtcccagctactcaggaggctgaggcaggagaatggcgtgaacccagaaggcagagcttgcagtgagctgagatcgcgccactgcactccagcctgggcaacacagtgagactccgtctccaacaacaacaaaaaaaggaattgaaatggttcaaaaaagagcttgagcttttggtgcctatctgatttgaatcccagtcacttactagttgtgtgactagacgactatttctctgagcctgttacttcatctataaaattctcacatctatcccacatggttgtcttgaggattaaatgagttagggtttagatgagactgcattgtcttaactactgtaatagataatactatatgcaaaagtaaaccgttctgaatgacaaaaaaaaactaaaggatgatatcaaactgtagttgttaagagcacatactctggaccaggctgcctaggttctaatcccaactgtcacaacatgaacctgggtcatcttcttaacctctatgcctaagtttttcaatttcgagatggagataatcttgaaattatctcagtggaagtggtggtaggagggaaacgaagatcaaatgagagttttttaaccctttacccatggtttccctgctagccgcttgcttataatcatatataaacactaaagtcatacttccagaaataaaaacccttacgaaaacttaacagggtgtatacaatgaaaacatgagctattcttttaggcttggttcacatatttatcttcaaacgtccctaaaacacatatattgtagtccctgtttaatgggagtggtaaaattgtctacagctctcaataccaatcaacttggagtgccacttttaactcctgttgtttaatagccctatttaagaccatattacagctcgttcaaataaagaatacaggaaaaaagttgattggtctaacagtcaaaaaacttactccaagaacacagctgaagcaaagtatacattcaaaagctcgatcaaatggactaaaggttaaaactattccaataatcatttcagtaaaatattaacgaggaatacagatatatcataatacttgaaatgtgggaccttcagacaagaataaattcgaaataggtacgtaacacaagcataccatactgacatcaatggctacttgaccccatatttctagaagaggtgcctaaaccgaagagcattccagttcagagctgtccactcactaaaattgttggatgtggaatgtttgaaagttgcctcatgtgattctaacattaacagctgaaaaaccaaaccacatgcacacgtcaaagtttctgtaagttgaatcaataatgttcacataaacactggtttttccaatatgccaagtttttatgttgtgtctatattacataaatcttcaaaatatttacaaaaggagacaacctggttaactaagagtactaaactagaaatcaaagttcttaaacaaaaacggtttttaaaaattataaattgtgatattaaaatagcagtaataactaggagtgtcatgtgccaagagcctgttcaaatttgcacattaatccatttaatcgtcaaaacaaatctaggaacttaaaatttgttttgttcactgctgccaccccaatgtctaaaacagtgcctggtacatattaggcacacagtcatttattgttcatattacaacagatacccttcttatagaggcacataaacttgcccagagctagaattctaactggagcatttctgctccaatgtttacactcttagccactgttatattgtctctctaaagcttttaaatcatttaagtggtgtcacagcagctgggtatgacctgtaagagaaaaaaaatcagaggccttcctttaacgtgttctgttccacatgcacaaaaagctatggatctggtactattccacattttagtggcctgaactaattccaacagaaaagatttttatttgtactgaatgttatgctctttgtgtaaaccacactgtaacatacaactaggcttctccaatatgttcctggcctttaaagtggtcacaaaaagaggtaattatttcaaaataatttttactttaatccttaactcctaaaaagcgtttcttcctcttttctttcatttcacaaagatttaaatttgtatttcgcataacccaaaatgacgatgttatgaaggcccaaaacaaaattcacgatttcatatcaatacatactaagagtgaagatttaaaccttcctctttcatgaaacaccaatcttgccaaataaactccagtcataattaaatacaggcaaatgtagtatcaggtctattttagtaaaggcaaattcttgccattcctctcagaactctttttaaaaaagtaatctattaaaaccaaagtttctaacactcaccgacactccacaatttttctagtaaggctgaatttattccatgacatttttttcaagttagctgtaaacactccaccctcttcgattgtgcaacaaccaaacacatcacacaaatacaagtcacaaaaaagggaaatacagtttaagagtttgaatttaggtaagttttgagcagaggatcttagagcagtgcacaacgcgatataaaagttaacatttaacaaatcatattaattcacattattacgaaaggagatgccggaaagagcctgaaccagttaaagcagccgccatcttaaaatgcgggatagaagttagagcaagaaaatgagactaaaccaccggaggtggaggttccgctcactcccagagctccgaaaaatcctagttttttttcaacttaaatcgataatatactatcaaaccacatttcaagtaacgaaacaagggtgttattaaatagaatgaggcaaaaataggtacattagctttcccttactgccatcgcaccccttatccacccccactctccagccaaaaggaaaagggagcttccagaatgccttttacatcagttcccggtgtccctcggataaatagcttcgggtgaaaagctgcaactacaaaatacaggaagtggcaacactgtgtcattccatctcctcccaaacccacttattcggtgtaacctgcccagagtcgactaagagtttctactagactcactgactgaccttcaatacgcaagacttcttctacccgaccctcagtcaagttcgggactcgccagattttttttctctcctccgagttttctttcttacccctagaaggcctagataaccttgatctcacaactaaactaagttttcaagcaccaagaataggaagcgccatgacatctgctggagcgtctctccgcaattcggacccccaaaaaaactccttcttaagcagcaaaaaaataaaataataaaggcgccttaagtcactctcctccacccctaatttgcaccgattccactgaagcactcaggataacacctcacttgccacaagtgttctccgtttcctagctttaaacttcatttcttcaagaagtatatctgcgttctccatccccccatggaagaagtgatccaagaggtattttcagaattatgcttccttcccacccccacgctttcctcttggcccgagccttccttttctcctaccaccccatgcccttgtccccgcgggttaccttattaatccgtttcagcgccatagtgtgtgcttgtcgtctggctcctcactctctcggtgtatgctcaaaggtccggccaaaactcttgattatcccggcggcggggcaggattgtctcgtctcacaccagctctgccagacacaggcgccttttgcaaaaacggagcagatcagcactcgcacaggccccgaagagcccctgatgaatccaggtcccttaagacagccgcgatccggggtgggtggggtggcgtggcaaagccaccaacagcctctgtaccgtgctttcggcccgaagtgggggcgagggtgacgggaagagcggaggtggtggctacaagtttaacttcccggcctctagaaaggaagagacccgggtgggagaggaagaggcgtaggagaaaggggtgggtgcggggcagggtccggagcccagcagaggaggagccggggcctagtcggcgctataccggcgtcactagggcaaagaaaggcaaggggggagggggaagcataagactccggacggacgccgggctgctttcggtttctgtccaaaggtgcggccgggaaaaggaaagaaataaaggaagggagacttgatgtgtattgctatcctcgcagcgagctattctgtgtcacccctgacgccaccgtacactcactccgccttccagcgcgctcccgcgcgcgcccgcccagccacctccaccacgcgcccgcgctgtccctgaggctccggcttaggcgcgaggacgcgcccattccccctcctcctccagcaggagaggccgcggcttccccaaccttcccaccctaacccaccgcacccaataggctggccgctcaagccgcccaggtcccgcactgcccctcttacccggccggccactgggccggcctcccttccctgccctagccgtccacacccacgcgtacagaggggccggggcctccctcaagctgcggcctcggcctcctccccgcgcggcagctggtgcctccccggccctacggggctcacgcgcacgacacagccacaagatgtccgctctgacggaactactgccagctgccacgctccgcccctccccctcctcctgcctcttcaccgccgcggatcagtccgccaacgccgccgtcccgagcacaggaccgatgtgaggccgaagccagacggcttgcttcccacgtccggggccgagtgaatacgtgtcaagcccttttccttctccttctcggaacagcaccttcttactaaacagatcggagattggaccaggagggcgggggagggaggaagatcatgagctggggggagggtgaacgagtggcggaaacccttaggctcagagaagcatcgagaaccggaaggagaccatgggaggaaggtaaaggaagcagccgctgcgcgatccagccccacgcccctccccacagcgtcccccagtttcctcacttggtatcgaggagacgactctcgcgagaacttcgtggctggctaaccgaagcggtagctctgcaatgacttaagagcagttttgtgcgcttttcctgacggggttccgcctccaaaatgcataagttctcgcgagacgcagtaaggcaccggctcgaactggggcgggccactgccaggaaagcaacgcccctgaatgcttatgccggtggttggtagaggaaatggaattccccagactggtaagagcgcgcgcagacacagccttgtctcacgcgcccaatcaggagcgtgtggtgggaggtgccaaggattaattaccagatacctttagtctagctcgagccgggattttgaggtttccggtggagcaggtgagcagtatttactcgcctgccctcctgggctggttatggtgtgggaggaggcgcccctcgagatgggaatagtagttttaaatagacccaggttggccgctcatcagcgctcccacgtgctgaagtctagtgcacgtctgaccctaagggagcaatactgagaacagcagggagcaggctgagtcaagctcaattgagtggatggggctaggacagagagagttaggggcagggttttcactggtctccgtaatcagtcgctgccgtccgccaaggtgtagatgtgggaacaagcttaaattctcaaactttagcttctgttgctgtgtttcagttcttgagccagaaagtgttgagactaattagttaattaggtagagtttagagtcagaaaaacaatacaatacttcctgaaatatccaagttgggaggtgggatttacctcagtaggattggcctgttttagtcaagggtttaaagtatggagacggcagttatgctctctagtgtatccttcaggcaaaagaaagaccttaatttttatgaggaatttaaaagtgggtaagcactgaccagcttaaggttttttaacattccttaatgaccccagttaccgaagtggagatcttcaattacttggaaaaataaacttgttttaaaaatacacttaatttgaaaactgttgcagaaagttttacctaataaaaacttaacacgtcaacaatgatgaatataagtagtctaatgtatactgttcaagtgaccatgtagtgtcactagtgaagcagtgtttctcaaactagtgtccataggaaccacctggggttttgttgaaaatacgactttgatttggtagggcagtggtggagcctgagagcctacatttctaactagctcccaggtgatacagatttttctcgtctgaaccaccccgtgagtagcaaagcactgaagtgcttacctcatggcctaactgctcatgaggctcacctcagtaacacctctggcccctccctcctccctgaataatctgtgttctctctcatagctagccagatatactaaaagcacaggactaggcatgaagatggagggaggaacccagattagttattgcttcccatttgcttgatattggcctggttagttatcttctaaccccgtttcttcaccgctaaagtaagtaataatgactgtcctttctcacagggtgattgtgtggttaaagtgtcataatatatgtgaaaggacactggagactctacagtgctgtataaatgtcagttattaaagtaaccagtcagacattaactggccatagtgtgaaacaaatgtatagtagtaatagtggccacgcctgtaatcccagcactttgggaggctgagacgggtggatcatatgagatcaggagttcgagaccagcctggccaaaacagtgaaaccccatctctactaaaaatacaaaaaattagctgggcgtagtggcgggcgcctgtaatcccagctgcttgggaggctgaggccggagaatcgcttgagcctggaaggcggaggttgcggtgggccaagatcactgcgacagagtgagaccctgtctcaaaaaaaaacaagaacaaaaaacaaaactaatatatatggagttctagattatccaagcttataaaggcaagtgattgtgtaatcacaaactcattattgttaggcagtgaagtaaattcattggttgattgggctttctgtttacaagtttgtatttgcataagtggacttacgtttctgcttatattttgccatggttaaaatcaaaagaaacatagcctagaagcattttgatgccttaggataaagcaggctaagattaagttaaattttaaaacattattcatgtacctgttgttacagagagcccactttacagttgcaaataaagttaaaacattttcattcatttaacttacttgaattacaatggtagagatgtcctcatttgaaacaagaaaggaaaataatcatgttttttatattgcagtcggaaataatgctaacaagaaaaaaattatggctgtaaatactgaaagaaaaatttacatttagaaattaataaaggtacaaaaatgttgaaaatttaattaactaaaaataatcccttccttaataaatactattttgaagtcctaaaaactttgtaaatatagtagatcagattatcttgcatgaattgacataaaacatgagaaaatagaaaggatcaagaaaattaaagctgggctggtggcttacgcctgtaatcccagcactttgtgaggccaaggtggaacgatcacttgagcccaggagtttgagaccagcctggataacatagggtgacccagtctctacaaaaataataaaacaattagctgagcatggtggtacacgcctatggtcccagctacttgggaggctgaggtgggaggattgcctcagcctgggaggttgaggctgcagtgagctgtgattgtgccactatactcaagcctgtgatggagcaagaccctgtctcagagaaaattactagtaaatgggcaattaatctaccaatctgaataatggtggtgtgccagggtcttattacatgaatttttcagtgaggccacgttattataataacttgagagtaaggggttaattagaatgtattgatgaataaacataattaacagattttatatatatgtacttaatattgtatctatgttttcatgtatctttaattttgttacagaatattataacttgccaaagacactggctctagtacagtgtataccattttattagttttattaaattgtaaatgctacggtccagattttatattcagaatgctcatttacatattctgcctggaccaagtaatttggagcccaggtcaaccaaatgttattttacattgtttgcacaaaaatcaaattgatttctatacttaacaattcagaatctcattaagtcaaattaatatggtttaagaaagtgtactttatttcatgctaagatgtcattttggccttaataaggcttttggcatgtaatgaagcatgcacaaatctttgagataaaaatagagcatttttccacacaaaaacatatatatacacaaatgttcagagtagggctattctactttttagtagaaacaactcaaatgtccatcagctgatgaatggataaagaagatgtgatatatgtgtataatggaatattattattattataaggaacaaagtactaatacatgttacaaaatgtatcttgaagccttaaaacattctgtcaagtgaaagagccagacacaaaaggccacatactgtttgattctgtttatgtgaaatgaccacaatagtgcattctgtcttccaaaaagctggtttacttacaaacacaggttaaaaaaatatatatttgtaatactgcttttggtgtagggtgaggcacgataaagagactttcattcggtttgtcaatcagtgatacttaggtctgaataggcaagtgggagtctttcaggtttaggacaaagaatgttaatgtagtagagatctgttgatagagtcactcctagttttctatttatttaaaaaacatcgaattactattaggtgctagacactgaagatacataaaagacacagatgtcatctataagaaagtctcttgaggagaccagtaagcatcagacaacatcatagagtgggttcagtgacataaatgtgtgcacagagcactattaatgtactgaactcagctggcggtggtcagggaaagtttctctgaggaagagagttgtattaaaacaaatgaaaaaaagggagcaaggcaaagttggaaaaaaattgtgagggaggctcctaggcagaggaaacagcatgcaaagtctcagagatgacttgataagtttttaaaactagaaaaactttggctgcagtattgcgaggttgaggtggcggggggagcggcaaggagagaatgagaagacagaaaagatgaggagacaagatagatttgaaagacatgactggagatcttgagggccttttattttgaaggggatgggatagaatggagaaattgaatttttaacaaaaatggcctgatcagatttgatggcaaaaaggtaactgtgatagcaatgttgaagcatgtgcccaaagtatgtattgggatggagactagaggcaagaaaaacaggatgttaatgaaataatcctgaagaaatgggagaaagatctgaaatagttgcactaataagagagagtacaggaagtaaacttagtttatttactgggtcaagcttgcctaaaaaatatttgggggcggggggaattctccctccagttacctttattagaatgttacaataaaatcaagccaggcacagtggcttatgcctgtaattccagcactttgggaggccaaagcaggaggattgcttgagtccaagagtttgagatcagcctgtgcaacatgatgaaactgtgtctctacaaaaaaattaggcatagtggcatgtgcctgtggtcccagctgctctggaagctgaggtgggaggatcccttgagcccagaaggtcaaggttgcagtgagccatgttgcagcagtgcactctagcctaggtgacagagtgagaccctgtctctcaaaaaaaaaaaaaaaaagtttatagaaaaacaaaatatgatattctaataaaataacttgaaacaatagtatgaacttcctatgtttttagctcttaaagaactacgaaactaaagtttacataacattggaaacatgtgctacatgtttttttttttttgcaaatcaaatctcctcttgaaactcaaatgtaggactaactgccacaatttcatttcttttaaatttggccatgtctgtactaactgctgtgatccatgtctcagttctcttaccactttactagaacctttgggagacttttgttcattctttgactgatatcatttggctttcaagtggccagaaaaaagaattcattatctatttctgttccatctgcctcagacaaaatactattatgtgttgccaacaagatcataaacctaaataaaacacaggttctaaaatcacatggcagtacttagtataagtgggtatcaaggtgactgggactgtgcttacagtaattatagattactaaaatcacaaaatggaaaaaagttcatgtagagaattcaaagaatttagtttgatgtagatagagattataacaatccttttgtcacatacctaaagtggaatttgttgagtttgaccttgtgacttttgagtcaagaaatgctaggcaggtagaacagataaattaataaacctgattctgaaatggaagtaaaagggctttaaagatgttagaagcattttaagattcattctcattctggatctcaggacataatttcttatagaaaagtagttgtgcctgcagatcaatccacaaaaggctttaaaacccaccctccctgtatatattacacctatgagaaaatgctccatagaattccaaattgataacaggaggaccgacctacccctctgcccgccagaattcccgtggctcagggcaagtactgaagccgaataggaagaattgactgagggtaaatcatgttgagtggttggttgaaagctttgaaaagttggagaatggtggttaagaaatctgtacattcagacttcttgaatgtcactgtatgttttgggttagtgctgggatacttttcttttttagtgccagatccattaatttacattcctctccactgccattatcaattgcttcctaacagaaaccagtaagctttctttttcccccttttctacagagaagagcagtttcacaagattcaacttttcttatacttttgttcctaaaacagatacacactctgttaagttttcataagggtttttatttctgcaagtatgactttagtgtttatatatgattataagcaggcagctagcagggaaaccatgggtaaaggattaaaaaactctcatttgatcctggtttccctcctaccaccacttcagcccccaatccctgcctaacaaattagacccaatagaaaaagtcacaagattgagggccgggtgtggtggtacatagctgtaatcccagcactttgggaggtcaaggcagggtggattgcttaaacccaggagttagagaccatcttgggcaacatggcaaaaccctgtctgtacagaaaataaaaaatcagcatggcgtggtggtatgcaccagtagtcccacatactagggaggctgaggtgggaggattacttgggcccaggaggtcaaggctgcagtgagctgtgatcaggccactgccctccagcctggatgacagagtgagaccctgtctggaaaaaaaaaaaagattcaactttttttttttttgtcttttgtttgttttgagacagggtctctctgttacccaagttggagtgcagtggcaccatcttggctcactgaagcctctgcctccagggctcaaggagtcctcccacctcagcctcctgagtagctgggactataggcatatgccactaggcccagctaatttttgaacttgcccacacagattctttccccttttccatccatctccaatccccactctctcaggataccctgatggctctgtgggtatccttagtgttcacttatcacagtctacagaaccaccagtctaatgaatataaaatattttaaattataatgaagaagcctcattatgagtaatagtaacatgtgaagcaaatacaatcagccctccagatctgtgagttccacatccatggattcaaccaaccacggatccaaaatacacatttttaattgcatattttctgaacatacatacttttttcttgttactgttccctagacaatacagtatatttacagtgtttacattgtactaagtattataagcaatctaaggaggatgtgtataagttatatgcaaatattatggcattttatatcatggatttaagcatccttggattttggtatctgagagtggttctggaaacaatccctcatggatactggaggatgactataatatgaagtatattagagataaacatataaagacaggcactcagaggagtggcttaccagcagacatgtaataaaaacatgagaatttcagttgcctgacatctctgtaagccagagatatgtgctttttggctgcccaaagaaactatttcagtttaaccctgaaagaaaggaactatgttgtctagcataaagcagttacctcttcctcatctctaccagttagaccacagctacattgttatgtttttaacagctttattgaaatataattgacatacaataaattatacatacctaaataaacagtttgataagctaacatatatatatatacccatgaagctcaccaaaatcaagataatgaacttcaccacaagtttccttatgctcttttataaatcctttctcttgttcttcccccacccctctgtcttcttaacccacaggacacctctgatctattttctgtcacggtaaattagtttgcattttctagagctgtattgaagttgaatcacaatacaacttcttgtctgccttttttcacttagcataattattttgagacttacctatattgttgtctctcagtagttcattatcttttattgctaaataatattccattgtatgtatttgccacaatttatccattcaccagtcagtggacatttggtttgtttccatttttttttttttttttttttttgagactgagtctcactctgtcacccaggctggagtgcagtggcgcaatcttggcttactgtaacctctgcctcctgggttcaaatgattctcctgtctcagcctcctgagtagctgggactataggcactcgccaccacgccggctaatttttttattttttagtagagacggggtttcaccatgttggccaggctggtctcgaactcctgacctcaggtgatccactcagctcagcctcccaaagtgctgggattataagagtgaggcactccgcctagcctcttccaatttttgtcttattacaaatagggctactacgaacattctttacagtgtttatatggacatatgttttcatttctcttgagtaagtagcttaggagtggaatagctagattatatggtagatatgtgtttaactttttaagaaactgccaaactttcccaagtgttttttaccactttatggtcccacaagctatgtatgagtgttccaatttctcctgactggttaggattagtcttttcaattttagccattgtaataggtgtgtagtggtatttcattgtcattttaatttgcattttcctagtgaccaatgatattggcattttttcatgtgcttctttgtcatccacatatcttctttgctgaaatgcctgtctgtatttttccccattgttcattgtattccttttgtcagtatttatttataggtgacacatatgggagtggccttaaatgttttttaactaataaagtcataacaaggtaacatatacctggaggaatatgaaaaagcatgacaaactttactttgcgagatagcaaaatttaagatttcactatataaatctgagtactaggtcaattttttttgtgggtttttgggtgaaacctgctagacagattctaaaagagcagtcacactatgtctattttttaaattattagctagcagaaccacctcaactcacattgactagtccctaagtcacttccacaattaagagtataggcagtagtgtgatagaactggcttgtaacagcttacaagggtcaatttaaaaattgtaggaattttgcaggctgattgttaaacacagccattattaaaaattatagaaactgacaattatattaaaatctgttaaataaagctcaataataaatactcaaaactcacttcctagttattttactatagacatacctaattttattgaacttcatggatatggtatattttacaagttgtaagtttgtggcagcccatattgtgcaagtttgtggtgccatttttccaacagcatgtgcctactttgttagtatgttttagcaataaagtattttttaattaaagtatgtacacaggccaggtgcaatggctcatgcctgtaatcccagcattttgggaggctgaggtgggaggatcgcttgggcccaggagtttgagacaagcttaggcaacacagtgatcctgtctctacaaaaaatttttcggctgggcgcagtggctcacgcctgtaatcccagcactttgggaggccaaggcgggcggatcacgaggtcaggagatcgagaccatcctggctaacatggtgaaaacccatctctactaaaaatacaaaaaaattagccaggcgtggtggcaggcacctgtagtcccagctactccggagaggctgaggcagaagaatggtgtgaacccgggaggcggagcttgcagtgagccgagattgcgccactgcactcaagcctgggtgacagagtgagactctgtctcaaaaaatatatacatatttttctaaaattttctaaaatagctgtagtctcagctatttgggaggctgaggtgggaggactgctgaaacctgggaggttgaggctgctgtgagccatggtcttgctgctgcactcctacctggtgacagagcaagactctgtctcaaaaaaaactgtgtacacttgttttagacataatgctattgcacatttaaatagtgtaaacataactttcatatgcactaggaaatggaaaaattcacgcgaactaaacccacagtatctctgaggtatgctataccttttactgtgttccgtgtttttgtggttatgtctattgtatctgcatggtggaagtattacagtttgatagtgtgcacctcttcccagctctgtgttcagtgatgttctttggaacatgacacagtaccacataggagtactttccccagggaaatttgaaaacaccacagatcagatctctgcctgctgctccctacttcaggctagttgttaaactttaccagcacacttgtgatgacatgacccttcaagttgactgacttctgtcagtaatgaataatcgaggcatcagttagatggagagtttacctttgtgaaacacttaactctcaaaaagaaatatttttgttacagaataaagcttgtaacacctagttttcttggtgttcaatgttttccttacttccaaattctctaaggtagagaaaggtaaagtctgactactggataaggggggatactaatacagtagttctgtggtctcaagtaaaagcgtaaaatattacatttgaagtagaactagaaaggatgctaaacaaaactgtgctgggcaaaaaaaaaaaaaaaaaaaaaaagaggaaaaggaaaggcaaatagctctatctaaccaaaattctattcatgtgagggagcaaaagatgatacaagaggagagtttcttctgacccccaaatcagctttttaatggatgaagctctttttgtccagagttactgaagcttctggatgttgttaggaatttaagttcccagacagattcagtaaaatactatagcagtccagagaaaaccaaataaacttgcagggagagggagggaagggaaattctaagtataaaagataaatctacagctaaggttgaatggctgttacaattaaatttttttaaaactaggagaaactgactaaggatttcaaatggaatagaaactgtcttacactttagggtctaaatgaaaggcatatacatttaaaatgtaaaagaaagaaatatatcatatgactttcttcttctttcttacttttttgagacagggtctcactctgtcacctaggctggaatgcaatggcgccatcatggctcactacagcctcaacctcacaggctcaagtgatcctcccacctcagccaccaccaccaaagagctaggactacagccgcttgccgccacacccagctaattttttttatcttttgtagaaacagggtttcaccatattgcccaggcttgtcttgaactcctgggatcaagcaacctgcccgcctcggcttcccaaagtgccatgattacagtgtgagctactgcacccggcctcatatgattttgaataaggcatttgctttatgctttacaaggtactagtagtaaaaactgtttagagtgatgtacataaagaacagttcagacacaaatgtaagacctgaagctataaaactactagaagaaaacaggtaaaccacttcaggacattgggtctaggcaaagattttatggctaagacctcaaaagcacaaacagcaaagacaaaaatagccaaattggactatattaaactaaaaagctcagcaaaggaaacagcagagtgaagagataacctgttgtatggaagaaaatatttacaaactattaatccaacaagggactaatgttgagagtatacaaggaacttaaaagtaaaacaaaaataaccccattaaaagtggtcaagcgatgtgaatagacatttctcagaagaagacacaaatgcccaataagtatatgaaaaatgtgtaatatcactaatcatcagaaagatgcaaatgaaaaccacagtaaggtatcacctatgacagagtggttattacgaaaataacagatgctggtaaggatgcagaagaaattcttttatactgtcagtgggattgtaaattaatacagcctctatggaaacacagtatttctcaaaaaactaaaagaactgccatatgatctgtcaatcccactaatgggtatttattcaaaggaaaagaaatcagttcaatgcagcactattcacagtggcaaagaacagaatcaacttacgtgtccgtcaacagatgaatggataaagaaaatgtgttacctatgcacaatgaatactattggccacaaaaaagaatgaaatcatttcctctgcagaaacatggaaggtactggagattattgtgttaagttaaataagccaggcacagaatgacaaatatcacatgttctctcattcatgtggaagctaaacatgttgatctcatggaggcagagagtagaatgatggttaccagaagctgggaaaggtgtctgggtgggaggggggatgaagagacgttggtgaatgggtacaaacatacagtgagatatggaacaaaggaatgtttaatagcagagtagggtaactatagctagtaacagtgaatgctttttgtattttaaaatagctaggagagaagacttgaaatgttcccagcacttagaaatgagaaatattcgaggtgatggataccccagtcaaggtaacaaaatagcccatatacctcataaatatgtaaactattatatatcgatttttttaaaagtatagcagtttgttacaaaaattagctgggcacggtggcaggcgcctgtagtcccagctactcaggaggctgaggcaggagaatcgcttgaacccaggaggcagaggttgctgcagtgagctgagatcatgccactgcactccagtctgggtgacagaacaagactcttttaaaaaaaaaaaaaagtatagcaatttggtattaaactggaaggaccaaaggacctaacaaataatctttaaaccagtcaatgccctatgtaacttgtttaccaataaattggacagaacagatggaactttagtgatacaggtggtttatttttaaatgaggagggaatacaaattccccaggagataacctctttctctaagaacataaagttttatgtaggagacagaacattctcatatgaaaaatacctaagaatatatgaaactaatatatgtaataggaagctattacatatattaatggtaacttagttgttcagtttttagttactgctgaacatcttgactatttaaataaatcactattttttccctaaccttgtccagatttctaaaactcagttactctcctaaccagtctacttaagtgaatatatttttccagtcatcaagactaagattcagtataatggagtcatctttgtctttcacccttccctttccttatgagtgtccatttctacttatttaggccttcaatgcatattacaccttaaattgtataacagtttatacattttaaaagattttcatcattatgtaatccctctgagttaagcagaagtgattaacatttcatcactcaagtatttattgagggcctacaaggtcactacaaggtgagtgacatataaataaggatgcagaatcaggcaggtcaaatgacttgcccaaggtgacaggatcagtgattattaccagtcttatgattctaatatcagcattcttttcattacactatgatgcctctcaactcatatttggtccattactataaattcatagtgggcttctctgcctctacttttccttctccagactatcttgcacatcaccattaaattaaacacagctttcattataatgtagcacaataaagaacttttcaatggtttcctattgtatagaggagaaaaactttatctctactttttacaggatatctctattaaactgtgatcctcatattcttttgaacatacttttacttttctaagagtatgcctttgcttttagcagtttaaccttctttgagtttcaagtccctaagtaatagttattaccgtagatctagatatttatgtaccaagcattatctatagactacatatatgcacaactaccttgtgtattttgactgagggagtaaagttttgatactaaaaaaaaaaaaaaaagagtcctctttgctgggtgaggtgcctcatgcctgtaatcccattgctttgggatgccaaagcaggagaatcacttgagaccaggagtttgagaccagcctgggcaacatagtgggaacctgtttctaccaaaacaaaaaacaaacaaacgctgggcatggtggtgcatgcctgtaatctcagctactcaaggaggctgaggtaggagaatcaattgaggccaggagttcaaagttgcagtgagctatgatgaggccagtgcactctagcctgagtgacagaaagcctgtcttaaaaaaaaaaaaacctcgagtttcacttctgataattaagaactcagtggttttgatcatacttctgctgtgaacaattaaaaaagctagaccaaaaccaaacaaacacccctgtttaaaggcacttgttagtgacaagttgtattttccactatcacaacaaagaaaaaggcaaaatatgtggcaggcgtctttagatttggagacaacaaaacatagtacaattgggtaagctgttcttagaggcttaactgtaactgtaagactaccagttttggccaggcgtggtggctcacgcctgtaatcccagcacttcgggaggctgaggtgggtggatcacctgaggtcactaaaaatacaaaaattagctggaagtggtggtgcatgcttgtaatcccagctactcaggaggctgaggcaggagaatcgcttgaacctgggaggcagaggttgcagtgagccgagatcttgccactgcactccagcgtgggcaacagaataagactccgtctcaaaattaccagttttgagtggggtagggcccagacttaggctttatgatcctgtagacccaatgatattagaagttaatgtaggagagatgttatatgaagcctctggcaagtttcagtgcaagaattacaacatagacccttaaggtttaggagtaaggccatatcttccttagccatgattttgtttcatttttttttttttatttgaaaagtacctcttgacttgctactggtacctggaagagatgtaacacctgaccatgggacatcaagtgactgtgtgaatcaaactgcccatcatgaattgttgttatttgactcatcaaactgtacaactggatgaacacaggagcagtgcactacatatgggactggaaccatgaatgagcaggtgactcagactcctatagtacctgcctctactccttcagcacttctccctcaacccacataaactgtcatcataatgagttccctctgaccagttaatggaagagaaaaaagtatggatgttatggatatcctaacatatttctggccattggacccctagaaacctgtggcaagagtcctggaagtttttcaaggttcatcttgcaccttctagcatgcatatgtcgtaccaaagcatgtagaatgctgcctacttctgctcttcagtttcatttaatataatttcattactctgataaatcagtgtgatgttctatggaataacaaaagaccgtcaaggtcccttcataccatatagagaacaggagagttgatgtagcctgagacaagacagtaaggacttactgttatccctcctatttaaacgtagtctgtttctgattctccttagaatgggggtggggggacatttccagatcaatatcagatcagtatcgtgtcaacatgggtattaatttcttccgaagaagataccacacctagaacagcaaccataattggcatccctacctaattaaagtttgcagtccactgtcattcttcactagccatctggtttttatattgtcattctctatgatgcatctggtggccacaggaaatttaaatgggaatgtggtatgaatcaccatggcagcatggtggcactaatctctgcaattcttttggtttttctattttgcttttttatgttttgtagaaatgcagtcttgccatgttatataggctggtctcaaactcctggtgtcaagcaatcctcctgccttggtccccctaagtgctggggttacaggcatgagccactgtgcctggccaatctctgcaatttcctcagggatatagccctgcttttcctttactatcttaatgaggagtggtagaaagcagacctaagctgctgtgtagcactttctaccataatagcaatccctccattgatcaggaaaccaaaataaagattgttgttaaaagatacatattaccactacacatctgggactggagaaatagccacagtatgggtccttctggatctactgttagccacagccaggccaagattccatcacttgacttccttaggttccctattctgaccagttgtccagggtagagttttgggtttctagtattagtacaagttaagagacagtgccttaagaattctagccagcctgggccgggcggtgggtcacacctgtaatctcagcactttgggaggccgaggtgggtggatcacgaggtcagcagatcgagaccatcctggataacatggtgaaaccctgtctctactaaaaatacaaaaaaatttacctaggcatggtggtgggcgcctgtagtcccagctacttgggaggctgaggcaggagaatggcgtgaacctgggaggcggggcttgcagtgagccgagatcgcgccactgcactccagcctgggcgacagagcaagattccatctcaaaaaaaaaaaaaaaaagaattctacccagcctggccaatatgacgaaaccccatctctaccaaaaacacagaaactagctgggagtgatggtgcatgcctgcagtcccagctatttgggaggtagaggttgcagtgagctgagattatgccactgcactccagcctgggtgacaacagagcaagaccttgtctcaaaaacaaaacaaaacaaaacaaagaattttggatattttcctttctctagtgaatggtcactggtccctatggaaaaggcttagggcaatgattcccccaacatatctgctcactggaagtatctggggaacttgaaaaaatactgatgcctgggtcttccctgagattactatttaattagtttgggttgtggcctgggctttagaatcctaaggtgttctaatgtacagacaagtttgagaaccccactggattagggaacaattcgttgtatacagctgtgattgcattgcccctttcgtcaaaggatccagtctctttccatcagtgaaggagtaccaagtctgggagctagatgagatgcttcaaattttactacaaaaccacaagaatttttccacctatatatgtcaagcagcaccttggtaggttactttattatatttccagggacctcatgatcatttagccattatcacttttccctgtgggtcaaactactctggttaacgttctctcctttgacttattttggtaattgtgcctactttgtctctgatatttatttatttatatttttatgttttttgagacagagtcttgctctgttgcccaggctgagtgcagtggtgtgatctcggctcactgcaacctccacttcccaggctcaagccattctcttgcctcagtctcctgagtagctgagaccacaggcatgcaccatcacacccagctaatttttgtatttttactagagatggggtttcaccctgttggccaggctggtctcggactcctggcctcaagtgatctgcctgcgttggcctcccaaagtgctgtgattacagacgtgagccactgtgtctgtcttgtctctgatatttatatgccattatgtggcctctactgccttaggattctaatgttcccactaagatcagctaactcagttccactacagggtttaccaccatcatctctcgcaaacaaagacagccacttcagagctcctaggaaatagtggtgctcccatcatcattgcattccttaatgacatggtgaaaattaacaatggctaaggagcctttgtgttttctcctctacaatatgcccaggaatttctggcattttggccatcttatttataggctattactgaatttaagcctcatcctaccaaattattaatgccaaaatattaactcttgattcttaggtgagtgcacccatgccaataaatttgccatgatctaaccttaaatgtattctcatatatgctgtccaagtttctgctgattaaaatggcaaggcctttagttctcctacataggttttctctctccagagaaggcctcaattctctgactaggctatgttgggatataactggaggcactaataggtagtagggtaaattctttattttattatttttggagacagggagggtcttgctttgttcagactggagtgcagtggtgtgatcatggctcattgcaactttgaactcctgggctcaagtgatcctcccacctcaaccttctgagtagctgggactacaggcgcaaaccaccatgcatggctaattaaatttttttttttttttagagacagagccttgctgtgttgcctaggctagtcttgaactcctgggctcaagcagtcctcccacctcagcctcccaaagggctgggattacaggcatgagctaccatgcctagccccagccggtaaattctgaggagagcatgtatcagcttgtgaaggagcttgcccaagtgcaatcactgaaagcctctatgcataggagcctggtttcctcagaaagagatttaggggaagattgatgttcagagttttcagcttcatttttctctgctcaaatgtccctatcgtatgtcttaggactcctctccccaccaatgttccagcattagaataggaaaggggaagaattaagcatgtaattgatactacaaatctaccatatctgcccagtgattacagaagataatcaactccttcagacctgtaatagagttctcatgctccacatacagtcattttctttttgttgttgtttatgatagtgtctcactccgtcgcccaggctggagtgcagttgtgcaatcaaggctcactgcaacctccacctcccaggttcaagcgattctcatgcctcagcctcccaagtagctaggactacaggtgtgcgccaccacacccagctaatttttgtattttttcatagagatggggttttaccatgttagtcaggctggtcttgaactcctggcctcaagtgatctacccacctcagcctcccaaagtgctgggattacaggtgtgagccaccgcacctggtcaccacatacagtcttaattgtagtttttatgtttttctttttcttatgtatttttcttttcttttcttttcgttagagatagggtcccactctatcacccaggctggagtgcagtggcatgatcatagcttacggcagcctcaaactcctgggcttagacaaccctcctgcctcagcctcctgagttgctgggataacaggtgtgtgccaccatgcgcagctaattaaaaaaaaatttttttagagatggggtcttgcagtgttgcccaggctggcctcaaactcctggcttcaagagatcctcccaccgtagcctcccaaataggggactacaggtattagccaccatgccccttaacccacgtatgcctagcgttccattattggaacgctaagcatgtgggaattatttatagcctactgctcaaggtcatcgccaaggtctgatttttcactcatgcaaaaattcaaaaaattgcaacctctggcacaaacgggttaagtactttctgtttcggaccataagaaaagccagatggatctataatctttataattaccatggttatcatggtgatacactcctcacctgcttcacttgatttcatgttgttactggtaatcctaatacaactgcaaactggctgggcacagtgactccttcctgtaatcccagcactttgggaggcaaaggcaggaggatcattggagctcaggagttcaagaccagcctggacaatatagtgagactctgtctctacaaaaaaagaaaaataggccgggcatggtggctcacacctgtaatcctagcactttgggaggccgaggtgggtgggtcacctgaggtcaggagttcaagaccagcctcgccaacgtggtgaaactctatctctactaaaaatacaaaaattagctgggcgtggtggtgggtgcctgttatcccagttactggggaggctgagacaggagaatcgcatgaacctgggaggcggaggatgcagtgagccgagatcacaccattgcactcaagcctgggtgacaagagcgaaactccatctcataaatgaataaaaaataaataaataggctgggtatggtagtgcacgcctatagtcccagctatttaggaggctgaggcaggaggattgcttgagcctaggaggttgaggctgcagtgagctatggtcgcaccactgcactccattctgggcaatagagtgagaccttgtctcaaaaaaaagtaaactaaatattgtaagccatggattacctgtagtctgtagtctctttccttataggaacgaggttattcctctgattgattttatgtgtgcctgtgtgtgtgtgtgtgtgtgtgtgtgtgtgtgtgtgtgtccaacccaatctcaaaatcttacttaagggtccatttcctgtaataacttctgttgcaaatcaccatatctttagagtcttaagaagaaatagaggacagattaaaaataatttaagaaggcttggcatggtggctcatgcatgtaatcccagcactttgagaagctgaggcaagaggatggcttgagcccaggagtttgagactagccgggacaacatggcaaaaccccacttctacaaaaaaaaaactagctgggtgtggtggcacacacctgtagtcccaggtacttgggaggctaaggtaggaggatcgcctgagcccaggaggttgaggctgcagtgagccctggttgtgccactacactgcaacttgggtgacagagtgagacccctgtctcaaaaaaaaaaaaaaaaaaaaaaggaaatatactggtaaaatgtattacattaataattttgtttatcaaggcaccattacaaaaagactaaccacaatgtaagaaaagatactggccacacatatatttgaccaagaactcatatccagaatatataaatgattcctaaaaatcagtaagaaaaagaatgacaacccaacagaaatatgggcaagtgactttaacaggcactacagaaaagatctccaaaatgtctctgaaggccatttttgtcaaaaacaaaaacatctccaaatgttaagtaccataaaatggtgctcaacttcaatggtcatcaagtaaaaggttaatgtcaaaatgagataccactacattcgcatcagaatgaccaaattaaaaagattgacaataccacgtgttgaccacagtgtggagaaagtgaaactttgtcacactgttgtggagcagtgacaggggacgggggacagggattgggtaaagtttccataaacttggaaaactgtcattctttacaaaatttgaaaatacatcaatgactaagcaactttaatcctaagtatatactcaacagaaatgtcttcacttgcatgtgaagagacatacagaagaatgcaccataattggttaatagctttaaagtggaaacagcccactgaaatatcaacaataaaatggataaatatattttatccatttaatagaatatagaagtgaatatgaacaaacgataaacaccacagatcattttcagaaatataatggtgaaaatatacattacataatttcattcatgtaagactcaaaactaggcaaaaatgatgtatggttagaaatcagaagagtggttacatttggggaacagtgacaggatagttactgggagctctcataagaaggtttctatttcctgggtgctggatacagggacactctgtgataaatcactcatttttgcatatatctatatttcaattttttaaaagggtggtccttaaaagattatgatttagggtttaccaccttgcccctctccatcaattcaaatatttcttccagttcagatcccacaccttacatgaagcctttcccaaccatttcagccagaaggaatttctctttcttcctggtttttatgccatgttctctgggaggtagtgtaatatagtggaaatagtataggctaaggaacttggactttaatctgtgtggcaataaagagcagaagagtgactcggtcagacttgtatctacctaccacaaatttaaccaattttacttatatttctctgtgaacaaatatgaaaatttatacacatatattaaatataaatatatagcttttataccacggaatactactcagccataaaaagaaatgaaataatggcattcacagcaacttggatggagttggagaccattattctaagtgaagtaactcaggaatggaaaaccaaacatcattatgttctcacttataagtgggagctaagctatgaagatgcaaaggcttaagaatgatacagtggacttgggaactttgttgggggcgggtgagaggggggtgagggataaaagactacgcattggctacagtgtacattgctcaggtgacaggtgcaccagaatctcagaaatcatcactaaagaacttatccatgtaaccaaaacccacctgttccccacaaactattgaaataaaaatttaagaatacataaaatgtgtaatttgtgagattgttacaatatttgccctcaataaatcatgcctactttgttcatgcatctttgcaatgtgcttttgccacttttcccatcaaaggctttatttccttaccccttgaatctagctatctttgtgacttgctttgaccacagaatgcaaatagatgtgactttgtacaacttcttagactaggtctagagaagcttcacagcttttttcaccgtttggaacactgcactgagaccactatgttataaatctgggagtgaaagacagtgtaaaggcagccacaggagtgaacacaggggagactaacagaactttctggccaaatcacagtgtggtgagagagaataaatcatgttgttttaagccactgttttggaatgcatgtgtaatgcagaagtagataatttgtaggaaacagagtcccttttccattacctagctcacctatttactctgttgtggcagagaatacaattatttcccaatgtcctttctcctcttcttcctttaatattagaacccccatttttttttgttttgttttgttttttgtttttttttttgagacggagtcttgctctgtctcccaggctggagtgcaatggtgtgatctcagctcactgcaacctctgctgcctgggttcaagcaattctcctgtctcagcctcccaagtagctgggactacaggtgcacgccaccacacctggctaatttttttgtatttttagtagagacggggtttcacagtattggtcaggctggtctcgaactcctgaccctcaggtgatccacccacctcagcctcccaaagtgctgggattacaggcgtgagccaccgtgcccggcagaacccccatatgttagctgggtacattgctacatggatagtgactataatttcctaactctcttgaaagtttggccatgtaactaggttttggcccatgggtcgtaagtggaaatggtggctccaacttctatgatacgcccttagaaagaagaggtatactcttttactatttcctgttctcaaatgtatcatggcaggagctggaactaccaccttaggccatgaaatagaagccacatattcacatattgagtagatcagattaaaaagctaaaagtagcttgagtacctaatatccagagctgctctatcagtcctgaaccgattatccttggactatgagagaaaaagaaatttacatcttatgtcattactattttgacctgagagcaagcaaacctataatcccaagtaatatgtgtttttcacattccctcgtatatatatgttcatgtatatatatacatttacaaatataaatatccatatgtgcacacacaaatatgtaaacatctctataggtattggtgtattttgttttacagattgagatcctgcacttttctccatctttttctcatttagcaatatctggaaatgacaactcatacaacttgaattcattccttttgatagctgtataatattttataggatgcaggagttgtaattcattctgctgttttcctactgattagctttcattttgttacccttttttccactatgaatatttttgtgaatagaaccttatgtatttctatagaacagattcccaagaatggtacagcaaggacaaaagatatctgtagcttaaaaaattttaatacaggttgtcagactgttttacgaataagttgaaaaatttcacatttatgccagctatctataacaatacccttttacttggacccctcaccagccatagttgctattggtcatttaacatttttcccagtctgaaaagatgtttcacctcacttgtgacaagagaaatgcatagtaaaattttactgagattaaacatttctgcttattagtcccaaatccaacagtttgaataacatactctaataacaatgctgtgggggcactctcatctgtttatacagcacctatggagagaaatttggcaatatctgtcaaaattacacacaaacacacacatctttttttttttttttttttttttttttttttttgagacggagtctcgctctgtcgcccaggctggagtgcagtggcgggatctcggctcattgcaagctccgcctcccgggttcacgccattctcctgcctcagcctcccgagtagctgggactacaggcgcccgccactacacacacatctttaacttagcaatctcttttctgtgaatttatccagcagatatcttgaacatgagacaaaattatgtacattattattcaatgatactgtttttaaaagctgaagactgaaaacaatgtccatgtccatcataaggtctagtaaaataagttctggcattcatgtagtggaatactaagcagccattaaaagataaggaatctcattatggagttacataaataattctaagatatattgtaaactaatatatgtaggacagtgtatatattgttatctttatttttaaaatggagaataatataaatttgtatttttctgtaaaatatctgggaaggtatgcaaaaaactaataaaagtattaatgggataggtggtggtgttatgagaaattggtgaacaggagatcatgggagactgaaacgcaaaacatctgtctctctctacacatacagtatctgaatgaactatctattcaaaaaggaaagaaaaatagctcctatagagtgaattcaatttcgcctactgtgagttttatgatcctcactttcatcaactgaataaaagggataagatccacttcaaagtactttctgaacactaaattagaggtgtgcttagctcagtgtctgtccatattaggcactcagtaaatgttagttgaattaaaaaaaaattgtcagtctgttagactaactggcatcttattattttaattttcattttcctgatttctcctgattctgagcctcttttcatatttggatttattattctctgaattcatattatttgcccatccattcttctgttgaattgcttgttcccttgatgtgaatttctgagttccctgattaaacctccttgcaaatatttttctaaatttgttgtgtatctattaatttcgtttagattttttttgcaaacaaatgttatttttatattgacaaatgtgtatattttttaaggataatgtatattctgctgttcttacatgaagtattctataaatgtcaactagatccagtagattaatgatactacagttcaatttttactgattttctgcctgctggatgaattattgaaagagagatattgaagtctctgtgatactggatttgtctatttctcttcgtggttctatcagtttttgccttacacattttaatgctgttaggtgcatatatgttaaagattgttttatctttttggagaatttacctctatacttatgtaatgcttctctctatccctgacagttttcctttttctgaaatctgctttgtctgacaatatagcaactccagctttctttttattagttttagcatggcagatctttctttatttacttttcacctatctatgtctttatatttaaagtgagtttcttacatatggttcctgaaaaaatgaaaaactagtaaaggctgttgtcttcctccctccaaatcaaccctgagtaacaacagaaacaagaaggaagcaaaagcttgaggaataagatcaaaaacttaagaggaaaccatagttagtgttaggagtaagttctgaaatactgttttgccatgccccactttgctttgggacaatcagtgccaaactactgattgctacagaaatcaccagcaacagatcaggcttcctgtaggattagataaagggtctgttgaagtgagttgccaatgaaaaagtggggctgaccagatactatagaatattggggcattcacccctccactccttccctgctgccagaattttgataaattataacagccttctgctgctggattgtggatttcaacacagatccttactagagaaacagtagcaaagagagagcatcagttctgtggttgcctacagctcttgctttctgctccttaaacttgtgggaagggataaaaacgagggtctgccattttgctctacctttctatccattattagaaggggtagtagataacactaggagaacatggcttgtgaaccaaaatatctagacacctgaggagtatgatcactatcaaacacaacaaattctacaacatgtaccaacagaagtagaataataggatataccaatacttttaataactcaattattcattcaacacaatttgtaaagatacagggtctcactctgttgcccaagctggagcaatcatagttcacttcatgcagccttgaactcttgggctcaagcaatcctcctgcctcagccttcttgctagctgggattacaggtgtgtgccaccacacccacctaatttttagaatattgtttatagagacgaggtcttgcaacgtttcccaggctgcttcaaacacctggcctcaagcaatcatcctgccttggcctcctgaagtgctgtgattacaagcatgagccattgtgcccagttcattcagcagttttttactgaacacctaccaagtgtcaggtactaaggattcatcagtcaacaagataggtaaataattttgttcatgtgggacatggcaagggggacagagacaaaaagatacaaattaactaaataataaacaattttggaaggtaatatttactaccaaaacaatgcagagtaggtagattgggactgatgaaagggttgccattttaaaatgaaacccatcctaaaataggagccacaaagatgcagggttgcggtgaggctggtaatatgtgaagagtgaacaagaaaccataaagccatatgagattattaggtgtggaaaaatatgagctaaaataaggatcatagctgggcatggtggctcatgcctgtactcccagcattgtgaaaggcctaggcaggcaaatcacttaaggccaggagttcaagaccagcctcgctaacatggcaaaactctgtctctactaaaaatacaaaaattagccaggcatggtggcacaagcctgtgatcccagctactcggaaggctgaggcaccaaaaatttcttgcaactgggaggcagaggctgcagtgagctgagattgcgccactgcactcccgtctgggcaacagagcaagacggtctcaaaaataataatgaataaaaaattaaaaaataaagaacatcatagataaatagcaggtggattggatcttatgatgcttttgagatacagaattttaatatttttgtgcagttaaaatctctagaacttttcctttgtgctttctagtgctttcatgctttgaaaaaacctttttatccagagatatttttaggttgataattaaaatatttaaaatcataatattcgtatatggaaagaaattcaaacaaaataagatactagaaagtaaaaggcctcatctactgtctctcctcctttcctcagaagttatcatttttctaggtatccttctagaaatgttctatgtataatcaaatacatgtaatttttaaaatttataaataggatactatacatactttctacaatttgcttttttcattcacacatatggccctactccagagattgaggttttaaatatcaggaagaattttatttagaaggcaaaactacagagacaaaagataattggttacccaggggtataagttaggtaggggtaaataggtggagcatagggcacttatagggtaataaaatgattatgtatgctactattatggtggacacatgacactatgcagttgtcaaaattgatagaactatacagcacagagtgacccctaatgttaactatggattttagttaataatgtagcagtactggttcatcagttgtgacaaatgtaccacactaatgcaggatattaataggagaaatggtgtgtgttgggttagagggtgacatatgggaatctgtattttctgccctgttcttctgtaaatttaaagctattctttaaaaagtctttgaaaaaacttcatttagaaaaactattcttaaagctttgtatagaatattttaaagttggaggctagaggtcacatatctggtagactgttgctatggcccaaacataaaataataaaggactatactatggtagcaaataaaattactttgaataggtttgctaatacctaagaaaatttcacattagaaattgagtggaatttaaagtttctaatataaagaaatcatgtgtcaaacatagtgttaatcaaaaataggaaaaaacaatatgcataaaaattatgagaacaaaaggaaatgtggctgaaaagatgctaatagccataacatgttgaatatgttgtttctttttaaagttaacatgacacagaggaaccaggaaatgcgtctactgcatttagttttatttatgttcttaaattgtttatttccagatttctgtaacatgtatatatatttttaaattcaattttattttgtgtgtgtgtgtgatggagtatcactccctcgcctaggctggagtgcagtgctgcgatctcagcttattacaacctctgcctcccgggttcaagcaattcttctgcctcagcctcctgagtagctaggattacaggcatgcaccaccacgcctggctaatttttttgtatttagtagagacagggtttcaccatgttggccaggctgatctcgaactcctgacctcgtgatccacctgccttggcctcccaaagtgctggggttacaggcatgagccaccgtgcccggcctgtattttcttaaaagatcagccattaccaagttattattggatgcctttaatctcttttgttagtgtatccatattccaataaaaatttatttataaaaacaggcagtggtctgctctataggatcttgcactaataagttactttaattctttaaggttgtcttgagaattaaaacacataatgtacaaataaaacaccatgatttggcatatagtaagcacttgaaaatagtagtggctattttattaaaatagtgtgttatcatacagctcaaaatgctgataagatgaatctgaaattcagacttaaaagtatttttattatagtaacaaggttatatttgggattttaagttttgttctaccaccagtggtagtttaaggcttcttgtataacggttctttgtgatgtttttcttgtcagagacacgtgtgatgaactcttgggacatgttccactacttggggatcctggtatttccttgctcagttttcacaagaaataggtttggcatctctaggagtatcaaatgaagatgttcagaaacgacacaaggtgtcgtttaaagtttaaagtcattttcgactttaaaaaatattctattgatatccattaataatgtagtaaaagcttccaagttactataaagtaatggttctggaaagagcatgttaatttaaaaaaataactactttaggtatgattgacatgtaaagctgtatatattgtatataatacaattagtttggggatacattctaatcatttatgataataacaacttagatctcatacaaaaactcgacactttaactcatctgtcctctcccacattgttatcgatgtcaaaatttacatttttatattgtgcatcaattaacaaattactgtagctatagttatttttaatacttttaactcagagttaaaaatgattttatgtatcaccattacattacagtattctgaatgtaactctatacttccctttaccagggagtttcatactttcacgttttcatgttgctaattagcatcctttagtttccacttgaagtacttcaactttagtttcagttttagcatttcttgtgaggcaggtctagtggtgatgaactccctcagcttttgtttttgtggaaaagtcttcatctttccttttctgaatgacagctttgtgggtaaattattcttagttgggaggcttttcttttctttcagtattttgagtatatcatcccattctcttctggcttgcaaggtttgctgaaaaacctgctgaaagtcttataggagctcccttgtacatgacaagttgctttcctctgctgctttcaaattcttcgtcattaacttttgaaaatttgatcacaatgtgtctcagtgaaaaaattttcatatcagacaggtaatgtgccagtgttttggcaaggtctgagaaaggcacatcttacacaatggtatgaaaacccaatcatcatgcttatgaaccacaaaaagatcaatgaagacatctttatgttcaacctacatggaattctttgggaattgtggatctggatgttcattttcctccccagatttgggcagttttctgctattatttctttaaataagcaatctgcctcctttctctttctctgcttgctctaccacttctataatgcgcatattggtttagagtcctgtaggcttactttattatttttcctctttgttcctttgactggataatatcaaatgatctgtcttcaagttcattgattcttctttctgcttgattcaatctgccactgaagctcacttttgaatttttcagttcagttattgtgttctttagtttcagaatttgatttgtttttttttttgatatggagtctcgctctgtcacccaggctggagtgcagtggcgcgatctcagctcactgcaagctctgcctcccgggttcacaccattctcctgcctcagcctcctgagtagctgggactacaggcacccaccaccattcctggctaattttttttgtaattttagtagagacggcgtttcaccatgttagccaggatggtctcgatctcctaacctcatgatccacacgcctcggcctcccaaagcactgggattacaggcgtgagccaccgcgcccagccagaatttgattgtttagtggtttctttgttgaaattctcatttgttcatgtattgttttcctgatttcgtttagctcactgagattcaaggtgagtgttctgaattctttatcaggtaatttataggtctctgtttctttggggtcaactgctagaactttaatttgttcctttggttgtcatgttttcttggtgtgtgtgtgtgtgtgttcaactgctagaactttaattcctttggttgtcatgttttcctggtgtgtgtgtgtgtgtgtgtgtgtgtgtgttcttttaagccttgtcttctaactttgcatctgaagaaagagtcacttcctccagtctttactgactagcttcagaagggaaagacgttcaccagtcagcctgactagagattctgaaggtctctcagaccttttctatgatatgcccattccattcctcttgttctgtcttgggaggggaagtcttaggattgtgtgctttctttcaatctcacaaagctagactatgtgctgagaacctccttttattttctctagtgcagtgcctcagagtgttcaaggttgtgtgctttcttccaatccagcaggagccagttgctgatatctgtgtgctatctgctggggcctgcatacactatctgcaggggaggttgggctgctggctagtgggtgggtgcatggagtgctgggtgtgcttgtcagttgaggggttctgcaggtgaagtgtcctgtagggctcatgggtgagcctatggtggagtctgcaagccagttaggagactccacatctagctctgaagaatcatgtgttggttgctataagcctctgcttcttttcccttctcctagatattcctagactattcatctgtgaagagtccctcagtattctggatagggaaaaacagaagtgagccttttgggcggcaacacgcaaggctagggaagctgggcactcacttgactcttactttccttcctgggagaactcatgggccaaaagggcctctcttggcactgaactctgctgccttggaggagaaggatgtaggtaaagtgaaactgtttttcttaccctcttcaatgtgtctattcttgagtttttcattctactggggtgctggaacctcttagcaggtctcccaggctcccaaaatggtatttggtatttctgcaggggtttgagggctggaacctactaatccaccaacttgctgatgtcagtcagggtgcctttaatctgaatagtattatttcacacagaatgctatctctgagtttagtagctcagaggcaaaatataaacagttaaatatataaagtaacattattaaatctcacatttattctgtgcacaactacaatatcgcaaagcattatgcaggttccttcttcatgcctagttcatcggtgcttggagtagctagttccataaacttctgaggtaataagaatctgccttgttattttattatttaatgactatatttatagattacagtaaccatggaatttctaaggcaaaaaagatggcttccaaaatagcaaaagaaacttcaaagatctatggaattaagcttttaattatgcacatatgcatatacaattatgtatatcatatatgtgctttgtaaccataatcttttgtctagtcaatgactgcaaaagtggtatgtcagtatacacttacagaattatagaaaagagaagctttcttcagagctcactctattctatcatgtgtttgcttgtttatttatttattatggattgactgacagggtctcactctgttgctcaggctggggtgcagaggcataatcatacctcactgtaaccttaaactcctggcctgaggtgatcctcccaccttggctatatagataattctatatactgttagtttttagtaccacaaagtgttatggaaggtgatttcaaaatagtttcgccatgttattgatttatagatcccagttttgtttctttagttttccatttatttctagtttgctggacttcctcttaaaactgtggggttaaggcaaggcagttccaaatgtagttcctcatacacaaaggggaagtaagaacaccaaacaccaaaatcaaaatgttctaataaaaaaagtttatctctttaaaatgttgaatagacagatttaataataattcttttttaaaaaaaattgattagtttctcatatgataatcattattttaaccccaacctatagtccactgtaagtatccttttaatttgttaaagcatattagttgttccattaatttcatctacttttccaatccatcaatctgtgattccttttacctttctcttattttgggtttcttataccttgatcaaatgtcctactttttcttagtttattcctcatttaggtggaacacatcctctattagctttctgagaagagaatgcgtagattgtgtattttttaaaccttttaggtttgaaaatgagtttattgtagtttcacaatgggttcttggtttggattggtatagaattctaaattataggtagtttttcttcagatattttaagaattgccctttaactaccagagctactgttaagaagtccagtacatttaacttttgtagtatgtgtctcagtctgtttgggttgctgtaaaggaatacctgaggttgggtcatttatttaaataagaggtttatttggctcatggttctgcaggctgtacaagaagcatgatgccagtatctgcttcttgtgaaatcttcagactgcttacactgagggcagaaggcaagaggaacccatgaatacacagttcacatggtgagagagaaaggccagaagtgaggggtatgggtatgcccaggcttctttgtttttctttgttttttttttctttttttgagacagagtctcactctgtggcccatgctggagtgcagtggcacaatcttggctcatagcaacctccgtctcccaggatcaagcgattctcctgcctcagcctcccaagtagctgggattacaggtgtgtgccaccacacccagctaatttttgtatttttagtagagatggggtttcactatgttggccagtctggtctcgaactcctgacgtcaggtgagccacccaccttggcctcccaaagtgccgggattacaggcgtgagccaccgagcccggccccaggctctttttaacaactacctctcacaggagcgaacagagtaagaactaattatcacaaggactataccaaaccattcaggagggaaccacccctatgacccaaacacctcccactaggccctaccaacaacattggggatcaaatttctttttcttttttgagacagtctcactctgtgacccaggctggttgcagtggtacaatctcagctcactgcaacctccatctcccgggttcaagtgattctcatgcctcagccacctgagtagctggggttacaggtatgtgctaccacacctggctaatttttgtatttttagtagagatggggtttcaccatgttggccaggctggtcttgaactcctggtctcaagtgatctgcccagctcagcctcccaaagtgctgggattacagacgtgggtcaccgtgcccagctgggatcaaatttcaatatgagacttggaggggtcaaacaaaccacatctagagaaagagctccagaaatctgcatggggttccttaagcattttatattaataacaatcttacatactcaatagccatgttattagtattgacacattacataattacattgatcatgtagatctagaccaaccactgtgaaaaaaacaaggtgcagctaataataaaaaagatgagttgataatgaggtaaaaaaaatgatgaagatgaaatatcatactaactatgcatgtatatgtgccaggtactgttttaattgctatctatgtcttaattcagtgaatatacacaacacaaccttaagatgtaggtattacctacatttttacaggttatataatttatcctagtagaatcagaattgtagtctaaacagtgtggctccaagagtctacagtcttaactataatgctgtatgtaattccttgcagtaagtagacagtagtagtgttttgttatattgttattaaatgccctttcttgaccaaataaaaaattggcaaacctatcttgacttcccaatttaaaaatttattggctgatgaaatctaaaagcctggaaatcatcaatttatagggccagtaaagaacaaaaaaaattaaaatttgagaagtaactgatggagcaaggtcttaaagggattcagctctagaatacagggagcagttagatttggagaacagaacaaaagctaaatatagaagggattatgaccaagtagagatgatggtgagaaaagcttctctagtaactaaaaatcaaggtcatctgagctcaaaataagcctggtaatgttaatagaagacataattattaatataaaatagtgaagatttgaacaacttttgtcaggaatgagaaaaataaataaatccaggaatgggctgacagagcagaaaaagacagggtttcaaaactaaatcaaagaatgtttagtggcagtaaaaatgtaccagaatgtgagattgtggtcaccagtaaaattgctgaatttaaggtctgaaagccagagtaaagggtcattcattgatggtaaagacgataatgataataaccattcattgagtatattacaaaattaattgtatctagtcataaccactggtatcaccatatcaaagagaagaaaactgaggccctaattaattttcagtaaaaagttaagtttttcatacaacttgacaagaggactctgaaattcacagagtagtaacaaggccaggcattcacaatgcaatttgaagaaaacaggtggggaagcttatcttgctagatattaacacttacttatatagttgtagcaattatgacagtatggtattgttatagaggttatacaaatacagcaatggaagagaataagcaacccaggatgtgtggaaacctgatttgagataagtgacattacaaaccacaaaaacaagtttaactcttcaataaatggtgctagaacatagttgtttgtatgtaaaataataacaaatgagagtagatccctttctcatgcacaaaaagtaagtactgggttgagtaaagccctaatatgaagaatataagtttaaaacttttagcaaaaacacaggtgaatacctttgtgatttaggggtagaaaaagatttcttaaacaagactcccagaacacaaattgtaaagaaaaagatgaataaatttgactacacccaaaccaaatttcagtataaaaacagacatacacggtcaggcacggtggctcacgcctgtaatcccagcactttgggaggcagaggcaggtggatcatgaggtcaggagttcaagaccagcctggcaaatatggtgaaacctcgtctctactaaaaatacaaaaattagccgggagtggtggcgggcgcctgtagtcccagctacatggaaggctgaggcaggagaatcacttgaacctgggaggcagaggttatagtgagctgagatcgcgccattgcactccagcctgggcaacagagactctgtctcaaccaaaaaaaaaaaaaaaaaaaagacatacactaggagaagataagcaacaggaaaagataagcaaccaatgtaaccaacaaggtaatattttccagaaaacatgtaccagtgaaactgatgaacaaaccaatagcacagtgggcaaagatgtcaagagcagactagtaggcatttggaattagactcctagaattaagattagcctaaagaaatctgggctggaaatagagatttgggctatatcttaacgatcatatttgaatttggggcactggatgacctaatgggaaaaaaacatgaaagaaataaaagtcttgggcctagctaggacaggcagaagatgagtgatccaagctcaagtgcttgaaagtaaataatgactcctttaactgtatttacatatttatcttgagttttctgaccacagtttctttatgtcttttaaagatggagtctaaaaacactatcgcataaggtggtcagataagcctattacatctatttagagcaatattatctttagaccatgtttcatgtgcagccaagaaggcagggttgtggaaatgaaatacaaatataaatgaaaacaggatttaaattttaagtaaagggaatttaagaaaatattccttttaagtggataataaggatttttaaattggtggagttaggaattatctcctattacacattcgcatagctcatgtaatgcatcagaatacctaatatatgatccacaccttttctctgaatttcaaggcctcccaaaaaagttttatccatatagacttgcattcactacattttttctacttgaaaatagcaaaccagctattcacataaactgctaagaggaagtaagccaaccataaaaaattacatactgtaaaattacttatatgtgagggtcaaaaacatgcacagcaatacagaatagtagtaatggtggtggatgtggttggaagggtcgctttttaaaaacgcctctattgaacattctgtatattgatgtgggtggtggttacctggaactgtacatttggcatttgagcattttactatatctttaaattgaggtatgtattttttaattctttaaagaaaaactgcttggaggtcttattcttaatgcacaacaatcacaaacattaaatttatacagtccagagaatgtaaagttgctttaaaaaaattctttccttttctcactttaaaataccaaggggaaaaattaaactcaacacagcacgtcttgcccttgtcaagatgacagatcctctaagagaagaaacgaataggtaatggccttttccagattttcttttcctaatgtaccccacttccaacctacccctacctcaactagggtatctagttgtacccaagggtgcttctacattagatccacagagattaaagataacagttaacagaatagtccagaggacaaggatattcaagttccatcatcttcaggataaaaaagctccagggtttacctccaaactctctctaaaggaaatcccatcaaccttttaaacatcactttgtatacaccatcttctgtactgccctagctcaaaaacatgaacctgtatctaaacgtgtttgtagaatttccattgtaagttttactttaacaattttgaacaattataatgatagaaaattatttaatctagattttggtcaactctattactgatattcttttttagtgaaggacaatcacaaacactaaatttatacagtccagagaatgaaagattgctttaaaaaattccttccttttctcactgtaaaataaaaataccaaggggaaaaatggaaagtatttattataactggctgttacactgtcatacacaatgaaatactggaccattagcagttcgttattatatgttgttaagtgtagaactgtaaataatgaggcatattattaagatatcacacacattatccaatcagcaagtgcacaacttcggacattttgacttcagccaaaatatgaaacaaagtcatagcaagaaagttatttcaagggagtgaaattttctcctcttacccttcaaatcttttagagatattaataaaaacaactatccagcctgggcgatataatgggactccatctacatacacacaaaaatttttaaaattcgttgggtgtggcagcacacgcctgtaaacccagctacttggaaggctgaggcagaaggatcccttaagccggagttagagtctgcggtgagctatgatctgaccactgcactacagcctgggcgatagagcgaaaccttgtaacaacaacaacaacaacaaaattaaaaccttcaagatcaagcttgcccaacaggatggctttgaatgccactcaatgcaaatctgtaaactttcttaaaactttatgaaaaaaaatttttttttagctcattagctaccattagtgttagtgtatttatgtgtggcccaagacaattcttcttccagtgtggcctagggaagccataaggaccccctgcgctagacttcagcagaagccttgtaacataaagaaaaccatacataaggctttagattctttttttttttttttttttttgtgacggagtcttgctctgtctcccaggctagagtgcagtggcacattctcggctcactgcaacctccgcctccctggttcaagcgattctcctgcctcagtctcccgagtagctgggacaggcacctgccaccgcgcccggctaatttttctatttttagtagagacggggtttcaccatcttgacctggctggcctcgaactcctgacctcgtgatccacccgcctcggcctccctaagtgctgggattacagacgtgagccaccgcgcccggccagctttggattcttttaccactttcccgaaggaaaaggaactgaaaatatctaaggaaggactactacgaatcttctctgagtggcaaaaaccagaggtttttggagctagggctgcagttaagttgccaaggggcagagatgtaaacagttcctggtttagttaaaatattttaatttttatttttttaagcctggcctttgggtgaaggagtaaaattaggcactggggtctgggtagggggaggatactcatgggcgagtatgcaaccctagggccacagcaaccaaactgtaggggaagaggcggggcgagaggggacgaagtagagacagcaagagactcacttttgaaaggcactttcggttagaaagcattctcacatgcttatctcatcgcacacagtatcctttctgctggtctccagcatctacagacgttaaaggcccaagaggagggccaccttcacacgagattccgaggagggcctcgctacccgccagttcccgcgcctcggcagtccgccgcgagcgtacgtcactcgcccgccgccaatcggcgcccggcaggtcacctctcctcccagggcccgccgccccgcccgccgcccaggccgaggccgccagtgcccgccggccgcttccgctcccggcgcaggcgctgcagcttggccagagcggagggggctcgggagaggagtggacgccgctggccaggatggtgctggagagcgtggcccgtatcgtgaaggtgcagctccctgcatatctgaagcggctcccagtccctgaaagcattaccgggttcgctaggctcacaggtaatcctcccccatcagccagtccccatccttgcacgttcgccaagcgggggaaggaggcgtaaaaatcctagggccaaggggcgggacggagctcggcgcctggcacgtgatccccgcgcgcagaggaaggtgggcgcgcgccgacgcagctgcctggggaacgcctgtgaggcagtctccgggtgcttgatgccccagggtcttttgtcctcggagttgtctccggtgtcattccgtggcaagataccaggtttttgcagagaaggtgctgagttgggaacaggccagtctctttcatctcctgtcctgctcatcgctctctgtagcgtacttgtttattttaaagcgggctaagtcgtcgttatctaaggcctcatgtaacaggcagccccagctaccggctgggttgtaccctcagcatgtgggtgggagtgtgtgggagagaaatatagacttacacgtaacacgtatatgaccgttttatttagtaacgaaattaggagataacctccattccctcaggttagaattgacctatcataggtggcatttgaggtcatctccgtttctacggtcccggggcccgctgcggtaacttaagttggaagaaagataccttacccaagaaagtattcgaaggccggtatgaggagtgaaatcttagaaaatgaaatttagtgaatatatgtaacgttctatacttaaggaccctcacttaacccacacaactcatgaggatttcacatctaaaggatgaaaatctccagaatgcagtcaacacttgggagattgtgttgagttatgagcatttcattgtaagggggatatttctaaacggaactcagaccgagtaggatggtgaaggaatcagcaagtattgaactcctatgtcctaggttatcagggagtgcaaacatgaattaagataattctgaggtaaatagggttgcttcgccgggaacgttctaaagatctgtagtacctgacctaaaatacagcaatcgcacagctgtctggtagaagaaaaataagatttgtgtagactaaaatatagaactgataacaaattaaccaaattagtgaaggttattgggaggtgaatttcagtctaaggaagatttttttttaaattaaagaatgctttccccaaacaaatgtggtgcttcagtgatagcccctctcaaagatgaaaaaaacaaacaaaaagactctggtggtgggtggtcgatagatttagaagggataaactagatgacaaattctcttccaaatctagagattcattgaattatggtcagacagacgctctgttgagtggattgtgagattttaatattttttaaatattaagagttttagtagaaaacatgcaattgaatagaaagcatggtaacaataataaacattaaaaaggaacattaaacatcagaagcaatgcaaaagtaaaataaaatgaaaaacgtttcacatcaagtgtttataaacatcagatcttttgatcctaccagtttactctgacagaattgcagcaattccataaaattttggctttccccacttcttttacttaagtactttacatattttaatataatcctcattttttccctaacaactaaatacttattttagttttaacatcacaatgggcctaaccattcattcccttacaactggaaattagaaatgtttctattttttaaaattcattatgtaatagttcattggcaagtaagcaaataccagttgtcatatttctcccttttggatgtcttcacttaaatagcaataccaggccaaaacggtatgatcatattgtgacttttgtacccttttgtcattttgacatttgtaccttcttactaatttgcataagttaactgttgaggaatttttaacagtcaagaaaggaaaatgtccaatgaattacctatgttttttccagatggtggctgcatttgtattagtttcgattctctgtaaatcaagtataattgaagaaaattagaaagtatgaaactagatttaatggctagattttagaagtatgctttcttttcttgaggatccctagtgtcaacaaatatttaattcctattaaagacattaagaaaactcaaccaaaaccttttctctcttaagaatatatagtaacttcctcttaaaagttgttaaatatttaatatgaagactgattctcagaaataatgaccattctgagaagtattttaataacatacatttaacttaagtcccattacagtgtggctatagttaatagttctcattttattgctggtttatttaggaaacatgaacatgcttgtaataactggtttatgaaaaacatgagatagccctttttggattggacaaaacaattgcagggtttattttggagtactatagaagaaaaatttcagtggctattttccactctcggtctcccattctgaatagattgtaacagttaatgacatttggctttcttaaatgagttacttgtagaatccataatgtacacttttgttaaaataaaaacctggaagacaactttttagcaattgtttaaaatgtctaggagaccaaaaaatatttccattttcttctatgaaaattagagcaaaaaacaatacagttcacattattattgcctacatttccttccctatttaaatctagctgttttttaaagctattgactctcttatgatgactctgcattcttagaaaccacatggagatctttaatgaccatatactaaatacaggcagttctcacctatcagaaacaacttaactatctttgtttatgtcacattttcaagagtgaggcgttcaagataaattactgtgattatctaatttatgtttaacttaggtttttgttttgttttgttttttgagagggagtctcttttgcccacactggagtgcagtgtcggctcactgcaacctctgcctcctgggttcaagcgatgcttatgcctcagcctcctaagtagccgggactacaggcatgtgccaccatgcctggctaattttttgtatttttagtagagacggagtttcaccatgttggccagtctggtcttgaactcctgacctcaggtaatccgtctgcctcggccgcccaaagtgctgggattacaggtgtgagccactgcgcccagccctaccttaggttttaagtggtaatagtaaactcatgcaatgaaaatattttatcttttctacagttaagaaatagaaataatttctgtgtttagctacatatgataaatgagaaaatatgttataaaataaccagcaaccaagctgccagtattatttttatggtatcataagatgatatggctatattatatgtagatgtttgaaaatttgaaatggaaaaattctgttctagttctgtggaatgtaattcctcattaagatcggagtttgtctatgtcatttttatgtcattttatgtcatttttagctattattaaaaaatgttttaataatagtatttatatgtcataaggaataggtgtcatagctagcctgtgtcactatatataataaaaggttaaacctaattttgtttcccaaagaagatacttcattttgacaatgtctaaactttcagaaaatttatgctaaaattggtagctaccgtattattccgttttcatactgctataaagaactacgcaagactgggtaatttataaaggaaagaggtttaatccactcacagttcagcatggctggggaggccttaggaaacgtacaatcatggcggaaggcgaaggggaaacaaggcaccttcttcacatcatggcaggaagaagtgccgagcaaaggaggaagagccccttataaaaccatcagatatcatgagaactcactcactatcaccagaacagcatgggggataccacacccataatccaattacctccacctggtctttcccttggcacgagattatggggattataattcaagatgagatttcagtggggacacaaagcctgaccaaatcagctattcaagttgctttgaaattttcttttctgactagattttggttttcttttgtgagaaagggtttcactctgttgcccaggctggagtgcaggtggcatgatctctacccactcattgcagccttgacttcacaagctcaagccatcttcccacctcaacctcttgagtagctggtactacaggtgcacgctaccacacctggctcatttttttgtatcttattttagagacggggttttgccatgttgcccaggctggtcttgagctcctgagcttaagctatccactcacctcagcctcccaaagtgctgaaattataggtgtgagccactgtgagtggcctagattttgtttctctgatggtgctggttctttcattcttcctttttggtcctgttatttatcttaatagtgggatacgtggaaggctgaggcaagagaattgcttgagtcgtggcactacattccagcctaggcagcagagcgaaaccgtctcaaaaaaaaaaaaaaaaaaaagggatgtaaaagtcaatatgaatattaggtccttgctcagtattgagctcaataagaagatgaacaactcacatttaaaaattggcaaaacaggccaggtacggtgtggctcatgcctttaatcccaccgctttggaaggctgaggcaggcagatcacttgaggttgggagtacgaaactagcctggccaacatggtgaaaccccgtctctactaaaaatgcaaaaattagccgggtgtggtagtgcacacttgtattctcagctactcaggaggccaaggcaggagaatcgcttgaacccaggaggcagaggtcacagtaagctgagatcgtgccactgcactccagcctgggcaacagagtaagactctgtcttcaaaaaaaaaaaaaaaattggcaaaacagaaaaatgaacaaaatcttatcctttgcagcaatatggatgcagctggagaccattatcctaaggagattaacacagaaacagaaaaccaaataacacatattcttacaactgggagctaaacattgtgtattcatggacatgaagatggcaacagtagacactgggaactgctaaaggggagggaggcaggaggtcaagggttgaagactattgggtactatcctcactacctaggtgggaggatcagccatatcccaaacctcagcatcacacaatatacccatatgacaaacctgcacatttacctcctcaacctaaaataaaagtcgaaattatattaaaatattttaaaaaggaaatttgggcacacacaaagggagaacaccatgtgaagatggaggcagagattggggtgatagacctacaagctaagggacaccacagcttctccctcagatcctccagaaagaatcaaccatgctgacaccttgattttggacttctcgccactagaactgtgagtgaatacgtttctgttgttttaagctaaaaaagaaaacgaaaatgcaagcacgaacacattgttctctgcagtttagggaatcctagtagagactactgctcacatttgttctctcttctctgctttaatggccactaccttagttttatctcaaactattttcttccagaccatttccatggattttcaacaggttgtcttgccttgtcttcttccactagccctctctgctattcctgtggccctctaatccatcttccatctgataccagagtgacttcataggtgaacaatttcctagttaggctaatattcaaatatttcagtggtttcctattatgcacaggttagattcttacttacctgttgaatatcagagtttgtcatcatacggcacctgctcagttctacagctccctttcattaaattctaacaatactatggtgcttagtttcccagacacttaatgcatgtcatatctccgtacctttgcctatgcagcttcctctgcatggaatgaagctcctcctcccatattcccatgaacttctgtactcttcatctttcagaaacctatttaagtatcaaaacctgtacagtttttgctcatgccagtaaaaagtgaataacttgtacctctgcgttgcttctgtattattgctgatagtacacagtattatgatcgtcttttataggtctgtcttccatactaaatggcaagctcctttctaacagggagtgtgttttataatttttgtatcttcagtacctgtcccaccacctgatacatgtgagtgaggtattacaattttagaaggtgctgaaagtttttttcttaaatattttaagtagtcttcctgtattttaacttacactgtcattattcataagccatgaacaaagacaagtaagtacagaccttgtaggaattatctcaaatgccagtttattggagtacaaactcaattaggctaaaacttactgaggtcttggtttatgtaagtctctgttaaagggtagggagttagggattttttgtttagttggggaggagacaaatatttacctaactgtatagttttaaggcagaatgcattaatagtttgaattgtgttctgtagtttttactgagtgggttcctacttcattcgtttctcccagcaatcctatgaagttagaagactctttacttttctttgtgccttgaaaattctgcgctcaagtgcttgagctcctggcttctcattcgttaggtctctgcttaaaggttcttttttcagaaaccttccctgaccccttacctaaaattgcagccaccctactgctttgccccaggttagtttttctcttatgtcatcctttatttcctttataacagttactatagtctgtgatcatcttgtttatttgttcacttgtttatagtctctgtcctctgaaatatataccctatgagagaagggaccttatctattagcctgtatccccacatagtgcaatttgtggagtgtggtaggtactaagtaaatattgttgaacaaatgagcttacagttgttattcctgctttacagacaaaagaaacctggttccaagtatatgaaaatctggatttataccacagataaactgaattagttgtttactgaagtcctgttatgtgcaaattactaagcactggttacatagatataaataagacagctactgtatttgcatttagcacagtatctctacatagtaggtgtattagtctgttttcacactgctataaaggtaactactcaagaggccaggtgctgtggctcatgcctgtaatcccagtactttgagaggccaaggtgggcagatcatgaggtcaggagatcgagaccatcctggtcaacatggtgaaaccccatctgtactaaaaatacaaaaaaattagctgggtttggtgatgcacacctgtaatcccagctactcaggaggctgaggcaggagaatcacttgaacccctgaggtggagattgcagtgagccaagatcatgccactgcactccagcgtggtgacagagtaagactccatctggaaaaaaaaaaaagataatacccaagaatgggtaatttataaaggaaagaggtttagttgactcacagttctgcatggctaggtaggccttaggaaacttacggtcatggtagaagggagcgcagacaccttcttcacaaggaggctggagagagaagagtgaggagtgaaagggcaagagccccttataaaaccagatctcatgcgaacagcatggggaaaaccactcccatgatccaatcacctcccaccagtttcctccctcaacatgtggaaattatggggattataagaggtgagatttgggtggggacacagagccaagccatattattccacccctggctcctcccaaatttcacattcattttgcatttcaaaatcaatcatgccttcccaacagtcctccagagtcttaattcatttcatcattaactcaaaagtccacagtacagagtctcatctgaaacaaggcaagtcccttccacctatgagccagtaaaataaaacataagttagttccttttaagatacaatggcagtacaggcactgggtaaatacacctattccaaatgggcaaaattggccaaaacagaagggccacagggcccatgcaagtctgaaatccagtggggcagtcattaaatcataaagctccaaaatgttctccttgaccccatgtcacatctggagaacactgatgccaggggtaggctcccatggccttgggcagctccttcaagggctggcatcgagtgcctgcggcttttccagatgcatggtgcaagctgttgttagatataccattctggggtctggagcaggtagccgccttctcatggctctgccaggcagtgacacagtggggactctgtgtgagggctccaaccccacatttcccctttgcactgccctagcagaggttctccatgaaggctccacccctgcagtagacttctgcctggacatccaggtgtttccatacatcctttgaaatctagggtgaagttcccaaacctcaattctagacttctatgcacccacaggcccaacaccacatggaagccaccaaggcttgtggcttgctccctctgaagcagtggctcaagctgtatgttggccccttttagccatggctgggacacagggcatcaagtcccaatactgcacaaagcagcaaagccctgggcctggcccacaaaaccattttttccttctaggcctctgggcctgtgatggaagggcctgctgtgaagacctctgacatgtcctggagacattttccccattgtcttggcaattaatatttggctccttgttacttatgcaaatttctgcagccagcttgaatttctccccagaaaatgggtttttcttttttttgggggggcggggggaaggagggggacagagtctcacactgtcacccaagctggagtgcagtgacacaatctcagcttgctgcaacctccgcctcctgggttcaagtgattctcctgcctcagcctcccgagtagaactacaggtgtgcaccaccatgcccagctaattttgtatttttagtagagacggggtttcaccatgttggccaggacggtctcgatgtcttgacctcatgatccgcctgcctcagcctcccaaagtgctaggattacaggcatgagccaccagcacccagctgggtttttcttttctgttgcatcatcagactgcaaattttccaaacttttatgctctgcttcccttttaaacctaagttccgatttcaggtcatctctctctcaagtttcatcagtctcttgggcaggggcaaaatgccaccagtctgtttgctaaagcatagcaagagtgacctttgctccatttcccagtaagttcctcatctccagctgagaccacgtcagcctggatgttattgtccatatcactgtcagcattttggtcaaaaccattcaataagtctctaggaagttccagactttcccacatcttactgtcttctgagccctccaaagtgttccaacctctgccagttacccagttccaaaattgcttccacattttcaggtatctttatagcagtacccaactctctgttgtagcaatttactgtattagctttcacactgctataaaagaaataaaaacataaaataaaaatactaccccaaactgggtaatttataaaagaaataagtttaattgactcacagttacgcatgactagggaggcctcaggaaacttacaattatggtggaaggggcacctttttcacgaggcaggagaaaagagtgaagagcaaagcaggaagagcccattttaaaaccagatctcatgagaactcactatcaggagaacagcatgggggagattgccttgatgatttaatcaccaaccaccaggttcctcccttgacgtggggattatgggattacaatttgagatgagatttggatggggacacagagccaaaccatattagtagatacttaataattatatagtaaatatttaatttttatagtaataattatatagtaaaaatttgtttaacaatgagaaattgatttattctttcagaaaatgtttagtaagcacttaataaaaatcagaagggggggattgattgggaaagtactacaagagcaaactttctggggcaatggaaatgtattttgtcttaggtggtgtttataggtccatatagttacaaaactcatcaaactgagcgcttcacaaacacaaagcttggccaggtgcggtggctaatgcctgtaatctcagcactttgggaggctgaggcaggcagatgggagtttgagaccagcctggccaacatggtgaaaccccatctctactaaaaatataaaaattagcagggcgttttggcaggcacctgtaatcctagtgactcagaaggctgaggcaggagaatcgcttgaacccgggaggcagaggttgcagtgagccaagatcatgccactgcactccagcttgggcgacagagcgagactccatctcaaaaacaaacaaacaaaaagcacaaagctcaataaactgaactgtaaattaaacacttcaaacaaaagtaagttaaataaattgagccagacgttatatagacactggggacacagatgatcagacaaataaggtccctgcccttgtatctctctttttcttttattttttattttttttatttttttgagatagagtctcttctctgtctcccaggctggagtgcagtggtgagatcttacctcactgccacctccacttccgggatttaagtgattctcctgcctcagcctcctgagtagctgggattacaggcgtgtgccaccatgcccagctaattttctgtatttttagtagagttgggatttcaccatgttggccaggctggtcacgaactcctgacctcaagtgatctgcccacctcagcctcccttagtgctggaattacaggcgtaagccaccacgcccagcccccttgtatctcttatattgtgagtggggaacatgataggtagatgcagccattaaaatttatgtttccaactgatattaaggagttggggaaataatataataatctgacataccattaagtgaaaaatgcaatatagccttattttttaagcatttacagcctatgtatttacataccaaaaaagagatacatttaccaaataaatacataaatgttattttttataatcctaagacaaaaataaataatatgctgaataaaatacattattttatacaaaaatttgcttggtgtggtggcgcacgtccataatcccagctatttgggtggcggaggcacaagaatcacttgaacctgggaggcagaggttgcagtgagccaagatcatgccactgcactccagcctgggtgacagagtgagactatctcattaaaaaaaaaaaatattttaaattattttatttggtcaggcacggtggctcacgcctgtaatcccagcactttgagaggccaaggtgggtggatcacctgaggtcaggagcttgagaccaacctgaccaacacggtgaaaccccatctctactaaaatacaaaaattagctgggtgtggtggcgtgcgcctataatcccagctactcgggaggtcactgaggcacgagaatcgcttgaacccgggcagtggagattgcagtgagctaacacgacacacactccagcctgggaaacagagcgagacgctgtctcaaaaaaaaaaaaaaaaatttttttttgcacattatttacagttagtaatattttcctttcaaagtatctaaaatatctgtaatagctgaacatatatcaaacagatctatagagactagcacatgtaaaattttttttaagtttcttgtttgattcttctgtatttcatctttcttcatataaaatcagccttaattgacagagaaatattctatgtactcattcatatgtgggaactaaaaaagttgatctcatggagatagtcaaatggtagttaccagaggccaggaagggtagggagggagagaatgaagagaggttggttaatgggcactatagtacggttatatagaaaaagttctagtattcaatagcataatagggtgactattgttatcagtaattttagtgtatatttcaaaataggagaggaaatttggaatgttctcaatataaataaatgataaatgaggtgacgaatatcccagttacactgagttgatcattgcacatcatatgcatgtatgcatgtagcaaaatatcacttgtaccccataaatatgtacagttattatgtatcagtacaaaaacagcctgaataaatgtacttacagtcatttgaattgagcttttcaagctgtattgctttcatgtataaagtttttcagtagttaaactgtagttggttatctttaaaaagtagattatgttaagactttggtaagttattactttgttgtaggaggtaatagtacctctcatcactgtatttttaagcatagtgttttaccaaggaattaagtgttcaaaagaatattttctgaagtggattttaaaacagtagtaataccatttgttcttgaggtttgtgggttaagataggaaatgctatatttaagagtctaacattaaggttttcaaccaggcatggtggctcacacctgtaatcccaggactttgtggggctgaggcaggcggatcacttgaggtcaggagtttgagaccagcctggccaacatggtgaaaccccatctctactaaaaatacaaaaattagccagacgttgtggtgtgctcctgcagttttagttacttgggaggctgaggcaggaggatagcttgtgcccgggaggtggaggtggtagtgaccaagagcacaccactgcactccagcctgggcaatggaagtgaaaccctgtctcaaaaataaataaataagattttcatctttgcgttcccattcactcgctttttgataaatttaagctcttatgacttctaaaatattgtaatatgtacaataatacttaatgttattctacattgaacaaacatttaatgactgctatttcgagttacatactggatgctggggccaattgcaagctaagataattagtcagataaaacagaaggaactccatatgcaaagaactcaaaaaggctgcttactagacagtagctttcgctggcctcaggtacatgaagagaccatgtttgtggaagttgaagctggaaaggtagccttgccattctttggagatggcaccttatagagccaatgatctatagtagcattgtccagtaaaactttgtggtaatggaaatgttctctgtactgttcaatatggtagtcagtagtcacatgtagctagctattgagcctctgaaaggttaccagtgtgtcttagaaacagcattttacattttacttaattttaatttatttacatgtgaatagccacatgtgtttgttttgttttgttttgtttttgagacagagtcttgctcttgtcacccaggctggagtgcaatggcatgatctcggctcactgcaacccctgcctcctgaattcaagcgattctcctgcctcagcctcccaggtagctggaattacaggcgcctgccaccacgcctggataattttttgtatttttattagagacggggtttcgccatgttggccaggctggtcttgaactcctaacctcgtgatctgccctcctcagcctcccaaagtgttgggattataggcatgagccaccacgcccacatgtgtatattaaccgtgttttcaattttctgtattttattatgctttaatatcttaggagccttgttggctgtggagacaatttaattcctagagatactaaataacttgcctgtgagcatgcctttcatatgcaaaccaaccaatccaaagcccatgcccccaaccacctcctttatctaacccttacacatgaagtcagtatttctccagtcaatatttctcctgccctaagtcaccccagggacaggtaggagacgactagggaccactacttttgcccagaacccactgaaattattcaagctagccagtcctgaacagtttcctgccttgccttttccatggaaaccacagtaaaggcctgtgcccatgctttttccctttcctctttcttcctcctgatcaaccctagtacctctcatgtggccctgcattgcatagtgtatcctctcctcttgggaactataagtaataaactgttatttcaagacagtttctacaagtctgttgggtacaaatctaaacagtatggctagtggtgcccatattgaatagcacagatcttatacctaggcctccttctccccgcaaaaacagttctgtgttatctccagagctttaattcactcaaagaacctatttggagtgtctccactttggttatgagaatgtaacagccagcatggcagacaaagttcatacttttacagagttttattctggtaactacaagattatattcctgaagatttttgcccatatagcattgtcaagttatttggcaaaatatttttttcaaaggagttgctagtacttcctcaccaatctctataatctctgaataaaagctaccatttattgtgtcttttttgccagccactcttataggtgctatctatgaaaatggtagataaataggttttttcatttagatttctttggcatgatgttatatcaaaaataattccattttggaagagttcatattgtctttctttcaatagttaaatagtactattatctcctgagagtagttttaccaagataggcacagattttaattttagatctattgggtttgattcatgataactgacaacaggctttggatttagggtgtcctggactaaacctgcttaggctacagttttctcacatgtaaaatggggataataatgatacctaccacatatagttgtttaagctaacatagtgttaaatgagctagtgcccttatacccttagcataacctgttcatttatctttaatgtttattagcatgagttagcatattattttctgtttttctcttttctcaactaagctatttccacatagtgcctagcaaggtatcagattcggcattcagtgaaggaagttaactggtaattctataagaacagaaaagagcccagcagaggcagggtgctagcagacatttgataaatgtatgttgaaatgtttatcttggtttcctggtatttttgtgtccacatgcatagggactgtttcatttgtatcacttatattccctgtccccttaagacaggctaggtactccaaaaggctttaaatgaagtttatggaattagatgtatcttaaaatgagaacattcaacatagaaggtttcaatttgttctttaaaatagtagcttttacacaaaatttcagtgttctttagcaacatttaccaaaaatgtaccttaaagcatcagaggacatgttctctctgatattatgaatcagtggtaaaaattctgcagatattctgttgtatgattttgacatagtattaaggagataaaatgttttcttaacttataaaatatacattgaattttgtttatagttatagtgatcataactcctaaaataaaaatagacaaacacaaatagacttgatgtagacaatgagataggatatttgaaatggaacctatttctgaaaagttaggtttctagtttcactggtctcaaattataaataaagtaaggtggtctttggtagagctggctttattgtgttatttattcacagttttatggatccattaaaaaggaattaatgtaaaaagtaacaaagaataagctcaaggatgaaacgacatgctattttgaattcttttccaagagcactgcagattctgacacatctacatgtttagtttcagaatggcttcggttattgcctttccttggtgtactcgcacttcttggctaccttgcagttcgtccattcctcccgaagaagaaacaacagaaggatagcttgattaatcttaaaatacaaaaggaaaatccgaaagtagtgaatgaaataaacattgaagatttgtgtcttactaaagcagcttattgtaggtgttggcgttctaaaacggtaagatgtctgtttacgtgtacactaaaattttgcagtgctaggattgtttcgcctcttaaatccccagttttgaagttctttaagatgagagaattttctgtaatatttggtattgaaagaccatattcctaaattgaagttttcatgtcatgatagatactacctacattagaaaagttggagcagcaaagaagaataaaaatctaatgccttcgcaatgtttggcatttatgtagagtaacatgtattttaaaatacacattctttgagagaggacctaaggtttaatggaaaaaagctttggtgtcatagtaaatagtggtcaaatatacttgtcacagtatgagtttggttggacaagttacttaatttttaatctctaatcttcagggtttgttttaacctgatacatccacattacatatctttgagaagtgagatgatatatgtaaactgctttaataatatgaggtagtaaatgatagcctcaattatagatgatttttaatgtgggaaggagtttggagtgataagtactataagtagttgacaaaatctgtttcttgtacttgatcatagattatttgaggtttttaatacagtattgctcatcacagcatcctttgtaatagcaaaatttttataaactaaatatctgataaaaagggaatgatcatgtttttaaaggatatataatgacatgagatcctgatatgagtaagaaagcatattacagtgtgatcccaattttgtttaaaaaacgaatacacgcaggccaggcgcggtggctcacgcctgtaatcccagcactttgggaggccgaggcaggtggatcaccaggtcaggggttcaagaacagcctgaccaacatggtgaaaccccgtctctactaaaaaatacaaaaaaaattagccaggcgtggtggcatgcacctgtagtcccagctactcaggaggctgaggcaggaaaatcacttgaacccaggaggcagaggttgcagtgagccaagatcacgccactgcactccagcctgggcgacaaggtgagactgtctcacaaaaaaaagaaaaaaaagaatacacacaataaatgcataggaaaaaatataccaaactgttaattattattacgtgtatctggatgggttatgagtgaattttttaaaatttatttttatttattctttatttatttttgcgggggacagagtcttgctctgtcactcaggctgaagtgtgatggcatgatctcagctcactgcaacctccacctcctgggttcaaggaattctcccacctcagcctcccaagtacccgagacacaggcgtatgccaccacgcccagctaacttttgtatttttagttagagatggcgttttaccatgttggccagactagtcttgaactcctgatgtcaagtgatttgtctacctctgcctctgaaagtgttgggattacaggcgtaaactaccgcaccagcctaaaatatatttttgttttcaaaaattgtgtggtatgcatgagttttatagcaagaaaaaattataatttattttgaattaaattccattgttttaaaattaagcaataggtgagctcgaattttaagctccacaaatgaccaagaacttattcgattcccttttaaacctgttgtctattttaatcactcatatggactcattcataggtttttatttaaaatctaaaccaaataatgaagtaactgtttaaattgttagattttgaatatggttcagttggatgtagaatgtaactattactcaggaaaacgatctgattttttttagcaagtgatatgctttctttctgagagcatttcacaaatgtttctacctaatgaatcatattttaaaaataacacttgtaattcttttttctttttagtttcctgcctgcgatggttcacataataaacacaatgaattgacaggagataatgtgggtccactaatactgaagaagaaagaagtataataataataacaatattttctcattctttgtgtatagaaaattttaaaatggtggtcttaattattactactggttgaacaattatttcttccaatttattttcttcctgcactactgtttgtatttgatcctttgtctattcagtcacttaattagaaattaaattgtcaagcctcttattctgacttcaaagaattaatgtatcttccaacaataaaatcacttctgattttaatctaggaaaacctaaattgtggctatggatccaaagctgtttgtttctttgaatatcaatattttcaacaggatcttgtatttaaaattcccacctacattgttaaatatgttattttttcatatctcttttggttttgataatctgaagtgtttttttctcgttttggccttccaaactgcatttggttaggtgaattaagaaaaatattgccatcaagaattacttgtgttttcacagagatagactctttgctttatagagattgttgtgtatttaatatgaatatcccagctttagaaaagaagtaaactggatacaaaaagttccattgaggaacagttatttacagtataaaagatttgtttactttacaaaaggcttgtgtctgtgtgtgtgtgtgtgtgtgtgtgtgtattttaaactgactcagtgacagctggggtggaatggcaagaacacttacaaccaaactcatgggctgctgcaatttgaagatcaattggtaataaacataagacattaattcatattaaaatagttcagtgttcaaaattgtgtttatgtggatatttttctctttttaacactataaaccattaaaatacagtcatcccttgtatacgctagggactggttccagggccacacatataccaaaatctgcccatactcaagtcccacagaaagtcttgcagaacccatatgtagaaaagttggccctccagttgaccctccgtacacatgagtttcacatcccatgcacaaatgctgatctgtgtgacctcacctgcatttgattgaaaaaagtatgcgcgtaagtgtacccacccagttcaaacccgtgtgtaagggtcaactgtacaaaaaagtttgtgaaataaacgtactggagaatctttaaaatttttgtgctttttaatcctactattatgaatctttttagtttcatcttacattactactctcataatagctatccttagccaggtgccatggcacaggcctgtagtcccaactgctgggaagattgaggtgggaggatggctgcagtacaagagcccaggagttcaaggccaggctgggcaacatagtgctccgcctctgctgggctctgtagggaatcctttctgttgtaaaagagttaccatttaactcccttcactgagtgcgtttctgagaccttgctaggcactctggaaactgcttagttgagaaaagacaaatacaaaagcttttctttagtctatttaagatacagtttattcagttcactttgctttctttttataagaatgtacaagaggcagacagaggtaatccttctagaaataaaactaattgttattgggcacttgtatgtaccagacactacactaagcatggtacttgggtttttaatttattacatgtaatgtcagtaggttcaattatatgatcgtaacatcttcatgaccagcagcatgtattttagagttagaaatgtagtctggtttttgagaagttttacaaggtgtatgtccaaaattgttctttcctcacatgtcagtgggggataaatacagcattgctctcacttctttgactctgggtgctttttcggatacattttcttcaacactgttaaggggcctcactgtcagattaaccaattatttttccacagttggtcaccagactttggaaaaaatccacctcaccaaaattttggatatcctgatctgtgttcatgaaatgctcttctttttgtaaaatctatcactgcatctcacagcaacttgttttcacacatgttctagtggttcccataacttagattttacaggaggcaaatttactaaaaatgaggagactaaaatgaatgaccaactttgaattttgtcaaataacattgaaaatgaattatctcataaaaggtaattttaataccccaaaagtaagatggttgtactctcagaataaagacttttccctgccacattttcagttgttaaaatatgctaagagctatgcccatatcttttcccacctgtgcacatttttcagaagcgtagggttggtagtaagctgttgctttaataactcctttaaataagcattattagcagtttgcattacttcttgtaaatttacacaattttatcttgtccatctttaaaaaatagacatctaataaccaaatgtatttgaattgatgcagtgtaagtaacttgtagaacttgaggataagtggtaaaagaaaaaaaaaagtaacttggctcttgaaatacatgtcttcggtttctagagccttcaaaatacagccctgttgttactgcgtcacattatgattgttttgaggactgcttctgcttacctaggaaactactcatgccttactcagcaaatgaacatcactattacataaacatcaggtatccaaaagtgttagcaggcttgaggtatgaatgattcattcatatgggtaattaagcaagttgaattatggaaagcacctcacaattcacacaattcagctttgagttcaatgccaaatacgatgattcattaagttgcctttgtattttgtaacctaatttgttaataagtaagttacaggaagccaattaagccagctgctgatctatatagtactaccttcctcattgtgattccatagtcttccaatagaaatgtgctgtcagaatctgtatagagagtttgtaaatgccactatttaacaaggttcttaagaatttaggtggatgttttatttgatacctaccaaagaagcctaagtaattgtataatacttaacccatttagaattcagttgtggcagcataaccaatctggagagaccaggggagatgttactaatgcttgtactttattcagaagtgagtgcctcattggcttggtgcagtgacgacacacctgtaatctcagcactttgggaggctgaggtgggtggagtacttgatctcaggagtaccataccagcttgggcaacgtggtgagatctcatctctacagaaaaatgcaaaaattagccgggcacagtggcgcaccagtagtcccagttactcgggaggctgaggcacaagaatctcttgagttgaggaggccaaggttgcagtgagccaagattgtgccactgcactccagcctgggcaacagaagtgaaaccctatcttaaaaaaaaaaaaaaaaaaaaaaaaagtcttttttttttttcatctaatcaaatttattgtggcagaaatcagtacgaagttcgtaggacaggaggaaaccaatataaatatctcagcattgtaggaaatttaacccatggaaagcaggggtgaattaaagaccactttgaaggctgggaaaagcagataatttagatatagtcaaagtatgaaatcattgatagatccagaacaaggaaatgatgtatgtgtttacatattacatctactttattaacaattttccctctgttaaactaatatcgactaatagtagtctaggtaagtcaagttcaaattaagtggtaattgaaaaagtcttctttttaaaaaatttttaatggtagaggcagcagctacccagagtctacttattcttacttcacattgaattctaacaagtttggttatctgatttctgcttcttaacaaatcacaagtatcaaaagggtcttgcagaaggggtgaactacagaatgtgacagctgacagcaagtcaggggaacaaaaataaatttaaggtgaacattaaaggcatagcagcttgagacaatttataggattctgcatacaactgtctctgaggacatcactgtgatcaaattatacaagtgatgtttagtgatgaattggaatcaagataagtagtatgtgttattcaaaaaggcaggatatgtgttgcatttggtggtaacaatttccccttagctatttagttaaaagcttagtgcttaacatgttggaaaatttatatgtaaaatatattgacttactcgatgattggaggctttatcacaggaagttttcccattcaattgaaacatttttcaagcttaatgactataatttactacataattatttattttgttaaagtttgaggaaaactaaataaagcagtagcaatttaagtcataataaattttgttagatgacttcttccactttagggggaattaaaaatcatgtttaaaaaccacatgtgcagcagttctgtgactccctcaacatccggttggccatatagtccctttgcaccacagaggttggagtatagaatatgcccaaagctgttttgttttgttttaactatgcttcatcatctgaggttgtgttaacatagtttgtcctaatagtcttttactggaaacttgctatatttgatcatgttcagcaagtaaactaattttatctactttcatatattttgagacaaagtctggccctgtcacccaggctggagtgcgggggcatgatcgtagctcactgcagcctcagcctcttgtgctcaagcgatcctcccacctcagcctcccaagtagctgagactacagtcatgcttcatcatgcccggctaattttttatttttctaagagacagagtctcactgtgttacccaggctggtctcgaagtcctggactcaagtgatcctccctgcctcagcactcccaaagtgctgggattgcaggcatgagcaaccatgcctggtgttttatcttttgcagaaatccaatttagtaaagtcatgttgtagcaagcatcactttaatataaaaagtgtacagcttatattattagcaattgtactgtttaattttatattagttatggtcttgaaggacattgaaaatctgttcagaaagactatgtttttcaaccagagatgacatcactctaactttcctttggtttaaatgcttgattcttcgcttacaaaacttctgttttgaacaactatggtgagaaagtatatttgtgatactgttttcttagaacactgttgtcagatagatcagccataatgttaacacatttctgatctctattataaggctgtaattttccaaaataatacagaaaaggagaaaagggtagtacatttcataattagagataaccctgtactagtgagaaaataaaaatgtcaagtttattaaattttcagatttcctgtaatttttccattactatccctcataaatttctctgcatgatcacactaaagatataaattaatcacatccattcaacaaattaagaaactcaaaactcacaagtacaatcttcaaccctatagaatgctaccaagaagtaaaataagatgaaggtagaaagattctctttgagggccaggtgcggtggctcacacctgtaattaattccagcactttgggaggccaaggcgggcagatcgcctaaggtcaggagttcaagaccagcctggccaacatcgtgaaaactcgtctctacaaaaatataaaaattagctgggcatgatggcggatgcctgtaatcccagctactcgggaggctgaggtggaagaatcgcttgaatccaggaggcagaggttgcagtgcgccaaggttgtgccattgcattccagcctgggccacagagcaagactccatctcaaaaaaaaaaaaaaaaaaaaaaaagaaaaagaaaaaagaaagattcactttgaaatgctgcatgcaactatttagcaacacattggaaaatctagagaaaatgggtaattttctggaaaaatataaatgaccaaaactaatccaagaagaaatttaaaatgttaatagaccagttacaaagaagagaatgtaaagtgattttttaaaatccataatttaaaaagtactagggttgcaagaaggataattccaatgttatttaaagtatcccaaattttttttaaaaagaaaaaccaattcatttcacataggcagtgcagcattaatatgaaaacctgataaacataagacaaaactgtaggccaggtgcagtggcttacacctgtaatcccagcactttgggaagccaaggtgggtggatcacttaaggtcaggagttcaagaccagcctggacaatatggcgaaaccccatctctactaaaaatacaaaaattagcctggcatggtggtgcatgcctgtaatcccagcttgaacccaggaggcagaggttgcagtgagccgagatcacgccactgcactccagcctgggtgacagagcaagtctccatctcaaaacaaaaaaacaaacaaaaaaaccaaaactatagaccaatctgacatacatatgaatgaatattctaaataaaaacccagcactgttatcaataattgcaacaacaaaaaagagtaatacagtatgcaaagagcactgtatttcaggaattcatgggtatttcaatatcagttaagtatattaacacaattacataaatgacatcaaagaagagaaaaatgtgattatatcaataaatgctgagagggctattgttaagattaaacatccactcctaatgaagattcttgagtaaaatagaaattgaaggaaagtgtctaaacataaccgttatttatgaaacgcctacaaaacaagtattttaaatcatgaaacaacgtttcaattaaaacaaggaaccagtaggaatagctgctgtcattatttgttattaaagattatcttggaggatccatgaatgtaacaagatttttaaatgaaataatcagtataaatatatagaaaactttttgtggatatgattatatgcctaggaaatcatagagattaggaaaaacagaaatttcaaatattttaaagaggaatattggtaagttatttggaaataagatgataatacaaaatatattagcaataagcaccttgaaatgctagtggtaaaaatattcacaataacaaaaataataaaggtaaaataaatttaccaagaaaggtagaagatctataagaaaaaaactataaaaatgttaccaaaagctactgaataagaaacacatgaggctaggcgcagtggctcatacctgtaatctcagcactttgggaggctgaggcaggaggactgcttgagcccaggagttcaaaaccagcttgggcaaattgtgaaacgctatctctaaccaaaacaaaaagctagttgggcttggcgcatgcttatagaaccaggtacttgggaggctgaggtgggaggttggggcttcagtgagctgagatcccaccactgcactccagcctgggtgacaaagtaagaccctgtctcaaaaaaacaaacaaaactcttgtaaaaacataaatctaaaattatatataaattcaattaaattcacattagaatcacaaaagcattttaaaattggattaaattatcttaaagttcatgtagaagaatagtcagaaaattgttccaaaaaaaagactattgagaggaacttttctcagcagatatcagcacctactatagaactattggaattgatcaattaagaaaaacaattgtattaagaataagcaagagtggtaaaaaattgagaatctacatgtagatgaaaaattaatatatgaaaataaacaattcaaagaaaacaaaattggaccctcaatttacactgaaggctttgaagtgacacataaaatgattttttaaatgatttaaatacgtacataaatggagacaggaagggtgggagagaagcagaagagaaagaaaatagaagactaaagaacaggaacacctatgtggaaaaaggtaacacttaatgacaaaatatgttttatgtgaatatcagttatacataataaatattggggacattgccttgtgggttataataaagcattaagaaacagagtagtgaacaaaaaaaggaaagaaaactaccaaattccatgtatgataccccattttaaaattacataaattaaatgtgtacacataagaaaattttaaacattaaaattttgttaataaaacagatttgataacacgaaggccaatgatgaccttacccacagcagttttgtttaaatggggactaaggatggagcaaaatttttagtagagcactttgaataatgaattagcaaactataataaactgaaatcttacctaccaaataatctcagtaaacaaatctaaaagaaatgagtaaaacaattgtgagcaaaaaaggatagagtcactacatataatgtaaatgagacaaggatggcctctgtgtattggtgcctaggttatttcttcacagcaagctgagacccattagctcaaaagccaactggcagcaaactcaaatttttaaacatccaattgtgttaaacattgcccagacatgcagatttgtaggcatttagagcctgcctgatttacatgccctgggaaactgtgtccaaaatctgcctgccacagataaaccctaggctgtaaagaccccaggctgcttctgctctttggaactctgtgaactatagactccatgccatgctgctgagtgatatcactgagacatgaaagcctcctctctgatcctttcctccctcaggagttcctttgccctcctccccttctgagtggtggcccccttgcctcaatcctctggtccatctcttgctgtgaaggccttccccaggatacaaacctgacgagatcatccagataaagcccatgtgtgcttctgtcacatctttttctatatttttctcacttttttctaaacttttctaattttttcttaatttttataaaattgtggatacctaataatgtagtctcaaaataaataaagccaaaattagaactggaaagagcaataaaaaaatccacaaacatagtgagagattttaacaattcatttttagtaattgaaaaaataaacactgcacaaacttcccgaggctccaccccgtaatcccagtgcacaggtgggcattattcagaatcagtggggaaagggcggcttcaaccaggacccgcagtccagtttatctaacagccttcaggctgttttagtcttgaaggtggggttttaccgggggacccttggttgcctcctgtctctatcactttcacattaggtgctttgtggtgaaaatggtttcaagggtgatggcattgtacatattgagacacagaagcagctgaaagttctattaaaaaatgaaatggatgcttctaaatgacagcaaagtctttgttggattaagtcttgtaaacaatgagaagcagaactcagagttaaaaagttcaccaatgtttacaggaagatttttggagaagacatggatggtaggtgccttaaagatctctttggcaagttgggatctgtcttaagtgtgaaagtagtggttaatgaaagtggaaaacccaaaggttttggatttgtcagctttgaaaggcataaagatgcgcagatgagatgaacagaaagaagctcaatggaaaacaaattgatgttggtcaagctcagaaagaagtagaatggcagatggaacttgtgtgcaaatttgaaaagatcaagcagtataggatcaccagataacaaagtgttaacatttatgcaaaaaatcttgatggtattgatgaatgtctctggaaagaactttctccacttggtacaatcactaatgcaaaggttatgaaggatggttgtcacaacaaagggtttgatttgtgtatgtttctcctctccagaggaagcaactaaagcactttcagaaatgaatggtagaattgtgggcactgagccattgtatatagcattaactccatgggaagaagagcaatgaagagcaccaggctcagctcattaaccagtacagtatgtgcaaagaatggcaagtgtaaaaactatgctcaacctgggaatcagcctctatcagccagcaccttcttcaatttacttcatggtagttatcccacagactgacagccatgctgcaaagtattctcctagccaaactgctcaactaagatcaaatcctccctaaattgctcagggtgccagacctcatccattgaaaaatatgcccaagccactcctagctcactacatttagtagtaagagaccagcttcttcacagcttccacgagtcatgtcaacacagctgttgtaacacatcaacacagacaataggagcacattctgcagttgccgctactgctactacagatactcctgctgtttgcaccatttcacagtataaatatgctatggaagttcacaatcctcaatggcagtttcatgcacagccccaagttaccgtgcagcagcctgctgttcatgtagaaggtcaagaacctttgacttccatgatggcatctgctcctcctcaaaagcaaaagcaaacgagtgaatggctctttcctcttcttcaagccatgccctagtcgtgctggtaaaatcattggcatgttgttggagattggttatttagaacttcttcatatgcttgaatctccagagcctcgctgtactaaggttgacaaaggtatagctgtaccacaagaccaccaagctaaagaggctgcccagaaagcagttaatggtgccactggtgttccaattatttaaaactgatcagggaccacagaaagaaacttgcgcatcactgaagaaaaaatctcaatatcaaaaaccttaaatactatggaaaaaatttgtaaagtataaaataaatttaaaaaggaaactttgaactttacataccaagcaaacgtcagatctaacaaatgcaatgatagtcctagattacttactgatttgaaaacaaaaaatcctcccaaaataataaaatataaaaatgctgcaatgcttttcagactctgtgataaataattttcagcaaagtataaaaatttaaagcattcctttaattttgtaattcgttagtgtggaatagctcagaatgtcacttctgttttaagtaacagaattgataactgagcaaggaaaggtaatttggattataaaattttgctttaataaaaattccttaaacagtgaaaaaaataggcaaagatacaaaaagttgataagaaacaacaatcttgtatttatttgttattttatttttttgagacggagtctcgctctgtcacccaggccggagtgcagtggcgtgatcttggctcactgcaacctttgcctcccaggttcaagtgattctcctgcctcagcctcccgagtagccgggactacaggcacctgccaccacgcctggctagttttttgtatttttattttttttgttatttgtatttttgtatttcaccatgttagccaggatggtctccctcccctgacctcatgatccacccgccttggcctcccaaagtgctgggatggtgtgagccactgtgcccagccttatttgtttaaatactataaacactaatatcatacacatggttaactggttgtaatttttaaattatattaataaatttttataaaaactttttataaataaaaaacttaaaatttcaaataaataacaacatctgccacaccaccttaaaagggcgactatttcagtataataaacatatatcacagacacttagagaaagttcaataaataaagaataaaaagaatagttacaacaattttcctcctaatcaataacacaattcctcattttgaaaattatttatctctcttttattaaaataaactttctactttgaaatctaatcctcttgtgaatgtaaaatactatcttgtaaatatatatatatatattttattattattattttttgagacagagtcttgctctgtctcccaggctggagtgcagtggtgcgatctcagctcactgcaacctctgcctcctgggttcaagcgattctcctgccttagccttctgagtagctgggattacaggtgtgcgccaccacacctgacaaatttttgtatttttagtagagacggggtttcaccatgttggtcaggttggtctcgaactcctgacctcgtgatctgcccatgtcggcctcccaaagtgctgggattacaggcatgagccacaacaccctgcttatatttttattttcttgtaagtgacaatgagatgccctcatgatttaaatagtagtcaaaacactggcacagtttaaatttttagaatttgagtactagaattacaatatttgaaaatggagtctgtactttgttgtaaaactataaggagaaaatgtcactaaaatagtagctattttatcttttcccagagttattctcccagagtgtattttctaagagttatttcccagaaggttttagaacttctggcagtttcggtgatatattctgtaaaagcccttagtcttaataggaataacacatagttttgattgccttaaattttaattgcttcacttggcaaatttatgtgtaaatgtcatattctgtggtattttaataccttgcttgtggagaagaggaaaaagaggaatgaaagtaatattcagtccttgcattgagcttttgccaaagaagtctaaacaatttctaagatgccattcaataaggccattttagaatcgtttatatgactcttataactttaaaataaagagtcttgaagttaattaaaactcactttgcttgtgatgggttctacattaacatggcagatttaatcagccagaattaaaaggtaattctatattactaaggagaagaaactgccacatgacagcagtctccaaatctttcatttttggaggctgccttttatgcctagattttaaaatactaattgaaaaaaatatagtttacttccatttgtgatttaattttatttctataaataaaaatatagatagtgtttcatctaaaaactgctaaaccagactttcattttaagggcatggcagaagtaaggaaagactaacttggttctattactgaacatattatttactcaggtagtcaccaaaaccagaatttaaaatctatttagttaacccatttaaagttgatgtgttttattccttttctttctttttgtggtgatctttttaactgaattactggacatcatgggagttctactccttctatttggaaacttaggctatcttaccaagttcaatattcaaagtttttctttctgccattaagtttgtttaattttatattaagctcagtttgtattatgatatcaaattcagcctgagggattactttaaactttcctagggtatttacagatttaatttgttcttacagtatgtaaataccaagagagcattccatttaatattatttttattaaattaactttggagtaaaaagtccaagaaaagccctgtactgaaatcacatgtttactaaatcctggattctctgtacagtccccacatatttctactttaaaattcttctgtcatgtgaaataattcattaaaagaagcaggcagatgatgacaggtaaactttttaatgatgttctaatgttgacaactgcagttttattttgcttggatcataatggcgtgtaagcattttaggccccagaatgcccataagtagagctccatttggagctgtgatcaagatggctaaaaatgctactgtcatcacatccttcgcatatggttccaagtggggtgcggagactcttgctgtttctagagccagaggacctaacacagcctgcatttaggggtaaaaatggggcataaagaaaaatattaaactgagttgatatataatgtaaatggctctgttaaaataaacaaaatctagtactagactattagaaaaaaaaagtactcagtaattttcataagttactcatcagttccatgttcttcctagcaaatatatgtggaggaagagtacaatagtgacaaatcagcaggcaaacatttttgggctgattttgcactcttgtcctctcagtgttcctctattcgaatatctcttttgagtgttcatgttgccctcataacaccaggagttctaacgaaaccagttttgcttagttgcctttaccgtgtgcaagtggttcttgactacaacaagacaacataaaatactaaggtttcttatggttctctaggatttgttgcccttcttctcattgttctccctattcagggggcactgtgttatagcagaactgacagcaggcttggaatctagcaaaccgggtttgaattctatttttgctgcaaccaggctagtgaccttgtacaaatgactcacactctctaaccttctacttacttatgtgtaaaatgaagaacaaaatacttatcttactgaatggttgtgaaaattaaatatgagaatgcaaagaacagctggcacacagtaggtattcagatagtagtaagtttctctctccctcactcctcatgccctgccaggtcagagaatgagttcctttgaagttttcgttttagaatgactgtactgggtcacaagtttttttccctagtcaccttctaccacattatttttaataacataaagcaaatttcttgctaaccctctttctttgtgtttaataatctaggcatgaaattgccttaaaattttggggaattaaataccaatatataacatattttctatggagttgcaaagtaacaacataatggtggaaacattacctctgatatggaacattatggcaaaagaacccctcaatttaagatcaatttctatatcctaaatcaataatttaaaatggtatcatttttatatcgtaacttttaatgtactgaacgtgagccagtgtgctggaggatgctagggagaaaaagataatcatgcagaaaaccaacttgaaagaatcttacagtttagaagaggatttgaacataaaagaacttccaacagaaaaaacaaaaaacaaaaaccaaacccattgacttttaagagatgattatgataatggtgaaactagaaataatatttatatagttatatggcattcatcatatggcaggtatcattcttaaagctttccatttatcaattcatttaattcttacgacaaccttattatgtgaggactttattagatgataaatgatttcctcctagtgactgagatttaatattatttctttaaaagaatccaattgccaagctgatcttacatttgtaaactaaattatttatttactctcctaatagcttcatttttccactctaatttttatcagtaactcgaaactgaagaacaagagaaagagctgaaccttagccaattttatgttagcagcagagaacggtggaagaggataaaggtgaaaataatttaaaattgaaatttaaatatttgttgatcttatttacttgtgacattatcgttatctattattgctgttgtgactctacttgtataaataattaattttttatgtcttgccagttcctggaaccagcttgatattctttgtgtagaagctagcctgaagccagcagacaggaataggcagaagcagaataatactgcaggactcgagtgagtggtctctttcctcatacctgcttttcttttttccctgctttatgaaaattatgaaataataaaacaaaattgcgagagtattgttggaaggagagagaacagatactccttttgtagatttattattccctacagtagacattaaaaataaaaagttattatttatattacttgaaggtaagataaaataacaacattgttaattgagcaccaccatatgccagagagagtgctaagcactttacgtggattatctcattgaatcctgacaacactgctaagaaacagatacagtcatagacttcattgtaagatgagaacactgaaggactgagagattagaaaataattttcctgaggttataggcaagtaacatggtattcaaaacaggtagtcaggccctatgaacctgcttttctaacatgataatagaggttttttttgcatgaaaatttaggagcttctgttttggaataacaactaagaaaagagccacaggaaattaaggtatattatgctgccaagttaaacagtctaacaataagtagcaatatattttaggaggaggagaatatccttgaataagagggcaaaattacaaggtttccctttctgttcattcattcttgcaggcatgcaatacacatttggctcctgcatgtcaggcactgtgttaagtgccagggagaaataatgaaaaacaactgcaacaaccagacactgtccctgtccttacgtagtctatcaagggggcaggggcagggatttagccattaaccaaatagaatacaaataaatgtgtaattaaaaacaataaatgtgcatttgtgtgatggagtgagtggcaaggtaggaaaagtattttttaaaaaatcaatgtgtctctattttactttactttttttttttttggagacagggtctcattttgtcacccaagctggagtgaagtggtgtgacctcagctcattgcagcctcaacctcctgagttcaagcaatcctcctgcctcagcccccaagtagctgtgactacaagtgcgtgccaacacacctgactaatttttttgtattttttgtagagacgaggttttaccatgttgctcaggctggtcttgaactcctgagctcaagtgatctgcctgcctcagcctcccgaagtgctaggattccaggcatgagctaccatgcctggcctgtgtctctactttttaaaatcataacatttagctttgttatattcagcaaaatataaaaactccaattttcagatatattcttattatatattttaggaaaataaaaaacattttcataaacttaggaagtacttattgaaagaatactttttaatttcaaaagaattgcttttaaaactgagatttaaaaaggttacattggctgggcccagtgggttatgctcataatcccagaactttaggaggctgaggcaggaagatcacttgaacctaagagttcaagaccagcctgggcaacatagcaagacctcttctctacaaaaaaatcagaaaaaaaagaccaggcgcagtggctcatgcctgtgatcccagcactttgggaggctgaggcgggtggatcacttgaggtcaggagtttgagactagcctggccaacgtggtgagaccccatctctactaaaaatacaaaaattagctgggtgtggtagtgtgcacctgtataatcccagctactcagaaggctgaggcaggagaatcgcttgaacctgggaggtggaggttgcagtgagccgagatcatgccactgcactccagcctgggcaacagagtgagactctgtctcaaaaaaaaaaacaataaaaaagcagttgggtgtggtggcaggtgcctgtgatcctagctactcaggaggctgatgtgagagaattgtttgcgcccaggaggttgaggctgcagtgagctgtgatcatgcgactgcactccagtctgggtgacagagtgagacctggtctcaaaatgaaaataaaaataaaaatagaaaaagattacattaaggttctttgtttttgtttatttatttatttatttatttatttttttgagatggagtcactctgtcgcccagactggaatacagtggtgccatctcagcttactgcaacctccgcctcctgggttcaagcgattctcccatctcagcctcctgagtagccaggactggttacgttaattttaatgaatagttatgatcaatcaaacatttaaaaagtaaggataatagctcatattttgtgactagagtaacatttttcattttaaattttaaaagcatcaaaatgaaagcattaagcaacaggcttaatatgttcttacctgtactgtagctttgggcatccatgctaaagcaataaatattttctccttaaaactaaaaccagcaaagcacatcaatagatatgtggttaaaattcgaacacataatgccaaacttagagtggcaacagatatgcctacaacagatgaaaacaaacataaataacaaaatatttgtgaagaagtgttcttcatgcccaggaatatgatttctaaaacttttgaaaacattttaaggctattgtctcttcatgtgcttattttttacataaaaacaatgattataaaaaatgaatatgatggaggattctctgtaaagtgcaagagagtatctgatggtggaagtaccatgaaaaataagacagatgacatttatacaattctgaactaatagacttcttttgaatacttttattattaataataataatttattttttgagaaggattcttgctctgtcacccaggctggagtgcagtggtacaatctcaactcactgcaacttccgactcccgggttcacgcgattctcctgcctcagcctcccgagtagctgggattacagacgcgcactaccacacctggctaatttttgtatttttaggagagagggggttccccatgttagccaggcaggtctcgaactcctaacttcaagaaatctgcccgcttcggcctcccaaagtaagattacagacatgagccaccacgcccagccaatagttttaaatgaaagtactcaaaaagcgctgatcgtatcaaatatgttccctcaggaaagaaatcttatatttatttcttcagataactcagggaatatattcagggctgtccttggtttataaaaaaaaaagagcacccagtgtaaaggaagagcaatatgaaaatatgacactgtatcaacatgtgtttctgaagaaggtcgttgtagccaaagatatattgtaaataaaaataaatgtatttataattttcttaaatatttttgaatttcatattttttgtgctctaattattcttaccaacaatatttgattcaagcgatgaaacagatacttctgctccaactaaaccaaaaagaagtggttgaaaaatatcccatacagtcgtaataatcttttggactttcatctatagaaaagagaaatacatttataatgattttggcacataaatatatttcagaaacttaaagtcttccccccccttttttttttcattttttaagtattttagagatggggtcttgctctgttgcccaggctggagtgtagtggcataatcatagctcactgtagccttgaactcctgggctcaagtgatcctctcgcagtctcccaagtagaactacaggtgtgtaccaccatgctgggctaatttttaaattgtttatagagatggagtcttgctatgttgcccaggatggtctagaactcctgtcctcaagtggtctctggctgtggcgtcccaaagcactggcattataggcatgagccaccatgcctggcctaaagtcatttaacatttaataaatttaagacactttattttaataaaaatgttaaacttaataaaaactgagcacttcaatagttttattcaaacacttaggtagaatttgattaaaataaactcacaaagcaataaaataatactatttggccattttgtcacagaataagtgatgtccttagggttctagccatgtttcgtatgagttccagattttgtctgtaaagtaactgaacagagatataactacatcatgcctgatgagaacatacccagttcatgcaaacatttgggttctcaaaagggggttgggaagccctccactaacaaccatcctggaactcaatcccattaaagtgaatcctgatatatatagcatatactactaggaaaaacaatttggaagtctgctaggcctgcttccaaagaacccatgttgaatattttaaagttactttttccttaaaacaaaaccaaaacatatattagattctcatttaactgcctacccagcttccctttctggaaacgaatgcctcccagtgctacttccccaattaaaacgttacaggaaaggcccctattggcctacattactctggctcttctccaggaatttggatgaagagatttcagtctcagtctgggtttaacatttttttttttaaacagaagatacataagaactttgatgtctcttccttgaggcataaactatcttcataactatttcccttatgactgtgttttctgatccccacttattatagtttaaaaaaagaaaaacaaagaaaaacaatgttactattctttacagcataattatcctatttgttacttttaatctttaaaacttgttttagttctgtttcttttaccatttaaaaaaattctagcagttttaattttatttattgatttgcatttcattcatttcatttcttttatcattatgattatataagaatactaaacaaaatgtcactatgatttttggttggggaacttctcaagctgattctaaaatttatctaagaaagaatatgtgtaggaacagccaaaaaatactttaaaaagaagtataatctatattagattttgacacataaaactgcagtgatttaaaacagtggtgttggcatagaaatagagaagtaggattaaatagacttcagaattaatatatatgggagaatttagttcatgttaaaaaactgaattattaatgaattggtcaataaataaacaatttggcaaaaaatgactgtctagtttatgtgcatatatctgtatgtacatattcatcacatgcaagtacatatgtgtgtctgaatatatatgtatatttatgtgtgtgtgtatagatatatatatatacatacacacacatcaggcatgatgtagttctatctctgttcagttaacttacaaactgtatgtgtgtgtgtatatatataaatagtttgtaagatacacatatgtatatatgtataaccttacctcacagcattcacaaagataaattccagatagattaaaagactaaatgaaaaaaacaaattaaacaaacaaaaactaccaaaatattaaatgataatatacaaaatagtatatctttgtaacgtttatatgttataatcttcagtgagaaagtccttcttaaatgagatgcagaatccaaaaccaaaaaaggaaaacccaataggtttggtcataggaaattttactttcatacaccagacaccataaacaaagttgaagataagcaaaaattatatgcaatatatacataacaaaggatcagtagccctaagagaaactataaattagaaacaaaaaaataaataacccaataaaaatggtcaaagaagatcataggtattttaaaaagaatatatgaagagaagcttactatactactaatcagagaaatgtaaataaagaataacaacatcacataattgtaagaaactacaagaattggatggtgaggtcatctaatagtaaaaagaatagaactagtgataatatcaagtgctgttgatgagttaaggaattagatatttttgtgcactgttggcagagtgtaaataaccaaaatcttttgaagggataatttagcagtgtccatcaaaataaaacacagatcatttccagctaggtgtggtagctcatgcttgtaatcctagcactttgcgatgtcaagttgggaggatcccttcagctcaggattttaagaccagcctgggcaacatagagagactctgtctcaaaaaaaaaaaaagtcatttctaggactctatccctatagatgtacctgcaatcccaacattttgggaggccgaggcaggagtatcacctgaggtcaggagtttaagacctgcctggccaacatggtgaaaccccgtctctactaaaaatacaaaaatttgctgggtgtggtggtgtgcgcctgtaatcccagctactagggaggctgaaacagaagaatcacttgaatccaggaggtggagtttgcagtgagccaagattatgctactgcactccagcctgggtgacaagagtgaaactgtgtctcaaaaaaaaagacatgaacaacactgtttatgacagcactgtttgtaaataacaaaaagtggaaacgatcttaatgtctataaatagaatactggttacttaaaaaaatgtaagggggtttgatatttgacagtggtggggaataaagaaatcttttacattttattctatatgttttattcttttacaagcatttctatttttattatttgtttgtttattatttatttatttttttgtgatggagttttgcacttgttgcccaggctggagtgcaatggcatgatcttggctcctgggttcaagtgatgctcctgcctcagcctcctgagtagctgggattacaggtgcccaccaccacaccaccatgcccagctaatttttgtatttttagtagagatggggtttcaccatgttggccacactggtctcaaactcctgaccccacgcgatctgtccgcctccacctcccaaagttctgggattacaggcatgagccaccgtccccggccttttacaaacatttttcatggattaattgtataattaaaatttcaatgaataaaataattagattgataaaggtaatataataatattatataaaacttgggaaaaagagaagcctgatgtgattaactcaacttctgattccatattagtatatttccaggtgcttttcctaaatattttctttcctcgattgattcatacactttcttgaggacagaaaaccttttggaacattttccaaccagaatgaggggatttcctaaatatatgtaaaaaattcagttgttttagcttttaaaatatagcatattaaaaatattcaccttttcttgggaccattttgtccctgcaatgaaactcaacactagtgtgcataatcctccagatccatgtaaaccaatacgttggctgcctaagacggcagaaacacacatagtcaaaacaaggaatcctctcttcaatgtaagttttttctagaattagatagatatttagaaattagtttatattaaatatataatataagatttgacattatctattatatatttttgaccctctgatattatgtctttaaatgttatattaaatgtctaaaattttgattttctttctcaccatatattttagcagacttactaccaagtaacaaaatttgcaattagtcacgtttcatcttctgccatatctctgatactagtatcagtaatatggttaaagtattactataagtgaagaagaaaagagacccataaaatctccagtttcatataacatatccaatgaattcttaaaaaatatttgaatatctctttggtcaatatgttacagctaaatttggatggaaattacagaaatacaaaagtaatggcatgttttcctttaaggcaggaaatggctaaatttgagtgttgcctttgtcaaaggagagcaggagtgaatttcagtcagaaaatatgcagaaataaatggggacctatttccccctaaaatgtttaagggaaaatttgggggaaattatcaaacatcagtaggcagtttagtagagaaagggaaagtataattcagagggatactctgcattaagtatattttttgatattccttatttgccaaattaagaagcagagactttaatcaaagccattgacctgtatcaatcactgctgtgctcagttttaagtacagagtaggcattggaggctagttttagagaaatagaattaagtattaaatttcatcgaccttaccaaagtttaatattttgaaaaaaatgtctaatactatacttctataaaatagattttgtatttacctggtcttcacttggaaaatatcgaacaaaaaatcccaaaacaattcctgccagcagactaatacatacgttccttatagaggctatggcgttattaagtataccacctgtaggggcacacaataaaaaaaaattcacaaagaagtatcttcacatacactacacatcagaaaagcaaatctaggtggttcatgaagaaaagtaagcattttatagaacaaatatatgcaaatggtctttttatagtgacatatatgaaaacatgtagatctatttagtacgttaaatatatactctcaaataatttaatatatacacacaactcagaaatgtccattatgtaaataggccagaaaacaaagacttaacaagcacaagatgctccccttacatagccaacttaaaagacagagtgaggtagtccaggcacagtggctcacgcctgtaatcccagtgctttgggaggctgaggagggtggattacttgaggtcaggagttcaagaccagcctggccaacataatgaaaccccatctctactaaaaatacaaaaattagctgggcatggtggcacacacctgtggtcccaggtactcgggaggctgagggaggagaatcacttgaacccgggaggcagagtttgcagtgagctgagatcgtgacaccacactccagcctgggtgaaagacggaggccacacctccaaaagaaaaaaaaaaaaagactaagtgaggtacaagaatggagagagaccgaaacacttgtggcacttagcatatggctgttaagggctatattaacaattcttctttcatgtactatatgaaaaagaaacaaatgattttaacatgaaaagaacaatgtaataacaacataaaaaattttgttccagggtcagtcctagaaacattcaagggtcaattaagatttcagtatatttaagtatctgcttttggtgaagaaaaaaggaaaaaaaatacaaaagattccagtatattttatattcattaatattaatatatccatacttgtagttcattgtaataagtaaaaaacaaaaaataaaaaaacaaaatgagtcacaaaaatagttcagttaagctctgggtagtggattcaatatagtaagtaagtatatttttagacatattttctactaaatataacaggcagggcatggtgggctcacacctttaatcctagcactttgggaggccaaggcagaaggattgcttgagcccaagagtttgagaccagcttgggcaacagagtgaaaccccatctttacaagaaaataaaaaactagcccggtatgtggtgtgtgcctatagtccaagtactcagtaggctgagggaggaggtcccttgagctcaggagtttgaggctgcactccagcctggctgacagagcaagatcctgtctcaagaaaataaaatacaataaaaataaaaaataatataaacagagagatgtcagccagatggtggaatggggagctccaaaccttgattctccataaagataccaactgaacaacaatatatggtctaaaagcctttatggagttccataaaccattaagaagctgtagtagcacagacaagtgcaaagccaagaatagtggcattgaacaaataagaaaagctgttgcattatactcatgataccccttccccaagctggaacaggttggtgtggctgggaagcactcaacttgcagcttctccattagcagggaaagagaagactggaacggaatagttttatgaggttacctgaagctctctctctctctctaacttgacacccaactggcatactttggatgcgtgggagccactgggaataaaggagaggtcagagatgatgcagcaccagggaacctgcagtgccacagacagataccagagagaacaacagctccagaaaaagaaactggcaaacctctacttgggatgttgcaatgtataaacccaaagaagatgcattcccagaaaaggtttgagaggctgctagaacctatagccatgctgattcaggtaaaggtcttccgtatgaagccagctgataaaaactgggagcagtggcagttttttcaaacgtccaaatcttggcaaaaataagtaaaaaataaaaaaataaaaaataacaggcataagaagaaacagagaaacctgatgactaaattaaaggagcaaaataaatctccagaaaccaatcctaaagaaatagataaatgagttacctgacaaagaatccaaattaactctcttaatgaagcccagtgacaacagaaatagataactaaatgaaagcaggaaataattcatgaacaaaatgaaaatattaacaaagagatagaaactaaaaaaaaaaaaaaaaaaaaaggaaccatacagaaactctgaagctaaggaatacaacagctcaattgaaaaattcactattggaaatcaccaacagactgtgtaactgcccaatgggttcaccttgtgccctgcttagacagagctgatttatcaagacaggggaattgcaatggagaaagagtaattcatccagagccagctgtgcgggagaccagagttttattattactaaaatcagtctccctgagcattcggggatcagaagttttaaagataatttggcaggtaggggcttgggaagtggggactgctgattcatcaggttggagatgaaatcatagggggttgaagtgatgttttcttgctgtcttctgtttgtgggtgggatggcagaactagttgagccattattaccagtctgggtgcactggatgaatcagccagtgcagggtctgcaaaatatctcaagcaatgattttaggttttacaatagtgatgttatccccaggagcaatttggagaggttcagactcttggagccagaggctgcataacccttcaactgtaatttctaatgctatagctaatttgtttatcctgcaaaggcagactggttccaggcaagaaggggatcttttcaggaaatggctattatcaactttgtttcagagtcaaaccatgaactgaataccttcccaaaattagttcatccgactgccaggaatgaacaaggacagtttaaatgctagaagcaagatggagttgattaggtctgatgtctttcactgtcataatttcttcagttgtaatttttgcaaaggcagtttcaataacatcaagcagaataaagaatcagtgaaacagaagactagtcatttgaaattatggagtcagaggagcaaaagggaaaaggaatgaagagtgaagacagcctaagagacttataggatgccatcaagcagaccaatgtatgtattatgaaagtgccagaagaagagaaaaataaaggggcagagagccagttaaaaaaatgaccaaaaacttctcaaatttaaagaaggaaatggacatacaaatccaagagtctcaaagaactccaagttggataatttgcaaaagacctacaatgagacacattacaatcaaactgtcaaaagtcaaagacaaagagagaattttgaaaggaacaggatcaaagcaacttttcacatacaagggagatgccatatggttatcagtggaattctcagcaaaaactctacaggccagaagagaatgggatgatatattaaaagggctgaaagaaaaaaaaaaaactgtcaaccaagaactgtatagccagtaaaactgtacttcaaaaatgaaggacaaacaaagagttccccagagaattaaaaggtgagggaattgatcaccactagacctaccttacaaaaaatgttaaagggagtcctccatgtggaaatgaaagggcattggatagaaatacaaaagcatacaaaacataaacttctttggtaaaggtaaatatatgagtgaacatagaatcctttaatactgtaatggtggtaagtaaaacactttttttctttacttttttctttttcttttttgagacaaagtcttgctctgttgcccaggctggagtgcagtggtttgatcacagctcactgcagccttgcaggcctgggctaaagcaatcctcccacctcaacctcccaagtggctgggactacagacatgcaccaccacactcagataatatttttaaatttttagcagagataaggtcttgctggtctcaaactcctaggctcaagtggtcctcccattttggcctctcaaagtgctgggactacaggtgtaagacaccacacccagcctgtaattcacttttaattgaagcatagaatttaaaaagtaaaagcataacattactgtattaaattatgtgaataaacaatataaaaatatatattgtgtgacactgataacaaagtgagaaggaagtgtaaagaagtagagtttttgtatgtgattaaagttaagttgttgtcaatttaaaatagattattataactatgagatgttttcatgtaattctacagtaaccacaaagaaaagacctacagaagatacacaaataaacatgagaaaggaacccaagcatgcccctaccaaaaaaagaaatcagtgaaacataaagggaggcaggaagagaggaaaagtggaaaaaaatagctgcaagacatacataaaacaataaacaaaatgacaatagtaagcccctccctatcagtaactactttaaatgcaaataggctaattttccaatcaaaagacagagattggccaaatggatttaaaaaaatctaaatatatactatatgcaagagacttacattagatctaaagacacacaaaggttgaaagtgaaaggatggaaaaagatattcaatgcagttggtaaccaaaagagaacaacgatggccatacttagacaaaatagagtttaagtcaaataatagcacaagagacaaggatattacataataataaaagggccaattgaccaagaagatatagcaattataaatatatatgcaactaacagtacagcatctaaatatatgaagccaacatagacagaattgaggggtaacatagataacaacatcataataacagaaaacttcaatatcccactttcaattatggatacaataaccagacagaagatcaactggaaaacagagaacttgaacaacactgtagaccaattggacctatctgacatatacagaacacttcacccaataatagcaaaatacactttcttctcaagtacataccaagacttttccaggataaatggcatgctagtccacaaacaagtttttaaaaatttaagaaaactgaactcataccaagtatcttttctgaccacattaaatgaaattagaaattcatagcagaaggaaaaaggaaaagtaataaatatgtggaaattacaaaaatatactctgttaaccaattggcctgtatggttaatattaattgtcaatttgattgagggatgcttagatgcctgatgaagcactgagtgagggtatatctgtgagggtgctgccacaggagaatgatggatgagttagtggactgagagagaaagacccatcctcactgtgggtaggcatcatgcaattggttgcaagtgtggctagaacaaaaaggcagaagaatgggaacattcagcttgcttggatttcttttttatgcactttctctctcttccagagcagtatgcctttttctcctcttgcccttgcacatcaaactctaggttcttttgcctttggaccctggaacttgcatcagcagccttttgggagctctcaggcctttggcctcagactagtggctgcactgtcagcttccctggttttgagactttcaaatttggactgagccatgtcactggcttccttgggagccatgctttaggcttctctcattttccggcttatagatggcctattgtgggactttgcctttgtaattatgtgagccaattctccttaataaattatatttcatatatatgtaaatatattctcttttatatgcatgtatctatatctatatctatatctatatctatatctatatctatatctatatctatatctatatctcctattggttctgaccctctggagaactctgattaatacatagtcaaagaataagtcacaaggaaaattagaaaatgtctcgagacaaataaaaatggaaacacaacattccaaagcttgtgggatgcagcaaaatgaatatgaagaggacagtttatatatctaactacctaccttaaaaaagaagaaagatctaaaataagcaacttagctttacacctcaagaaactggaaaaagaagaactcaatccaatgttagcaaaaggaaggaaataataaagtctagagcagaaggccgggtgcaatggctcacgactgtaatcccagcactttgggaggccgaggcaggcagatcacctgagatcaggagtttgagaccagcctgagcaacatggagaaacctgtcactactaaaaaatacaaaattagccaggcatggtggtgcatgcctgtaatcccagctactctggaggctgaggcaggagagtcacttgaaccgggaggcagaggctgcactgagctgagatcgtgccactgcactccagcctgggcaataagagcaaaactccatctcaaaaaaaaaaaaaaaaaaaaggctagagaaaaaaaaaacccaatgaaactagtagttgtttcaaagttcaacaaaattgacaaataatcagctagaatatttaagaaaaaaaataaagaagactcaacttcttttaggaacaaaagagaagacattgcaacagatattacagaaataaaaaggattctaagagtctactatgaatgattatatactgacaagttggataacctaggagaaatgaacagattcctagtaacatgcaagttaccaagactaagtcacaaaataaaaaatcttaatagacctataactagtaactgaatcaggaatcaaaaacctcccagcaaaccaaatacctgataaggggttaatatctaaaatatatacagaacaacaactcaataacaaaacaacataatgagaaacggtcagttgactttgctatggtccaaatgtttatgttctcccaatattcatatgctggagcctaatattcaatgtgataatattaagaggtggggcattttggagatgattagttcatgaagtcatagccctcagaaatgggactagggcctttataaaagaggcttaagggagtttactttcccttttgaacatgtgaggacaaagagaaggtgctatctatagtgaatatagtgacctcaccagtcactgagtctgttgtagcctaaatcttggacttctcacattccagaacgcaagaaataaatttctgttgttcataaattaccagcctaaggtattttgttatagcagcaggaatggactaagatagacttgaacagacattttttccaaaaaaaaatacaaatggccaactagcatatcaacccgacactatgtggcagctgccaaggcttggggattgaactctctgaagcaatagcctgagctgtatgttggctccttttagccatggctgggacatagtgcagtcccaagactgcacagagcagcaaagctctgggcctggcccacaaaaccattttttccctcctaggcctccaaccctgtgacgggaggggctgttgtgaagaactctgacataccctggagacaatttccccattatcttggcaattaacattcggctccttgttacttctgcaaatttctgcagtcagcttgaatttctccccagaaaatgggcttttcttttctatcacatcataaggctgcaaatcttccaaacttttatgctctgtctcccttttaaacataagttccaattccaaaccatatttttgtgaatgcataaaactgaacacttttaagagcactcaggtcataaactgaacactctgctgcttagaaatttcttctaccagatgtcctgggtgggttccaagatggccaaataggaacagttccggtctgcagctcccagcatgatcgacgcagaagacaggtgatttctgcacttccaactgaggtacctggttcatctcattgggactggttggagagtgggtgcaggcccacagagggtgagctgaagcagggtggggcatcacctcacccgggaagcacaaggggttgggggatttccctttcctagccaagggaagccgtgacagactacctggaaaaacagggcactcctgcccaaatactgcacttttcccaaggtcttagcaactagcagacaagatgattctctcccgtgcctggctcagcgggtcccacacccatggagccttgctcactactagcgcaacagtctgagatccatctgcgaggtggcagcctggctgggggagggccgtccaccattgctgaggcttaagtaggtaaacaaagcggctgggaagcttgaactgggtggagcccactgcagctcaacaaggcctattgcctctagactccacctctgtgggcagggatagctgaacaaaaggcagcaacttctgcaaacttaaacgtccctgtctgacagctctgaagagagcagtggttttcccagcatggcgtttgagttctgagaatggacagactgcctcatcaagtgggtccctgacccctgtgtagcctaactgggacacacctgccagtaggggctgacagacacctcatttaggcggatgcccctcttggacgaagcttccagaggaaggatcgggcagcaatatttgctgttctgcagcctccactggtgatactcaggcaaacagggtctggagtggaactccagcaaactccaacagacttgcagctgagggtcctgactgttagaaggaaaactaacaaacagaaaggaatagcatcaacattaaccaaaagatcatctacaccaaaaccccatctgtaggtcaacaatgtcaaagaacaaaggtagataaaaccaaaaggatagggataaaccagagcagaaaagctgaaaattctaaaaatcagagcacctcttctcctccaaaggatcgcagctccttgtcagcaatggaacaaagctggatggagaatgactttgacgagttgacagaagtaggcttcagaaggttggtaataacaaacttctccgagctaaaggaggatgttggaacccatcgcaaggaaggtaaaaaccttgaaaaaagattagatgaatggcttacaagaataaacagtgtagagaagaccttaagtgacctgatggagctgaaaaccttggcacgagaactttgtgacacatgcacaagcttcaatagccgattcaatcaagtggaagaaagggtatcagtgattgaagatcaaataaatgaaataaagtgagaagacaaggttagagaaacaagagtaaaaagaaatgaagaaagcctccaagaaatatgggactatgtgaaaagaccaaatctacatttgattggtgtacctgaaagtgatgaggagaatggaaccaagttggaaaacactcttcaggatattatccaggagaacttccccaacctagcaaggcaggccaacattcaaattcaggaaatacagagaacaccacaaaaatactccttgagaagagcaattccaagaaacatacttatcagattcaccaaggttgaaatgaaggaaaaagtgttaagggcacccagagagaaaggtcaggttagccagaaagggaagcccatcagactaacagtggatctctcagcagaaaccctgcaagccagaagtaagtaggggccaatattcaacactcttaaagaaaagaattttcaactcagaatttcatatccagccaaactaagcttcataagtgaaggagaaataaaatcctttacagacaagcaaatgctgagagattttgtcaccaccaggcctgccttacaagagctcctgaaggaagcactaaacatggaaagaaacacccggtaccagccagggcaaaaacaggccaaactgtaaagaccatcaatgctaggaagaaactgcatcaattaacgggcaaataaccagcaactatcataataacaggatcaaattcacacataacaatattaaccataaacgtaaatgggctaaatgccccaattaaaagacacagactggcaaactggataaagagtcaagacccatcagtgtgctgtattcaggagacccatctaacgtgcagagacacacataggctcaaaataaagggatggaggaagatctaccaaacaaatggaaagcaaaaaatagcaggggttgcaatcctagtctctgataaaacagactttaaaccaacaaagatcaaaagagacaaagaaggccattacataatggtaaagggatcaattcaacaagaagagctaactatcctaaatatatatgcacccaatacaagagcacccagattcataaagcaggtccttagagacttacaaagagacttagactcccacacaataataatgggagaatttcacaccccactgtcaatattagaaagatcaagaagacagaaggttaacaaagatatccaggacctgaactcagctctgcaacaaacagacctaatagatatctacagaactctccaccccaaatcaacagagtatacattcttctcagcaccacatcacacttattctaaaattgaccacataattggaagtaaagcactagtcagcaaatgtaaaagaacagaaatcacaacaaactgtctctcagaccacagtgcaatcaaattagaacttaggattaagaagctccctcaaaactgaacaactacatggaactgaacaatttgctcctgaatgactactgggtaaataacaaaatgaaggcagaaataaagatgttctttgaaaccaatgagaacaaaggcacaatgtaccagaatctctgggacacatttaaagcagtgtgtagagggaaatttatagcactaaatgcccagaagagaaagcaggaaagatctaaaattgacaccttaacatcacaattaaaagaactagagaagcaagagcaaacacattcaaaagccagcagaaggcaaaaaataagatcagagcagagctgaaggagatacagacacaaaaaacccttcaaaaagtcaatgaatccaggagctggttttttgaaaagatcaacaaaattgacagactgctagcaagcctaataaagaagaaaagagagaggaatcaaatagatgcaataaaaatgataaaggggatatcaccactgagcccatggaaatacaaactaccatcagagaatactataaacacctctatgcaaataaactacaacatctagaagaaatggataaattctgggacacatacacccttccaagactaaaccaggaagaagttgaatctctgaatagaccaataacaggctctgaaattgaggcaataattaatagcctaccaaccaaaaaaaaagtccaggaccagatggattcacagctgaattctaccagaggcacaaagaggagctggtaccattctttctgaaactattccaatcaatagaaaaagagagaatcctccctaattcattttatgaggccaacatcatcctgataccaaagcctggcagggacacaacaacaacaaaaaagggaattttagaccaatatccctatgaacattgatacaaaaatcctcaataagatactgacaaactgaatccagcagcacatcaaaaagcttatccaccacgatcaagttggcttcatccctgggatgcaaggctggttcaacatacacaaatcaataaatgtaatccatcatataagcagaaccaaagacaaaaaccacatgattatcttaatagatgcagaaaaggcctttgacaaaattcaacagcccttcatgctaagaactctcaataaactaggtattgatgggacgtatcttaaaataataagagctatttatgacaaacccacagccaatatcatactgaatggacaataactggaagcattccctttgaaaactggcacaatacaaggatgctctctctcatcactcctattcaacatagtcttggaagttctggccagggcaatcagggaagagaatgaaataaagggtattcaattaggaaaagaggaagtcaaattgtccctgtttgcagatgacattattgtatatttagaaaaccccatcatctcagcccaaaatctccttaagctaagcaacttcagcaaagtctcaggatacaaaatcaacgtgtaaaaatcacaagcattcttatacaccaataacaaacagagagccaaatcatgagtgaactcccattcacaattgcttcaaagagaataaaatacctaggaatccaacttacaagggaaatgaaggacctcttcaaggagaactacaaaccacttctcaacgaaataaaagaggacacaaacaaatggaagaacattccatgctcatggataggaagaatcaatattgtgaaaatggccatattgccaaaggtaatttatagattcaatgccatccccatcaagctaccaatgactttcttcacagaattggaaaaaactactttcaagttcatatggaaccaaaaaagaacctgcattgccaagacagtcttaagccaaaagaacaaagctggaggcatcacactacctgacttcaaactacactacaaggctacagtaaccaaaacagcatggtactggtgccaaagcagagatatagaccaatggaacagaatagagccctcagaaataatacgacacatctacaaccatctgatctttgacaaacctgacataaacgagaaatggggaaaggattccctatttaataaatggtgctgggaaaacgggctagcaatacgtagaaaactgaaactggatcccttccttacactttatataaaaattaattcaagatggattaaagacttacatgttagacctaaaaccataaaaaccctagaagaatacctaggcaataccattcaggccataggcatgggcaaagaattaatgactaaaacaccaatagcaatggcaacaaaagccaaaattgacaaatgggatctaattaaactagagagcttctgcacagcaaaagaaactaccatcagagtgaacagacaacctacagaatgggagaaaatttttacaatctacccatctgacaaagggctaatatccagaatctacaaataacttaaacaaatttatatgaaaaaatcaaaccccatcaaaaagtaggcaaaggatatgaacagacacttctcaaaagaagacatctatgcagccaacagacacatgaaaaaatgctcatcatcactggccatcagagaaatgcaaatcaaaaccacaatgagataccatctcacaccaattagaatggtgatcattaaaaagtcaggaaacaacaggtgctggagaggttatggagaaataggaatgcttttacactgttggtgggagtgtaaactagttcaatcattgtagaagacagtgtggcgattcctcaaggatctagaactagaaataccatttcacccagccatcccattactggtcatatacccaaaggattatgaatcatgctgctataaagacacatgcacacgtatgtttattgtggcactattcacaatagtaaagacttggaaccaacccaaatgcccatcaatgatagactggattaagaaaatgtggcacatatacaccatggaatactatgcagccataaaaaggatgagttcctgtcctttataaggacatggatgaagctagaaaccatcattctgagaaaactatcacaaggacagaaaaccaaacaccgcatgttctcactcataggtgggaattgaacaatgagaacacttggacacagggtggggaacatcacacactggggcctgtcatggagtgtggggagggaggggatagcattaggagatatatctaatgtaaatgacgagttaatgggtgcagcacaccaatatggcacatgtatgcatatgtaacaaacctgcatgttgtgcacatgtaccctagaacttaaagtataataacaaaaaaaactatgacactgtcctatataccatatctgtacaaaaattataaattttagatagccatccagagatacttctctacttcttggaaaaaatatcaacattgaaaacatcaaaaaaattaaacacttcttcttttgtccaaaaaaaaaaagaaagaaaaaagggaatcctccctaactcattttatgaggccagcatcatcctggtaccaaagcctggcagagacacaacaaaaaaagagaattttagaccaatatccctgatgaacatcgatgcaaaaatcctcaataaaatactggcaaaccgaatccagcagcacatcaaaaagcttatccaccacgatcaagtcggcttcatctctgggatgcaaggctggttcaacatatgtaactcaataaacataatccattacataaacagaaccaaagacaaaaaccacatgattatctcaatagatgcagaaaaggcctttgacaaaattcaacactccttcatgctaaaaactctcaataaactaggtattgatgggacgtatctcaaaataataagagctatttatgacaaacccacagccaatatcatactgaatgggcaaaaactggaagcattccttttgaaaaccggcacaagacaaggatgccctctctcaccactcctattcaacatggtgttggaagttctgaccagtgcaatcaggcaggagaaagaaataaatggtattcagttaggaaaagaggaagtcaaattgtccctgtttgcagatgacatgattgtatatttagaaaaccccatcatctcagcccaaaatctccttaagctgataagcaacttcagcaaagtctcaggatacaaaatcaatgtgcaaaaatcacaagcattcctatacaccattaatagacaaacagagagccaaatcatgagtgaactcccattcacaattgctacaaagagaataaaatacctaggaatccaacttacaagggttgtgaaggacctcttcaaggagaactacaaaccactgctcaacgaaataaaagaggacacaaacaaattgaagaatattccatgctcatggataggaagaatcaatatcatggaaatggccatactgcccgaagtaatttatagattcaatactatccccatcaagctactaatgactttcttcacagaattggaaaaaaaactgctttaaagttcatatggaaccaaaaaagagcctgcattgccaagacaatcctaagcaaaaagaacaaagctggaggcatcacactacctgacttcaaactgtactacaaggctgcactaaccaaaacagcatggtactggtaccaaaacagatatatagaccaatggaacagaacagaggcctcagaaataagaccacacatctacagccatctgatctttgacaaaactgagaaaaacaagaaatggggaaaggattgcctatttaataaatgatgctgggaaaactggctagccatatgtagaaagctgaaactggatcccttccttataccttatacaaaaattaattcaagatggattaaagacttaaatgttagacctaaaaccataaaaaccctagaagaaaacctaggcaataccattcaggccataggcatgggcgaggtcttcatgactaaaacaccaatagtaatggcaacagaagccaaaattgagaaatggaatctaactaaactaaagagcttctgcatagcaaaagaaactgccatcagagtgaaccaggcaacctacagaatgggagacaaattgcgatctacccatttgacaaagaaagaattcaaacaaatttacaagaaaaaaacaataccatcaaaaagtgggcaaagatatgaatagacacttctccaaagtagacatctatgcagctaacagacacatgaaaaaatgctcatcatcactggtcatcagagaaatgcaaatcaaaaccacaatgagatatcatctcatgccagttagaatggcaatcattaaaaagtcaggaaacaacagatgctggagagcatatggagaaataggaacacttttacactgttgatgggagtgtaaattagttcaaccattgtggaagacattgtggcgattcctcgaggatatagaactagaattaccatttgacccggcaatcccattactgggtatatacccaaaggattttaaatcatgctactataaagacacatgcacatgtatgtttatttcggcactattcacaatagcaaagacttgtaaccaacccaaatgtccatcaatgatggactggattaagacacgtgacacatatacaccatggaatactaatgcaatcataaaaaaggatgagttcatgtcctttgcagggagatagatgaagctggaaaccatcactctcagcaaaactatcacaaggacagaaaaccaaacaccgcatgttctcactcataggtgggaattgaacaatgagatcacttggacacagggctgggaacatcacacactggggcctgtcggggggtggagggctgggggagggagagcattaggagaaatacctaatgtaaatgatgagttgatgggtgcagcaaaccaacacggcacatgtatacctatgtatcaaacctgcatgttgtgcacctgtaccctagaacttaaggtataacaacaccaacaaaaaaagaagtttcttctaccagatgtcctcaatcatctctctcagtttcaaagttccataaatctctagggcaggggcaaaatgccaccagcctctttgctaaagcatagcaagagtgacctttacttcagttcccaacaagttctttatctccatctcagacctcctcagcctggacttcactgtccaagtcactatcagcagttcggtcaaagccattcaacaagtctctaggcagttccaaactttcccacatcttctggtcttcttctgagtcctcccaactgttccaccctctgcacattacacagctccaaagtcacttccacattctcaggtattttatagcattactccattaccttggtatcaaaatctgtattagtcatggttctctagagggatagaactaataggatatatgtatgtatgaaagggagtttattaaggagaattgaatcacaccatcacaaagtgaagtcccacaacacgtctgcaagttgaggggcaaggaatctagtattggctcagtccgagtcccaaaacctcaaaagtagggaaactgacaggccagctttgagtctctggatgaaggcctgagagtccctggaaaacaactggagtaagtccaagagtccaaaagccaaagaacctggagtctgatatttgagtgcaggaagcatccagcatgggagaaagatgagggccagaaagctcagcaagtcagcttctcctaaacttcttctgcctgctttattctagccatgctggcagctgattttatggtgccgacccacactgagggtggatctgcctctcccagtccactaaataaatgttaatctcctttggcaacaccctcacagacacaaccgggaacaatactttggatccttcaatccaatcaagttgacacttacttaatattaatcttcacaatgtaatattcatcccatttgtaatttttctttaatatacaagctccttgagaacatgcaccatttgatcttgtctctctgttttcttgggaggcagtggagaagagaagagttaaatgtgtgggtgtggagtcagactgccagatttgcatcttggctcccctacttactggatctctgaccttgagtaaattacttaacatctttctcagtttccttacctgtaaatgagtggtgacatatatggaacttagaacaagagccaagcaagtattcaataaaagctaatgttgttgcctactgtttattctcagtgtttggcatagtagccggcaaaaggaagaggaattttttttttctttttttcagacagtctccccctgtcacccaggctggagtgcagtggtgtgatcttggctcactgcaacctctgcctcttgggttcaagcaattcttgtgcctcagccccctgagtagctgggattacaggcctgtgccaccacacccagctaactttttgtatttttagtagagatggagctttgctatgttggccaggctggtcttgaactcatgtcctcaagtgatccacccactttggcctcccaaagtgttgggattataggcgtgagccattgggcccggcctggaaatatttttttgaaacatgactgataacagtattttttgaaagaatgacagataccaatcatgaaggaaaagattttcacaattgacaataaaaaactttaacttctgaatggtaaaaagagtgagaaaattaaaagccaaattacaaattgaaaaaactaaagtatataaaacaaaggttttcattctcaatttaatgcagaatcttgacaaatcaaaaagaacaaaaggtgaacccacctaaaagaaataggcaaaagacttccaagaaaagcaatttacaaaatgccaatgactaataaacatggatatttaacagcactagtattcaaaatacttcatttatagagatccctccttcacctatcaaattagcaaagatgaaaaaggctagtattaccaagttttgaagacaggtgagaggaaatgacaagtttatgtaccctggtaggacatgatattgtggcaatttgtttcagaacactcataaatgtagatatcttttagatcaacaattacacttttaagcttaagaaaatatgaagaataggtacaaatatttctctatatgttcaattaagtattattttttaaattaaaaaaaaattttttttgagacagtgtctcactctgttgcccaggctggatagctcactacggcctccgcctcctgggttcaagtgattcttctgcttcagcctcctgagtagctgggattacagatgcccaccaccatgcctggctaagttttgtatttttagtagagacagggtttcaccatgttggttggccaggctggtcttgaactcctgatctcaagtgatccacccttcttggcctcccaaagtgctgggattacaggcatgagccaccatgcctggccaattttttaattaaaaaaaatttttatagcagcacaactaagtattattttaatagtaaatattggagtcaagtttaattttgaacaggataagtaattatgatgcagcacattgaatactctttcattaagctaaacaactattaaaatgatatacaaatacatttactgaaaagaaacatgtttgtgatatacagttaagtgtaaaacaattcaggttataagaacatattaggccaggtgcgatgtctcacgcctgtaatcccagcactttgggaggccgaggcgggcggatcatgaggtcaggagattgagaccatcctggctaacatggtgaaaccctgtctctactaaaaatataaaaaaaattagccgggcgtggtggtgggtgcttatagtcccaactacttgggaggctgaggcaggagaatggcgtgaacccgggaggcagagcatgcagtgagccgagattgtgccactgcactccaacctgggtgacagagcaagactccgcctcaaaaaaaaaaaaaagaacatattggtcaatattcactgatttttataagaatatttgacagagagagagggggaagggaagggaaggggaaaggaaagggaaaggaagaagggaagaagggaagggaagggaatatgggtggatttatatcaaaaggttcagaaggaaatgattcttttcttctggatgtgactactgcagatttttttaacttttcctctttttcttatttatttatattttctgattttaagagaaactataaaactatatatattacttttcaacttaaaaatattttagtgcttcaataatgcagaagactcaatttcaacattgcagataattaaagcattactaaatgtggaaatgtttactttcacaatttctgtagtgatattcaagaccagatatcaccttggaatcagaactggtgcaggatcttgtcctaacactaccattaaggcatatggctgacccagctctgtatgtttaggttgtcttataatagagcaaccagttgtttattaggatggccaaaaaggcacatttcaaaaatgcctattaaaatattagtagtacaaataataccgctgaattttttctaatgagaactgataaaattccaaagcaatataagcagatacatagtaataatatggtttatcaaattaattgtcacatgattattaaaatgagatcatgtgtgttaagtagtggtatcttaagccactgaaatatcttccttggtctagaatgagctttctatggagattaaaaagatgttaaattgaacagtcttggttaataaatgaagaagcaaagccagaaaccctgtttaaagaagtaacaaaaaaggtcatgaatgatctagtggttgttatattttcttgtttacctgaggaaaagactatgctcaagcatgtattgaatccagtgatagccagaatgtcatccatactgctagcagccattaataaggttggaatgccttcctcaacaccatatccattttcttgcagcaccatcatgtaagggacaacaacagcaggagagacagcacctagaacaaaactgaaagaaagaatgaaaattaatttaaaagcatcttttaaatcaagtagtgttttataagtacaagtagtttataataactttataacaaacattgtttagaagaatttcaaatttgagtgaatgcaatttaatggtgataaaacttttcatgcattgtttagtgctggctaaaattttatacagatgtggtttaaaatgttgggctgaacacaggttgcagcctctccctctattcctaaatcctttgaagtgaagatgtaaaagtaatagaaaaattcataacctaaccagaaagcaaaaggtgaatccgcaatggacaagaaactaagtatatcccagtaagataagagacagacaatttaggattgaaaaaaggaaaccataaaccaaaatctgtgtaaataagattgcctcaaaagatacatgtgcttctaaaagtgctccaagccctgaaatggcagatgctgggagcaggagagacctctggggaaaccaaatagttaattatttggagtaccactgtaagaatggtcagacaaatctatcttccacacatttcctacctcttgagtaaataagtaagtaaggaaggaaggaacagagttgtctgcccaaaaaaacaagtgtggccacctaagttacaaaggcaaatgagaacatttctggagtggttgatgacacccatgaggaatggggaggctcctgctccgaataccttctattgacatatcttatccagaatttcgcctcatctcttctacatttactttataaaggctgaagtatatcctgtgtagaaatgcttttggtgctcctgccagaattgacctggtaaatgaacacatctcccagtgctgcttgttggctgctaatatctgcagatttctagaacccttgtcctgctgacaagcacctacctgggaatactagggaggttgtgcacccctctactttccctccagacagcatctgccaatgactgactgatgtgagtgtctaatagtttagcccatttgcttctggctgtacaacctctatggtgcagtttatgctacagatttccctgtgggctcaagaagagactagacttctctaagaccacatactggtctagttcagtggttcctaaactctgctgcacattgtaatcacctgttgtattatttttctcattttgcttaacaagtcatccccaaacatagcagcttaaaacaacaaatatttattgtcttatgacttctgtgggtcaggaatctgggcatggcttagctgtatgccttcacttaagatttcccatgaggtagggtggggtgggagaagatctgcttccaagtttactcatgtagctattgcaggcttcagttttttccaatggggttttctccacagggctgcctcaggacatggcagctggcttccccaggaataagtgatcaaagagaatttaatccataacatcaattaaaaacacaaaatatctaagaaaaaaactgtgaagatagtctatacttttataaaaattgtgaatataataatataataattaagataatacctgaatacttagagagacatttcacaagtgtgaactaaaaagcctcaattttaccatcgcccaacaccacgtctggctagtttttgtgtttttagtagatacggtgtttcaccattttggccaggctggtcttgaactcctgacttcaagtgatatgcccaccttggcctcccaaagtgctgggattataggtgtgagccaccatgcccggccaaagcctcaataatataaagatgtaatctctcccccaaataaattaatcagagatacaccaatcaaaatctttgcagggatttttactgagcttgacaagctgattataaaattcatttggaagaataagatcttagaacaaaagatcaagtaaacttaagaaaacaagatactgtttttgtaagggtaaaatagttaaaactgaataatagtgacatataaatagacaaaataaattggaagaaaagaaaatacaatgtgtggaaacaaatctatgggatttgttacatcatacaattggtattttaaatcagtgggagaaagaaagaaatctttcataaatggtgttgagataactatttatgtggaaaggaatatagatagatccttacacataataaatgttaaaagctcaaaaggaaaagtagtaataagaaaatgtagggggctaggtgcgatggctcacacctgtaatcccagcactttgggaggctgaggcggacagatcaggagtttgagaccagcctggccaacattgtgaaaccaatagctgggtgcagtggtgcatgcctgtagtcccagctacttggaaggttgaggcaggagaatcacttgaacccgggaggtggaggttgcagtgagctgagatcacgccactgcactacagcctgggtgacaggaagactctgtcacaaaaaaaaaaaaaaagaaaatgtagaataatatatttgtgatcatgaggtaaaaaggaccttttgaatgatacatacaaaggcattagacataaaaagagattttgatacattcaattatattaaagtagtacttcaaaagcaacttcaaaagtactacaataaagtactacttcaaaagcaattctgctctttctccccctttttttctttttcattttcaaagtcaagtgaatggtgttgtgtattggcaattctgtctgttgaaaataacaaaatacacttcttagagagaaaaaaaatcatcacaaacaaaattaaatatctagtgatatttgcaatacatataatttacaaatacatataacagatataattaataaagaagttgaagactcaacaaaaaaatggacaaaggatatgaacaggctagttacagataaggaaaagttgaaggacaacacatatataaaagatattcaagtttgtgaataatcacagaaatgcaaattaaaacaacaaaaatatgccattttttcaattatcagatgtgaaaacattataaaatttaataatatcaaggatttgcaaggattttcaagaacaacaggtatgctcataagctattggtattagggcaaattaaagtggccataccgaagggattttggcagtgtatatcaaactaaaaatgcatataacccaggtaactattctagacaaacttatatttaagtaaaatgagacaaataaaatgctatttttgttataacattgtaaataaaatctgctgttgacatacaatgtagtcttatacaattaaaaggaataaactacgtgtgtatccatcttgagatggataaacctcaagactattgttaagtgaaaagaacaaattgtaaagtaaaattttcttgggtatgattaagtaaaaatgcacaaaataatactcttttttttctctgggttcacaaatacacttgttagaagtccagaacattattttcaaagatctagaatggtaacataaaactcacgaagatgctgccactctgtccccagtggcacatgagtgcaccccacagcaccattgccctggctgacccatgcaagtatgcagaacaaccccatcccacacctgccggcactgcacccctgccaacacaggcatacctgctgtgtgctgctgctgctggcacatatgtgtgagtagggaccttgctacaatcactacaatgaagcactctggctggcacaccccatcagagtgttgttgccagtggactgggaacacctcagtgcttaacactgaagggccagacaacaaatctgtgggtatggtaccagccctgcaaagttagagcatgcagctcaggagtgctgagctgagcctttgccccctgaaatcttccagaaatgaagccatttgactgaacctaccttgtgccacagtcaaaccctcaagggcattaaagaatataaaaaaggaaaaagctccatccaaaggacagtgactcaaaacattaaaggaaccttagcccacacagatgtgaaagaaccagtgcaaaaactggcaatgtaaaaagccagaatgtcttcctgtcttcaagcaatcatactaactctctaacaatggttgttaaccaggattaaatgacagacatagaattcagaatctggatagaaacaaagatcattgagattcagaagaaagtcaaaatccaatccaaataatctaaggaatccaataagatgacataagagctgaaagatgaaataggcattttaagaaagaaccaaactaaactgatagagctgaaaaatgcgcctcaagaatttcataatacaataacaagtactaacagcagaacagaccaagctgagaaaagaatcttagatctcaaagaccacttctttgaattaactcagtcagatgaaaataaagaacaagaaagaatgaacaaaacctctgagaaatctgagattatgtaaagagaccaaacatatgactcaaggcatcactcaaagaaagggagaaagaataagcaagttggaaaacatatttgaggatactgcccacaaaaatttcccaaatcttgctagagaagtcaccatttaaatccaggaaatgcagagaacccctgtgagatactacataagatgaccatccccaagacatccccaagtcatcagattctccaaggtcaacatgaaagaaaaaaacatgaaaggcagctaaagtgaaggggcaggtcacctacaaagggaatcccatcaggctaacagtggaactgtaagatactctacaatccaaaagaaattgggggcctatattcagcattctttctttttgtttttgagatggagtctcactctgttgcccaggctagagtggactggtgctatcttggctcactgcaacctccacttcccgggttcaagcgattcttctgcctcagcctcccaagtagctgggactacaggtgcgcaccacaacacctggcaattttttgtaattttagtagagacgggatttcaccatattggccagggtggtctcaaattcccaacctcgtgatctgcccacctcggcctctcaaagtgctgggattacaggtatgagccaccatgcctggccttcagcattcttaaaaaaaaaaaaaaaaaaaaaaaaaaaaacttggctgggtgtggtggctcatgcctgtaatcccagcactttgggaggctgaggggggtggatcacaaggtcaagagatcaagaccatcctggccaacacggtgaaaccccatctctactaaaaatacaaaaattagctgggcatggtgatgcgtgtctgtagtcccagctactcgggaggctgaggcaggagaatcacttaacccaggaggtggaggttgcagtgagctgagatagcaccactgcactccagcctggcgacagagcaacactctgtcgccaaaaaaaaaaaaaaaaaaaaaattcaaccaagaacttaatatccagccaaactaaacttcatattgaaggagaagtaagatccttttcagacaaacaaatgctaagggaatctgttaccaccagacatgccttacaagaggtccttaaaggagtgctaagtgtggaagtgaaggactgttaatggccaccacaaaaatacgtttaagtacatagaacattgacattgtaaagtaactacacaatcaagtctgcataataaccagctaacaacataatgacaggaccaaagctataaatatcaatattaactgtgaatgtaaacagtataaacgccccacttaaaactcacagaatggcaagttggataaagaagcaaagcccaactgtatctgctgtcaagagacccagctcatatgcaacgatacccattggctcaaagtaaaaggatggaaaaaaatctagcaagcaaatgcaaaacaaaaaagggtaagcattgttatcctaattcagacaaaatagactttaaaccaacaacaatcaaaaagacaaagaagggcactacgtaatgataaagggttcaattcaacaagaagacttaactgtctaaaagataaatgtgctcaaaactggagcattcagattcataaaacaagttcatagagacctatagagaaacttagataaccacagaataatagtgggagacttcaacatctcactgacagtactagacagatcaaagagacagaaaatgaacaaagatattcaggacttgaagtcaacacttggctaaatggacctaacagccatctacagaacactccacccaacaacaacagaatatatgttcctctcatctgtacatggcatatattgtaaaattgatcacactatcagtctaaaattattttcaataaatttaagaaaacccctgaaatcaggccaaccacactcttggacccgcagtgtaataaaaatagaagtcaacactaagacgaactctcaaaaccatacaattacatggaaattaaacaacctgtgcctgaatgacttttgggtaaacaatgaaattaaggcagaaaccaataaattctttataactaattaaaacaaagatacaacattctcggctctctaagacacaggcaaagcagtgttaagggaaaagtttatagtgctaaatgcccatattgaaaagttagaaggatcttaaattaacaacctaatatcatacctaaaggaaacagaaaaacgagaggaaaccatcccaaagctagcagaagaaaagaaataaccaaaatcagagcagaatggaatgaaattgagtcatgaaaagccatacaaaagataaatgaaactaaaagctggttcttcgagagaataaataaattggataggtcactagctagaccaataaggaaaaaaaaaaaagagagagagaagatccaaaaaacacaatcagaaatggcaaagtggacgttaccgccaaccacacagaaatacaaaaaactctcagagactacgatgaacatcttcatgcaaacaaagtagaacacctatgagaaattggtaaatttctggaaacatacaacttcccaagattgaactaggaagaaactgaaatcctgaacaaatcaaaaatgagttctgaaactgaatgagtaataaaaagtctctgagccaaaaaaaaaaaaaaaaaaaaaagcaagcccaggacccaacagattcacagacaaattctaccagaagtgtaaagaagagctggtaccaatgctactgaaattattccaaaaaaatgaggaggaaggatccctccctaactcattttatgaggccagcatcattcagatatgaaaacctggcagagacacaacaaaaaagaaaacttcaggacagttatcactgatgatcatagatgcaaaaatcctcaacaaaatacaagccaactgaatccagcagcatatcaaaaagctagtccactatgattaagtaagctttatccctgggatgcaagtttggttcaagatatacaaaccaataaatgtgattcatcatataatagaactaaaaataaaaacatcccttcatgatatagaccctcaacaaatgagttactgaaggagcatacctcaaaataattggagccatttatgacaaaaccacagccaacttcatactgaatgggaaaaagctggaatactccctttgagaactggaacaagacaaggatgcccactctcactactcctattcaacatagtaatggatgtcctagccagtgcaattaggcaagagaaagaaacacagacatctaaataggaagaatggaagccaaactatgcctcttcataggtgaaacacttttataccaagaaaaccccatagtagcctctcaagagctcccagatctgacaaatgacttcagcaaagtttcaggttacaaaactcaatgtacaaaaatctgtagcatttctatacaccaacaacatccaagctgaaagccaaatcaagaatgcaatcccattcacaatagccacaaaaaaactataaaataccttggaatacagctaagcagggaggtgaaatatctctacaatgaaaattacaaacgagtgctcaaagaatcagagacaacagaaacaaaaggaaaacattccatgatcacagataggaagaagcaatattgttaaaatggccatactgcctaaggctatttacagagtcaatgctattcctatcatactatcaatgacatttttcacaggattaaaaaaagcatcctaaaattcatttggagccaaaaaaacaaacaaacaaaaaaagcccaaatagccaaagcaatcctaagcaaaaagaacaaagccaaaagcatcacactacctgacttcgaacggtagtacaatgctacagtaagcaaaacagcatggttatgctcagcaaaagaaataatcagcagagtaaaaagacaacctatagagtgggagaaaatctttacaaactatgcatccaacaaagtactaatatccagaatctataaggaactcaaaaacagacatagaccagtggaacaggttacagaacgcagaaataaagccgcacacctatagccatctactcttcaacaaacttgacaaaaacaagcaatggggaaaggaatccctactcggaaattgtgctgggataactggctagccatatgcagaaaactgaaactggactccatacgtttcaccgtttacaaaaatcacctcaagatagattaaagacttaaatgtaaaacccaaaactataaaaaccctggaagatatcctaagaaataccattctggacacaggccattctggacatatcctaggaaatttcaattctggaaaacactttatgatgaagacgccaaaaacaattgcaacaaaaacaaaaattgacaaatgggatctaattaaactaaagggcttctgcacagcaaaggaaatcatcaacaaaccacctatggaatgggagaaaatatttgcaaaccatgcattcgacaaaagtctaatatccagaatccaaaaagaacttagaaaaatcaacaagcaaaaacctaacaaccccattaaatgggcaaaggagaggaccagacacttctcaaaagaagacaaacacgtagtcaacaagtatatggaaaaatattcaacatcactaacattagagaaatgcaaaacaaaactgcagtgagatacaacctcacaggaggcagaatggctattatcaaaaagtcaaaaagtaacagatgctggcgagcttggggagctactcccaggtctttggaaggctgaggcatgagaattgcttgaacctgggaggcagaggttgcagtgagctgagattgggccattgtactctagcctgggcaacagagcaagactccgtctcaaaaaaaaaaaaaaaaaaaaaacccgagagagagagagaaagaaaaacccacagccagcattatactgaatggggaaaagttgaaagcattcccccgagaactggaacaagacaaggatgcccagtttcaccacttctattcaacatagtactggaagtcctagccagagcaatcagacaagagaaagaaataaagggcatccaaatcagtaaagaggaagtcaaactgttgctattcatgattatatgatcatataatgagaaaaccctaaagactcatccaaaaagctcctagatctgataaatgaattcagtaacgtttcaggatacaaaatcaatgtacacaaatcagtagcactggtatacaccgatggtgactgagctgagaattaagtcaagatctcaaccccttttacaacagctgcaaaaacaaacaaacaaacaacaaacaaacaaacaaaaccaaagaaaaaaccccaagcaaacgaacttaggaatatacctaaccaaggaggtgaaagacttctacagtgaaaactacaaaacactgcagaaagaaatcatagatgacacaaacaaatagaaacacatcacacgctcatggataggtagaatcaatattgtgaaaatgaccatactgccaaaaacaatctacatcatcattcttccctgaactagaaaaagcaatcctaaaattaatgtggagcccaaaaatagcccgcataaccaaagcaagactaagcaaaaagaacaaatgtggatgcatcacattacttgacttcaaactatactataaggctatagtcaccaaagcagcataacactggtataaaaataggcacatagaccaatggaacagaatagagaactgagaaataaagccaaatacttaagccaactgatctttaacaaaggaaacaaaaacataaagttgggaaaggacaccctattcaacaaatggtgctgggataattggcaagccatatgtagaagaatgaaactggatcctcatctctcaccttatacaaaaatcaactcaagatggatcaaagacttaaatctaacacctgaaactataaaaattctagaaggtaacattggaaatacccttctagacatttgcttaggcaaagacttcatgaccaagaacccaagagcaaaggcaacaaaaacaaagataaatagatgggacttaattaaactaagaagcttctacacagcaaaagaaataatcagcagagtaaaaagacaacctatagagtgggagaaaatgtttacaaactatgcatccaacaaagtactaatatccagaatctataaggaactctaacaaatcagcaagaaaaaaccaaattatcctatcaaaaagtgtgctaaggacatgaatagacacttcccaaaagaagatatataaatggccaagaaacatgaaaaaatcctcaatatcactaattattagggaaatgcaaacaaaaccacaatgcaataccatctcactcctccaagaatagccataatcaaaaaaataaaaaaaaaaaatagatgttgccatgggtgtagtaaaaaggaacactttcacactgctggggggaatgtaaactagtacaaccactatggaaaagagtatgaagatttcttaaataattaaaagtagatctaccatttgatctagcaatcccaatactgggtatctacccagaggaaaagaagtcattatatgaaaaaaacacttgcacacgcatgtttattgcagcacaatttgcaattgcaaaaaatacggaactagctcaaatgcccatcaatcaatgaatgcatacagaaaatgtggtgtatatatacgtatctatgtgtatatatgtgtatgtatacacacacacacacacacacacacacacacaccatcgacagaatactactcagccataaaaaggaatgaaataatggcattcacagcaacctggaaggagtcggagaccattattctaagtgaagtaattcaggaatgaaaaaaccaaacattgtatgttctgacttataagtgggagttatgctatgaggatgcaaaagcgtaagaatgatacaatgggctttggggacttagggggaagagtaggaggagggtgagcgataaaagactacaccttgggtgcagtgtacactgctctggtgatgggtgcaccaaaatctcagaaattaccactaaaaatattttccatgtaaacaaacaccacctgttccttaaaaactaatgaaaaaagaaaaaagacatgagatcaacctaaatgcccatcaatggtgaactggataaagaaaatgtggcacataggagggggtatatctcagggttagagcatcagactgcggaccaagaaaatgtggcacatatacaccatagaataatacacagccacaagaaagaacgagatcatgtcctttggagcaacgtggatggagttgaggccattatcctaagtgaattaacacaggaacaggaaaccaaatatcccatattcttacttataagtgggagctaaacactgagtacacatggacagaaagaagggaacaatcgtcactaggtgaatttgagggtggagggtggaaggagggggagaatagaaaaactacctattgggtattatacttattacctgggtgacaaaataatctgcataccaaacccctgtgacatgcaatttatccatataacaagcctgctcatgtaccccttgagccgaaataaaaattggagaagaaaaaaactcgtaagagttgtcactttgggtagagttatgggcattatgatttgaaggcatattctaaggtcattcctcctttatttataaagttctaatttttaaaataaaagtgcatttgagtattttatcataaacattaatttaagaattcactggattttgtagtaactatgtaatggatgaactttgctatgagtgtcattggaatggataagcagagacaaaagttgatgaattaagaaatgaaaaggagttaggatctagagacagtagttacagacttattttgaggaattcaaacataagacaaatggatggtagataaagatggatggggcattggatatacggcaagagtttttgtttgcttgctttctttaaaatgggagagtttatatttatacacctatgtctatataaaatgtttctcaaatatacttatatatatacacatacatatatatgaaatgtgcaactgtacttacatacagctatgaggaagaggccattagatagattaaaacatacagatatgttataatacagatgaaaaggaataaattgatcatgtgaattttcttgatgataaacatttaggggctatgaatgtttgttaaaaaaatttcgtacaatttgggacatggctctgcttttaatcaactgctttccaaggattttaacactgaaacgaattttaatagagcttttctatacaacattctgaatattttaacagttttaatgaagcatccttaattgaatattttcataagaaaaaatgagaaagaaattaccctaatagaaatgcccattgccagggaaatttcataatgaagtgtgaaaaaacagcagctgcacttgcctccataaggcatggacctacagccaatctgaaacaaacgaccttcaaatgcctcaaagcctgaaacacaaaacagtcacacttagatacatttacaatggccaacaagaaaattattttaacaaatgtcaaactataaagtcttttttcataagaagctttcactaaacgaaatctcatttcaacagattgtcccactggactttgaactctattacattttatatgtcatcataggttggattataaacaatttcatctttttaaaaatattattatattttaattattaaaagatcaattttactgtgattaaatagctaatgctaccttcctgaactttcctaataaatagtataataatagtgtcctattagtgttttcccattaactttttgatatgaactgtttgattaacttaataagtataaatagaataccaacatgccaaagaaaataacttaaaaactgcataattcattttaaaagggagaacttttcaatgttctccttggttcatactttctgctggagaatataatcttattggctataattatttatgctcttgagctatttctattaaaccacatttgccacatttatttgagtggctgtcatattcatgaatagtcatcttcttatagatgggatttatgatccctagaatgtaatattttaagaaatgctttaaaagattggattttacaataatgcaaagataatcaggaacataatcctgtggagaaaatgtcataaaaaaattactgaaatccttaatctccctaaaaaaagaaaaagacttttataaggtttttcttatcctatgttaactgaaaagtacatacttctccatagaagagcctcccaaataatataggtgctatataagagacatttatctctgtgcaaatgattagatcgctaataaagaccttacaacacagtcaattctcttcatatcagtgataatgatggctagacatagaaattagggtgccaatatttctatacagtctttttttcttctgtttttttcttctgtttgtttgttttgttttgttttttgagacggagtctcgctctgtcccccaggctggagtgcagtggcactatctcagctcactgcaacctccgtctctcaggttcaagcaattctcttgcctcagcctcccgagtagctgggattactaggtaaatgccaccagcccggctaatttttgtagattacaggcatgagccgccatgcccggcctttttttctttatcttaggtttgtttacagactctatttggaacaggaaaataaaatttttgcttctttttctttctcaccgtcctctaatatttgaaataaccttactcgatttgtaattgtaaatctacctgtggatcgagtccaagcccagctcttattagaataatggtaagggcaatgcttcttaaaattgaagaccatgtgttaggaacatggacatgttcattgatgaatggaacattcctaatcgtaaaaccagccagtaacatcccttaaaagaaagaaaataaagatacatgacagttcatttttctgagaaagaaaacggaaatgtttactttcttttctaatgcactatgtctctcattattttggtaaagggcaggttacaagcaagtagagaaggcagcatgaataaaggaatggcgataagaaacaatacacctaaatggggttcaacaagtaagttagtgttgctggaacatacagggcaaggaaaggagggaggagaatgagcttgggtgggccagatcatagaaaggtctccccccactttggcaaagtaaggcaccatgggaaggttttaggcaggaagtaacataatgagtcttgcgttttttatgtgagggtcttggtgaattagtttgggataaaactggagacagagaccaaattgaaggctctgccacagtccacgcaaaagttggaaacaaatagcctaagctagagcaaaagagaaagtttggagaggaggaaaatgattcaataaatacttagaaggtgctgtaagaaaattgtggatacagaagggacagcagagataagatgtagagattatctctactgacagtgtactgaatatatatttatttttgaggacagggtctcattctgttgtccaaggtgagtgcagtgatgcaaacatggctcactgtaggcttaacctcctgagctcaagtgatcctcttgccttagcctcctgagtagctgagacccagaaaaatttttaatattttgtaaagacaaggtctgctatattgcccaggctggttttgaactcctgggctcaggtggtcctcctgccttggcctcccaaagtgctgggattatgggcatgagccaccgtgcctggcccactgtactgaatatttagatatatttgaatacagtaagttctcacttaacatcatcaataggttattggaaatggcaactttgagtaaaatggtatataacaaaaccaattttagcataggctaaatgatataaacaacagtcaatttcctacagcatatttccggtcacaaaacatcaccaaacttctaaataaagatccaaaacacttctagtattaaacaatgaaataaatgtgagctctacatacactttagaaagttttataaaaacaaataagataattatttacttaatttttggtgaatccatgagtgatggtggttatagcggtgatggttaaaatcaaagaataaatgtttacaaagtgaaaattgtaaggagcacctcctcccactatgcagttcaaaaacaatcacaaatatggtaggctggctgagagttttcatatcacattgtctattgtcatgcatttgtatggttaccatatacttaacaaaattttattttacaataatttgtattcattcatttattcatcgtacaatccacttattctagttcagggtcaaaggtgactgaaacttaatccaaaaaaatcaaggagggactccctccctaacacattccatgaatctagtatcacagttatacccgaatcaggcaaagccatacacacacacacacacacacacacacacacacacacacacactactggtcaatatccctgatgaacatagatgcaaaaattctgaactagcaaaatgaattcaatagtacatcaaaaagataatatagttaagtggattttactccagaaatacaaggatggttcaacatgtgaatcattcttccataaatacatatacacacatatgttcattgtagcactattcacaataaaaggacatggaatcaacttaaatgactaaataaagaaaatgtggtacatatacaccatggaatgctatgcattcataaaaaagaatgacatcatgtcctttgcagcaacatggataaagctgaacaccattatcctaagtgaaacaactcagaaacagaaaaatcaaataccacatgttctcacttatatgtgggcactaaacaatgggtacatatggacctaaagatggaaataatagacactggggagtccaaaaggagagagggttggagggttaaggttgaaaaattacctattgggtatagtattcactatttggtgatgggttcactagagcccaaatgtcaccattatgcaatatatccatgtaccaaacctgcatatgtaccccgtgaatctaaaatttttaaagattctattaaacaataaagcaacaggaataatgtactaaggatattaaatttattttaaaaataaattttggataaaacttgtgtgtatatatgtagacagagaaataaatgcatctataaaggagctgtacacacacacacacatacagtaaatacatacatgaagaaactatataaaacatactacattgaaatatttctgaattataactaattcaacaagaaaatgttcaacatttgcatatagtcaataataaagaaaagagagctaattatatacttaccaagaagaggtggaagtggaggcactaaaggtattctaatgagttgtaaaatttttcccccaataatggcactataaaaaataatgaacaacccaaataaatttccaccagggagagcttcagagcctaagattgaccaggtcatacaccatatcacaaacagtataactcctgaaatacaaaaaagtgtacagctatatatctacatacacatagatgtatacaaacaaaggatcaattctcttttatcatatatactaatagccagttttataaaatgatacatggtatagatcaacattgcttactagtttggtgaaagagatatctgcttaacatatattccaaataacctgtcaatttatgaagtaggtttcaaacaaagtgtttttactttaaaaatatttaaaacctatatgtgggccaggtgcagtggctcacaccttaatcccagcactttgggaggctgaggcaggctggatcacatgaggttcaggagtttgaggccagcctggccaacacagtgaaatcccgtctctactaaaaatacaaaaattagccaggcgtggtggtgcgtgcctgtaatcccagctacatgggaggctgggtcaggagaattgcttgaacccgggaggtggaggttgcagtgagccaagattgtgccactgcattccagcctgtgtgacagagtgagactcagtctcaataaaaaaataaaaaaataaaaaaaacctatatgtgaactctggaaaatgctaaccattataatatatgatagttaaaaacatcatggcaatatgatgagatttacttcattttatattttaaaatagctttttcatcaggatggaaaataagaggatgactggctgtgataagaattcacaaccttattgaagatcacagtgtcaaggtgccaaatcttttaagaggaacctactaaatctttgtattgaaaggataattcaactgatatttggcataaatgtattagaggaggtaatggctggaagaaatgaacctagattttgtgggaataaatataaagtatcttagattatgtgtaggaagtagaggtagataagatgagtaggtataagttactagacatcttgtttctggcaactaggtgctactcactgaggaatccataggtttctataaaggacagacaataacatggtaaatttccatatgctaattaaattgctacctttatttgctatgaatcataattgctaatgcttttaatattcttaaaacagtttatatgcattttttagctatgacccctttccggctgtatagaatttgccagggtaaaagaggacgattttgactcactccaggcagaaagttagaacaaagtatctctttcctcctcccctctgattattgtcatcctgcaaaactggaagccttggagggctaaactcttactaaaagaatggaccaggctgggcatggtggctcatgcctgtaatcccagcactttgggaggctgaggcaggtggatcacctgagctcaggagttcaaaatgagcctgaccaacatggtgaaacgctgtctctattaaaaatacaaacaattagcctggcctgttggcgcatgcctataatcccagctacttgggaggctgaggtaggagaattgcttaaacccaggaggcagacattgcagtgagctgggatggcgccacttcactccagcctaggtaacaagagcaaaactccatctcaagaaaacaaaacaaaacaaaacagaaaacaaaacaaaacaaaacacggacaagaaaatgtcatcctactgacaaattgagaagacaaggcagtttgtcttagctggtctctgggtggcaaagtcttttttgagaattcataggtaaaactggcctcatccaacttatgtgtagggctcaaattacattatgtgcacaggttagggatcccaaagttctaaacctaccataaaagtgtccctgcatagaagtatccctagaacacacttagtagatgctaattcaaaaaatctctaatagacagtcctgatcccagactgcataaagtctcaaaggtaaagccaagtgaatctgaacttaaaataagaagaaatatcccatgagcaaaagttaacagatactacaaagaatgggattagatgtctgaaaaccttagctaatagaaccactagatagacactataaaatatgtattttcaaagggactagagacaatttttaaaaattggagacatgagaagaagaaattacttgaaagcattgtaaaataattaaatagaacatctagaaaaaactgtaaaatttactcaactaaaaaaaaaaccactaagtacccaaacagcagtctagacatggctgaagagagaacacagcaaagtagtagatatgaggaaattacttaagagcatagcacacacacacaaaaaaatgaggtggaaaatgagagatttagattatggaaaagatctaaaacacaactaatagtagtttcagaaacataattgaaagaatgaagaagatataatatttgagaagaaaactggcttcaaactttacagaattgattagggtttttattgatttggacacaggaagtcaaatgagttctaatcaggattaagtaaaaatagatacttagataaaatgttgagaaactatagactaccaaaggcaaaaataaaatcttttttttttttttttttttattatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatactcatttgggtatatacccagtaatgggatggctgggtcaaatggtatttctagttctagatccctgaggaatcgccacactgacttccacaatggttgaactagtttacagtcccaccaacagtgtaaaagtgttcctatttctccgcatcctctccagcacctgttgtttcctgactttttaatgatcgccattctaactggtgtgagatgatatctcatagtggttttgatttgcatttctctgatggccagtgatgatgagcatttcttcatgtgtttttttggctgcataaatgtcttcttttgagaagtgtctgttcatgtccttcgcccactttttgatggggttgtttgtttttttcttgtaaatttgtttgagttcattgtagattctggatattagtcctttgtcagatgagtaggttgcgaaaattttctcccatgttgtaggttgcctgttcactctgatggtagtttcttttgctgtgcagaagctctttagtttaattagatcccatttgtcaattttgtcttttgttgccattgcttttggtgttttggacatgaagtccttgcccacgcctatgtcctgaatggtaatgcctaggttttcttctagggtttttatggttttaggtttaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttattcttttggcttaggattgacttggcaatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcacccatgatttggctctctgtttgtctgttgttggtgtataagaatgcttgtgatttttgtacattgatttcgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgctggttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctcaggcaaaaataaaatcttaaagaatctagacagagaaaaagagattaatcataatcgaataaacaatagagcagattctcagtacttatcagcaacaatagaagatggaagataaataaagtcttcaaagtacagagataaagaaatcattcaatgttgaattctgtagccagttaactgtcactcaaacaaaagacaaatgaaagatattgtcaaacaaatacatttaagaacatatgccattttttaccagggaaaaatctactgaaagatatgctttagaaatatgacatagaaccaaaaaggaaggaacaatgtgcaaagaaattggtaaaatgtaggttagtctaaacaagtactggttgtgtaacacattactaatgaaaattgttaatcagaggatataaagataaggttgggaggtgacatgaaaaggttggcaatttatttccacaccaaaactccccccaaaaattgcaaaaataccaaaaacaaacatttcaggaccctgaaaactcatcaaaggcagttatcaaattaagaagcatttatccttgaaaaaagtgttagggttttgggtaggattggtaaaagtctgagcccttcctgactggggttgctccctgatatggtttggctttgtgtccccatccaaatctcatcttgaattgtactcccacaattcccacgtgttgtgggagataattgaatcatgggggtggttccccccatactgttctcgtggtagtgaataagtctcacaagatctgatggctttatcaggggtttctgcttttgcatcttcctcattttctcttgccgccaccatgtaagaagtgcctttcacctcccgacatgattctgaggcctccccagccatctggaactataagtccaattaaacctctttttcttcccagtcttgggtatgtctttatcagcagaatgaaaacggactaatacactctcatctctcttctcatccccaagctcagctgggaaaaacagtagttttaccagtttgaagctggatgtaaaacccagcagctttcctgttagggctgggggcaggggtggatttggtatggagtagagggaagaaatcaatggttttgccagttaaatatagcagagtggtttgagaatgaacagacagaattgcagctttgctagtctgaggttgcagtttcaattggggaagtggaagacaagacaaaaatttaaatgagagatcctgagggtcaataggtgcagcaaaccaccatggcacatgtatacctgtgtaacaaagctgcacgttctgcacatgtatcctggaactcaaagtaaaattaaaaaagaaagaaagagagagagagaaacaacaaacaaagtggaagaaagaaagagagagagaaagaaagaaagaaagaaagaaagaaagaaagaaagaaagaaagaaagaaagaaagagagagaaagacccacatgcaaggctagagttttccagttccaagttccaattctctcactgagaagagtggctcacggtgcctaaactgtttatacaaacaatatggtttactctgaacagctgcttttcttctgggagtctggaattctggtacatgtgaaggacagtaacctccgtaaaatcctgagtactgagtctctaatgagactctggtcctggtagacgacattgcacatgtgctgtcaaaatttcatgctggggaagagaaacacatccttgtaactccacaggagatgattccaggaagtttgtgcctggtatcctccagactttaccacacacaactttttccctttgctaattttgctttgtatccattcactataataaattaaaaacctgagtattactaaaaaaaaaaaaaaaagactgatcctggaaaggagagaataatagaaagtttgtgataagttctccacacatatatggccgattggaaaagtatggaagtgcaggaaagactcaagagagtatgacaaaaagtaaaaatgaagtaagacttgagtattaattgcaactttgaatgcattcacccacccacccacagattatttggcagacagtggaagccttactagctttaacataatgtctctccaaaatcaagctatgcaacagacacaaaggaaatccctagaaagacaggctaaaacaacaataacaacaacaacacaatataaaagacatcactgctgaaaaccactgggcagaaggattacacagcacatgtataggccaattaccaaaacaataacaacaacaaaaacaatcacaaataaaaaccaaatccagatttgctataatgtgtaattaaagtgtttagttttcaattaaaaattatcagacatgtaaggaaacaggaaaatatggttcatactctggaaaaaaagcagtgaatagaaactctcaattcagatactggatttagaaagaaagttttcaaagtatatattataaatatgttcaaattaaaaatatgataatgtgctgtctaatagagaacatgaataaggagacagaatatatttaaaaatagaatctagaatcgaaaagtacaacagttaaagtgaaaaaatcactagcgaggttcagtagcatatttgaccttgtgaaagaaagtatcagtgaacttgaagatagaccaatagaggttaatcaatctgaagaacaaaaagaaaaaagaacgaagaataataaacagatcctcagaaacttatgggataccatcaagagcactaacatatgcataatgggaattccaggagaagagagagataagagggcagaaaaatatttgaaaacataatgtctgaaaacttcaaaaatgttatgaaaaacattaatcttcaaatataagaagttcaacaaatctcaagtaggataaacacaaagagattcacacctagagccatcatagtcaaattggtgaaaaccaaggataataagaaaatcatgaaaatagcaagagatgacttatcacatacaggggaacaataatatgatcaatactggcatttttatctgaaaaaaatggaggccttatgaagcgacatttcaaaagtggagggaaaaataactgtcaattaagaattcggtatccagttaaatgatccttcaaaaatggagctgaaataaagacatttccagataaataaaaataaagagaacttatccttgctaaagaaacactaaataaaatgcttttaagataaaaggatatgacaccagatggcaacttgaacctataaggaataaacggcactggaagtggtaaataaatttgtaagtataaaagattgtatgtgtgtatgtgtgtatatgtgtgtgtgtgtgtgtgtgtgtattctgatttcatctcttttttaaaaaaagcatctgattattataggcaataactataacaatactgctgagttcatagcatataagaggtacattggatcaaagttgctatataacactggaattaagtaaaaattattaaaccaaagtagattgtaaaaagtgaagatgattgattattataacccccaaaggtacttgggaggctgagatagaagtattgcttgaggctaggagtttgagactagcctaagtaacacaatgaaactctgttgatatagtttggatatgtgtccctgcccaaatctcatgttgaattgtaatccccaatgttggagataggtcctgctgggaggtgaatggatcatgggggcagatttctcctgaatggttagtaccatcctcttggtgctgtccttgggacagtgagtaaattcttgtgagatctcgtcatttaaaagtgtgtggcactgccccttgctcttttactcctgctttcgctatgtgacatgtctttgccttctgccatgattgtaagcttcctgaagccttcccagaagcagatgcctgcatgcttcctgtacagcctgaagaactgtgaggcaattaaaccacttataaattatcgagtctcaggtatttgaaagcaatgcaagaatggactaatacacctgtctctaaaaaatttaagcaaaattacccaggtgtgatgacacatgcctgtagtcccagctacttgacaggcaaaggtgagaggactgattgagcccaggagtttgaggctgcaataagctatgaccatgccattgtctcttaaaaaagtaagccccagagaggccaggcgcagtggctcatacctgtaatcccagcactttgggaggccgtggtgggcggatcacaaggtcaggagatggagaccatcctggctaacatggtgaaaccccgtgtctactaaaaatacaaaaaaattagccgggcatggtggcaggcacctgtagtcccagctacttgggaggctgaggcaggagaatggcgtgaactcgggaggtggagcttgcagtgagccgagatcccaccactgcactccagcctgggtgacagaacgagactccgtctcaagaaaaaaaaaaatcaacagagaaattgaaatagggcactaaaaatacttggttaacatgaaagaagcagtaatgtaagaaaagaaaaacaaaaagacatgacacatagaaaacaaataacaaaatgttaaatgcaagtccaaccatatcaataattatgtgaatggactaaaataaaaaggcaactattactgtacaggactttaaaaaaacaagattcagctatatggtgcctacaagaaacaaactttagataaaacaagcaggttgaatgtaaaaggataggagattaggagacatacatatatatatacacacacacacacacacacacatacgcaaatggtaattatggggaaagaagaaaacataagtgtaattactatatatatgtaatttttttaacctgtaagtcagttttattatctgtaaaatggggataaaaaaattatctcctgccaacataaataggttttgttacaataaaatgaactagtgagcatgaaagaacattgcaatctgttaagatgttcttccaggaattcttgcattctaggaaaatcagaacatttctggttatagaatttttgacattttgaggaaagatattttttaggatatatgtgaaaagaacactttatcttctctaattacatcatggattctctttttgcattgagattttgcttgaatatcaatagacaagacaagggagtggttcaggcacttgtctagtgagcggatcgctgacaggaagcaaggagccagaaggacactcccctgtgctgttggtcaggggcccgcttggctggtgccaaggatttgttctcagtgacaagacaaatacagaaatggagagtggttacaaacttctatagcaatttgacactgtattttataaaaagtaaatatcagtctacatcaaataggaaattaaaaacaaaaacaattgggtattaatctactaagcttagtccctaggtgacaaaataatctgtgcaacaaatccacatgacacaagtttacctatgttacaaacctgaacatgcacccctgaacccaaaataaaagtttttttttttaaaagaaaaacaaaacaaaaaaaccacatctgtttcttcatcacagataatttgagaagcactagtgtcaggaaaaaagaataataaataatatgtacattaaaactcaccagaaaacatatatgcactgggatatctttttggacattaaagaaatgtgaaaaatcacacatatattcctaatgaacttgactatattatatatatatgtttatttagaagtattaaattgaattaagtattaaatttattttttaataagtggtataaaggaaggatgttctgattaagaaggataggtaaagggcaattacaactctgggtagagaaatagtaaaatggccagaaacagactggcaaaggctatggagtaattaatctcacaaaaggaagcagaatttattaatataaataacatagtattgctgatacttaaataattgtgagttatattgaagaattattttatattttaaaatagcaaaaccccccaaaaaacagtgtggtaaagctgtggtgaggtttgtacattttaggaagccttgttatttttagctcatatggttttttgataagtaaaaatttaaaaaaagttaaaaatgatttctctgctgcttaaattccgatacacatctattgagtggtaagatatgagtttagagtcactgtatttttttagtagttctactaataagaaattttcattaagctttactttctttctttctttctttttttttttttgagatggagttttgctcttgttgcccaggctggagtgcaatggcatgatctcggctcaccacaacctccgcctcccgggttcaagcgattctcctgcctcagcctcccgagtagctgggattacaggcatgcagcaccatacccggctaatttggtatttttagtagagacagggtttctccatgttggtcaggctgctcttgaactcccgacctcaggtgatccgcccgcctcagcctcccaaagtgctgggattacaggcatgagccaccgtgactggcctaagctttactttctaaaaattatatcaaaattggtatttctctattatgtaatcataaattatatcaaatatgctgttttgaattttatttttccctttaaacataaagacacacattcagttcattgtgctatataaattaccagtgtgatcacaaattaagaaatgcaattcaaagaattttgcgtacaaggagtcctgaaagtgttaataacttttgatgcaaagataattttatgaaagtaatagaagactaaaaaaaggtacaaaacaattattatgtaagtatcttcctttttctgaatcacccatgattactttttccaccaagcaaaaactgactacatacttcagatctgtctcaaatctccccagcctcttttcctaaacctccccagcctctcaggacagacaggctgctcctgtactttgtgcattctgctatttttagcaagaggcctattttgtcagtgttgtctgaatagtatttgccaactcccagactttcagtcacttatttgtttatttatttatttatttggctcttttcttgtatttcccttttccttttctttcctttctttttccatttcctcctcccttcctttgcttacttatttttttccctttaattcccattcactatttccatgactgtcaaatagtaggttgatcctttaaaatattccttttttaaaatttattgtactttaagttctgggatacatgtgcagaacgtgcaggtttgttacataggtatacatgtgccatgtggtttgctgcacccatctacaatatatcttaaaatgaataaaagtggaaacacgcagaagacatggtgtatggggtgagtgggttgccaagtggatggtggcagggtgctccagggtggccagtggggctaaatgctgtgtattccaagcatggcggggttcctgccttcctgtgtggcagactgtggcatcaggtaagagccacttggtgcccaccctggctcctccattgccttgctctcagcccctggcatccagcccacacctggaggttgagctgcacccactgctctgggtctcagccctgtgatcacctcagtagatattctgagcttggctatgcaggcaacactgagccatagtttactattctttcttgcatttctatcagagagtcagcaaaggtagttgacaaagcccaaaggagaatgttgaggggagttgatgaccttgactttttcatacaggatgaagccattgataaatctatgtatgctacaaagtggtcaatatgactggaatcactgaagactgggatattatggaaaggttcatggagcaagtggtttttaaatatctttgagcagaatctgaggaccattattttttaatgacagaacttccactgaatacactagaaaatacagagcatttttgcagaaattatgtttgaattatttaatgtaccaggattctacattgcagttcaggaggtactggccttggcagtatcttggacatctcaacaagtgggtgaatgtatgttaatgagtatagtcattgacaaaggagatggagtcacccatgttctcccagttgtagaaggttatgtaattgggagctgcatcaatcacatcctgattgtaggtgatactgtgtatttcactcaacagctgctaagggagagggaggtaggaatccctcttgagcagtcactggagaccacaaaagccattaaggagaaatactgttacatttgccctgatacagtcaaggaatttgctaagcatgatgtggattcctggaagtggatcaaacaatacacaggtatcaatgtgatcaaccaggagaagttcataatagatgttggttacaaaaggttcctgcaacctgaaatatttttttacccagagtttgccaacccagactttatggaatccatcttgaatgttgttgatgaatacaaaactgtcccattgatgtgcatggtccactgtataagaatgttgttctttcaaggggtttgaccatattcggggatttgaacctcaactacagagagatttgaagagtggtacatgccagattaaaactcagtaaggagctcagtggcaggagaatcaaacctaagtttgcagaggttcaggtggtaatccatcacatgcaccacaatgccttatggtttggaagcttaatgatagcctcaactctggagttatttcaggcctgtcacaccaagaaggactatgaagaatatggccccagcatctgccaccacagccttctctttggagtaatgtcttagtgtctgccttgaaagcatcatttaatagtgtcatgttggggaacaagtgtccttcagaacccagagaagactaccatttctaaatgacatttggtgttgatgtctgagcagcatgcttgcatcacctagtgcatgaggcacagggcagagtcatttcagtaaaagccatttctttatgtgttgactgttgtatgcccactccttcttctctcactccctttcttcatgcttccccagtttccctcctccttttcacttgagcttttttgttgacaaataccattctgaaggaatttaaatgtgactttgaaaattgttaagaggaaaaaaaatttcaaaaatggcccaaaatagttctcccccaggaaataatgcagtggtataaatccttttcccccagcctatttttataaataaaatgttataaacttaaaatacaaaaaaccaataacataacattatttacaggatgcaattaaagcagtgtatagaggaaaatgtatagctttaaaaacagaaagaaaaaataatctaaaattggtaattaaaacttccatcttaagactctagaaaaagatgagtaaaccaagccaaaagtaagtaggatgtatgaaataaaaaggtcacagtggaaaacgataaatacagaacaggataacattaaaaacaaccaaagaaactcaaaattgcttatttcggaaagtcaagaagataaataatatttagttacattgaccaagaaaaaagaaagaagacactaattcccaaaatcaagaatcaaagaaaaatatcatcacagaccctacccttaaaaggatgttaagaaaatagcataataactttaaggcaaaaaattcgacaacttagataaaatagaacaattcctagaaagacacaaattaccaaaactgactcaaggaaaaaggaaaaaaaaaacaaatatcaatatcaagtaaagaaattgcatcagtaatttcaaatcttcctatagagaaaaaatatacttcactggtgaactctatccaactattaagggaggaaataataccaatgttacaaaaactttattaagcaaatagatgaggaaggaaacttcccaatgaactttatttcatttgatatcaatattaccctgatatcaaaacaagacaaagacattacaagaaaacacagctatataccaatatcccttatgaacctagacataaatattcttaaccaaatattagtaaatgtaattgagcaacatatgaaaaggattttataccataatcaaatgaagtttatctcaggaatgtgaggtggttgacttaacatccaaaaatcaatgtaataaactatattaacagaataaaggacaaaaccatatgatcacctcaatagatgcagaaaagcatttgacagaattcaacactcatatatttaaaaaaatctcatcagcttatgaatagaagggaacttcttcaaatgatcaaggcatctaccagaagcctacagccaacatacttaatggtaaaaatgtgcttacctctagattaggaaacatgcaaagatatctgtgtttaccacttctattttttccttgcaatagtcaaggaaaaaagttatggaaaaaagacaactctttttattgttagccttgtatacagaaaatcctaaggaacacacccacacacacacacccacataccacaccccctcccagacttactagaactaagagggtggcttagcaagtttgtagagtatatgatcaatatacaaaaatcggttatatatatagtagcaacaaacagtacaaagatgaaataaagaaaacaattccaatcacaatagcatcaaaaataaatgtcttagtttgttttatgttgttataatagaatacctgagactgtataaagaggtttatttagctcatgtttctccagaccgggaagttcaagaagcatggcaccagtatctgcttagcttctggtgagggctttagtagtgcatcacaacatggcagaagaccaaagaggaagtgggaatgtgccaagaggccaaacacaaggtacaaccttgtacaatgggttgctttataacaatccattctcagggtaactaatctattcccacaggaaccaatccagtttcatgagagcaagaactcactcactatatgaggactgcaccaagctgctcaaaatggcagagcccccatgacccaagcatctcccattaggccctgcctcttaaaggttccaacatgatttttggcagagacacggaaaccatggcattccacccttggaaccccaaactcatgtccctcttacactataaaatgtaattattcaatctcaatggtccccaaagtcttaatgtattccagtaacaattcaaaggtcaaagtccaaagtctcatataagactcaaggcaagttcctcctagctatgagcctgtaaaataataaaaaaaaaaacaacaagttatttacttccaagatacaatggtggaatagtcatatggcagacagtcccattccaaaagggagaaataggccaaaagaagaaagaggtgacaggcctcgagcaagttcaaaagtcagcagggcagacactaaatcttaaaactccagaataattctccactccacgtgctacctcctgggcacagtggggagtttttatccctaaagccttgggcagccccacctccattgctttgttgggcatagccacatggctgctctcactggttggaattggatacctatggcttttccaggctgaggttgtatggtggcaatggctctatagttctggagtcccagtggtggtccacttcatggattcactaggtattgccctggtacagactctttgtggcagctccaaccctacatttctgctcagcattgccctagggaagatacactgcagtggctctggccctgcaacaaatctccacctgagctcccagtcttttcagtacattccttaaaatctaggtggaagccaccatgactacacttctcttgtattctgcacatctgcaaaactagtaccacatggttgtaaacgccatcaaggcttaccacttgcaccctccagagtgctgtcatgagctgtacctgaggctgcttgatccacgactgcgtgccaccaaggtttatggtttgtatcttgtggaatggcagcctgagccatacctgggtatgattgtgccatggctggggtggctgctgagggctgtgccagaatttggggagcaggatctcaaaacagcacagggcagtgatgcatggattctgtctcttaaaaccattccgtcctcctagacctctggaaaggcaacctcaaaaatttctgaaatgtcttcagggcctttaaaaaattgtctcaataattatcaactggctctcttctctcagtgctaatctctttagtattggttgttctgctgcacccttggattcctctcctgaaaatgctctttcattctctaccacatggccaggctattaattttcaaatttttatgcttgcttcccttgtcattttgcatttcactgaatgtagtaagaagtaactacatagctgctctatattttgcttagaaatttcttctgccaggtaccctagttcatcactcttaagtttggccttccacaaaaccttagggcacaaagccttagaaacaacacagccaaatttttgctatggtctaacaaggatgacttggtctccagttcctaataccttgttcctcatttctatctgagatctcattagaatggcctttgctgtccatatttttatcagcattgtggtaatgactacttaaccaatctctaagaaattctaaactttctctcgtctttttgttgtcttctgagccctcattgaaattatccttaatgctctgtttatggcaatacagtctttttctagtctgctccttcaaacttgtccaacttctgcccattacccagttccaatgatgcttctgcatttttgagtatctaaatagcaacatcccactctcagtacaaattttctgtcttagtccgttttgtgttgctataacagaataccggagactgagtaatttataaagaggtatatttggcttgcagttctgcaggctggaaagaatgacactggcatctgcttgggttctggtgaaagctttagtgttgtatcacaatatggtagaacaaggtcaaaggggagtaggcatgtaccaggaggccaagcatgaagcgtgacctcaccgtatagcaactcattctcatggtaactaatccattcctgagacaactaatcccacaagagtgagaactcactcaccagtgtaagaatagtaccaagctgcccacaaaagaaaagctcccaagacccaaacacttcccattaggccccacctcttaagcattccaacatgagttttggtaaagacactcaaactatagcaataataattaggaataaatttaacaaaataagtgcaaaacctttgcactgaaaactaaaaaacatcactcagataaatgcctaaataaatggagagatatatcatgttaatggattagatgactcaatattgttagatgtcaattgatctacaaattaactgcaattcctgccaagagtctagaaagattattggaaaaattgacaagctgattctaaaattatatagaaatacaaaaatacctagaatagccaaaaaaatcttgctaagtaagaatgaagttagagtacttaatactgtcttatttgaaaattcagtgtaaagcagcagtagtcaagacagtgtagaatccacattaagagagatagatagatcaatggaactaagtggagttcagaatccaacccacataaatagtcaattgattttcatcaaagatgctaagacaattcaataggaaaaagatgttctttcaacaaatgattctataataactggttattcatttacaaaaactaaacctagatccttaggtcatatgcaaaaattaactaaaatggatcacagacctaattgtatgagctaaaactataaaacttctaggaaaaaaatataggagaaaatatttatgaccttggactaagcaaaggtttcttagatataatatcaaaaacatattccataaaagaaaaactggtaaattggacttcatcaaaatgatgaaatctttgcttttcaaatatttcttaaataaatgaaaggagaggattgttccaagatggccgaataggaacagctcctgtctgcagctctcagcacaactgacgtagaagacaggtgatttctgcatttccaactgaggtacctggttcatctcactgggactggttggacagtgggtgcagcccacagagggtgagctgaagcagggcagggcatcgcctcatccgggaagcagcacaaggggtcgggggatttccctttcttagccaagggaagccgtgacagacggtacctggaaaatctggacactcccaccctaatactatgcttttccaatggtcttagcaaacggcacaccaggagattatatcccctgcctggctcggtgggtcccacgcccacagagccttgcttactgctagcgcagcagtccgagatggaattgcaaggtggtagcctgggctgggggaggggcgtccaccattgctgaggcttgagtaggtaagcaaagcagctgggaagctcgaactgggtggagctcactgcagctcaacgaggcctggcagcctctgtagacgccacctctgggggcagggtatagctgaataaaagccagcagaaacttctgcagacttaaacgtccctgtctgacagctctgaagagagcagtggttctccaccatggagtctgaactctgagaatgggcagagctcctggtagggactgactgacacctcatatagccgggtgtccctctgatatgaagcttccagaggaaggatcaggcagcaatatttgctgttctgcagcctccaatggtgacacccaggcaaacagggtctggagtggacctccagcaaactccaacagacctgcagctgagggtactgattgttagaaggaaaactaacaaacagaaaggaacagcatcaacaaaaaggacatccacaccaaaaccccatctgtaggtcaccatcatcaaagaccaaaggtagataaaaccacaaagatggggggaaacaagagcagacaagctgaaaattcaaaaaaccagagtgcctcttctcctccaaaggatcggagctcctcgccagcaatggaacaaagctggatggagaatgactttgacgagttgacagaagtaggctttagaaggtcagtaataacaaacttctccgagccaaaggaggatgttcgaacccattgcaaggaagctaaaaaccttgaacaacgattagatgaatggctaactagaataaacaacatagagaagacctttaatgacctgatggagctgaaaaccatggcatgagaactacatgacgcatacacaagcttccatagctgattcgatcaagtggaagaaagggtatcagtgatggaaaatcaaatgaatgaaatgaagtgagaagggaagtttagagaaaaagagtaaaaaaaaacgaacaaagcctccaagaaatacgggactatgtgaaaagaccaaatctaagtttgattggtgtacttgaaagtgatggggagaatggaaccaagttggaaaacactcttcaggatattattcaggagaacttccccaacctagcaaggcaggccaacattcaaattcaggaaatacagaaaacatcacaaagatactcctcgagaagagcaaccccaagacacataattgtcagattcaccaaggttgaaatgaagggaaaaatgttaagggcagccagagagaaaggtcgggttagccacaaagggaagcacatcagactaacagaagatctcttggcagaaaccctacaagccagaagagagtgggtgccaatattcaatattcttaaagaaaagaattttcaactcagaatttcatatccagtcaaactaagcttcataagtgaaggagaaataaaatcctttacagacaagcaaatgctgagagattttgttaccaccaggcctgccttacaagagctcctgaaggaagcactaaacatggaaagtaataaccagtaccagccacacaaaaacatgccaaattataaagaccatcgatcctaggaagaaactgcatgaactaacgagcaaaataaccagctaacatcataatgacaggatcaaattcacacataacaatattaaccttaaatgtaaatgggctaaatgccccaattaaaagacacagactggcaaactggataaagagtcaagacccatcagtgtgctgtattcaggagacccatctcacatgcagagacacacataggctcaaaataaagggatagaggaatatctaccaagaaaatgaaaagcaaaaaatagcaggggttgcaatcctagtctctgataaagcagactttaaaccaacaaagatcaaaagagacaaagaaggccattatatagtggtaaagggatcaatgcaacaagaagatctaactatcctaactatatatgcacccaatacaggagcacccagattcataaagcaagtccttagagacctacaaagagacctagacatccacacaataataatgagagactttaacaccccactgtcaatattagacagatcaatgagacagaaggttaacaaggatttccaggacttgaactcagctctgcaacaagcagacctaatagacatctacagaaccctccaccctaaatcaacagaatgtacattcttctcagcaccacatctcacttattccaaaattgaccacctagtttgaagtaaagcactcctcagcaaatgtaaaagaacagaaatcacaacaaactgtctcccagaccacagtgcaatcaaattagaactcaggaataagaaactcactcaaaaccacagaaatacatggaaattgaacaacctgctcctgaatgactattgggtaaataatgaaatgaaggcagaaataaagatgttctttgaaaccaacgagaacaaagacacaacatatcagaatctctgggacatatttaaagcagtgtgtagagggaaatttatagcactaaataaccacaagagaaaacaggaaagatctaaaatcgacaccctaacatcacaatgaaaagaactagagaagcaagagcacacaaattcaaaatctagcagaaggcaagaaataactaagatcagagcagaactgaaggagatagagacataaaaaacccttcaaaaaatcaatgcatccaggagctgtttttttgaaaagatcaacaaaattgatagaccactagcaaaactaataaagaagaaaagagagaagaatcaaatagatgcaataaaaaatgataaaggggatatcaccactgatcccatggaaatacaaactaccatcagagaatactataaacccctctacacaaataaactagaaaatctagaagaaatggataaattgctggagaaatacaccctcctgagactaaaccaggaagaagttgaatccctgaatagacccattaacaggctctgaaattgaggcaataattaattagcctaccaacaaaaaaaagtccaggaccagatggattcacagctgaattctaccagaggtacaaagaggagctggtaccattccttctgaaactattccaatcaatataaaaacagggaatcctccctaccacattttatgaggccagcatcatcctgataccaaagcctggcagagacacaacaaaaaaaagaattttagaccaatatccctgatgaacatcaatgcaaaaatcctcaataaaatacaggcaaaccgaatccagcagcacatcaaagagcttaaccaccactatcaagtcggcttcatccctgggatgcaagcctgggtcaatatacacaaatcaataaacgtaatccatcacacttcagccttcgagtagctgacaggtgtgccaccatgcccagctaatttttgtatttttagtagagatggggtttcaccatgttgcctaggttagtcttgaactcctgggctcaggtgatctgctcgcctcggcctcccaaagtgctaggattacaggtgtgagccactgtgcctggccaatctatgtaacttttcatggaaggcaaaactataaaaaaagcagatcatttgttacttgggacttgggtaggtgggagggaggatttaatgcaaataagcatgaggaaactttttgagattatgtaagtattcaaaaactgaatttttgtaattgttgtacaactctataaatttaccaaaactcatcaaaatgtgcatttaaaataaataaattttgtggtctgtatattatacctcaaaaaagctgataaaatataaattggaacaaaagtactggaaaaccataagttggagacaaatgagggtgatcaaaattaatgcatccttcaagatgaaacgtgattttaattttaaaattaattttttaattacttgttaattcaagtacacatattaaatttcaagggtaatcgtgaatagaatagaactagaacatacaacttttaaacaaatagaggggaaaaaccttgatcaatctaacagaatgcattggggaaaagtattagagaaataatatggttaacagaaagcacaaaacatgatgacagaaataaatataaatttatcaataaccacaataaacttaaatggtctaaattagttaaagacagacacttgaagactggattaaaaacatgaaaatccaggtatcacctgtaatagttaaaaacatgaagacacaaaattctgaaggtatgagaagagtaaatgataaataaaacaaatattaaccaatatatggctggtatagctattttcatatcaaaaactataagacaaaaaacattctgaggaataaaagtcattatgtaaagacatctatgcaagtaacaattcaaccttaaaatatatgaagcacaaattgacagaattacaaagaaaaatggctaaatcctcaaccttgaagaaacttaaacctctgagtcaatgaaaatcaaaatgtagtaagattatctcagattttaaccaccgtattaaaaaagcttaatttaaaggaaatatatagacttccatatgctcaaattagagaatatatatactttgaagcctgataaagtcttaggagaactgaacctatactagcctatgaatcaaatcacaacaaataaacaaacattataacatgtggcttatactctgtaactaaaatgcaatttataatagaaaaaaatgtaaatttctttcattttcaaactaaaggcataccttaaataatttttcagtcaaagaagacatgaaaacaaaaatcagaagatatttggaagtgaaatactacataacaaaacttgtgagatagagctgaggcagtactgaaagggtaatttatatctttaaatgtttatattgaaaaatagggtgaaaattagttaagcgtccaccttcggaagtttggaaagagaaaaagagattgggcatggtggctcaggcctgtaatcccagcactttgggaggtcaaggcgggcggattacctgaggtcgggagttcaagaccagcttggccaacatggtgaaacccccatctctactgaaaatacaaaaattagctgggtgtggtggcaggtgcctataatcccagctactcaggaggctgaggcagaagaattgcttgagctggggaggcagaggttgcagtgagccgagattgggccactgcattccagcctgggcaacagagcaagactctgtctaaaattgaaaaaaaaaaaaaaaaaaaaaaaatcggagtaaacctaaataaaataaattaaaggaaataaggcaaaaagtagaaatagacattaataaactataaaacaaaaaaacaataggcaagattcacaaaaccaaatgctgattctttgaaaagaataataaaatagacacacttctggtaagattgattaattaaaaagagaaggcataaataagcaatattaggaataaaaaatgaaatgtaacataaaatatgagtgaaaaaataaagtgaatactataaatgactatatgacaacagtctaaaaacataagtgaaatgaacaacttcgttggctactataacttataaacacttagtcaagaagaaatgggacacctgaatattcctgtatctatttttaaaaattcaatcagtaaatactttctcagaaaacacccactagtatgagatactttaatatgaaagttctaccaaacattcaaagaacatataaataaccactatcacatcaaaataatttcagagaatggaaaaagagggaacaccttcaattcattttgtgaggctaacataaatgcaatataaatatttaagatcattataatccaagaaaattggaggccaaactaagcttagatacaaacatctaaaataaaataatagtaaatctagtaatgtattctaaaaaaattctggacccgttgggtacctcaggaatagaagcaaacatttaacagtttgcccaagcagcttttattttattttattatttttaaagagacagggtcttgccctgctgcctgggttggaatattggcatgatcatatagctcacagcatccttgaactcctgggctccagggaccctctgccttagcctcctgagtagctgggactacaggcacacaccacaatgcctagctaattttaaaaaagtttttattttgtagagatgaagtctcactatgttgcccaggctagcctcaaactcttggcttcaaatgattcttccaccttggtgccccaaagtgttgggattacaggcatcagccacggcacctggcctgagcaggttttaataagtcaccccatgtttggagaatttctaacattattaatattactttcccagtgtagaagccaggaactcaagtttttaaacttcctttgtcatgaaggcatagacacatgatgaacacactgctactgacattaatttctgcttttatctgaatagttggtacctccaggaaaaggaggggaatgaggttggaaaatagtacacaggaagcttcaactatatctataatgattatatatacatatatatatatatatatatatttttttttttttttttttttttgaggctggagtgcagtggtgcaatatcggctcactgcaacctccgcctcctggggatcaagcgattctcctgcctcagcctcttgagtagctgggactacaggtgcatgccatgatgtctggctaattttgtattttttagtagagatggggtttcaccatgttggccaggctggtttgaactcccaacctcaggtgatctgcccgcctcagcccccaaagtgctgggattacaggtgtgaactaccacgcctggccagataatgtttaaattagaaggtcacatgcataaatatgatatcttggacattgatgagaccacatagaaaaactatataaaaagaaaagaggaaaaggcccaggtctaagtcctgagtgatatttggtatttagaagttaggaaaagaagaatggaatatggaagacaagaaaggaagaagcagtgagggaagaagaaaaccagttggtgcctcagaattagaaaaaaaagacaagtgtttcaataagagagtgatcattggtgtcaaaagctggaaagatcttgaatacgatgcagacagaaacgttcactggatttggttaatacacttagtcagataaaccccagcaatttcaccagttacggtcgttttcatactccagagatgaaggataacatttactagcctacgtaatattctaggtcttgaatgtagatatcagtattgatttactttgaacttctactttaaaatcaagaaattaagtctcttctgaaattcaaagatattatcatttcttaacagtcatcaatagttttcatgacatctcatttgaagcaataactaatttatattgcattagctaatttaataaatggtttctgaaagactatatgcaaggataggtcccagtcataaagagctaatacctgctttgaaggaacttacaattaatttaataaaaaagacagaaatgttgtacaaattaaaatggcataagtgccaaagtaaaactggaaaatctggaaaaaaatcataggttcttgaaagatgaaatttcaataggcaaagataaggacatggtaagttaagggataggatggacacagatatagcaacgtgaagtcaagagcacattgagaggtaagtaaatttgtccggatgaagtgagatattttggcaggtgagagtggaaagaaaattcataattgaaacatgaagtgtcttgaatgctttgctaaactttaggagtaaaataaacataagaaatgttatgggctgggtgcaatggcttattatctgtaatcccagaactttgggaggccaaggctggaagatggcttgagcccagaagttgaagaccagcctgggaaactcagggcaatgctgtctctacaaaaaattttaaaaattatccagatatggtgacatgtgcctgcagtcccagctactcagtaggctgaggcaggaggatcacttgagcccaggaagtcaaggttgcagtgagttgtgatggtgccactgtactgcagcctgggcaacagagtgagactctgcctccaaaaaaagaaaaaaaaagagagaaatattatggaagtggaattgatagggcttataaacaaactgaataacagcatgaagaaaaaaggccaagtcaaagatgcttatgagctctctaggctgtataactgagacaatattataacttaaaaaaaaaaaaaaaaaaacagaaaaaaaggaagaagaacaagaggagcagagttttctagtgagaagatgaagatacttttgactacactggtgtaagtgaccttaagagaattacaaacaggattctggttaaataatttattattatgcttgtagttgagggtagatattttgttttagctccctggcaaacagaaccttataggtattcaataaatgtttgctgagtaaatgacattttgatgtatctaaattaatgttacttcaggagagcacctaaacaccaatgttgagaacgtttttgggaatactttaattatgaacttttagaacactagtacaatttttttctaacaaccagaaaaatttcttgtccctaataattcttttcaatgtgccattctcagagccccagctgggtgcagtatatggctaagcaattaatatgggacagctagagttttaaaaatatatagtctatgagaagttacaaatttttaaaaacatattctttttttattattatactttaagttttagggtacatgtgcacaatatgcaggttagttacatatgtatacatgtgccatgttgttgtgctgcacccattaactcgtcatttaacattaggtgtatctcctaatgctatccctccccactacacccaccccacaaccatccctggtgtgtgatgttccccttcctgtgtccatgtgttctcactgttcaattcccatctaagagtgagaataagaggtgtttggttttttgtccttgcgatagtttgctgagaatgatggtttccagcttcatccatgtccctacaaacgacatgaactcatcattttttatggctgcatagtattccatggtgtatatgtgccacattttcttaatccagtctatcattgttggacatttggcttggttccaagtctttgctattgtgaatagcgccgcaataaacatacgtgtgcatgtgtctttatagcagcatgatttataatccttaaatgggatctaattaaactaaaaagcttctgcacagcaaaagaaactaccatcagagtgaacaggcaacctacagaatgggagaaaatttttgcaatctactcatctgacaaagggctgatatccagaatctacaatgaactcaaacaaatttataagaaaaaaacaaacaatcccatcaaccagtgggcgaaggatatgaacagacttctcaaaagaagacatttatgcagccaaaagacacatgaaaaaatgctcaatatcactggccatcaaagaaatgcaaatcgaaaccacgatgagataccatctcacaccagttagaatggtgatcattaaaaagtcaggaaacaacaggtgctggagaggatgtggagaaataggaacacttttacactgttggtgggagtgtaaactagttcaaccattatggaagtcagtgtggcgattcctcagggatctagaactagaaataccatttgacccggcaatcccattactgggtatataaccaaaggattaaaaacgtgttcttatttttaggataatactacaaaacttttctaaaataaatgctctaaaactttttatttgctctctagtatttattgatatggttagctttctggtttcttaatttaccgtacatggttatactcattattaaaagctttttaaatatgatgctgtgaaaggtgttacagagagcaactgcataaatagttctacttatgacagggtaaaaaccactgagcaaacatacttaattgaatggatgacttcttggggaataaaaaagcattataatgtaaaactgtaggtgaaaacccttctcaagttcattgatgttagagacaaacgttttcaactcttttcatttcctatttgctctttgccaagattggaatagtaagtagttaacctgattggtgagaacctcatagttattgagccatatcctagaatcagtaggtaggtttcttttgcctcaaaagtgagaaatccattcctctgtctgttttgcattgtttggatgagtaaactctcctcttttcatttgttattctcagtagtaaacacatgtgggtcaggacccctctaaaaggcatccatttctcttctccagcctctagtgaactccagtctgctcatgatagtgtttttgaggcaagtccttcctcatagttaactgcgtactcaaagtctgctctgaaggatcagctttccagacaggaggagacacgatctatggagaagccttatgtttactccatttttccaaggagatcttacttgggggaagcactggccctccactaatggaactatgttcatccccacttggctccttagtgtctgttctctactgactataacccagaaggaatgtggatattattgtatttttaataggctttattttttagagcagttttaggctcacagcaaaattgagcagagattacagagagatctcaaaaatccccgctctctacaacctacagaatgggagaaaatttttgcaatctatccatctgataaaggtctaatatccagagtccacaaggaagttaaacaaatttacaagaaaaaaaacaaacaaccccattaaaaagtgggtaaaggacatgagcagacacttctcgaaagaagacatttatgcagccagcaaacgtatgaaaaaaagctcaacctcactgatcattagagaaatgcaaatcaaaaccacaatgatttaccatcttatgccagtcagaatggtgattattaaaaagtcaaaaaacaacaaatgctggtgatgttcagagaaaaagaaacacttttacactgttggtgggaatttacattagttcaaccattgtagaagacagtgtggcaattcctcaaagatccaggagcagaaataccatttgacccagcaatcccattactgggtatatacccaaaggaatataaatcattctattatgaagacacatgcacatggatgttcactgcagcactattcacaataaaaaagatgtggaatcaacataaatgcccatcaatgatagactgcataaagaaaatgtggtacatataccatggatactatgcagccataaaaaggaatgagatcgtgtcctttgcagggacatggatggagctggaagctgttatcttcagcaaactaatgcagaaacagaaaaccaaataacacatgttttcacttatatgtgggagctgaatgatgagaacacatggggggaacaacacacactggggcttgttgagggggttgagggacggagagcattaggaagaatagctaatggatgctgagcttaatacctaggtgatggattgatctgtgcagcaaaccaccatcgcacatgtttacccatgtaacaaacctgcacatcctgcatatgtaccctggaacttaaaataaaagttgatgaaaaaaaaatcccggctcccacacacttcctctatgaccaacattccacaccagagtggtccatttgttagaattgataaacctatattaacacatcatggtcacccaaagttcagagtttacattaggttccctcttgggtttgtatgttctatggcttttaacaaatgtataatgacatatttccatcattataatatcatacaaaatagtttcactgccctaaaaatcctctgggctctgcctgctcatccctccctcctctcaattcctgacaaccactgatctttttactgtgtccatagttttgcccctgttagaatgtcatatagttggactcgcacagaatgtagctatttcagattggcttctttcacttagaaacatgcatttaagtttactccaagttgtctcattgcttgataggtcatttcttttcagtattgaataatattccactttctagatgtaccacagtttatttattcactcacctaatgaaagacattttgattgcttctgaattttgataattatcaataaggttgccataaacatccatgtttatgtgcaggtttttgtgcggacttaagttttcagctcatttgggtaaatatcaaggagtgtaattgctggattgtatggtaagtctttttatttttgcaagaaactgccaaactatcatccaaaggggctgtacagtttgtacaactcccacctgcaatgaatgaaagttcctgttgctccgtacccttgccaagatttagtggtgtcagtgttttggattatggccatcctaataggtgtgtagtggtctctcactgttgtgttaatttacaattacctaatgacctatcatgttgagcatcttttcataagcttacttgccatctgtatatcttatttcgtgaggttcctgttgcagtgttgtgttcattttttaatctggttgtttgttttctttttggtgaagttttagagttctttttatattttgataacagtctttatcaaatatgtcctttgcaaatattttcttccaatctgttgcttgtcttttcattctcttgaaagtgtattccacagagcatagatttttttcccttctctttcacagaagggaacagcatggaagaacatacattttaatgttaaggaaatcaagtttatctattatttctttcatggagtgtgcctttgatattatacctaaaactcattaccataccaaaggtcatctagattttctatgttaccatctacatttatagatctgtgttttacattcaagtctatgatatgtttcgaggtaattttgtggaaagttttaaggtctatgtatagattcctttttttttttgcatccatgtggaggtccatatgttttgtcatgatgtatagttgaaaagattatgtttgctccattgtattgcctttattcctttgtcaaagatcagttgacaatatttttgtgggtctatttctggactctattctgtttgattgatctctttgtctagtcttttaccaataccacattgtcctgattatcgtagctttacagtaagtcttgaagttgggtaatgtcagttctctgattttgtttctctctttcaatgtcgagttggcttttctgggtcttttgcctgcccaaacaaatttttaaataaatttgttcatatccacaaaataactttcaggaattttgattgggattgcattgaatcaagttaggaagtactgacatctgacaatactagtctttcatgaacataaaatatttctcaatttatttagttcttttatttatttcatcagagttttatagttattactcaaatagatcttgtatatatttttgttagacatatatctaagatgttaatttttgtggtgctaatgtaaatggtgctgtttttaatttcaaattccatttgttcactgtggcacataggaaaacaattgacttttgtatattaatcttgtacctgccatcttactcacttagtagttgttccaggagttttttttacatgattcttttagaatttttaccgatacaatcatcttatctgtaaacaaagacaaatttatttcttccttcctaacctgtataccttttatttactttccttgtcataattcattagttggacttccagtacaatgttgaaaagaagtggtaagaggaggcatccttaccttgttactgatctagaagaaaagcttctagtttttcaccaatgagtacaatgttacctgtaggattttagtagatagtttttatgcagttgaggaagtttccactctattctagcttgctgatagttttttatttttaatcatgattgggcattggattttgtcagatacctttctgcatctactgatatgatcatgtgatttttcttccttagcctgttgatgtgatggattacattacttaatttttgaatgatgaactaatctcatatatctgggataaatcccacttggtcatggtcatggtgtatcctttttatatgctgtttaattcaatttgttaatactttgttaagaatttttgcatctatgtgcatgagagatattggtctgtagatattggttctataatgtttttgccagattttgatattaggaatgctgaccttatagaataaattggaaagtattccttctgcttatgtcttctagaaatagctgagaaaattgtataatttcatccttaaatgttttgtagaatttatcagcgaatccacctgggcccagtacattctgttttggaaagaaacactgattcaatttctttaatagttataggcctattcatattatccacttcctcttctgagttttggcagattgtgtctttcaaggaattggtcctttttatctaggttattgaatttgtgggaataaagttgttcatagtattactttattatccttttaatgcccatgggatctgtagcaatgtcttctcttttatttctgatataagtaatgtgtgtcttctctcatatttttcttagttagtttggctaaaggcttatcaattgtgttgatcttttcaaagaaccaggtttttgtttcattgaatttattgatttcctgtttttaattgtactgatatctactctaaattatattactttttttcttctgcttactttgaactcaattagctcttttctttctagcttcctgaggtggaagcttaatttattcattttagatctttctttttttctattaagaaatattatcaaatgctataagtttccttctactcattgcttttgctgcatcccataaattttgataagtagtattttcattttgttcaaagtacttgtattttttattattttattttattttattgagacagagtctcactctgtcacccacactgaaatacagtggtgtgatcttggctcattatagcctctgcctcctggggtaagcaatcttcccacctcagcctcccaagtagctgagactacaggcatgcgtcaccacactcagctaatttttatatttctttgtagagacagggcttcatcatgttgccaggctggtctcaaactcctgagctcaagtaatctgcctgcctcggcctagcagagtactgggattacaggtgtgagccaacatgtctggctgttcaaagtatttttacctttctcttgagagttctttgatttggtgttatctagaagtgtgttgtttaatctttaagtatttcgggatgttaaagctgtttttctgttactgatttttagttaaaattcattgtggtctgagagcagagattgcatcctttcaaatttattaaggtatgttttatggctcaggatatagtctgtcttggtgaatgttccatattagccggagcagaatttgtattttgctcttttgggatgaagtagtctataaatgtcaattatatccagttgactgatgatactgttgagttcaactatgtctttattgaatttttgcctgctgtctctgtccatttcggatagacaggtgttaaagttccaactagaaaaatgaaagttatctctttctccttatagttttgccagtttttaactcatgtgttctttttttaagaaaaagggtctggctatgttccccaggctggcctcctgggcttaagcaatcctcctattcagcctccagagtagctgggactaaagatgcataccaatgagcctggcttgactcacgtattttaatattcttttgttaggcacaaatacattaaggattgtcatgtctttttgaaaaattaacccttttattattatgtaatgctccactttattcctgataacactcattgctggaagtctgctgtctgaaattaatatagctaatttaactttctttttattagtgttagaatggaatatcattctccatctctttccttaatcaatatgtatcttgtaaaaaacacatagttcggtcttatttttgacccactctagcaatctctgtattttacctagtgtatttagaccattgacatttaaagtgattattgatatatttgggttaatatcaatcatgcttgttcctctttgctattcattgcccttctttgttcctacttttgtcttccattcttttcctgccttttgtggttttaattgagcattttatatgattcaattttctgttagcatatcaattatacttctttataaatttttgtaatggttgcctgagagcttacaacatgcgtttacaactaatacaaatccattttcttttctttttttttttcttccttcttttgcccaggctggagtgcagcggtgtgatctcggctcactgcaacctccgtctcctgggttcaagcaattctcctgcctcagcatcttgagtagctgggattacaggtgcctgccaccatgcccggctaattttttgtatttttagtagagacagggcttcaccatgttggccaggttggtctcaaactcctgacctcaagtgatccacccacctccacctcccaaagtgctgggattacaggtgtgagccactgtgcctggtcaaagtccactttcaaataatactatatggctttataggtagagcaaacactttataataatatttctaattcctccctcccatttcttgtattattgctctcattcatttcccttaaacataagctatagtcataaatacattattgctattattaatttgaacaaattgttatctattagataaattaagaatttaaaaaattttatctttgtgtatttcctttcgaatattcttccttttttacatagatgtgagtttctgatctacatcattttccttctctctgaagaccatcttttaacatctcttgcaagccaagtcaactggcacaaaagttcttcaatttttgtttatctgtgaaagtctttgtttctccttcacttttcaaggacagtttcacaggatacagaattctaaggctggtgttgtttttttttttttctctctctcaacattttaaatatttcatgccactctattcttgcttccatggtttctgatgagaagttggatgtaattcttacctttgctcttttatgggtagttttacctctgtcttctttcaagattttttctttatctttgacttttctgaagtttgaatatgatatggctaggtgtagtctgtttggacatttaccctgtttggtcttttctgggcttccagaatctgtgacttggtgcttgacattcatttgtggaaattcctagtcattatggcttcaattatgtcttctattcctttctgtcttccttttccttttgatattcccatttcatgtatgttacaccttttgtagtgaccccacaattcttggatattctgtttcattgttgttcagtatttttttctctttgcttttcagttttagaagtttctactggcatattctcaagcccggagattctttctcagctttgtccagcctactaataagcccatcaaaggcattcttcatttgttacagtgtttttgatatctggcatctctttcttacaattttcatcctgtttataatactcatctgttcttacatgttttctatttttttccgttagagatcttagcatatttaacataacttttaaattcacagtctgataattccaatataccctccatatatgagtctggttctgatgtttgctccatttctttaaactgtgttttttgccttttaatacacgttgtaaattttagttgaaagataaacatgatgtactgagtaaaaggacctgtggtaagtaagactttagtaatgtggtgataaggtgtgtgtgttgggggtggggagaaaattctatagttctatcactagatctcagtcttttagtaggcctgtgcctctgagctgtgaatgtcaaaaaatgcttttctggtttttttcactcccttagttggtgcaggatggttagaggaggccagagttggatattttccttcaactatgtggaaggctagaggaggctgactagagttgggaacagaacttctccattaaaatcttactatcagtttttatgaagttagcagtcttggaagtttagatcaaaaataacatcccagagacttccagtttccatttctacatgtaaggatattagaagtcatcactctgtcctaaaaacaaataaaaagctgaagaaactgaaaaatcaacaactcttcttagatccatcagatctaagttggttaggctctgataaaaacatgtgtaggttaggctctgataaaaaatttttttttggggggcagactttgtaagaagaacagaatactgtggtatatttcacaatggttaccctcctctttccttgatactttccctctcctcctgctggttggctgcagaaggtaaaacttaaaaaagtgtgggcctctcccatcccataattggggacctcctcgacttttccacacagagctttagccaagttttaaattacaattcaggtttttgtaccctgctcctggttcccaaagaggttttcattcctgtaagttatgattctctgaatctgtctaatcactcctattttttgggcagcagtttgccctgtgactcacttctctgatggatttaagaagaattgttgatttttcagtttcttcagctttttatttgtttttaggacagagtgatgacttctaatctccttacgtgtagaactggaaactggaagtctctgggatattatttttgaaccttaaatttccaagactgctaacttcataaaactgataataaaattttaatggagaagttctgtccccaagattacttaaaaatcatagttggacatacaagaaaactttaattcatttaaagaaaaaaagcttcataaaaatatattagcatttttgttaaaagtaggctgaaaagaaacaaaaaggaataatatcttaagctctaaatctactgtcctagactatccatttatttgggatgaagcaagccattccccaaatgaggtatgcaaacagtatgatattaaatgtgatgagactgatttctgtgtgcatttgagagtttagatttcttatttaaatttaacttgtacacatgtggtattggtgaattaactattatttatagaaaaacatgttgttctatttccttttattatccaaactctatgcagttttaagaaattattttgttgtttcattctgcttacacatggttgtacattacttattccatgatgcggcagagtgggattactaacagtggcatgttctaagcatacccagagattgagattctatactttgtgtataaaggaaacagtgtgaatgtagggagtgtgttgagagagagggacaaacagagagagattgatttcaaaaaagagagtgcaagaatatgcacccctaaatagaaacacagaaaatctccttttcctataaatgtctccaaaactgcaaaatcaaaaatgaaagaaaacaaagggggaaatgagttatatctaaacctgcagttttagttctgatgttctagaactcctcaattagttcctgagcaaactgtagtccacactcagtgaataattttggtaaataatacatttccctctcttccacagaccctggccctactcctaataactgctttgtagaaatggcctactaaatagaccaagtcatgggaacatatgtatatttacaaaggagtccaatcacttacactggcagatgaggactattcaagttcacagaaaactttgattcaaggccatcaatatactgacgtaaattaaaaagcaacctttactaatgaaaaaaatcaatgaataaaatttgcttcaaaagtttaaagttagcaagcagcaaataagaaaataaaaatttaaaacttcaattacttgtgcttcatcatttttaatcaattttttgttctctatagggaacaaaattctatatacttctggaagccaaaatctctttctctcataggtttaatcaaacagaatatttagaaaaacatacacaagaaaatctctttataagtatttgctgacaacaacactatgctttaaaattgtagtgggaaagcaagtgttatacaactttttacaaggttgctgctgttttaaaacttagggcccaattttaataagaaacataattatttccaaaattataatgttctttctagctaacttaaaactaaatgtcaaagtaggttttaaataaaatcctttaatcaatgatgtttctaatcccaaaaatttaacataaaaaagtatgacaaatattaaaacatacacctcctaggcaatattttgtttttgtttttatctttgaaagattcaagaaaatatttcctctttgttcacatattgcttgtaacaaagctgatcatctgatctggagtatattgattaagtagtgtctttgttgtctcatgttttaatatttatcaaacatatttctcatcttctcttcatttacattttttgtttcacataccatttgtaataattacattcaatactcctcttagaggacaagaaatgtatgtctccttttttgtctgtggttttatttcttctgtatctgataagacagttttagtttcttcctgtgcagtattattaggatcaatgagactctgtagtaaaacaagaaaatctttaaggaaccatactttctgtataattttatgaatgaaataaaccaccaaattttagaattaaatttatattattactgtcaatgcgaggaatcacagatacaaaagaagattcatgctccatatcagtagctgtttggggatgtaacagcagtgtattttgcaaggtaccttgattgaaccttttatagacttgggtccccactattttcaatcatttgtgtatactgaataaaggtgcctacagtttgggcacaataattaaaagtgtccatcctctgtatacatcccaaagattattcaccaaaacttttgtgaaatgaaaatacaactcaattagaaaggaggtgaaatataattttacttggattcatctcatttgataaatttatataactgaaagaaaaatgagaaaaacataggtcaagccttcggaaattcaagcatgcttccactaatatttatagataacatattaaatagtgcaagggtataccttaatctcccaggccttttaatggtagcctgattatgaaactgctgattttgaaaaaaaggaatctttggtttgtgagaatattgagaaacttcttccaatgtaaaaaacaaaacataaacaatgataacaacaacaaaacaccagagtagagttaactctgcagtagaaatctccaaatttgccttatgattgtcatgggtgggtgggtgtgggggtgtgtgtgccagcaatttgagtgacttgataatactttgagtgagtgaaagagggaacatcttatcatcacaggaaacaataaaaaggctagagtgcatggacacattgaggaagggaattttacatgtaatgactaaggagacagagatatcaaggcagctgatggttaaaaatgaattatgtagctctttaagatcaaagttcttcaaatctgatcataattaacctattggagttctggtatagaggcaggctttttctgaaaattctgttactatataaaagggataaagacacaatggtgaatttttattaaggtgggtgaaaggtcatgtagagtaaaaccatattattttaagttttattattttagaatttgtaataaactgatgtagactaagatgacttcttcacagataattagaatcaatggtgaatatttaaaatatttttaaaaatgactttttgacccttaagaactgtagaaatctctattttaaaaaaatacgaaatttacaattctaattatgagcaattattactaagtaaaactagatcaacaaaaggtctaacgacttgctctatatatctataaaaataaaaaacttgggtctcttcaaaacacacagcacaacattttaattaatctagacttatctttacctctgttagtttaagttactgagttttccctgaatgtggtgagaaataataagcgacatttcttcttattcctaaaatctgtgctctttagctccaaaatgctctatagtcacacctttccatttgtttcattatttctgctcatttcctaggacccattacaactagctattttaaaatttaccacttttcatttttaaccagatatataaaagaaacctatctaataagtaaattaggaataaattttaagatcaggttgattttatatcatatattacagtatacttttaagtttttacctgaggagttgtagatgtttggaagttttcatcctccaaatgttcattttttgattctgtggtatgcatgctaagatttaaaagaaaaatactttaaaagaagaaacaagactataaatccatatgaaaacaaacatggttaagtgggattaattttttaaaggattttttgttctaaagttgtatcacagtcaagtcagatatctttatagtcaacatagatccaaatattcatctttaacattattaaccaaagccatatgcataagttttaaaaaccattatcatacagaaatgtaatatttctcaacagttcataatgctggcccatatcatagaatcatgtatcagaaaatgcagaaatttattttatgcactgaactggtgtgtttgagttaatatccactgttgatttaatctatcttctgtcatgctcttacataaaacactccagaaaaattttaaatgaaatatgaccaactacattaatacctacatctataagttactgatacatactatctttttatgtggcccatttgaaggatctgtaggtccaacatttaaatatatctataaagttttattttgaagaagaataaactagatgaataaaataataattacttataacttttattttaaagtatctgttgtttctacctcctctgtaatctttgctagcttcaaatataagtagggtaacttttcttaaaaatatcttctctcaatttttgagttgttgttaagaacaaaactaaagatttcaagttttaatttttagatagtcttattaccatatcctgtagtgcttcaagtatctatacttttctaaaaggaaaacaattttaataatgaaaattgttaacgaaaaggaacattaacagttgagtagctaccatatgctagctgctttacatctattgtcttaccataatgaagtaaaatattactgcataaaatcctataaagaatcataactgaatttataacattattaaagcaaaaaataacctttaaaaattttgatcagaaacttagatctaaattcctttaaagtgtagttccattttgattgaagtgactgtcaaaataactatcttgtcattagaatgatgtattagtccattttcatgcagctatgaagagatacctgagtctgggtaatttataaaggaaagaggttgaattgactcacagttccacatggctggggaggccacaggaaacttaaaatcatactggaggggacctcttcacagggtggcagaagagagaatgagtgcaagtaggggaaatgccagacacttataaaaccattagatcttctgagactaactcacaagatccagctacctataccttgtcccacccatgacatgtggggattgttataactcaaggtgagatttgggtggggacagagacaaatcatatcattctgccccggcccctcccaaatctcatgtcctcacacttcagaacacaattatgcctttccaacagtcccccaaagtcttaactaattccagcattatctcaaaagcctaagtccaaagtcttgtctgagacaaggcaagtcgcttctgcctatgagcctataaaatcgaaaggaagttggttacttcctaggtacaatgagggtactgggagaaattggccaaaacaaagaggctacagaccccatgcaagtccgaaatccaatagggcaatcagtaaaccttaaagttccataatgatctccttttactccatgtggcacatccaggtcacgctgatgcaagaggtgggctcccatggccttgggcagctccgcccctgtggctctgcagagttacagtcccactctctggtgctttcacaggctggcattgagggtctgctgcttttccaggcacatggtgcaagctgctggtggatctaccattctggggtctggaggatggtggctctcttctcacagctcctccaggtagtgccccagtggggactctgtgtgggggctccaaccccacatttttcctttgcactgccctagcagaggttctccatgagggctctgccactggagtaaacttctgcctggatatccaggcatttctatataccctctgaaatctaggtggaggttcccaaagctcagttcctgagttctgtgcacctgtcggcctaacaccacgtgtaagctgccaagccttggggcttgcaccctctgaagcaatgccagagctgtacctggcctcctttagacatagctggagctgaagcagctgggatgcagggcaccatgtctcaaggctgcatagagcagggtgaccctgggcctggcccacaaagccatttttccctcctaggtctccaggcctgtgatgggaggggctgccacaaaggtctctgaaaatgccctggagacattttccccattgtcttggtgattaacatttgactcctcattacttatgcaaatttctgcagcaggcttgaaattctacccccttccccagaaaatgtttttttttctattgcatcatcaggctgcaatttttccaaacttctatgctctgcttcctcttgaacactttgccacttagaaatttcttctgccagatatcctaaattatcactctcaagttcaaagttctacagatctctggggcagaggcaaaatgccaccagtctctttgctaaagcatagcaagagtgacctttactccaattcccaacaagttcctcatctccatctcaaaccacctcagcctacacttcattgtccatatcaccatcagcattttggtcaaagccattcaacaagtctctatgaagttccacactttcccacatcttcctctcttctgagccctccaacctgttccaacctcagcttgttacccagttccaaagtcgcttccacatttctgggtatctttataacagcagcccactctgtggtgccagtttacattagtcctttttcacgctactacaaagaaatacccgagactgggtaatttataaaggaaagaggtttaatggactcacagttccacatggctggggaggcctcaggaaacttacaatcatggcagagggcagctcttcacaaggcagcaggaaagagaatgagtgaaagcaggggaaatgccagacaattataaaatcatcagatctcatgacgtgatcacatcagatcactcattatcatgagaacagcatggggaaaccacccccatgatccagttacctcctcattgttccacccctgacacatggggattattacaattcaaggtgaaatttgggtggggacacagaatcaaaccatatcaaatgactaccttgtcataagctgttagattatgaggtaattggtaagaataagggaggtaggtgaatcacctaagttgtgtcatgttctgaatagacagactgggagttagagccattaaaaagtttgagctgaagtgcacataaattttgaggagaggacacaaaattaatttacacacttaataatttttgaatgcctactcttctggcctctgaaggcaaagcagccaatcaaaacaaaataaaacagaaatataggcttctgttctcatggatcttatactcttgttaggtggaaggggaagattataaaaaacattttcagtactgcagaaaataaatgaggatcatattatagagatcaaggtgacatttgaactgtgtcctaaatgaggagaagctgtgagtcataagtaagcagatggacaaggagcaggcaaacataacaccaagaatcatacaaatggagacatcaagcgactaggcagcatattttaagatatgtaactataatgattaggatagcagggcttggaacccaggcaagcagactatgtattagaacttcaaaacctaagtaaggggtctgaataatagatgcacaggttaatagctataagagaagctttatactgagtcaagcaatatttgtgactggcagtcactcaataccctctttatatatctgccaagagtggaattggtaggtggtatgcctaaaagcaaggactttgagttgagaaagaaatgtattcaactcttctcttatcttttcataactgtgggaagtgatttatctccactggcctcaatttccttatctgaaaaaatatataataatgcttagtttattggttatcataataattaaattataatagctaatgccagttgaactatattaagcacttaacatgaatcatcttcctcaattctctcaacaactctatgaggtatttaatactattatccccattttatagatgttcaaactatggatgcaggaaagttaagtaatttaactttcaatatggtcatataactagcaagtggggagctggaatttaaatgaagtactctttaatattactcagatctttgtcaactttagtattgtctcttttttcttttaactgttgtggtgacattgcattatgaatttaaattgcatttctataatgagcattttttcatatatttactggccatttgaatatcttctttagtaaagtgttcaaatctcttgtccatttttttgttgtactggatcccattttcatactgatttgttggagttctttttaggtattaaaaatgtaaatcttttattggatatataaagagccaatatcatctcccactctgtgtcttgcttttttacgctgataataccttttttaaaagatactttaatttggcccaatttattctttcctttctttatccttagagcttttgttgtttaagaaatctttgccaacccatgtaggagaatgtttattctcctatatattcttccacaaacattattgttttgcttttcacataggaaaggaacaacaacaggtctatggtctatgagccatctggaattgaatttcatatatgggatgtgaggaagagatcaaagtttatttttcccatatcaatatctaattgactcagcacaatttattaaaaatatcatcctctatacattgtattgcaatgccacttttttttgtaaatcaggtaatcacacatatatgaatttattttcatattctatcctgttccactggcccatttgtctatccttaggctaacattatgctagtgcttgtatttttttttctgagatagggtcttcctctgtcacccaggctggagtgcagtgacacaataatagctcactacagcctcaatctcctgggctcaagtgatcctcccacctcagcctcctaagtagctgggactacagccacaagccatcatgtccagcaatttttttttttttaaatttttagtagagtcgaagactcactatattgctcaggctggtctcaaactcctgagctcaagcaatccttttgtctcagcctcccatagtgctgacaggcatgagccattgtgtctggccagtataacagatattgacatctggtgttggtgtacattctccacttttgttgttcttcagaattggattgactttttgatcctttgtatttccacatacattttaggaccaagttgtcaatttacacacacacagctggaattttgactgaagttacattgaatctatagattaatttggggagaactgacatcttaacaatattgagtcttccaatctttgaacactgtatattcctccatttatttagattttcttgatcttaataattttttgtgttttcaatgtacagaacagtatgtctttcattaggcttatttttaggtattttatgttttttggatggttataaaaattataactttaaaaattcattatttgtttcttgctggcatacagaaatatgaataattttcattcatttcactttgtatcaggccttgataaattcacttaattctaatagtctgtagatttgtttggattttctaagtacatacatacacagtcagcaaatataagttttatttcttcctctctaaattttatgtatttttctccctttttctttgtttttctggctttaacctgctgttacagttgttctaaatcattgctaaccttggtattgtctgtcttcagaatttgttttaatatagatctgttggcgataaattccttatttctttgcctgaaaaatatctatacttaaccttcacttttgaaagtgattcttattagatataggttagagtttattttctttaagtactttaaagatgttccactgtattctggctcccatagtttctgttaaaaatttaactgtcattcttgctatgattcctttgataataataatatcttttttactttggctgatactaatcacaattattttaagcaattttcctgtggtaaaatatgcataaaatttaccattttaaccactttaaagtatatagttccaggggcattatgtatatttgcattgttaagcaaccatcaccaccatccatctccagaactttttcattatcttgacctgaaactgtgtatgtattaattaaacaataacttcccattctcccctcctccaatccctgatagccaccattctcctttctgtctctatgaatgtgaatattctaggtactttatatgattcaagtcatacaatatttgcccttttttgtcttgcttattgcacttatcatgccttcaaaattcatccaaaatttattcaaaattctgtacatgttgtagcatgtacagaatttccttcctttttaaaggctgaataatatgcatttatatgtatatatcacattttgtttatccattcatctactgatagaccttttggctattgtgaataatgctgctatgaaaataggtgtaccaatatctgtttgaatccctgatttcaattctatttggtatatacctggaaatggaattgatggatcatatggtaattctatgtttaatttttggaggaaccatcatcatatggttttttttttttcacagcaggtacatcattttatattgacatcaacgatgcacaatgattccagtttctccacatgcaggcaaacacttgttattttctgttttttggtaatagccatcccaataggtgtgaatggtatctactgtagttttcatttccacttccctaatgattaatgaggttgagtatcttttcatgtgcttactatttgcatatatcttttttggagaaatgtctcttcaagtcctttgtccatttttattcttatttttttgagacaaggtctcattatgtcacccaggctggagtgcagtggcacaaacatagatcgtgcagccttgaactcctgggctcaagggatcctctgcctcagcctcccaagtggtaggactactggtgcacacgtccacacccagcaatttatttttttgtatagccagggtcttgctgtgtagcccaggctggtctcaaactcccagcctcaaagtgctgggattatgggcatgagctattgtacccagcatctttgcccattttaaaattgggatgtttgtttttttccgttgctgagttgtaggagttctttatatactgtaggtattaatatcttattagtaatatgcaagtattttctgtaagttgccttgtcactctgttgatagtgtcctttgttgcacataagttttaaatgttaatgtagtccaatttatctgtttttccttttgttgcctgtacttttggcatcatagccgagaagtaaactgccaaatccaatatcatgaagctttccttctatattttcctttaagagttttaatatttttagtttttataatcgtagttattgtaacctctttaactcaaaaatctggatcccttttgagtctgtttcccttttcaattttctatcttggcttaaggtcatataacattgtctaatactatggttcacaatttttattgaaagtttgacattgtgtacaaattgtacagtctccagatgataacttcttttggaaagaaatatgtggagtagggggagtgaaaaaatcactttaaccaaatcagagattgagctcagttgatagctttgtaatgctcagttttatttcaatttgtccttgttcctcaagtatagtcctttagggattttgccctaggtgatttccttgataaattatggcagtgtcacttgattcctcccatatcaggcattgtattattctgttttcacacttgttctataaagaactgcccaagactgagtaatttaaaaaggaaagaggtttaattgactcacaattcaacatggctgaggaggcttcaggaaacttacaatcaagtggaaggtgaaggagaagcaaggaccctcttcacatggtggcagaagagagaagtgcaagcaggggaaaatgccagatgcttataaaaccatcagatctcatgagaacgcattcactgtcttgagaataggacgagggaaactgcccccttgatccagtcaccttcctcccttgacacatggaaattacaggtctcttcctctacacatggagattacaatatgagatgagatttgggtggagacacagaaccaaaccatactgttctgcccttgccctcccaaatcgcatgtcctttatacatttcaacatcaatcatgccttcccaacagtcccccaaagtcttaactcattccagcattaactcaaaagtacaagtccaaagtctcatctgaggcaaggcaagttttcaaaaccaatcatgccttcacaacaatcccccaaagtcttaattcattccagcattaactcaaaagtccacagaccaatgtctcatctgaaacaaggcaagttccttccacctatgattctgtaaaatcaagagcaagttagttacttccaagatacaatgagggtacaggcattgggtaaatattcctgttctagatgggagaaattggtcaaaacaaaggggctatgggccccacgtaagtctaaaatccagtgggggcagtcattaaaccttaaagctccaaaataatctcctttgactccatgtctcacatccagggcatgctgatgtaaagggtagactcccatggcctagggcagctctgcctctgtggcttggcagggtatagctccatgcctggctgctttcacagctggcattgagtgtctgccgacattacaggggcatggtgcaagctgtcaatggatctaccattctggtgtctggagaatgatggtcctcttctcacagctccactaggtagtgccccattggggaccctctgtgagggggtccaaccctacatttcctttccacactgccctagctagaggttcttcttgaggctccacccctgtaccaaacttctgcctgggcatccagtcatttccatacatcttctgaaatctaggtggaggtttgcaaagctcaattcttgacttctgtgcacccatgggcccaacaccacgtgtaagccaccagggcttggggtttcaccctcttgaagcaacaacctgagctgtacattggcccctgttagccatggctgggatgcagggaaccaagtcctgagagtgcacaaagcagcaaggccctgggcctggcccacaaaaccactttctcctcctaggcttccagacctgttatgggaggggctgccatgaagatctctgatattttccccattctcctcattacttacgcaaatgtctgcaggcagcttgaacttctcccccaaaaatggatttttcttttctattacatggtcaggccacaaaatttgcaaactcttatggtctgtcacctcttgaacgctttgctgcttagaaatttctcctgccagataccctaaatcatctctcttgagtatgaagttccacagacctctagggcaggggcaaaatgccagcagtctctttgctaaagcacagaagagtgatctttggtccagttccaataagctcccatctccatttgagaccacctcagcctgaaattcagtgtccatatcaccatccagcattttgatcaaaaccattcaacaagtctccaggaagttccaaactttctcacatactcctctattcttctgagccctccaaactgttcccacctctacctgttacccagttccaaagtcacttccacattttcaagtatctttatagcagtaccccactcttcacagtaccaattttctgtattagtcccattttcacactgctataaagaactgcccaacattaggtaatttataaacaaaagaggtttaactgactcacagttctgcatggcttaggaggccacagaaaacttacaatcatggtggaaggcaaaggaggagcacggaccttcttcacatggtggcaggagagagaagtgcaagaagggaacaggccaaatgcttataaaattatcagatctcatgagaattcactgactatcttgaggacagcatggggaaaactgcttctatgatccaatcacctctctccctcaacatgtgggcttacaggtctctccctcaacacgtggggattccaattcaagatgagatttgggtggggacacaggcccaaaccatatcaggcataccttaccatttcctaacttggtttatttctactgtccatactttcctatattggaagagctgaattaacatcttcaatgttacataactataaataaaggagttggagcccatcaggcagtctgactccagagcccatactcttaaaactaaactgcttataatgtgacaagtattctgtgcaagacacagactaaagctctcataagaatttataggctaacatttagaaaatgctgtaataacttaaatctataaaagattaaatgatctaccaagaaaagagaaaaaaatccaacaactatatgattttttgacttttccattttagaaaatgaactagtacgagtaacttctttaggaagtaaaaaagagtcttaagaaaaacttaaaaatagaaaataaaggatgaataagtcacagaaggctaaaatggtttagaaatagcccattggaaatcaattacaaagctgttcagacccttggggattatgccaataatgctattccattgcctctgagcagccctatccatggtccttaactctcgagtgctttcactgaacactctggaacttctgccagatgattatcaaactgtattatattctcaacctcttttcaaagcattctctcaaattctgtgccctatatgaaaccaagcccttcctttaaggaggacactgcttcccctatagtcctctcacataacagcagtttattcactaacattccttctgacaccctactgctatttctaaaacttcttatataaaaaagaaacaaaatccttgcttttttaaagcttgtataatttgacaatatcaccttcctccccttctactcactgttacttactcaccttattttgatccctttccattattcaccaaagatgttggtgcttgacccccatatttgtaatcttttcatcttacacacttggataattcatctactatcttgtttcttcagttctttacttcctttctaataaaggaaagaccacactaaaaccttctatcatctgaaatgctctattatcgataatcatgatttcaagcatctacatctctgaatactacttcatcttctttcagttctcttgttcagttgtattcacttcatcccctccaattattcttcactttcatcaggatgtgcagtgtaatgaaccctgtaactcaaacttttgccctcttccttctttacctgtttttgtattcaatacctgtgatccatcatcctcaaaatactgctataaatatcttaaactatcttgaaatatctttgttgcttcattgttgcacatttgtagaaacacctcaatctagggatgctgctgccctacttccactgatgcccctccccagctgacacacatgcacccttttgcactgctgaggcagctggcatgtgtgagcatgcaaagatcctcttgccactaccccagtgaagcactccaatgggggtaattccccattggagtactgtggcagtggactaggaataccttggctcctgcagcacagcaggttcctaaccttgaggggccagagaacagagctaggggcctggtttcagccccccagagctacagcacacagctgaggagagctcagctgagccttgaccccttaaaatcttccagaaatgaagccagccaactgaacccaccttataccacaaccaaacccccaagggcatcaaagaagataaaagcaaaaagccccatctataggacaacaacttaaatgttgaaggaacatgagcccacacagatgagaaataaccagcacaagaactctggcaactcaagatgcccgagtatcttcttacctccatatgaatgtagttgttcctcagcaatgattcttaaccaggctgaaatgacagacatataattcagaatatggatagaaatgaacattgacattcaggagaaagttgaaccccaatgcaaggattctaaggaatacaataaaatgatataggaacttaaaaatgaaatggccatttaagagagaaccaaactgatctgatagaactaagaaactcactacaagaatttcataatacaaccacaagtattaacagcagaatagaccaagctcaggaaataatctcagagcttgaagaccatttctttgaaacaactgtcagacaaaaataaagaaaaaagaacaaaaagaataaacacctctgagaaatatgggattatgtaaagagaacaaatctacaactcatctatgtcccagaaagagagggagaaagagtaagtaatgtggaaaacatatttgaggatatcatccatgaaaatttccccaatcttgctagagatgccaatattcaaattcaagaaatgcagagaacccttgtgagatactatacacaatgaccatccccaaaacacaaagcaatcagattctccaaggtcgaaatgaaagaaaaaagcattaaaggcagctagagaaaagaggcaggtcatctacaaatggaaccccattaggctaagagtggacctttcagcagaaactctacaagccagaaaagattgaggggcctatattcagcattcttaaagaaaagaaatttcaaccaagaatttcttatctagttaaaagaggcttcataagcagaggagaaataagatcctttcagacaaacaaatgctaagggaatttgttaccaccagatgtgccttacaagaggtcctgaagggagtgctaaacatagaaattaaagactgttaccagccaccacaaaaacacacttaaatacatagaccattgacactataaagtagaaactacacaatcaaatcttcataataaacagctagcaacatgatgacagaattaaatttgcatatatcaaagtatcaactttgaatgtaaatgagccaaatgccccaattaaaaggcacagaatggcaagttggataaagaagcaagacccaacaatatactgtcttcaaaagactcatctcacatgcaatgataactataagctcaaagtaaaggaatagagaaaaatctaccaagcaaattaaaaaaaaaaaaaaaaccagaaaaaagcaggggttactgttctaatttcagacaaaacagactttaaacaaacagtgatgaaaaaagatgacaaagaaggacattacataatggtaaagggttcagttcaacaagaagacctaactaccctaaatatatatatgaacccaccacagaagcaaacagattcataaaataagttcttaaagacctatgaagaaacttagataaccacatacaagcagtgggaagtttaaacatcccattgacagtactagacagatcactgaggcagaaaactgacaaagatatttgggacctgcactcaacacttgatcaatgaacctaacagacttttacacaacttgccaccccaaaacaatagaatatacattattctcatctgcacatggcacatactgtaaattggccacatgatcagccataaaacaattctcagcaaatttaaaaaaactgaaccacactcttagaccacagtgcagtaacaatagaaataaatactaaaaagaactctcaaaaccatagagttacatagaaattaagcaacctgtttcctgaatgacttttgggtaaacaataaaattaagtcagaaattaagaaattctttgaaactattgagaacaaagatacaatataacagaatctctgagacagggctaaagcatgctaagagaaaagtttatagcactaaatgcccccatataaaagttagaaagatctcaaattaacaacctatccttacggctagaagaaatagaaaaacaagagcaaaccaaccccaaggttagcagaagaaaagaaataaccaaaattacacctgaactgaatgaaattgggacatgacaagcaatacaaaaagatcaaggaatccaggagttggttttttgaaagaataaataagattatttaaagaataaataagattataaataagaacaaataagattatttgaaagaataaataagaccacagctagactaacaaagaaaaaaagagagaacatcccaataaacacaattggaaatgacaaagggacattaccccagagaaatacaaaaaatcctcagactattatgaacacctctatgcaaacaaattagaataactacaagaaatgggtaaatttctggaaacgtacaacctcccaagattgaaccaggaagaaattaaaatcctgaacagacaaataatgaattctgaaattgaatcagtaataaaaaggttaccaactagaaaaagcccaggaccagaatgattcacagccaaattctgccagatatataacgaagacctggtagcattcctactgaaaatattccaaaaaattgaagaggaagaactccccaagtcattctatgaggatagcatcatcctgatacccaaacctggcagagacacaataaaaaagaaaaaggccaatatccttgatgaacactgatgcaaaaatcctcagcaaaatactagcaaatggaattcagcagcacatgaaaaagctaatccatcacgatcaagtagactttatccctggcatgcaaagttggttcaacatatgtaccaataattgtgattcatcacataattagaactaaaccccaaaaccatataataatctcgatacagaaatggcttttaataaaattcagcataacttcatgttaaaagccttcaacaaataggcatgaaggaatatatcttaaaataatgtcgtttatgacaaacccatagccaacatcacactgaacaggcaaaagctggaagtattacccttgaaaaccagagcaagtcgaggatgccctctttcaacactcctattcaacataatactggaagttctagccagaacaatcaggcaggagaaagaaagaaaaggcatccaagtaggaagagaggaagtcaaacaatctctgtctgtagatgatatgattctacacctagaaaaccccatagtctctgcccaaaagctcctagatataaaaaactacagaaaattttcaggatacaaaatcaatgtaccaaaatcagtagcatttctatacaccaacaagtccaagctgtgagccaaatcaagaacaagattccatatacaacagccacaaaaagaaaataccctaggaatacagctaaccagggaagtgaaggatctctacaatgagaattacaaaacactgctgaaagaaatcagatatgacacaaagggaaaaacatttcatgctacagtatcttggcatcactataaatgcataacagccttgaaatcagaaatatactggttgtatgatcttgggtaatttacaatctcttgtcatcttttttttttttttttttttttctggagagatgggttctcactctgtctgtcacccaggctggagtgcggtggtgtgatcatggctcactgcagtctccaactccccagctcaagtgatcctcccacctcagcctcccaagtagctgggactacagacatgtcatgtctggttaattttttgtagggacggggtctccctatgttgcccaggctggtcttgaactcctgggctcaagtgatcctcctgccttggcctcccaaatctcatcagcttttattgggcatagtactatctgtttttcttcatattcacagctagggaaagcagaatcacatttgaggacagacacccaaatatgagttgactggataagtttattagaaattatggcctgctttttgtactaacaaaaataagacttcttactggtttatattccagtgtcttacatataaatgatcagctcagtttaaaaaatttttatgctttacttatttcaataagcttcttaaaatccttttcggaatgaggtagatataagtacatacataaacacacatatatacatatcttgctattatgggaattaagtgagatgtttgtacaacttatagcaaaagctatggtatttaaaacttattagaagtctgtactgctgttatattgctaggctttgctttcaaaatagtgaaaaattttgatggatttagaagttccattttcaccttggttttttagaatgtctgtttgattatatattaataatggacacagtgtggtattgtaaaaagaactgggcaatctaagttctctgtttttcatttgctacttttttttttttttttgacagaatctcaccgcccaggatggagtgcagtggtgcgatctgggttcactgcaacctccgcctcccgagtagctgggactaccgacgtgagtcactgtgtccgtctagtttttttattttttggaagagatggggtttcaccatggtggccagaatggtctaaaactcctgatctcaagtggtccgccagcctcagccttccaaagtgctgggattacaggcatgagacatcgcacctgaccctgatacatcatattgagtaaatttcttgtcatttcatctctctgctcgattccaaacctataaagtgacgtagggagtgaggatcttagatgatctaagggctttaacagtttcttttttttttttttttttttgagacggagtctcgctctgtagcccaggcgggagtgcagtggcgcaatctcgactcacggcaacctccgcctcccgggttcaagcgattctcctgcctcagtctcccgagcagctgggactacgggcgcgtgccaccacgtctggctaattttttgtatttttagtagagacgggtttcaccgtgttagccaggatggttttgatctcctgacctcgtgatccgcccaccttggcctcccaaagtactgggattacaggtgtgagccactgcgcctggccaggctttaacagttttaagtctatgattctattatctgaggggcataccaagaaataggctgaaagaatagcaatacgtacttcttgggaacttcatttcttaaataccatgtatgtgcatatgtatcacttaatataaacaacttgtctttccttggtgtgtccatacacaatactatgggtttatgcttttggagcaatgttgtgcaacagtgacatctagtgactacatatcacagatcattcagcaaaactttatggccaacttgtactcttctaaatgtggatgatttactttgtagcccagctaaatacttttaaataattcctcacctctctcctctaaagaaaggtatgccaattaaatttgacaacagcattaataattggctaaataagaactgaaatttcctttaaaaatcataatgtatatggaattcagtataaattattctaaatgagactgcagctcttttccttccactgagagtggcaaagctgggattttcaattccagtgtgtttaaatatagtctattctcttatctactatgcattgctgacatgtagtaggcatttaacacatacttattcaattaatgttaggtaaaacatatgcatcaacagttgtgagtatgtattgctttggaatctttggaactattgctgcctttcaaacaaagaactcttcttgaggtcagataaaagattaacacaattataaacaaccacagtatacatctttctgaacaaatgaatttgagacctacatgcatgcataacagaatactctttataaaaggcattcaaactaggtcagtattttttttaagataatgactacctagtattattatttaatcaggacaatacaaatctgggctaaacttctactactataattcaaattgactgtcattgttaaaattcctaatagtatttaggatttgatctcattagtcagatagtaccttgattttaaaccgttttcgggtgcctagatcttgttgccacaataaagtgacacggtgtctgtcttaggtcattttgtatgctgtaacagaataccacagattggataatttataatgaaaaaaatttctttctcatagttctggaggctgagaagttcaagatcaaggcaccccagcatcttgagagggccttcttgttccattctctggaggggagggagtctatgtcctcctcacatggcagaaggtataagggtaagggacgcaaatgggtggcagaacttgtccttttataatgaaattaacctcacccatgtgggcacagccctcaaggcctaataacctcttaaaggtcccacctcttgatactgttacaatcaacatgagttttggaggggacaaacattcaaaccatagtagtgtcttagtctatttgtgttgctttaacaaaatcctcaagattgggtaatttataaataacaaaaatttattttgtcacagttctggaggctggaaaatccaagatcaaagtgctgacagatttggcatctggtaaaagctcagatctctgcttccaaaatggtgccttgaatgctgcatcttctggaggaaataaatgctgtatctttacatgttggaagagacagaagggcgaaaaggggctagctagctccctccacttattttataagggcattaatccatttatgagggcagagccctcatgacctagtcacctcctaaaggccccagctcttaatactgttgcattggggattaagtttcaacatgaaattggagggacacaaacattcaaaccatagcattttgccccttcccccacaacaaattcatgtctttctcacatataaaacacacttgttccatcccagtagctccaaaagtcttaactgtttccgataccaactcaaaagtccagagtccagagtctcatctaaatcagatatgggtgagactcaaggtttgattcatcctgaggcaaattgctctccagctgtaagcctatgatatcaagcaagttatatcattctaaaatacaatagtgggacagacagaggaaagatagatattcccttttcaaaagggaggaaatagaaaaggagaaaggggtaataagttccaagtaagtcccaaacccagcaaggcaaacaacattaaatcttgagacttgagaataatcttctttgactccatgtcctgccttctgcatacaatggggaaggggttgagcccccatgtctcctgggagccttgcctgcatggctttagggggagcagaccatgcaccagttctcacatgttggcatcacatgcctgtcgctctcccaggcaggaattgcacactggtatctctagtggcctacagtcttggtggtggctctgcccccatagctccactaggcattgctcttatgggggctctctgcggtatccctgactccacagctcttgtaggcactgccctagtggtgactctctgtgctgacctcacacctctggcagttctgtgcctgggccccaaggttctctgtgacctcctttgaaatctatgcggagatagccatgactacagacttagcaccacatgggcaccaccaaggtttactgtttatactctctgacactgcacctgggcctgcttgagccacagctggtgtggctaaggaatgctgagccacatgtgtggagcagaaagttgacgtggccctaggcagcaagccctgagttcccatggacaccctgggcccctcccttgaaactgttctgccctgaaggccctggcactctgagcctgtgataagagtggtagcctcaaagatctctgaaataccttcagggccactcctccactgacttgatgaataacatctggcttccttccatccatactaatctgcttatcaaacatgcacttggccatattcttggtattctctcctgaactcagtctttacaacctggttaggctgaaaaatttccaattctttaagttctgcttcctttttgattataaattccatcttgaattaatttttctctttttgtccagtatcataaacagtcaagagaagcatgtagcaccctcagcattttgtttaggtatttcttcccctaaatatcctatttcattgctcacaggttctgcctttcacaaagcattaggacacaggtggaattcagccaagttctttgctactttataacaaggatgacctttcctccagtttctagtaagacattctttatttccactgaagaactcatcagaatggtctttactctccacatttctaccagccttctgatcatgattaacttagataatctctaagaacatgaaggctctttatacagctctcctcgtcttctgaaccttcatcagaattgcccttaatgctctgttcatggtaatctagactttttctaggaggcacttcacaactgttctagcttttattcactactagctacaaagctgcttttacaataataggcatttgttataggaacactccacttcttagtaacaatttcttagcccattcctgctgctatgccaaaatacttgagactgagtaatctataaataacagaaacctactttctcacaattctggaggctgggaaatccaagattaaggttcagtcaggttcagtgtctggtgaggtctctgcttccaaaagggtgccttgaacattgtattctctgaagggaatgaacattgtgtcctcacatggtggaaggcatgtaaaggcaaaaaagtcctagctagctgtccccaggcctcttgtaaggacttttataatacattcatgagggcagatccctcatgacctaaccatttcctaaaggcctcacctcttaatattgttgcattggagattaagtttcagcatgaattttggaagagacataaacagtcaaaccatagcataaaccattccaggcatgttttatattcttttctttctcttagcaccaaacacaatggtttttctcaactatagacaaagctaccaaaaacttacccagaatccaaggtttgctatacatggaatcaaactgtctcaccagctttctttctggttctttcttttgacccaacatttcagtcaaactgttaactgcactccatgcctttatttggttggaacatcttcccactgaacctctttgtaaatatccattgattattctaaataaagcttcctgcaatgcacactacataaactggatgtgtttttccccttttgaattctcacatcattttgttatttgctctaccatccttacctctctggtgtcctttctttgtctttgttagtggtttctttcccctattcatcctttaaatattgggcttcctcagaattcttctctatgccctattctcttctcactctatatacatttctcaacatctattctactattatggctacaattctaactaatatgctgaggaatttgaactagaaaagctctcaagattctatttagtatatctaattacttattgaatatctctacttgtcttacaagcatcttaagttagtatatgcacaaactcaagatctttccccaccaaagttattccttctctggataatttcctatctcagagaatgaagccaccatcgacctagttgctcaaaacagaaactgagaagtcattctttctcgctgcttttctttatctgctaaaatcaagtgaattactaaatcatgttaagacaagttactgaatgtttaaaaattttattcatttctttccagataaattgtcactagtccagtccaggccataagcatttccccacctaaacaccgtaatggctttccaacttttccccacatccagtcttgttcctcctcaatgtaattttcacaatgcagaacaatattcttaaatgtaagcttgattatggcaacaaccttcttaatattcctcaatgacttcccatagaagaaaaatgttaaaactccttacattcagcttatagggtcctttgaataaggctctaaccttgaccctgcctaccttctcattcatcacttgacactctaaactttagccatactaaatttttgttcttcaaacttgccatgtctcacatctccaaaactttatgcattctgtacgctgccttccaacaccaacactcttgcttttcatccagctaacgcttcatcaatttagaagtcatttcttccagaagatttcctgacgctaccttcaacatgcatccttatcatggcatccaatgcttatcacagcatccaccccactattttaatccttgtttaactgtcatcatttttaaatttgacaaatattcattgagagcccattatattacagatactgtattctcctctgtatacagaatgtggtaaatatagagtattgtagaagcacgtttaggatgtgagagaagtccaagaaatgctttttagtgacttgtgttcccatctatttccctactaaattaaaccagagacagtttcataatcatttctgagttatttgaattgcctaacatagtatatagtagataaatattttataccatcaattattggattttaaatacatactaaatattctttgcattgtaagaggccaccagccagccaatactttctacccagcaactttttctttgatatcactttgcatacaatagagtgtaaaaagcaaagagacaaactaatatagtggaaaatatgggacttagagtcagaacactgtgattaataattctgccacttactaggtatatgtccttcgtcaagacccttaacctctctgagtctcaatttcctcatctgaaaaaggccattaggagaatgaaatgagataaagagaaaataaaagcataaaatgtaagaggttatccaaaatgatgtctattattattattgttattaaagtcaatgcagatcaagtctccttatgactggttatcccagctctgtaaggctacaagattttcaaagttcattcttcatcttccctttaccatccaagagataatcttttgtactttaataaacacatattgatggaaatggttaaaaatcacaaagaaaaacaagcccaaaattgaataagtatacattaatgtatgaaagggacaagacaaaagtaccagcctatgacagtttataatttgaatgtatggaccaaaaaaaaaaaaaaaaaaatcaggccacaattttttttaatgttgaccagaagggtaggtaggtggcacaaaagagtaatgctgtgaactgtttcacagtaaaatggtaacccattgacctagaaagtcaagatatctgggctcaaatactaatttagctactaattcaaccactaatacccaggtggtctacccacccaacactctagtctttcagttccttgatctccttagctcctattgtctttttctttcactgtatctcagccactcactcacagggccacaaatctcaaatggccactcaactttgcccagctgtgctattattctgattgctttccatcctccaaatgactattttgtatcttatcttctccccttaaacctcctacccaaatattcctcctcactctttactaatcttgcgtcataccttatcttcattgagaaaaagtatcagtatcaggccgaaggtctcacctctgaccactgaatctacccatctatctgcatctctacccatacttgctgtctttcttcttaccagaaattatacgttcatgtggttgggtgcggtggctcacacctgtaatcccagcactgtgggaggccgaggcaggtgaatcacctgaggtcaggagttcaagaccagcctggccatggtaaaaccctatctctaccaaaaatacaaaaaattagccaggcatggtgtgttggtgtgcgcctgtaatcccagctactcaggaagctgaggcaggagaatcgcttgaacccgggaggcagaggttgcagtgagctgagattgctccattgcactgtagcctggacaacaagagccaaactctgtctcaaaaaaaaaaaaaaaaaaaggaaagtatatgtttatatgttcatgttcctacctaaggccaatacttctatatattccctggattccataccctctcattttctcaaagacttcactcctaaaatatacacactctctcttataccatcatttccacccccctctattggattattctcagtctaaatatgcttaagtgtccttatctttaagaacccttctttgaccatacatatttctctattacctccatttcttggctctctttcatagtaaaacatcttgagatgtctatagtactacgtcaatttctgcccagccagcagtactatgtcaatttcttgacaccacattttctctttattgtactagtcaaggcatataactacttaatgtttccaaaacccaatgcacagatctctttattttatttgacttctaagcatgattcagtactgttggccatgttttgtagtcttggctttttttttttttttttttaattgagatggggtttctccatgttggtcaggctggtctggaactcccgtcctcaggtgatccacccaccttagcctcccaaagtactgggattacaggcatgagccaccatgcccggccagtctcggcttttatgtcactgcactcttcagattttcttcctacttcattggctattcttccatctcttttgttggcttcttttcctctgctttacactagtcactgcaatgttatcggtgagcacacttgccctaggtagttttccatatgctggtgactcccaactttgcatctttggttccttgcactctgcacagagctgaagcctcaaattacctttgatttctaataagaatgtaaaaattaaggtaagcaaaataaaactcccccctcccaccgccctggctgctcctttttcttccttagtcttttccatttggtaaatggcacaatcatccacacaagctcaagacaaaaatttaggggctagaggtgactcctttttcatcacctctatattcaaaacatcacaaaatctgtaggctctgcccccaaaatagagctcacatacatctacttctctgctattttatcccaaacttgtcattcctctttggatttctgcaattatcttctgctatagatcttgctccccacccagtatgattcagtcatcacataataggcagaacaaacctttttacaatgtaaatcagatcctatcactccctccaactcactactggtttctctttacactttaaataaattccaaacttattccatgggtagatttccatggcctattcaaagccttacatgatttggcccctacctatccctccaagctcatcctgtaccactttctctacattttagcttcagtggtcttgatgatgttcctggaaggagccaagttctttccttccttagggctcttgcaattggagttgcctttacctgtagtgcgctgatcccaaatatttccatggttggtttttaaaaatatcactaagcaatcaatctaaactaacccctcccccagtcttaaggaagacctttacagttttacttcttcactgtgcttactattatccaaaattccttgctcatatagtttacctattttctatcttacactcactagaatttaaacttcataagaacagcgatcttgctagtctttcttaccattgtattcacaatgcctaaaacaacgcctgacaaagtaggatattctttaaaaaatacttaatgaatgcctttccctaagcaagtcacttgacttctctacttaactcacactggtgagtttactactgctagactaagctctggatccaggaaaaacaaaagtggctaaggtatggcttcttcagaagctcatccattcattccctcaaaaaatatttattgaacatatattacactatgttccaggtactattcaatctcagtgtttagtaaacaccacagtaacatgggatttggttaaccaacagaagtgtttaaacaggatgagtacaaaaataagtacaaaatgagaagtactataaaaacgatactttatatgttacaactatagcacccacctatttccttgtgtctagtaattggcaggaccttatgacaagagccaactgaaaaacagcagtataaattctggtactctaaaagcccagacttcaccactgtgcaatatatccacacaacaaaactgaacttgtactaactaaatctgtatagaattttaaaaagtaagttaaaaaaaattctggtactcacaggggacaatacctatgaatgcccttttcataggcacacagtgactaaaatatttggggcatgaattctctaggggtgacaataataagtgtcatttttcatgcttctgttgcacacataattatatttatctctaaggaaaatcagagagtggggtgtggcctccctcagtgccacctgggccagttgtctccccacatcaccaaatctgttatttcacaggctctaggacacccatagagggggagtgagggacctggtatggtcccgtgaagagctcttgtaacactactgattgatgtgacagacacagtatgtgtgcaactttcctttttccttcaaaagcactggtctaaagcagggatccccaacccctgggcagcagacaggtacaggtttgtggcctattaggaacaggccacacagcaggtgagcagggctagaggattatgcctgagctccagctcctgtcagatgagcaaaggcattagattctcataggagcacagacctgattatgaactgcgcatgtgagggatctaaattgcgccttctcaagagaatctaatgcctgatgatctgagatagaagagtgtcatcccatcttgccccccaccccaaactgtcttccatgaaactgatccctggtgccaaaaaggttggggactgctggaagtgcttgtcccctgggttaaagccaagaggagtaaacaggattaaggggcgtggatgtgggtgggtgggggaagagagctttctcaggatcggcaaccaatcccagaatctccagtcgcaggagcatgtatgtgaaggtttatttgcagggatccaccgtttgtaaaatagtacacgcttaataaaattaattttgaggtcaatcttaactgacagatctcttctttcttactggcgagtatttgtaaaataagaaaaacaggaggaaaagagaacaaacaagagagatgtgggatgacggagtaaggaaaggagtcacggagaggagagacaatgtctgtggctgttccctcagcgtctgggagaagagcccaagaatcccattgaactgagggggaggaaaggccctcctgcggcctaccgcaaggaaacgatcgcggcagacccgggactagcgccaaagggcttggaagggcggcgttaagaaaaatgggccgtacctacaacttctttcgcagccctcgctggcccgggagcggcccaggagcccagtgaccgttgcgtaagccacgcgccacccaggtgggcagggtggtgacgcgaaagcccggatagacttccgcgcaggggcggggcggggcgaggaggcggcagcgcgtttaagtgacgtcttggctgtccgcgccggcagaggcgagggttctggggtttctgggactgtctggtgtgttttctgtctattgaaccctttcctttcgacgtctcttctgaatattgactcatcgggttgtagaaatccagggacagagttgacatcactgggcattttagccaaaaagcagtgctcgggactgcatgtgccagaagtaaacttgtcaaaactcagattgtgtttcccctaaagtcagcttaaagtgcaatggtagaagagcacggtctctccccaagacggcctgagcttaaactgcagcgctgtcacttgctagctatgggacctaggcaaatacatcgtctccctgaggttgtcttctcatctgtaaaggacgctgtggtggtggtgtgagaataaatgagacatggcaagtgtctggaacaaagacgctgtgtacaaagtaaacacttaatatactgttatcagtataaaacctttgtgagttttttttttttttccgcatgaaatcttatgtggaaagttgtatgtgaaagaaatgaaagcggagctgcgttgatggtgggcccagaagctttggcctttcagtcccaaagtttccagtaatagaatccgcgcttcctataaaagacaaaaacaactgttattggagaaagtgtaaacttcttagaaagacaaactgccctttcctatctaatgtttctcctgacactcaatgtttactcttgaacactgtattcctttttgcctcagtgcgttctgtaaagttaattcctctaccggagtgttctttttcttagtcatcatctaagatctgatccaaattaccgttccttcttgggtaacttaaatacgaaattatctttttattggttttgttgacgttgttgagacagggtctcactctattaccccggctggagtgcagtgcgatctaggctccctgcagcctcctcctccttggttcaagcgatcctcctgcctcctgagtagctgggactacaggtgggcaccactacccccggctaatttttgtatttttagtagagaggagtttcacatattgcccaggaggacttgaactcctggacttaagtgatctgcccgtcttggcttcccacagtactgggattacaagcgtgagccaccacagccctgccctttttattgtttttaacaccttccctccttcaacgtgttatagacatctcagcaaggatttatttttcttcctcgtttcaggagagtagacagggtttcatgattatagggttaaggaaatgttttgtactcatgaaaaggaaatgttttgtactcacaggaaaagcaggtagatccctaaagataatgggagttgggacaaatggtaaacctgggaaggaagacctttgctaggagtctgtttgcctccaaggcactactcttatgctctagaaggaatgggctcctggagaggtaagtgctttagggtccatgtaaggaagatggagcgcacatcaacaaatggagttttggaattctcaccaggccagagggctcaggctggatttgagtcagtcaactataaatataatattacgtactccccaaatgccatgaagcaattcccacttgttacagagaggtacataaatgattcatataaaaatataatgttctgagacattaaaaaaatacagtggttctttgggagacaatataatgaaaatttactaataaaaaacatttaaacaatcatctgataacctttcttataaaaattaagttttaaaaataagtaaattgattatatttgcaacaaagtcatggaaagcaaaagcttttgaggaataaggagaatcttaactgagagcaattttttaaaactatacatgacatgataaaaaaagttttaacactttctacatagtttcatacttctgaaagtacttcaataaaaatatttagccaatgatctatttagtatgatttcagtgccaactttcttttctagtcttatctctaattctcttcatcaatctcaagtgccaatcactttctatgctccaggctttactgttttcaaaactttgctaatatgccagcctcccacactagttgttcccatcttcaccttactccctaatattaccccatccatccagatcctctccattcttgaaggtctagttcaagtatcagttcctctaagatttcctcaacttctacactaaaaacacttttgaattattcacttggattatagctatttgtacatatcttatttccttctaaggttcttaaaggcaagtatcatgtcttattcatatttgtattcctcacattgtcaattttccactagaatcaagttctattgaaaaccaagcccttgaatatcttgttcatcactgtattccctagtatctagcacaagacctggcacacagtaggcatgttataatatattctgagtgagggagtaaatggattttaaaacaagctccatgaaggcagggatttgtctgttttattcattgcaaaatgaatatctgaatataaacatgaaggcttagcattcattatatacaaaaaaattcttcaatctacatagcatcataaaagccaaatatgaaatacttatgttgcctttcacccaacaaattcagttgatgatatatctttctgaaaataatacatcccccaaaactgcagtacaattttaaagaaaaataaaatacatgtttatattagtttcagttttcttgtttgtatttttctgtgttctaaattttttgcaatgaaaatgtgttactttataatcagaaaaaaatactatttttaaagaatgtagtggatgagatcatttgcaaatgtttacctgaggaaattttgaggacatcaagatcaatcaaggtgattgggagttaataccagacagaaatatactgtccttggaaatatgacacttctttcagggactgaattatgtccttccccacacattcatatgttgaagccttaacttccaatgtgatgtatttagatatgaggatttgggaaggcaattagatttggatgaggtcatgagggtagggccctcatgctgtgattagagtacccttataagaagagacaccagagagcttgcttgctctctctcggcatcaagtgatgacacatgagtgagagggtgagaatgtggccattggcaagccagggagagagacttcaccagagcccaacaatgctggcatcctgatctcgaacttccaacctttaatagaagtaagtttctgttgtgtaagccacccagtgtatggtattttgttatagcagcccaagctgactaagatagactaagtggactaagatccgaactgtcgtgtggcaagtagttttctgatattgagagaggatcctcttcctctcagatttagtcagtaaatgtttattaaatgtctactgtgttccatgccctgtgaaaaatgctgaggattcaaggataattaagacaaggttcctacccatagggagctgatttaataagagacaaacatgtaaataaagtgaaaaaaagtgttacatgtgctctgacataagtatgtataagggacccaaaagttagagtaattgtttctatctgtggtttaagaggggataggttgagttggtcagtactctatcaggttaaccctaagttcaccaaccaagtcaagagatgtggctttcaatgtggtgacaaaccccggccttcacatggtgagccctgctgaatggtcagcctctgtcattcttgacctcaccatctccatgatatataacagcaacatagtcttatagcaattaataaattcctacaaagagcttccaggaataggcacaaatttcagagatccaatagaggaagtcaaaaagccagcactgggcagtcacagagatttagatggtggctaccctcttagaggtagaaaagagtttgctgcatgacctcaaaatgaaaacaggtattggcagtggcttcaggtgcccttcaatcatttctgtactctgtggacttccatttctaattttcctaggggccctaaacatattcaatagcattctgatttagttatactaactgtattatgtataagttaataaatattccaagcctgttacttggagaaaatgccactgatgacctgggaaacagcatgaagtgtaacactttttggtcttacatcccttttgctggctaagtcctaatcttccctcagccaatgccctactttctctgggaagctgtgcctaaactccaccacccttggattgattgagtgctcctgccatgagctccctagcagccctgtagttcctgcataatagcacttatcatattgttttgcaatgtcttgtttaactgtctgttttctctattggactgttaaatccttaaggacagggacaatattattcttgatgatgtgcctggatctcaaaagctttcagtaagtattttttggatgcatctacttttagagcctgcaaaaatagaggaccagatgatcattaagtttatggtgctcccagcaaagtgcacctaaccaatgaagttcagttcaaaacacttatctgacctttggtataaattaatcaagtccaaatcaagagcataaacattaaaggaatacagcaccatagggtaaccaaagcaaagttgacataaaattgaaggctatttagaagaagtgaatattaaactagttttgaatagaggtgaaagccatggtggatagggctcgaacagaagtctaatgaagagaggaatggacaggctttatttatgcagatcagcttggtgggattaggatattcataattcattcatctaatacatatttaatatctacttcaagattaaaatgaactttgaattctaggtcgaggagtttagataggatatgacaagtatgtaataaacacttcaggtacacagataacatgataaaaactgtaaactgtatgtgaatgtgattatttcagtaactacacagaagatgacctagagtgaagaggaacttatgagtgatacacaaaagcagagatggcctgttacaaagtaggataaaatatgacctatgcaggtaagtctttcttctaatattttctctgctggcaagtcacaatttctgaaatccctgccatagaagtcactcttttggtttaaggcaatgtctttcaaaagcttttgtttgcatgtaagaatatgctactgaatgatggtaacatccaacacagtggaagctctggccccgaaaatctgatgttccgttcctcctaggagtgtgaatgcttagctagagacaacacttagctgcctcacagccggatatgatcaataccaataaatgtaggaaaagagatgtgtccaacttccacatcacttcctcaaaaataaattgctatacttgcattttccttgagagatagaatggagatatggtagagatccatttttaacccatttatgcctagtgttccattattagaatgctaagcctgtgggagttatttatatcccactgctcaaggtcattgccaaggtctgatttttcacaaaaaatttttgcaacctctggcataaataggttaagccatgtcctaagctagggaatggcagagcttcaggacagaaagacatgggactctgagcagacctcataagcagagtaaccctgttggtattaacgaaccagccagtttcattagacagaaatagaattttattttcttttaagcactgtattttttatttcttcattatagcacattaccctaatgtaatattcataagactggcatagatttgaaacttacctatctcccacctagaaatgggaagagcctaaagatatgggtcataagaaacaaaaaaagggctggattagggcactccttaggggaaggtagactcacatgggccactgaaataaaggaacctgggtggtcagctagggggcaggataaagttttttgacatctggagggggcaagaggatgaaccaatgaagatacttcatgtactttaaaattttggtgggaccaatcagttacagtaattcaaagaaaggtagtaagggaaggagaaatggagaagaggcagattatcagggtaaatgatggtaaaaattaatgagagactgcattatgatgtttaacaacaaaaacagatccaaaaaagagagccaaaaccaattcaaggcatcagagcctgggcaaatatgaatcaggaaactgtgaaagttaaaagttagggcaatcctagctgaagaggatactgaagctggtctttcccacattaactgtaaactgtggtagtacattaaagtagatatgtccttatgcaaattaagatggatgatgaaggggtgtttgaaaaaaaaggcagagagattaaggttggtgatatagatcattaccacccacatggaaagagcaagggctaaaaatgctgtttaaagaaacagctacacttttggttctattacattttaagcttaaacattacatatttcaatatgcatcttgaaaaaagtagcagctttctaaacattatgttcagcactctctcttttcacctctaaacttgcacagaagtctctccttgaacttcttcatctttattttgatgttcaactttctgcagaagcctggggcccagtaaaccaataagcagacttccaattggggctgtgatgaggatggacaaaaatgccactgtcaacacatccattccatagtcttctaattgtttctctccatgtgaccttgctgtgtccaaagccacagatcctattgcagcctataaaagtttaagggtaaaaatggaatcatgataagataagcacatataaaaaaagtgagttttttattgtttgcaaaagcaaattgcttgttcttttgctcaactaagaaagttgtaagcatcaggagatatacctaatgctaaatgacgagttaatgggtgcagcacaccaacatggcacatgtatacatatataacaaacctgcacgttgtgcacatgtaccctaaaacttaaagtataataataataaaataaaaaaaaagaaagttgttttagtattctttcaaagtgtattgcaggttttgttttgttttgtttttttacttttttagagacagggtctcgctgtgttgcccagactggtcttgaactcctggcctcaagtgatcctccctccttagcctcccaagtgctgggattacaggtgtaagtcactgtgcccagcccagctggttctgatgatctaaaaactctgcccttgcatgggaacatactgatgactcatttgtacttatctgtgtaaggtagggttacataaatatcagtaaaatacatttcaaaacacaaagcaaatccagaatcacaatattaattaaatataacataaagttctatgtactaaatttttcctgaataaagatggaaattactggtcatctccttttatctttaggaatgtggaactaaaaaataagatgaaaaacatgcagtgatacctactgaaaactgttaaattttaaataaatatatattactttagagcttaaactcattgtcaaacgtcatgaaacatgaaaatagtggacaccttgacaacttgaagttgatcttattaggtatttggtcaactccttgccacagaatttggtgaaatgttttatttggaatgcatctgttggaaaacattatgaaaattctcagtttcttttagaggcaaaatgcaatattatcagtgcagatgggaaaaatgtattaattaatctggttatcccttattccacagagaacaatgtaagcctctaagacaatgaaaaagaaaaatgtgcatcagaaacaatggcagaaactactagttgctcacaaaaacatgaatgacccctttcccttctataatagaactcctggagtttggctggtcacattgctgtccagagacctttttatagaactcttagccattatgttttagacatttttgaaagtctgataggggtgaggggaattctggagtaatgcccaaatgcaaagagcataattgaaatctggaatataactgctgagcatacacatcccccaaagcctcctaaatgaaaaacacttgattttaattccttaataacagaaattggaatatttaattataaaataatctggggcaaaacagttaaatgttgtttgatgtaattagtctgaaaatatacaaccaaagatacatcacatttgcaacaaatcataatctatacagttctaacttaattagcaatcatagatattctaacaaatgcatggtcaacaaattcaagcacctatctataatagctttatttatcacgtttattagaatgcacaaattttcggttaagtgattgagacatttgccaggaagttcagtgagttttgaataattaataccaactaataatctaggaaatcaataaagtgctttctgagttgtttttcaataaatcttttctccattacatacaaagactctggtcaagctcaactgatcatcaatcatattaacattaaaatatctccaaacattaagggaaccatgttatttctattttactctcttcttggaagctattaacatgaaaagagttaagaactctttccttgggtgacttacagagtgccgactgatgaaaactcttctctcctgttactactgctttctagtagaatagggatttactggatttttacttataccctggtgatctaaggaaatttaatgagctatcacatttaaggaatgaatataccaaaaatacaggttttaaagaatagattaggataaactcttttcataaatccacttcaattatttattttcactaaatttaaacaagccctcttattcaatatttcaaggtgtcatgcagaaatagcagttaaaatgctaagccatcctatccatcatacctgaactgtggcctttggaagccatgcaaaagaaataaatatcttttcttttaagttaaaaccagcaaaacacaccatcagaaatgtagtcaaaattcgtatcaatactgcaatgcctacggtggcaacacaaaggcctgtaagaaatattcaatttttagaaataataaaatactaggagagaaactgcatctcatggttactaattcaaaataaccatcaacagaaataatttttaaagcattaaaaattacaaatacaaaaatgtttaggaagaatatataaaaacaatcaatattaaggatcaatcaggctatttgtttaaaataaggtgtttctgtagattaaaaccagaaattaagcatatttgaattcttatgtagagatttgaatgttatatatgtcttatgctttatagcaagaaccatgcttgttcatgtgtgtaagaagaatttattaaatgatatgattaaatgataagtaataagctttaaactaagtactgtgtacacataaatgtacaatgtatagactttgcctcaaagtcagagaaagacacataaacaaccaattcatagactatacagtaagtgaggtataaacaaactaagggcataaaagagggaaaaacaatattttaacccaaaaagtcaataattctttacagggtataagaccagaagtgatagctaaaatatttatgagccagtatggagggaattagccaatcagagctggctgggcactgaccaatcagaatagacactggcagtctaccactgtttcaccatactgatgtgtactggtcgtactggtcccaattatccctggttaacatacacagctactccatttagtcctgtagaattctttgctgataaagacaagttcatcatcatttgccaaacaagggattgtgagtagtgctgctacatgctactggacctaagaatgatacagctaaggtgactcctgagtattagggtgattttttaaaaagtaacatttgttgagtgtttactctgtgccaaatgctgtactaagctttaaatgtattattttacttagtccttacaacccgtggagtaagtattattttatagttgaaaaaaccagaagctcagaaaggataagtagttttctcaaattcaaagggcgggtaaaacatcagacagacatagcgggaggatctattgtaaatctgccatatggcttttttatgggaaagttttgtggttctttgttgaaaggtatttcttcaaggttggaaagtattcaaaaatatctgtagcctgaagtacaagataaagagttgatatcattcccagaaggaaacattgaaagtttgagaagaggatgagaaggaagttttagttgagtttgaacgttaacaggacatacaagtggtgctgtccaatcaacaattggatatattgatttagagataaatagtttggaattatacagtttatagttgatgtcactagtatagataaggttagagaagttatatagagccagaggcacaaagttagaaagcaatttgataaagggcagcatttaagctacatatggtgtaaggaaaggctcaaacagcactgggaaataggaagtttaagaacttaatataaaggagtgttagagggtcaaaagcagcaaatgctgctgacagatcaagtaaagcaaagactggatttagcaatattaccttggtgagaggctggcaggttgtgtgagaggttggcaggttgtgtgataggcagaagctgggctaaaatgtatagaaggaggaaatgggaactgaagtggaaaggggaatgtagtgacctcttttgaaaagtccgaaaagaagacaagagaggtagcatggtagagacggggggaagtgaaatagaggaattttatatatatataattttaacatattattttaatatacattattttaattgtagtaaaatacacataacatttaccatcttaaccatttttatgtgtatagttagtatcattaagtatattcacactattatgcaaccaatctccagaattttttcatctcacagaatttaaactctatacccattaaacaacaatttccctttactcccagcccctggcaagtaccatttatgagtctgactactctggatacctcatgtaagtggaatcatacagggttagtctttttctgactggcttatttcgcttagcataatgttctcaaggttcatccatgttgcagcatgtgtcagaagagaagcatttttttttaagataagagagattggagactaaattctgaagagaagaaaattgcgacatggatatttaagatgtatgagaaaaggaaagaatccatatgcaagattcagaaggagtagcgggagatgggattcctagtatggatggaagaatactgtgatggaaggaaagaaggaaataatgagtacatatatacaaattaatttttaagtgcagtgttttgaatcaacagagttttaatatgatggcttttgaatgtaggaataaataaaataattaatgaacaacaaggcatttctatcccatgggtacaaactatagaactaactagttgtctttaaaattctcgctcttgttcaggacaaggctagatgaatattcttacccttggaaaaagaattgttaaggcctgaattttctgggtagtggtcagcagtgtcactttcatatacaaggaacaatattaaatgtgtaaaatataccatcttagatgaacaagcattattttctaaccaactactctaaaaaacttacatcataattaactttttatataattgtgacaatagtaaccactgtacacatacctgctggagatatttcaatgaatataaaaagtagactttattggtgagtaggctgaccaaaaaaagtgaattttaacaaaagcacattttgaaattcttacctacagtttctggtctgagagatgcaatagatacctctgctccaattagtccaaaaagaaggggctgaaaaatgtcccaggcaactgcaattatcttttcaacctctgcctaaaataacaataaaacacacacagatttttattatgtgaagttacaaatgcaaagaattttattaatttgaggtttgaattatttggcctgagataagctttatttctgtgccatctataactaaaaggttagctagaacagagcaaaaaaactgcatgaagatctttctatcacagttaagatacatgaggtgttttagcatactaaatattagtttgcacatggatattaataaaaagattcttataaagtaatcttatgaggactcctacttctgaatacatcgtgtgtatgtgcatgtgtgtatacatattgtaatatatagtagtgttttgtagtttaaaattttatgtcgactttccttcaacaatatgatttagagagcttgcaatattggtacatatatctagatatgcccctattactgctgcatagtgatctacagtatagaagtaccatagtttattcaatcatttctttattgacagatctttaaattgtttccaattttatctgtacaaaaaatactgtttaaggttatctcaaatcacgcacaaaaataaaatccaggtttactaaagtgattatcagtgccaattatcactttattgcccattatctccagctcctctttcactgttgctccacagaaaatggagctgggcctttaaaatatttttcctttgccaggtagcaccatgttaaactttgtcagtagagtgtgctaaagagatattgcaagctgaaggtgcttttcttcctggtttctgtggctcttcctagcaagatcttatagcatgcactggtggccttagctctaggttcctgcatcccaggtggcttctccagtatcagggtcctacaattcatgcaaccagcagcacctagtggccattacattccctagcatacccctggggcagtttcgtagcagattctcttgagcaagatacttccccatgcacccaaggggatggatctcctgcaaattgggagggtagattttcagcaaattctgcaagcacagcaccacagcgacttctctaggctctaacagagtctggatctcagccctgcaggcaggaatgtggagggtacaggcttaaggggatgatctattatagccataggtgctattctcatattctttaaggatgtcttcacatcttactagccaataccttgttactggaatccctggtgtggttaataatcaacttttcctattccagttactatttgatttctctttcctcataggaccctaattgatacaagaactaactttgtaacacataatgcaaaagactctaggaaaacagtgacacaattgactagagtaacatcaaaatgttttgtggcaaaagaagccataaaccaaaaaagtgacaaactagaagaaaatatctgtaccatgtgtaacagaataagaaacattggccaatcaataaaaaaaagacatagatcctaacagaaaaatgggcaatgaacccagagacagcatcatcatactgaataggcaaaagctggaagcattccttttgagaaccagaataagacaaggatgcccactttcaccactcctatttaaccggagtactggaagtcctagcaagagcaatcaggcaagagaaagaaagaaaaggcatccaattaggaagagaggaagtcaaactatttctcttcgcagattatactatacctggaaatactataccaagaatagtacagagatactatacctagaaaacttcatagtctctgctcagaggcttctagatcttataaacaacttcagcaaagttttaggataaaaaatcaatgcacaaaaatcattatttctatacacaaataacgtacaagctgagagccaaatcaagaacgtgatctcattcacaatcgccaaaagaagaacaaaatatctaggaatacagctaaccagggaggtaaaaaatctctacaatgagaattacaaaacactgctgaaagaaatcagagatgacccaaatggaaaaacataccatgctcatggataggaagaatcaatattgttaaaatggccatattgtccaaggctatttatagattcaatgatattcctatcaaactaccaatgacatttttcacagaattagaaaaaacattataaaattcatttggagccaaaaaagagcccgaatagccaaaagcaatcctaagcaaaaggagcaaatccagggatatcacactacccgacttcaaactataccacaaggctacagtaactaaaacagatggtactagtacaaaaacagacacatagacaaatagaacaggttagataatccagaaacaaaactgcacacctacaaccatgtgatcttcgataaagctgacaaaaacaagcaactggtaaaggaccccctattcaataaactgtgctgggataactggctaaccatatgcagaagattgacgctggaccccttccttacaacgtatacaaaaataaatttaagatgaatgaaagacttaaatgtaaaaccgaaaactacaaagcccctagaagatctaggaaataccaatctggacattggcccaggcaaagacttcaagatgaagactccaaaagcaattgtgacaaaacaaaaaattgacaaatgggaccttcttaaactaaagagctctgcacagcagaagatactatcaatggagtaaacagacaacctttagaacaggagaaaatatctgcaaaccatgcatctgacaaaggtctaatgtccagaatctttaagaaactcaaacaaatcaacaagcaagaaacaaacaactccattaaaaaatgggcaaagcacatgaacggacacttctcaaaaggacacatacatgtagccaacaagcatataaaaatgttcaacatcactaatcaatggggaaatgcaaatcaaaaccaaaatgagacaccatctcacatcagtcaggatggctattattattttttttaatatttaaaattaaccacaatatttgagcttgtggaagtaaactgggtgaccaaatgtcaaaggaaacataattgtacatcttttgatactttttaattttttgaatatttgagcttgtggaagtaaactgcgtgaccaaatgtcaaatgaaacataattgtacatcttttgatactttttaattttttgaaaaaatttattttaaattcaggggcacatgtgcaggtttgttacataggtaaacttgtgttatggcagtttgttgtacagattatttcatcactctggtattaagcccagtacccattagttatatttttcctggtcctctccctcctcccaccctccaccctacaataggccccagtgtgtgttgttctcctctatgtgtccatgtgttctcatcatttagctcccacttataagtgaaaacgtggtatttggttttctgtttctgtgttagtttgctaaggataatggccacccactccatctatgtccctgaaaaggacatgatcttcttttttatggctgcatagtattcgatggggtatatatacaccacattttctttattcaatgtatcattaatgggcatttatgttgatttcatgtctttactattgtgaatagtgttgcaatgaacatactcatgaatgtgtctttataacagaatgatttatattcctttgggtatatacccagtaataggattgctgagtcaaatgcatttctgtctttaggtgtttgagtaatcaccacactgtcttccacaatggttgaattaatttacacttccaccaacagaatggctattattaagtcaaaaaataacagatgatggtgaggttgtggagaaaagggaatgctgatacactgctggtgggaatgtaagttagttcagccactgtggaaagcagtctggagatttctcaaataaatagaactaccatttgacacagccattccattactggttatatacccaaaggaatagaaatcaccctaccattaagacacatgaacgtgtacgttcattaaagtgttattcacaatagcaaagacacggaatcaacctacatgcccatcaacggtagactagataaagaaaatgtggtacatatacaccatagaatactatgcagatatgaaaaatgaaaaaagctggaggcatctcactacttgaattcaaactatactacaaggctacagtaactaaaacagcaatggtactggtactaagacagacacatgaaccaaaacaacaggctagagaacacagaaataaagctgcacccctacaatcatctgatatgtcacaaagccaacaagaacaagcaatgtggcaaggactcatatataccatgtacatatataccatggaataccatgcagtcataaaaaataatgaaatcatgtcctttgcagtgacatcgatggagctggaggccataatcctaagctaattaatgcaggaacagaaaaccaaataccacagttatcacttacaagtgggagctaaacagtgagtccacagggacacaaagaagggcatgataaacactgcggcctattttaaagtggagggtggcaggagggggaggattgaaaatagtatgctgattacctgggtgacaaaattgtctgtactccaagcccttgcaacacatcatttatccatgtaacaaacctgcacatgtaccccttgaacctaaaataaaagctgaaaagaaaaaaaaaagaaacatgggcaaaacatatgcacaactaattcacagaagaagagatacaaatagtcacaaaatctaagacactaaaacggagtaattatgaaacacaaattaaattgacatgccttttttttttttcaagggggaacaccacattggaaaaatactaaaaggttttaataatgaaaagtattcatgactttgtaaggaaactcaccatttggcaggacaacaaattgataatgcttttttggagggcaattgagcagtacctattatactgtctaagaatttacatagaacagattttctcataactgaaaagaagctatatttttggatgacatttcaatgcttacaattacacaatttaaggatctgcaatatatacaccaggtcctcaaataatgtcgtttctttcaatgttgtttccttccaacaatgaaaaaaaaatcaattcttcatgttctccccatatctgcaagcattttatgtgggtaatctggtttcctcccaaatcccaaagatgttctcattaggtgaactgatgtgtctacatggtccctatctgaatgactgtgggtgtgtgtgaatgcaccctgtgatgggatggcatcctgtgtagggttggtgcctgggataggctcgggcttattatcttacttgtttttattaacctttctgaaatgtatgtgtagattacaattatttcaatgtttaatcttcacagtgttttggtttttattcagaagtttggtgatgtttttgtgaccagaaatatgcgttaggaacttagctcttgtttataccaattggcctatggtaaaattggttttgttatttgtcttttcacttaaagttgcagcttctgagaacctattgacaatgctaaaatgaggacttactattaatatattcagcagtttgacaaagaaggattacaatgtttctttgtattctttatttgcattatttctgatgtgtttatagtgggaagattatatttccattcagcttacaagtgttgaaagagagcatatgtgagggcattggttgatttatttaatagttctgtttctatagcatgaaaaatattatgttttcatcagataacgagttaagtttgaaccctccaccactaactgcaaggcacttgcctctcagcacctcactttctcatgtgtagaacaaaaggtttatattagataacatctaagatcatttattatgtaatggctagttctgccaaaactacgatccagttaacatccttccacatatctttaaattttactttttaatttagttttttgagtatattatagctaaaggtaagactttttttttttttttgaggcagagtcttgctatgtcacccaggctagagtgcagtggtgtgatcttggctcatggcaaccttcatctcctgggttcaagtgagtctcctgcctcagtttcctgagtaggctgggactacaggtgtgcaccaccacacccggggaagttttgtatttttagtagagatgaggttttgtcatgttgcctaggctggtctcaaactccagagctcaggcaatctgcctgcctcagcctccaaagtgctgggattacaggtgtgagccactgcacccagccaacgtaagactttagttgatactcattgtagtaaagaacaagaatcaactctattaattttagattacttagacttttgttgccatgaataattgtttaagagaagtcctcaaatgtgtttcatatactcagaatacaaatgaaagtaggactaaaaatatttctaatcaaattattttttatttctaaactgtagacaaaggccaaaatttgtttttgattataacactttagactagttgaacatcagacatgggcttatatattgcaaaacatagaaaaacatagaaaagtcacaatgtatcttcttgtgggtttttcataatgtcaaaactaaaatgaatttgcctataaagaaaatggagtcattgaataggctgtgtataaaagataagcccagggtaatgaagactgtgttgtcccttgaaaattaaggccatttgacacatttgtatgcatcattagtaagaatctgaaaaaatatcaattactttggaggaccaacaaaggagaaagttaagataaatggaagtttcatcatgagttggatatctacttaagtttatacttttttgaaagaacattttaagattcagaaaatccaaaataccgtatcaacaaaaaaatctgtaaaagtcattagaagcagcactagatttgacaacagacaaaaaaagagaagcagctttaaaaaaggtgagtgcatctgaatacaacaaacaaatggaaagattaatgcttataagaccaagcacaaagtataaaataatatcagaaaactatggacacaaacagaatcttataaaatattttagcttttcaaagtctaataagttaacaacaatattgctacagccctgtagaatttacaagtgtgtcattttcattttctcacataatagttacagcaattttttagatgattattgtattcactttagagttgagaaaactgagtatttcagaaggcaaatgacttgcttgggattatacagctagaaagtagtagaactgggattggcatcccaatctccatattttaaatcttatgctcttagtatgatatcatgctgttctggaggtaattataaaaataataagagttattatttactgaatgtgttctatgattaataactttccttagtgcttcgtacaggttattttaccgaatcctccagtcagtgaagttgtcatcatcactgggaagttagataacttgcacatggtcagacacacctagtaaaagctgtagtgttgagactggcctgaggagtctgagctcttggccctaggctatcctttagaataaggtaagaaaaggaatccaaactcaggactttggtttggttcctacaggaataagaactttcctgagtactaaattagaaaagatatggagagtacctgccacacgacagagtcaataaacattacttttccttcctttttttggggaaccatttttatatattcaaatggtatattcttttttttttttttttgagatggagtctcggtctgtcgcccagggtggagtgcaatggtgtgatctgggctcactgcaacctccgcctgccaggttcaagcaattctctgcctcagcctcccgagtagctgggactataggcgcataccaccatgcccggctaattttttgtatttttagtagagatggggtttcaccatgctggccaggctggtctcgaattcctgacctcatgatccgcccacttcgttctcccaaagtgctgggattacaggtgtgagccaccgcacccagcctcaaatggtatattcttatcctggctctgtcacttactttttgtccttatttttgaccttcgcaatatacttagtatttgtaggccttggtttcctgattttaaaagttgctctaatgtttacctttcaagattattgttaagaataaataacatatatctcactaacaaagagctcttcaaaaaaattaaaactattataggagactgacagatctgactacatgaaaatataaaatatctaagtgttaaaagtgaacaatataaaaaggtacaaagattacttagacttctgttgctgggactaattgtttaacagaagtcctcaaatgtatttcatacactcagaatagtaatgaaagtagaaggactaaaaagatttctatatcaaattattttttatttctaaagtgtagacaaaggccacaatttgtattttgattataatgcttcagactagttgaacatcagacatgggcttatatattgcaaaacacagaaaaacagaaaagttacaacgtatcttcttgtgggtttttcataatgccaaaactaaaatgaatttgcctataaacaaaatggagtcattgaataggctgtgtataaaagataagcccagggtaatcaagactgtgtcatcacttatatagatgtgtgtattgggggtgtatcttacagatggataatcaacacacattatactttggaagataatgaacaaaagacctaccaaagaaaaagaaaaaacacacaagtgtctaaatatgtgaaaaactgttcaatttcactgttaaagaaacacaaaataaacaagatgcaactttttacctatcagtatggctaaagattaaaagcaataatattttaagccagtggttcacagtgtggtccctagactggcagcatcagcctcatctggaaattaattacgtgcaaattctcaagccccaccacagtctaaaatcagaaatttgtagtagggcccagaactcaaatttaacaatccttctaggtaattctgctaaagtttgagaaaactattctaaggtgaagttgtaatgagacaggtacttcatattttactggtagaaaagtaaatggatagaactctagaaagcagtctggtaatatgtgtcgaaaacctcaaaatgttcatattatttcacccccaaattttactgttaggaatattccttaaggaagtgatcaatttctgatcatttcagcataatttaaaatagcagagactggaaataaccttataactatatataaaggaatgggtaaaaaaaccaaaaacccaactatggtgcatccatgtgtgtagataaagagattcacatagcagagttactagaggtaaatatttttaaaaatgttaatagttatctttctggttgtggggttacactgaccttctacatagcaggactacaggaaatgtaaacaaagggaacaatggtttggtttataagaatcatttatagataaccacattatagtttctctgaataacagtgtaatcggaagtgatcagtttccctttccctcctttttctttctgtgctcttatccagtgcccacttgcaggaggtatcagtctctccttcatttctctgttgctaaaactacttttttatgctctgtttcaaatgatattgctccttctcattgtttattctttttatcctatcatttatgaatttagaagctgaattttaaactgcaaaagtttagaattatgtttaaatacacatggtaagtgttactcaaacagatgtcaaaatataaaattgtgtcatgcacaataatgctacagttgtactacagcatagtacaactcaccttggagtcaaattaatctgagcttaaatctccgtgccattttctaattgtgtgaccttggacatgttatttaagtctttctgacttacagcttctataaggtagaaatcataatacttttcaaaggtaattttgtgaaaataaatgaccatatccacttagtgcctcatacagagccatacagcgtagcaacaaaaatttattaattcctttttctctttttacccatgacagtataatataatgagttgatttcaatttgcaaagatttttaaagagctggtgacagaatgcatttctgttacactgttgatatgagaatgaatgttatttacccacagtgaatgctgtctatggaagatccccacagagatccacttaattgagttatgattatatatctcatctcaaaatttgtaacgtttccatattttccatatggcattattttaattatttaagtttaattattttgaacagttgtcttcaggctttgtaagattatcacaaaatgatatagctgcatttattttaggtcaccgacatcttcattaagcagaatagcatacaatcctatcaagttcaaatctacaaaaatgaatctgaaaattaaaataaataaatgacaactagtgaacttccataatacatataaaccaaatgaatattcttaataatcttgaaaatcagtatgaaaaaccaaagcaaccttataaaaatggcaaaggcttttgaacaaactgggtagtaatcatatgaaaacatgattagcattgcccataaagaaatgaaaatcagaataataatgagatatatttttaattcataatatcagcaaaatatctcaaagacttagatcagaaaaacagatcctctcacataatattggtaaaaatataaattggtacagtcttttaaaaggtcatattgatattatcaaaagtataaatgtgagtactctttcctagagcaatctgatttctagaaatttattgtataaactaaaatatatactatattttatttattttaagacacatatttttatattttaacatttctgaaattagaatgttatgttatcgtttaattggcactattttttttctttcttggtgtcatataaaataattgtgttttttagaattgacagactcagatgaaatatggtatgtaaggatatattattgaagcactgtttatcttggcagaaaactagaaacaacgtaaatatctataaaatgcaatactccgtagccattacaaagaataaggaaggcattacggtagtatgaccatgatatattttaagtaaagacatcaagttatagattgatgtgtaaggggaaaaaaaagatgaacactgggtgtacatttgtatatgcacattaagatagcttttataatgaaatactttattaatttgatgctaagaaagtatctggaaagccaacttaatctcattagaaaagagtcatgagcagaaaaacttaaaatgaaattcaccttttcgctggtccatcccatgcctgcaaggaaagccatgaccaacgtgcacagtcctcctgatccagggaaaccaaaatgcacactgctgaacacagctagcacagacaaccccaacacaaggaatgttctcttacacacaagtttgtcctttaggagaaaaaaattcatttgctcaattatttcaaatccctgatttttaatgattgattttttccatatctaggatttagaaagaaaataaaaattaaaatgtctatataaatagacaaaacaagtgcactacataacatttactttctcttcttaaacaaaagcagagttagcacactgcaatggtgagctcttctttcaggaacaccaattctctcctctacagttatcaatgcagaatttcacagcacttaatgaagtagcagaaaaaaagtacatgagctttggagctggacagaccaaggttaaatttatagtttttatacattgttggtgtatgtagtagccacattacttaaccactccaagctttgtttcctgaaagcatttacatcatagggtttgtgtgaaggttaaatatatatctctattattttcaggctctatgtttactgttttaaatttgacgcccccttggtttttctttctaaatctttggaaaccaggaagctttaagaggttctagactgacagtagtttttgttgctgttgttttaaagtctaagaattgtgtactttttttccctttacttttccctgtccaggcttttaaacttcttgatcactttagaaagtaggtctttaaaagtgcttgacttggcaaaggcatgcaagctctgaaggtgaattacctgagttcattcccagttccaccgctttctagctatgtgaccttgttcaagtcacttatcctgcctaagcctcaatttccttatcagtaaaatggtcatagtaatagaaatctctttatgaactattttgtcggttgtactagagcagtgttttccaatagaatgtttagtgatgatggaaatgttctgtatctgctatagccacgtgtagctagtggctactgtactgaacaaagtggcactagatgatgattgactgatttatgtatgtgtgtatgcatgtatgtattagatatgggctcttgctgtgttgcccagactggactcaaactcccagagggatccttttgcctcagcctcctgagtggctgggactaccaggcctggctagaatctaaggtattttgatactaaaaaagggcacaaaaaagctattatatatctgggtttagttgagtattatgaacacttaaaaaacttgcatatcctattactttggaacgatattatttgttttacagtggaatttgaaatgtacagaatataatacgggaacccattacaggactgcattaaaatcttctatattgagcccacttcataaatctcatggatagcagtaagcaattttaaaatgaggaaccatttgctcaaacatgtccttcacatctgtctttgaaggaagtgttctagaatgttttcccaatgatatttcagagcacaactttcccacatattatttctttcacctggtcacggcttggaaagtactgaatgaaaaatccaagaacagatccagttgccacaccaattaccacctccaaaactcctctgaggacattaaagacagtagagcctgaaaaatatattaaaaaaacttagagctctaaatccaacaaatacacaggttttattccacaatcatcaacatgaagcatctaattacaaagaagaaacattttaaagacagtttctgctttccatattcttaaatatgtaagtggaacctacattttcccccatagcatataggatttaggaaactttaattaaaaaaaattttttgttagcacattgtgcagaaaattatattaaagtttctccacacataaagcacttcttcacagactgtcctaagaaaaatgtactaactggtttctgtggtctcttgttattatggcaatcattcttcttatctaaataaaattacctctgaagtaattttatttagctaggatcgctttctaccaggtaatgctatgactgttaaaaacatctagttgtgatagtagcattatgcttaagctattgtggtaataatttactatgaatgtgtagaaagtagctaattagctttagtctctggtatattgaggtgattaaaaaaaaaaagtcttgggccccacccctaaaaatctgattcagtaagtctagcagggctcagatccaaaaggtctaaggaccacacgtagttggtgggggggtggggcggggagaggaaacacagcagagtcaactaggaaggttcttcgagctgtagcttatgaaaaccccactgcctctttcctttctcctcccaccaccatgattctaatgcaaactctgttgctctaaagctgtggttcctattccaagctgcactggtttccactccaaaaggttctgatttaattgtctaagataggacctacataagagtatttttaaaaatcgcccaggtaattctagtgtgatggtaaggctgagaacaattgttttaaaggtatataccaggaaagtggtaagaacataaatttgggtatgtgtagtagcattaaaaataggagtatgaatttgacttaataggtaagagagcatcctcaaaggttcttgaacaagaaagtaatgtaatgaaaacaatgttttaagaaaatcaatttactagggaatggatggaaggcaggctctggagcaatgagacagggtgggattctaggtaacaggcataaatcatacacaatcacagaatggggagataactatagggagataacgagaatgtataacctgccaagaagatgtgttcccactacagaatctaaagctaaacttagattacaattatactttgtcaatcatataatgttgcaaattttatatcccaattttgaacataagattaagaaatgaacttaaacttgtgctgtaccacaggataataaaagtgttgaactgcttttggccttttggctaagatcaagcgtactatctgttcacatcagtttaatataggtgttgaacaacagtgggagaaaaaataacttaagttcctcttttactatacttgaaacaaaatacctcaatttcagacacttactaagtattaatgggacatccattaaaatcattgctgttattacccataaaaagctgaagaggagagaagagaaatttttcttattttaaaggcatgctgttcctttcacttggactgctctctgtcatttgtgctccttgaaaaacccactcatattttgtgtgaagtctccacacatcttttgtgtgaagtctccacacatcttttgtgtgaagtctccacacatcttttgtgtgaagtctccacacatcttttgtgtgaagcctgaacgttcctggatcacttcaagcagaaactgttctttaaatctttctaccttctaccgcccctgccgtactgcacctactgcatgctacttgagcagtctctagagggagcaagagagtaaagacagacagcttctggaccctccttaggtacagaactcttagtgttcttttgcctatttttaatttgccttaatcaattatcaagcaaatatgtcatgcttataacattttaacctacgtccctagaatgcaagagtaaagcctgttgtgaactgattaggttacctgtggaaaaggctatgcccaagcatgtgttgaagccagtgatggccagaatgtcatcgaagctgccagctgccatgagcaaggttgggacacccttctcaacaccatagcctcctccctgcaaaaggagcattgaaggcaccacaacagctggagatacagcacctaaaacaaaactaggcagacagcattttaaacatttatgataacatcttacttattactattttgaaattataatgccctccactttttaggggttatacttggacaacaacagtctttctttttttttttctaaattaagaaaacaaactttaataagaattgttttttgtttttttttcttttttttattatactttaagttttagggtacatgtgtacaacgtgcaggtttgttacatatgtatacatgtgccatgttgttctgctgcacccattaactcgtcatttaacatcaggtatatctcctaatgctatccctccccccctccccccaccccacaacaggccctggtgtgtgatgttccccttcctgtgtccatgtgttctcattgttcatttcccacctatgagtgagaacatgtggtgtttggttttttgtccttgcgatagtttgctgagaatgatggtttccagcttcatccatgtccctacagaggacatgaactcatccttttttatggctgcgtagtattccatggtgtatatgtgccacattttcttaatccagtctatcattgacaactacagtctttcaaatggcagagaagcatgaatccagaaaaacatgtatgtgtaaaacttctacagaacactgtttttcaaaatgtagccatagacaacttgcttcagactacttaggttgcctaaaaagatatatttattagtggtatagaaggcctaatgagggtaggccccaggatgctggcttttttaaacaaaaaaattcatgttataaggtttgaaaatgcatggactttctgatttggaacccagtgatgctaggccttctattagggcttgctatgtcaaataaggcaacagattagaagaaaacgatatgacagtcacattgataccagtaacaacagcagtggtaacagcagaaagcattttacagtatttactatgtaccagacaccattttgagcactttacacgtattcactaatttaatcctcacaacaaccctataaaatagacaaaatctatcttaattttataattgaggaaactgaggcacagagagattaaatacttgttaaagatcacacaccggaaaaatcacaaggctgggatttgaatccagggagtagagttccagagacttaaccatgagaagaatttcttacttcttgcctcttattagcactaaattcttactaagtcctgtcttatttatttactttgtgtggctcttaactgttggaagtaaagaactgacagtggaacgaagagacagcagaactgccaagtcataatagtctggtgacaggaggaaaacaatagtagctgttgatcactgttgctgtgtttattatcctttgtgcagacgttaggtggaatccggtatctctttaacaggcattgaatcaggtgtaggcaaaagaccacgacttcttcaacagtttgaatagtaggtgctaactgtaagagttagcgcctattaacacataaactatgttttgaagttagaatatttaaattatgctgtaacatctatgttgcattttctgatatctataagaaaattctattatgcattctcttgtatgcaatcagggaaagccctaaatgtccctacatattttcatatgacaaagaaacaatcattaccccagtataaatccccattgccatggtaaacccagcaggtaatgggcaagaagagcagatgtgcacgcctccacaatacagggacccatggacagtcttacacaaacgccctttaacttcttcagggcctgaaatagaaaagtagacatcctaatataatcctctgaagatgtgcagagaagatgaccttgaatgctttctcttcagtatatggaccacgtctgggtcatcatgagttttcaaggtaatgagttgtatttaacaaacattttagcactccaagtgttttcagacagcttattaagtcctcactgcaaccttataagataggtaatactattattatccccatatttttagatgtcctcatctgaaaaggcacaggctaaaggcatttgcccaagatcatgaaactggtgagtgatggggccaggtttgaacccaggcaggctgctttcagcatctgtgttcataatctctagctaatttaacattctcattagttttatttataatttgtggtcccagaatgagactaaagtgaagagcctgatcccccaagaaaattcattcctgtattcaaaaacatacatgaaaaaaaagcattaaaaaggcatacttgaccctcattttatatattaggcagtttcctgagctagtatagttagccctgaacacttgtatagggctttgcaaaccaaaaatatgttgttttctcccctgtgagcattatttataaccctggtctatatgtacatcagagaaaagtggggcctttattcttggtgctggccccatagacagactctacctttctccaaggaagagaatgagaccggctgggcgcagtggctcatgcctgtaatcctagcactttgggagggggaagcaggcagatcacctgaggtcaggagtttgagaccagcctggccaacatggcaaaaccccgtctctactaaaaatacaaaaattagccgggtgtggtagtgcatgtctgtaatcccacctacttgggaggcctgaggcaggagaatcacttgaacccgggagacagaggttgcagtgagctgagatcaagccgctgtactccagcctgggtgacagagcgagactctgtctcaaaaaaaaaaaaaaaggaagaaaatgagaccaccttttgagttattgcaaaccacaacaaggtctcacttgcaaaacaatcctccatgaaataaattctattttattctcaagaatgtcatgcaaagtgtccacatccatttcctaatgcttagtgattctgttagatacctgaagcattgaagaaacaagattcctatttaataatgagaaatttacatttcatacctttgaatccagaccaaggccagcacgaaccagaatgatagacagggctatgcttctcaaagaggaagaccacttgtgcttgatctgcacattatcgttgatgactgggatatttctgatgagaaaccctgcaagcagcatgccttgaacgaagaaatcaaacatatctagttagttttcaaatacagaaaatatttttagtactttaattttatacagactactatataatcccaggaaccacttcacttatgcttagaagaaattaagttaaacttttaagtaaaaattagtataataaagcagctaagaaaataatgtacagataaaaagatagattataataattaatattcccaaaataactgaacttaaaagggagacaagatgcagcatttggatagagagtatgatcaaattctaaatataaaatgttttaatacaatgccagctcagtcagccctttgcgtgcaaacagcaaacagcgcatgaaattatttgctatgtcagattacttgaaatatcaataaatacttatatggattctattttaccttcagattagataatttcataagagacagataatctactttgcaaaggttttagatgtcaattatgatgaaatggacattgccctgtcatgtcagctggtgactcttctttcactcagtcattcaactgtactgaatgccttcagtagtttagacactagagtatgtatcacacatataataatggattacatttcaacaagctttcagcctctagggaacaagacaaacggacaataccaattttatgaaggcatgagggggatgttacatgagctgaggcaggaagggggatttagagaagggggaagaggatgaagaaacggctaggggagttgagaagtttctggaaaagacagtagtttattcaaaggtaaaagaaaaagtgactcattctgaaaactgcaagtagttgagtgtaactgaggaagctgagtagttagtgagggaattctgccttcattgataccacatgcccacacaaagggaaaggtttctgtgagagactgagcctcttccctccatgcttctccagcagtgccctcttctcaccttgtccctataagcaccacacttcaaacaactaaataaatttactgaagttaggttattttgtgatgcaagatgggagaagagagacaacctgctgcacatgaaagcatcactccaggtatctctcatcactgccatttatctacgggaaagtctcgtaagttctgaatgctgtggcagtggtctttctggaatgtttattgggcaacaatatgaacaggcttggtttttggaagaaataatgatgagttatatatgcacatggtaaaattaagacattgctgacaaaatgtaaagtgacaagtacatactgtaccccaactgcaaccttccatcttcattcctgaatgtatttcactgttaagggtcttctgtgcccttccagaaagtttctgtacctattcaagtatatttctgtgtgtataagctcttttgtgctggacacaaataggacacttatacactgctgtacggcttgggtttttttcccatttaataatatatcctggacattttcccactgaagcacatatatatttgctttattctcttttaataactggaatagtatctcactgtttggaagttccataatttttggaccactaataatagattttaagaaacttttcaggtttttcattataaacagtgctgaaatgagcacaattcatacatcaagtatttaagtgcctgctacatgctagccctgtatgagatcctagtaacaaagaggtgagctagaccagcagtccacagcctttttggcaccagggaccggtgtcgtggaagacgatttttccactgatggcagggggaatggtttcaggatgaagctttccacctcagatcatcaggcattaattagattctcataaggagcacacaacctagattccttgaatgtgcagttcacaatagaactcatgctcctatgagaatctaatgtcactgctgatctgacaagaggcagagctcaggcagtaatgctcgctcacctcctgccacggcccggggcttgggcacccatgagctagactaatgtggtccttgtccatatggagcttatatatttgtaggtttacattaactatattcatattataatttcaagcagtggaaatgttaggccctatggtataggtatatgtcatttttatatatattgatagcttaacagccaaaaatactgcactaatgcttacattccattatcattacaatagctctttaatgaaatttaaaatgtgtttctaagccactcctaaattaacaatggcattcaatgacctgaaatcaaatggaatatcctaagaagaactcaaaactatgttaagaggtttttttgttttgggggatatgaggggacatttttttttttttttgagacagggtcttgatatgttgcccaggttggtctcaaactcctgggctcaagcgattcacccaccttagactcccaaggtggtgggattacaggtatgagccactgctctctcttggcctgagagagcatttttcattcctgaaatgaacgtgacagcagcttccctgggacactgtttcctttgctagtggtctggttgatgtaatgtgaccacctgattttgatttggcacatgtccccactcttgcctctagggcctcccctggtcatggaggaaagaacatcttcctggatagaggagtgttgttctcttaaaattttgtattatgaaaattatcaacacatggctaatctcatttcatccactcccaagttttttttttattatttgtgttatggaaattttttcaataatgatttttcttctcttccaaagggaagccgttttcaaattcatttcaggaatcaaaaatgctcactcatactccgaccctggcaatcacttcaattaaactcttaaaaatatagaacaggcaaccatcacatacattttgtcttaataagtttcctttatggattcagataatgcttcagttttggatactggccttaatgtaataagaaccagtaaactttcttcctctatgcaagtatacaactataaaaaagaatggtaaaatacatatataatttttgagaatgatttcagttaccttaggagatttcattttatcacaaatcccaagactttacatctttttgcaacatggtatattttgtttttgcaataggcatggagtgaaaaaaagacaaatggggtgtaatgggcattttcatgtgtctagaacaacagtcttcaacataggttgcatattagaatcatctggagagctttttaaaacttctgatgtccaggccatattccatttcaattaattcagaatctctggggtaagacctaggcatcagctttttttttttctttttttgagaccgagtctcgctctgtcaccaggctggagtgcagtggtgcggtttcggctcactgcaacctctgcctgctgggttcaagtgattctcctgcctcagcctcttgagtagctggggctacaggtgtgggccaaccatgcctggctaattttttgtatttttagtagagacggggtttcatcatgttgggcaggatagtcttgatctcctgacctcgtgatctgcccgcctcggcctcccaaaccagcagctttttaaagacaggtgattcctggcctggcatggtggctcacacctgtaatcccagcattttgggaagccaagatacgaggattgcttgagcccaggagttcaagacctgcctgagccataaagtgagaccctgtctctgcaaaaataaaaaaggtgtagggacatgtgcctgtagtcccagctactgggaaggctgaggcaggaagattgtttgagcccaggagattgaggatgcagtgagccatgattgtgcaatgattgtgcaactgcgctccaccctgggcaaatgagaccctgtctcaaaaacaaaacaaaacaaaacaaccaatgagagattcttatgtgcagccaagttctagaatgaatgatcttgctacataaaatgcgatcttagagcttagaaatgcagaatctcaggccatgaagacctacttaattagaatttgtattttaacaaattccaaggtcatcctctttacaatgaattttgagagtcactaattttgatgcaagggtcagcaaaaatgttctgtaaagggccaatgaatatcttaggctttgtgggctataaagtctctgttacaacttcacaactctgccagtataatgtgaaggacatagacaatatgtaaatgaataaacgtgggtgggttccaattaatattaatttataaagagaattagtctgcccaccctttatcctagcatataggcatatttaaaaacaattcattttaggcgatcattaaaaagtcaggaaacaacaagtgctggagaggatgtggagaaataggaacacttttacactgttggtgggactgcaaactagttcaaccattgtggaagtcagtgtggtgattcctcagggatctagaactagaaataccatttgacccagccatcccattactgggtatatacccaaaggattataaatcatgctgctataaagacacatgtacatgtatgtttattgtggcactattcacaatagcaaagacttggaaccaagccaaatgtccaacaatgatagactggattaaggaaatgtggcacatatacaccatggaatactatgcagccataaaaaatgatgagttcgtgtcctttacagggacatggatgaagctggaaaccatcgttctcagcaaactattgcaaggacaaaaaaaccaaacactgcatgttctcactcataggtgggaattgaacagtgagaacacatggacacaggaaggggaatatcacacaccggggcctgttgtggggtggggggagggaggagggatagcattaggagatatacctaatgtaaatgatgagttaatgggtgcagcacaccaacaaggcacatgtatacatatgtaactaacctgcacgttgtgcacatgtaccctaaaacttaaagtataatttaaaaaaaagaaacaattcattttaacaataatacaattaataactttagagaacaaaaagtttccatgagaaataatatgaattaagtggactatctttagttttacctaaaattagaaatacattgagaaatggggcatagtaagagataaataattctacttctttttatatttaactttaactactgaccacaagttcaaaagcagataattttggtgaatgttagcgaatcctgattgttctcactcatacagctaacagaaaaaaaaaaactgttcaggaaatgtgtgtaaatatatatgcatgtatgaaaggtaggtggttttttactaaaactgagtgattaataaatctgttagaaatgaacacaaaatgcctctgtggtaaacaaattttataatgcagaattcttttttttttttttttttgaggcggattctcgctcggtcacccaggctggagtgcagtggcgcgatctcggctcactgcatgctccacctcccgggttcacgccattctcctgcctcagcctcccgagtagctgggactacaggtgcccgccaccacgcctgactaatttttttgtatttttagtagagacgggattttaccatgttagccaggatggtctcaatctcctgacctcgtgatctgcccggcttggtctcccaaagtgctgggattacaggcgtgagccaccgcacctggcctataatgcagaattctttgaagaaacgttaaaggtatcacacctagttttaagactaatttgtgtatgtgtcttgtttgggcagttctcattgcctctggaagagtattttcagctatgtctttaagaatcatggtattttatttcatttttatcttttttgagatggagtctcgctcttgtcacccaggctagagtgcagtggtgtgatctcagctcactgcaacctccacctcccaggtttaagtaattctcctatctcagcctcccaagtagctgggattacaggcacccgccaccacgcccagctaatttttttatttttagtagagatggagtttcaccatgttggccaggctgatcttgaactcctgacctcaggtgatccgcctgccttggcctcccaaagtgctgggattacaggtgtgagccaccatgatcggccaatattatattttaaatatacccaatggtgtgctggtaaatgcttaacaggtggcttgccaaaaaagtatgcattttatataggcacatacattattaaattttactgatataaaggatgtgcagcacacagtttacaaatatacaaccatcttcactgtaaattctatatagccaatttattctcacagaatgttttcactgctgtttgtcaaacttctgtgtccataaccatctatggttgcagttctaccaagatttgacagaatcagactacaaataaatggttgcatactatctgattcagcaaagaagtcacatatcatgaatgagcaagtgcagtgttaccatgaatgttggttgatatttttgcttataagatgaaaatgaaacaataaaaatacatgtcagaacttcactctgtcaatgtcataagtgacttatactatgacaaactttgatttgtagcatttgctgattttttttgttgttgttgttacagatacttctaccatggccgattttaagctacaacatgatgtcactgaacgtggagttgggaagaggtggcagtggcacaccattatgtagtatttccataatctcaagagcataggtgaggggaaatagactaaaacattaggaagtcttcagtgttgagcactgaatgcttgtttttaatgtcagttaattttaagtatatatatatatatatatatatatatatacacacacacacacacatatatacacacacacacacacaaacacaaacatattttgagacaaggtctcattctgttgcccagattggagtgtaatggtgcaatcatgacagcctcgacctcctgggttcagtcaatcctcccacctcagcctcctgagtagctgggactacaggtgcacgtcaccatgcccggctaatttttgtattttttttgtagagacagggtttcaccatgtttgccctggctggtctcgaactccagagctcaagcaatctgcctaccttggcctcccaaagtgctgggattacaggtgtgaaccacagcacacgggccaggataatttaattttttaaattgctatgtttaacaactagattacagaactactcaaaatttaacaactggcttttggctccagcatggcaaatacagaaatattttattcctttatttcccaaagctttccaaactattatcttaaaaatatagtttactctggatagaacaggaaacatttagcacttaccaagaagagaaggcagtggaggcaatgtaggtaacttaataagccccaaaagtttaccaccaatgatggcacaatagaataggattataattccaaataggtttcctccaggaagacattcactgccagtaattgaccaaactacagcccacagaagaacaatgatggtaactgaaataaaccaggaatactagttactatcaataagttgtcacatggaggttttgacaaaatctaaaataatttgtaaaaataaatactgaatgaaaatgcaaatatttataatcatgtttaatctgtaaagagtatcagtaagatgaccaactgggtaactgccaacatcttaagaaatcggatattaccagtacttttgaatctgcctatgtgcccctccccatccatctccctttatactgccagaaggaaccattattttgactttcttcaccattcacttttttctttataattttaacacaaatttagttctgtcttgaattagacattattgttactttttttatagtcaatatttgtttagaattacctactaaggtaccttttttgaaatcatcattcattatggcatctcaaacttttctttctttttgttttgaaacagggtctccctctgtagcccaggctggagtgcagtagcacaatcatggctcactacagcctcaacctcccaggctcaagtgatcatcctgcctcagcctctcatgtagctgggactacaggtgtgtaccaccatgcctggctaatttcttaaaaattttttagtggagacagggtttcatcttgttacccaggctggtcttaaagtcttgagctcaagtgatcctcctgtctcagccttccaaagtgctgggattactggtgtgaacctcctcatccagcctcaaatttttcatctgggacaattatcctgctgcctaaagcatttcctttaggaaaagcatttctataagaatgtgaaataggccaggcatggtggtttatgcctgtcccatcactttaggaggtcaaggcaggaggattgcttgagctcaggagttcgaaaccagcctgagcaacatagtgagaccttgtctctactaaatataaaatataaaaattatctgggtatggtggtgggcatctgtaatcccagctactcgggaagctgaggcaggaggatcccttgagcccagaagtttgaggatgcagtgtgctacgattgcaccactgcactccagcctgtgttacacagcgataccctgccaaaaaaaaagtgaaatgtttccatttgaaaacttgtgttttacaaaactgtgcactaaaaattgaaaagtttatgggaaaaagagagttggggcagaccactcaaaactggtggccaaagcactaagaaaaaccaaaacaatcctaataagagtcttagcacagatgaatctacacactgacatttgtgtcccatacaggcagtctgttctttacagacttaaacctggcctcccatttcctacttcaagatggaaattcttgagggtattttctttaaacagagagcagttccatcaaaatctgatccatattttagccctctgcctcaatacaataaatttcaacaaaaggaaaagcgttggcagcttctttacctcagcttatactctcagccgcttcatccacatgtgttttattagatagcttaatgttgtagaatgtttgagtccttgaagcccctaaaccagctactaattgcatgaaaagtcagcacttccacagagatttcgtcctttaaaaggtcctcatgcagggaaggctttatctttaattgtaagaaagcatatatttggtcttttcttccccagttcactttgccttcacttgctattgcttgacgatacaaaatattatgggccaggaaaaattatacacaaaactgcaaattccatacactctaacaaaattctatttaccattgcatatgagctaattcatgacatagaaacactctgtatcacagcatgttgtatttctcaggagaatctgttacagtaaattcttagttgtatcatctggaattatctttattctcattcttaaaggatagtttttctaggtatacctcagttttatgttaaattctaggttgagtgttattgtttctccattccttgaaaatactattccttggttttctggttttgaagagcctgatttcagctttttaaaggaattctttttccttgttttcaacatcttctctttttctttggttttcctttcagtatgatgtgtttaggtgtgacttccttttgttttgcttaagatttatgttttttaaaaaaaatcagttctggaaaattcttagcctttatttcttcaaagatttcctcttccccattctctttttccatgttgctaaccctagttttcgtatctttcatctttgtgtgtactgcattctagataatctcttcacatttatttgccagttcaccatttttttcacttaatctgctgcctaatttgtccagtgagtttttaatttcaattactatcctatatctttcatttctagaagttcaagttggttcttcttcaaatctattcatttttaaaagttacttgttttgtactcatgttttctaattcttaacttctttatatatataaatgtcttatattctgttttctgataatgtacatttttgaaatctgtttttttgtttccttttgcatgttttttttgtttgttttttttttttttttagtttttttgcaatagtgagctctcccttggaactttgtctagtttgttttttgcaatagtgagctctcccttggaactttgtctaaaactaaactttttagtttgtcttttgcaacagtgagctctcccttggaactttgtctaactttgttgaagccttaggttgaatgagttttcccagatgggaatgaatttacttctaccatgtacttaaaagcttcccatccaagaccatctgaaaatgttttttgaaaatagatacattttcaaattgaattttttctgtgaaattggagacaaatcaggatgaagttaaacatttttattggcgactccacacctgccccagccagcaactacagttgagacaggtttagtcagaggccccatctgcagaacagatttacctcaaatttggcatcacactgggtttcaactttatatgggtgaaggagaatgctttttcctgttagacttctcccaacctgggcaggctctagcttagcctcctgtgctcacagcgctctcaaaatcaatctcaaattccctgaggtggatctagaactagaaataccatttgacccagccatcccattactggtatatacccaaaagattataaaacatgctgctataaagacacatgcacacgtacgtttattgaggcactattcacaatagcaaagacttggaaccaagccaaatgtccaacaatgatagactggattaagaaaatgtggcacatacacaccatggaatactatgcagtcataaaaaatgatgagttcatgtcctttgtagggacgtggatgaagctggaaaccatcattctcagcaaactattgcaaggacaaaaaaccaaacaccgcatattctcactcataggtgggaattgaacaatgagaacacatggacacaggaaggggaatatcacacaccggggcctgttgtggggtgggggtaggagggagggatagcaataggagatatacctaatgttaaatgacgagttaatgggtgctgcacaccaacatggcacatgtatacatatgtatcaaacctggacgtcgtgcacatgtaccctaaaacttaaagtataataataattaaaaaaaaagttccctgaggtttggtagaaacctccagggtggggccaccttgagtgcttactgacctctgctacttacactttggttttggtgtctgatgattccctgttttcttgacagatcatttcaaaagacttaaaacattttttcagatgatgtccttggtttgtgacaagattgttcattgagtctcatctaccatactgctagagactgaattcaatgtccctttttctaaaccctcacagaattgttccagattttctaggcttatgatactactgcagtggaatacctaagggacttccagtattttccaattagctacaagggttgaaatttctatgcgatatcagaggtagaatgggaaagcaggatttgccagctattatactaaattatactttatcatagcataaacccaagctaatattaaattcagcaaggtagaattaagtgttttctcttttcggctgggcgcagtggctcacgcctgtaatcccagcgctttgggagacgccgaggcaggcggatcatgaggtcagaagttcgagaccagcctgaccaacatggtgaaaccccgtctctactaaatacaaaaattagccgggcatggtggcacgtgcctgtaatcccagctattcaggaggctgaggaaggagaattgcttgaacccaggaggtggagcttgcagtgagccgagatcgagccattgcactccagcctgggcaacagagtgagactccatctcaaaaaaaaaaaaagagagatttttctacttcaagactattaaaaaaatctctctttccctgtgctttacttgaaacacagttgtaaatacatagcaaatggtatgtctataaggtttctctaaatcatgtttaaatcagttaacaatttacttctcatttacgattatggaaaaccacaaattttcacatgtaagatttactttttttatttttattttttgagacagtttcactcttgtcacccaggctgcagtgcaatggcacgatctcaacctccgcctcccaggttcaagtgattctcctgtctcagcctcctaagtagctgcaattacaggcacccaccaccatgcatggctaattttttgtatttttagtggagatgaggtttcactatgttagccaggctggtcttgaactcctgacctcgtcatccacctgccttggcctcctaaagtgctgggattacaggtttgagccactgtgcccagcctactttttaagaagaatactgatatatactgcataggcacaggaaaaaatataggacaaaagtcgtcttgtaaacctctggaacagaagaacagaaaaataagcgatgagatgtttatctaccatgaacctcatttttcaggctgctttatgaacgattatacatttttaaaaaatgtgtcccaaaattacattattcatttttactctttccttatgtcagtccatatctgtttcattgtaaacgttttaactataagtaggccatattttgaataataaaagtttaaaaaaataatgaaaagaacagaaaaggtattcaattatctgtgatcttatcagctagtgtatatttttggattctggttttctgtacatgttctaagtttgagattttcttccatgcttagttaagtaaactgacttggtttcattaaaaacacatctagagcctaaagtatagtatattatgcttatctttcattgtcccagatgataatggtaaacatgtctttcagagcccacaaagtataactatggaattgagtctcatttttcagtaaacatatgtgggcatccatatatttacttcaatgatgctattattcttgaacacaatttttgaaattgcctttaaattttctttaaaaggcaaatttagtaagacataaaattatgaaactattagaaaaaaaacataaataaaaagctccatgacactggtctgagcaataactttttggatatgactccaaaaatataggcaacaaaagcaagaacagacaaaccagattacaccaaactaaaaagcttttgcacagtaaacaatccacggagtgaagagacaacctacagaatgggagagagcagttgcaaactatgtacctggcaaggagttaatgtccagaatataaaaggaactcaaaaaactcaatagcaggaaaacaaataatccaatttaaaatgggcaaagacctgaatttttcaaaagaagacatacaaatggccaaacaggtataggaaaaaatgttcaacatttcacctcatgcctgtcaggatggctattatcaaaaagacaaaagataacaaggggttggcaaggatgtagagaaaaggtaactctgtgcactattggtgggaatgtaaattaataccactattatggaaaatggtatggagagtcctcaaaaaagtaaaaatggtactaccatatgatcctgcaatcccattactgggtatgtatccaaaggaaatgaaatcggtatgttgaagagatttctgcactcccatgtttattgcagtactattcacaatagccaagatatggaatcaaccctaagtgtccaacaatgaatgactggatgaagaaaatatgtgtatatacacaatgatatgcttttcagccataaaaaagaatgaaatcctgtcatttgcaacaacatggatgaacctggaggacattatgctaagtgaagtaagccaggcacagagagacaaatactgcatgttctcactcatatgtagaatctaaaacagttgttcatatggaaatagtaaatagaatggtgattaccagggactggggaggggaggagcttggggttatggggagagagtggtcaacaggtacaaagtgataattagataggaagagtagtttgttctgtaccacagcaacgtgactatagtcaggaataaggtattgtatacctcaaaacagaagattttctatgttctcaccatgaagaaacgataaatgcttcatgtgttagatatgctaattagctagatttgatcattatataatatatacatgtattgaaacatcatattgtaccccacaaatatgtacaaatatgtgtcaaaaataaaaataaataaataatgctgatgaatggatgtttatgtttttgaacaattctttttatattttgatgttaaaattatctttatcttttgaaaatatgatttataaaagtgaaaaattgtggatagattccaggcatttaaaagttggccggttaaaactagttttgccagatgcagtggtatacatctgtaacaagctacttgggaagctgaggtgggaggatcccttgagcttaggagttcaagacaaacctgggcaacataacaagatcctgtctccaggaaaaaaaaggttgggtgggggaggtgaaagtggcaggaagaccatgaccaatgccttgacatgtaattttctctagactttaaatctgaagatccatgaaaaaaaaaatgtacacacacgcacacacacacacacacacacacacacatataactcaagtatattgggtgatatatattgggttgttggtcacaggatacaaaatttcagttagacaggaggaataagtttaagaggtctattgaacaacatgaagactgtagttaataaatatattgtattcttgaaaaatactaacagtgaatgtattgtgttctcaccacaaaaaatgacagctatgtgaggtaatacatatgttaattagctaaaattagtcattccagtatgtatacatacttcaaaacatcatgttgcacatggtaaatacatacaattttatctatcaatgtaaaaaataaaataaattttaagtctcaataaaagaatactgtcttcttaaaaaaacctaatttgcctttatagataattttcaaatctcttcttttttctgctttatcacatattcccccagcatacacagcacagacacacatatgcacacaattcatttctgaagaaaaatagggcataaatcaatctgaacttccatatatttatcaaattgatggcagaataacctttggcttccttcaaagaccaaatccattcctgaaagacaaacatatacaagcctaaaaattttcaaaatagtgctgagataaactcccaaagaaaaatcccccaaatgtcttatgtaacagcaactctactaaaataagctgaattgcaaaccaatattcttacttataaagtaataggattcatctggaagtataaatggggctgtgtttgctaaaatattacttgcattacttaacagtaataacaacaaacgtttatgtagtgttttacagtcctaacgtaatcctgtgaaattactcagatatagtaaaggaaaaggtccttgatctgtgttccttcccccttcccacaatggtggtgaccacagtgatcctgaaagccaaggtgaagacagtggagccctgttagtctaggtccttcccttgaatgtgtggagcagagccacccatgtgtgtgaattgttcaccaactagtttttatgtttgggagaagtgaacttctttttgtcctttcaaccatattatttagtaatctgccattataacaacttcatcttttgccatctctttctgaattcatccttaccatttgttatgaccctgtccagtaaaccatgtggagggcaagccagcatttgtctcagtctttgtacgtgatttgcttcagttggtgtttcttgtagctttttttcactgcttttcaaaagaatacttccttctgttggttcatttgcatctatacctttgagcttcataactgtctcctcctgtgtttaaagtaattttaaaaatccttaaaactgtatatattttacacatatttataggtactgcatcatcaccttacaaatcaaatttctatgactagcatcaaggataacactttgtagaaaaaactcacagctttattactagctaatcagcttgaaacaagaatgatactaggagtatttagcacagtcactatttttagtacaggttgagtatcactaatctggaaatctaaaatctgaaatgctccaaaatctgaaactttttgagcactgacatgacacacaagtgaaaaattccacacctaaagtcacatgacaggtaacagtcaaatgcaactttgtttcatgtacaaattatttaaaatattatataaaattaccttcggattacctgtataaatatgaaacataaataaatttcctgtttagacttgggttccatctgcaagatatctcattaggtgcatgcaaatattaaaaaaaaaaaaaatccaagacacttatagtcccaagcatttcagataagggatattcaacctgtattataaatgcttgggtcacataacattttattatgttttataatactgggttttaaaataagcatatttaagataaaattcagggcaataattggcacatataccaaagtggtttagaaaaagataactatctgtaatgaaaaccacttcacattcattaatctacttgaatttaaacaataaaaaggaagaaaccaaaaccattctagagattaggtcagagacacaaagcgtttcataggctctccatttttctagttacaggtagggtcagctggcaatgatgttagctgggaaaactggtagtcacacctgccttggattgtgtaagtttggggataggagaattggtaaatgagtggtagaatatgaagaaaacacaattctatcacagcttagatttacctgtgcttcttgatgcatggagggcgtgtaattcattcctgtggatggttctgaatcttcatatgtaattcttttatcttcatcccccattatttataattaagaagatgacacagggaagaggaacgagatctgttttgaaagagtatagatatagagcagtaatttgaaagtcttgtgatttcaaagactttggattgtacttatttttttccctaaaaattccgaatggctaaactatttgaaattagactattcttaattttcaatggctggttattgtttttgcttgattctagtatattatcatcattcttatctacctttttatttttcttgaaaaagcctttgttgaccaatcacatttttatgatttctttcccatattattttttgagttaaacttaaaaacaatccaagcaatatcagtgttaaactgtcctctctcatgggccaactggatgaagcaggaagtctccaggtaactttccaatgttgatatgaggaatgagtcactaaagggaaatctctggatttcatccttttcggagaatctagagtcactaactcctgcctggttcttatttctaaattaaagtttaaaaatacaccacaattgactgagtagccagaatgtctcagacactatgatgagtgctatggtagtcactttttagtcattgtgggcaattcaaagattaccaaaacatattgtttgttttccattgacttatcatataccaggaaaaataaatttataccaaataactaagaaaacctgtaagactacggattggctcaataaacactcacttcaacacattctcccttggctttccatgctatacaggctacaaggcaaatacagcactccagttcctagccacttttgtaggtagaggtggccatgtgtcacagttctacatatgagatttaggtgggagttttgggggaggcctttagaagataatactttgtactttttgtcctctaacatttccctttctccttcctagaatgtagatacagtgcctggaagggcaacagacatctttcaagcatgagaataaaagccctctatttaggatagtagataagtaagataggagaagctggttccttgatgacatcttccagttgctccatcagccttggactgccaagcattggggtaattgtttaaaccactattaatcaagttttttcttcttttttaactagtaaggaaacttactcctaatgcaacaagtagaatgagtatcttgatagaggtacacactacaaacttgtggtagaatcaaagagaaaattatgtaagagaagggaaaatctaattcaacacatatcaaagtgcctaatgggttccaggcactatgctagacataaagacaaggatgaattagacaggacccctccctcaaggaatcattttctctgttcaacgaagtgccaagaaatttgcatttaaaacttcaaaaaacatcataatctttttaccacaaccacccccatttttcctacttacaaaacacatggtaaccagagtcccatctcaaaaaaacctttagtttgttttttattatacataatttgtaataaatgtttatataatgatatatatgtatgtgtatgtatgtttgtatatataattttttaaattaaaaaacttatttcaaaatttagactgataataaaaaagtcacttgatgagaaaatgttagactcagagaacacttgtcttaaaggcatggagacatgaaagccagtggtgtgtgaggggaaactgctggagcttgtggcaggaggctgagagtaatgcgagatcaggttaaagagttaggatatcatatctcaaaccacggcacttggcctttaccttctgaagtgaatgaccccaaatatggtaactgacaagatgggctgggttcgaatttggataagcctgaatttgaagtccatctataccaaattgcttaacctctttgtgattagtttcttatttatgaaatggagacaagaatagttctaactatgcacagttggcattcaatagtgttggttattgctaaccatgcatattccttcttcctgattatcataagaagaatctttaagaatcattttgctttccctattaagcaagaaaaagtcacctcaaccttgaagaatttactacttaatcccattgattttatttggtcatgatttttcatctgtttttgaggcccacttcttgatcaggtggatgtaacattcatttcttcacccttctcattaggagaattacatagaaattctttggcagtaccactagaattacctctttcatcaaattctcaaaatcagcccattctgccacttacaaaaactatttttaaatagtcgtgaattagaaattattatttttagtagacaaaaactattggttaaaatgaagcctttgcgaacaaattttatcaatgttattatggggtccttttaaatataaacaatcacaacttggcatgttatgccatctgtgggaatttatataattttacattccagaaaagttccctattctccaatactctcaaccataaatgccaaagtacttatacatgatcagaaaggtactgcagaaataaagggtaaaatgaaatacatgtcttttaatgagcccagtaagagatcttacaactagtcagctgtatttgtttgctctctgctgtgtttccatttctaaaagaccatttaaaatgcatgtctcacttcaggaacctacttaaatttaggaaaatttcaaaaatgttagctttacttaaagtgaccatgttcatggtatttattatttatagtcattgggtcttgaaattacaaaaatgacctttgaagggccataaaaaatgtcatgaaatgcttattagaaagtttattctccttactcatagagaggctcttaaggactcatgcagagcccattaacccttattttgttttgtttgtttgtttgatttttgagacgaagtctccctctgttgcccaggctatagtgcagtggcatgatcctagctcactgcaacctccgccgcctgggttcaagagactctcctgcctcggccttctgagtagctgggattacaggtgcccgccacctcgcctggctaattttttgtatttttagtagagatgggttttcgccatgtcagcgaggctggtctccaactcctgacctcagtgatccacccgcctaggcctcccaaaatgctgggattacaggcatgagccaccatgcccggcccttatttcgaaaacaattctaatgactttgctcctttgtttttcaaaccctcagaagattaggtgttaaatattaaaattcaggaagagattgctgtgatagaggcaaattgagagcagcattagtgactgatgacagtgaaagagatgaaaaagacagcaatctaagagtcatttatagtgggggcgacagagcaagactgtataaaaaaagaaaaaagaaaaaagttttcttaaccttttctccccacttgaaagaattgtccttaagagatcaagaatataagcagtttgatatatgtacctgttaagaaggaaacagaaaaaaaaaatcctttaacagcagttgcctttgggaagggaaatggaagaggagtggctggactttctttcttattttctaagaaagattttcttatgtaggattttcttatgtaatttgatatatatatatattttgttgttgttgttgttgtttttttgagatggattctcgctctgtcacccaggctggagtgcagtggcatgatcttggctcactgcaacctccgcctcctcggttcaagtgattctcctaccttggcctcccaagtagctaggactagaggcatgcaccaccacgcctggctaatttttgtattttttttttttttttttttagaaggagtctcactctgtcaccaggctgaagagggattgcaatggcacgatctcagctcactgcaacctccacctcccaggttcaagtgattctcctgcctcagcctcctgagggactacaggcacatgccaccatcccttgctaatttttgtatttttagtagagacggggtttcaccatgttggccaggatggtctcgatctcttgacctcatgatccacctgcctcagcctcccaaagtgctgggattacaggtgtgagctaccacacccggctaatttttgtatttttaatagggatgggtttcactatgttggccagaatggtctcaaactcctgacctcaagtgatccactggccttggcctcctaaagtgctgggattagagatgtgagccaccctgcctggccctaattttaaatacatttaaaaataatctactcaattcctaaagctttagagaaaagaaaatggtaccacatttcttggtaatatttctcatagatacagtctggtgatttgatttgaggtaacttaataacacctgccacaatttaaaatcattttttgtagttgtgatttttcaaagaagatgagtaactgcccagaatcaccaatagcagtggttttcaaaattttcaagtttggctttcatgttttttttttttttttttttgaggtggagtttcgctcttttgcccaggctggagtgcagtggcgagatctcagctcactgcaacctctgccttccggtttcaagctattctcctgcctcagcctcccgagtagctgggattaaaggtgccggccaccatgcccagctactttttctatttttagtagagatggggtttcaccatgttggccaggctggtctcaaactcctgacctcatgatctgcccgccttggcctcccaaagtgctgggattacaggcgtgagccaccgcacccagccctggtcttcatatctttatgtcaaatatctttcatcaaatgaaacctaatccttaaatcctacaaatggaacgactaaggtggcgctgcaggagccctgtctactcacccctgttccttctggcaagtggagcatactttggaaaccatttctgtaaatatgttttcacatagagagatatttgttaaatgttctctttttcatattatcttactaatgtaaatgtttacaagtactttctgtaatattccagaagaaataaaggaactatcaacttacaaatgtccgtaggctctcggtcaagtaaaatagacttactgctatcatttcagttactgctaaaagatatggataaagactttttattcttgctatttgctgcctgtgatttggataggctgacatttaaaggagtaatcttatggagaatttacatatattgcttgctatggcttgaatgtttgtgtccctccaaaattcagattttggaatgtaactgccaaggtgatggtattaagagggaggtactttggggaagtgattaagtcaccagcactcaaccctcatgaatgggactagtgctcttataaaagaggtcaaagggagcagcctagtccctttggctctttcccttccaccatctgagaacacagcattagtctcttcctccatgtgaagaagacatggcaagaaggcaccatcttgcaagcagagatcaagtgtgtaacagacatcaaatctaattagcaccttgacctaggacttcccagcctccagaactgtgagaaataaatttgattatttataaattaattagtttgtggtattttgttacagtaacaaaaatggactaagacattgctagagtactctgggttgtattcatgcctttgaaagagcatcactatgattgttcaatactctataatgataataataacaacaatctcctgcctttgtgttcatccattcatgtgttgaacgtataggttctcagtctcatacagtatttctacatagaacatacagaaacattccagtttctgtatttgcttatcaacactgatctaatggtcatttcccaaaaggagccctacccagcaatgaggaattcagatcaggctcagagtagggcttaacactttcttagacaattaattactaaaatgactaacagtgtttccctgaatgagaactaccttatctgaaagacttaggtgtgtcaaatacatgtggccaagttaccaaaggaaaacaaccgctattttatttggttaattgatttagtaatttcattgactcatgaaggaaaacactatataatgagataagaataaaaggaaattacccctacataagggacccaatacttgctttcatcctttctattctctctcctcaccaaagtgaaatatacttactaaaagtttaaaatattatttctaggcccactaaaatcagaatctacagagaccgaatctaccccaagtgggacagacatgacttatggcctgtctaaatgccaagtgttcaggtatgccagtaggacccttctcccgccctagggataagtcattattggtgtaaatcaatctctgtaacaccattcctctttgccacttattggctaaggagtgagcatgattcatttcttgccattggaatttgtaggcaagactattggggcatattacataagattttccttcttaataaagacagagagagaggaggaaaatcctctcctctttttgtctttaaatgaccaggtaaagaggcaagggaagttgggattgtggatgggtttcttgggacaattctagcagccatcattcacccatgaagaaaagtcaagattagctgaacacagaaagcaacatagagccctgatattactgagctactgaacaaaccctggacccacctaccttcaaacatcttcatgtatgagcaaagtacatctgtatttttgaagggagttttggctgaatatcctgttacttgcagccaaaagcatcctaaccaatataacaggtgattttgttgcagaaccatccctgagaagccctgatgaacagcagtgatgaggaacctctgtcttacaaactttagtttctatctttctagcttcttgttacagtgcaaaatcatcatagacaatgaatgatcagaacactgcctttgtattgaaatttctcaaaaatgtccagaaaataacattttataaagttaaaaattagtgccaaggttttcactgccattcttttagtcaacagaaattatttggattgtaagattatgtatttcccctcctctaccctgaagttaaattgtaatatttgaatactgaatgaagaaaagttggacttataaacgtttggttgttttccaaatttccactcatgaaacaaaacaacaacaataaaatatcactactattgctgcctggagtttcatttctgctttttctacttgaagaaattcaaaatctaactcaaatgtcaccttctcagtatttcctaactccaacattgacaaactgtctccctcgttttcctctctgatgattcattcattcattcaacaaacaagagctattaagctcttgttacgtcccagtccttgagctgaggattcagaagtgaacggtcttaaatagttcctatattcagatcttgtaatctagttacaggatgataaaggatgataaatgattcctaagcaatcacaatgaaatatggttaagtttcaactttagacacataacaaccccatcccttaacaagtttcatttccttttttttcttttctgagatggagtcttgctctgtcacctaggctggagtgcagtggcacaatcttggctcactgcaacctgtgcctcctgggttcaagcgattcttcagcctcagcctccggaatagctggaattacgggcgtgcaccaccatgcccagctaatttttatatttttagtagagatggggttttaccatgttggctaggctggtctcgaactcctgacctcaggtgatatgcccacctcggcctcacaaagccttaacaagtttctctggtgtgataggcacaagagtaacaaagatgactaagatgcagtctgccctttaagggatggtcagagactgatatgtgtttaccaaaatcgtttactcttctgcctgggtccatagtacatttccagtctcccttgcaggtcagtgtggcatgtgactgaagtctggtcaatggcatgtggacataaatagtatgtgatttccagtcctcacccataagaaacaatcctcatgcaatcctctagtagcttttctttttctgtccgttgcctggaaactaaggactccaaggtcttaggggatagcaaagccataatataaaaggagtttgggttcctgaataattgagtagaaggccaacagctgaacacgtgaatggacttgacatgaacgagaaataagcctgaactatgtttagttactgagatgttttactttatctcttacagcagctactgctgtcttaaggttatattcttcagtcaatagcatacgatgattcttagcacctcgaggatgctaacccagtccacaaaggcaacaccccctctggttaatctgagaactaaaataaaagcaagcaagaaaacccacgccaacaccttacaacagtaaacagacacgcgcccgtcaccgggtgtacaaacagaaaaggctgggcccctcgctcgcgtctccggtccagcaggcctacagggtacccgccgctggcgctgggtttatttttacccttagtgtctctggggcctctcacctggcagtctccggcgaagtcgaccaggctccgtctgaacgattaggaaaggggctgtgggggaggcggcggagcccggtctagccaccgcgctctggggttcccgattcgcgcatcttcccaggctgagccgggaggctgcgttgactgcagataaacggtctcagggcgcggcaccgcgtgtagtcggccccgcctttcgcacgaacccgctgggcgacaccgcgcagggaggtccgacccgtcggcgccggtacaggctccggagtaagcatgggttggtccggggcccgcagcggcagccccgtgtgccctccgccgggtttcaggtccggcggcgcgggtgcagagccgcgtgcgatgcctggtgcgcgtggcttcccccggaaaggtggcgccaggccgaccatgggcccacgtcccggggcctcggagcggcaccgcgcggtctttcagctgcttatcctccctgggcgggtccgcaggcttctggggccaggaccagcgagctcccgggaaagcttcccggaaagcttacccagagagcgcggacccaggcgccgagtcttcccggagatgacgagacaccgcgagaggagcacagcgcaggctcctcgggactccgcggcgcaggccgggcagcccgttacttgttttatcgttcccgaaaccaacctctaagttgtctatcagtcctccaccttttagctgtacctcttagaagtgtcttctcagctgcggtgggaagataggattctttcttaaggtgaccaattaaatggccggataaaagacttgttctgcccccctttatcgcttaacacctgcccttcttgttgtattttagatttttaacccttctatcagcagtgtgattctatttcatttaattctcatttcatgtttgtgtcttccttttctctgtatttcctcttgtgtgtgttaagacgcgcgcaccccttacctgtttttcactcctgtaagcaagtgccaatcttaatcaccgcttttcaagcaagggagattatcctcaaatttctccaccagtcagaaaccattcattcttgtctctcaggtcctcttttgtgatgaacctattggataggttccatccaatacccttcttcagatcatctgaaatgattattttcctaaacggaactcttcctctcctaaagcttgtaaaaatttctagtgacattcagcttcctcttaccacaggaatgacatatatttttccttttagtcatatgtacttcattaatatatcacctgatttgattaacatgactttggagaacattgaattttttggctagattttacttcgtttttattgctgatagtgtttataaaaatgttttatagtttatggtcggctgtgagaaagactaactcagatcatttgttaatgttggagcccattttgtagaattcgttgtgcatttatttaaaatttatttgttcatagctatacatatattatacatgtatacctgctcacagcataaagtatttcatgacatacttgtaagagtcagtgttctatgaattcactagagaagttacagcattttgattatgatacacgaaaagaaacccaagtcatttagcttaactccttaatttcataaaccagaaaactaaaatccaagatagattgggtgacttggtctagatcacaaaccaaagttagccataattcggtagtgtagtgcccggtccaaaacctcatagataatcttataatcaatggactctttctgaatgctagtcaaaatgtccttttgtgtgaattttaatgtaccgtcatcaactgcatgatattcttccccatacacaaagtgttatctttttgttgtccatttcagaattttccatgttaatattaaagttctaggaaaaaaggctaagaatcactgcacatttattgagtatctcagtgtgcatcataccatttggtcatttgaggttgcaacaagtaaaaaacaaacataaaacccttaaattaaaataaaaacaaaaaactttgccctgacaatgttacagaattaacatccataaatttacttttcttgaaaaatttattttctttaatttcgtttgtttcctgttacataatttatatttaaatttacatttatttatccagaaactatgtccaaattttatgtcctcttttctgttatcctggagtttggtgaagaaatctgtacttaatttagaaaagaaatccctctaactgacaatattgttagctaactatatatttcttaggcccatgtcaaatatcattgcttattttaataaagattgtttagttagactaagaaaatagtaaataataagggatggcatccgttaagtataaacactggattatttttcataacataacaggtcaacaatatcgttttgaggctgaactcctttactccttttactgtaagctattgaagccaaactccttcctacctttgttcatttatgatggtgtaaaattttaaaattaggatctacatacagaacaatgcagaattatataaaaatatttgaatattgaaaaatgaagtggaaattattattattatttaggtacagggtcttgctctgtcaccctggagtgcagtggcatgattacagctcactgcagcctcaaactcttgggctcaagtaatcctcctgccttagcctctgttaaccatgctggtcctgaactcctggccgcaagtgatcctcctgccttggcctcccaaagtgcaggaattataggcatgagctaccatgcctagtcctgaaattactatcttcttccttaacccccatctcccccacaaaaaaacaaaaacttccttttttcttcatatttacattttaattgtatatgctgcaatggcctatttgtatcaccccagagtcatgtgttgacatcctaacctgcaatatgatacattaggaggtggggcctttgggaggtaatcaggtcataagggtagtgccctcatgaacaggattagtgtccttataaaaagacacatgagcgctcgctttttttctctgctcttgctatgtgaggatacagcaagaagaggaccatctgcaaaccaggaagtgggccctaaccagaaactatatctgctggcacctttatcttgcacttcctagcctccagactgaaaaataaatgtttgttgtctatgacactccatctatggtaatttgttatagcagcccaaagtgactaagacagatgctaacaaatcgagatttattttaaaaactattctcctgctatgagttcaatatttttatttctttacaatgatttcagaagagattacaaagagattaatatacttaaagaatcagactcttgcaaacagtgacatcattaaaaagagcttattttcattaacatgtgattaacaggaaggagatgattggtgagttttcttcgtaaccaggttcactgtggataggaagggcctgccttccttcccaccatggagatcctaaaatcacaagctccagcctccatcaatgatgacagggttaccagttacataagcagactgcagtgataaacacaaggagacagaacaattaaccaggtttgatacaggctgtattttgaaattttcctgtgactaggataactaaacaatttacccttgtcctaacaggaaacctcacttaaacacttaattcagggaaatccaaattaacatttggttgatttagaactgctgagtgtcctgtgatctggaactaaatggcctctggctggtgtctaagcacctgtcactgttaggtatttggtctcagaatccccaaattaaggaacagtgatgtatagccattccccaaattaggatataggctaaaagcacattttcattttgaaactcagaactattcaaaactagctaagttttatgccactaataaacttttgaacataagtgtatcagtcataaaatggtcatattaatgaccagttttttaaaaaagacagcatatatttagttgatcaattataagtggataattgtaggagctgaagcacactaaatgtgttttaaaaatttacatgaatgataataactataatccattaagctataaaaatattctatattagtttcagatatccaaatctttataaaactaaggaatttaaaaaataattactggtttattcccataaatttttcattttctaaataaggctgaagtgatctttttggtagaagtttaaaaatcttttaacttaaaatggataataaagactcaaacagtctaaattcatctgaagcctgaaacaatggaagaggaagtaaggatatcataatgaatagagaaattttaagagttcaatagataaaagctgataatatacagtaggtgaactagggagttattagtcacttcaccaaagaaatacctccaactcccccaagttcttttaaaagacaagctctgttacacatatgaactcctctggaaacctctaaaaagccaaaggtacttttgtagcacatttcaagccacaacacttccaaatatcttgtaacctaagctctggctaactaagggtaatttagcttatcagcagtacccaaatcaaatgagctattctgaagatacggattcagagaaatcacaaaggctcatgtgcttcttcattaaacatttgtctattaatttccccagctattaacaattgttgttaatagttgggagaagttctgagaagaaactgcgctgtcacggaaacatttcaatccctgtatttgtcacattcaccaactatctggtgtgcaccaagttactgggaagaggagctatcagttgttccctcctcgctcccgcctagtcccctttccttccctcttctcacacattacagttccttgttcctgtagtattcagagacataaaacagaggaggaccttcttgtgctctataccttataagcatcatttttgctttcatcttaagccatttaaaagtaaacaatagttattaaggaaaaaactgttaaacagatgcaaagtggaagagattaaattaggaatttccatacacgatgatgaacaagtaagaatttttaaaaatatttatttattttgagacggagtctcactctgtcacccaggctggagtgcagtggcgcaatcccggctcactgcaacctccgcctccctggttcaagcgattctcctgcctcagcctcccgagtagctgggactacaggcgcccgccaccacgctcagctattttctgtttttagtagagacgaggtttcaccatgttggtcaggctggtctcaaactcctgaactcaggtgatccgcctgcctcgacctcccaaagtgctgggattacaggcatgagccaccatgcccggccacaagtaagaattaatagagaaaaaagagccagtggaattctcccaaacaagtcacaagtaaaactaaaacaccacatgcgaattctgtgtccactgaacacaaatctgcttaatcctctccccatttcacttagagctcttataatcctggaggttcaattttttgacttgcatttaatcagggtttccccaattataatttttgaaaggaactgtctctcagaaaattgagcactttaacttttttagtcctccattttgtttgctacaagattttatgtaaagctgaataaggaagaattagtggctcagatcgaagtggtctttctttgagcaaattaaatgagaacttatccctatcttataaatgtagcatcttagcacatatatgccacaaactctctaaaatgatattattttgatgagcaaattgtggccaaatgtgattgagggtaatgaactccttgggaagaatagtgcttacttcatcagaagccaaatacacgcagagcatggctatttcttctgcagttgcgaatcttcccgtcttttgtctcttcaggaaatcattccgtgcctgtgaccagagaccataccagacattagtgatggaagcagctgtatgtgctcacctgcatcttgttcaaggagttaaaggcaagagaatccactggcttgctgccttgatgaataatcaactagggttatggtgattcttttgccaaagttactcaaattgtttgtgttatactaaaacccacagatattgtgacacatcagaaagctaatgttaaaggatgagggcattattttttcatcttcaaaagttgtggtaaagtatacagaatataaaatttactatcttaaccattttaagtgtacagttcaatagtgttaggtacattcacactgttgtgccaccatcaccactgtccatctccagaactcttatttttattattattattttttcttagagacagagtcttgctctgttgcccaggctggagtgcagtgttgtgatcatagctcactgttgtacctcaaactcctgggctcaagcgatcccccagcctcagcttcccaagcagaactcttttcatcttacaaaatggaacctctctactcattaagcattaactactcttttccctccttccaagcccctggcaactaccatttcactttctgtctctatgaatttgtctgctataggtatggaagagggcatttattaacaaaaggtttaaatacattttaaatgctagatgtacctcttcaggatttcctctggcttgtattctttcttgtagagatggcgtatcaactgttcctaaatcaaagggggatattcagcttggttactcactttcactgaaaaagaaatcgataactaaacttcctttccatatgacaatcagtgagattcttctccttgacttaaaatgacaactttacagctgcctgcctgaggcctcttatttaataggcttataatttcttcaataacatttctatgattttaaaaacacagactatgattcttcgtgacactatgtagggactctggatgaatcacccagcattctcaaggacatatattttagtcacattgcatttatatgatgctttatggattttaaatacatttatgcatatgatctcagctaatcctcacaataaccctgagatgtagataaaatcgtacaagcactttgccagcttaaggagccagtttgcctcaatgatctcaaaaccattctttgctgtcaagttcactgtggcatctttggggacaatcccatggctaccatagtccttggtaattcaggtggcgctaaatttttcttatcaccttgcctattttcattgtttcaaatgcctacttttaaccacagtttcaagtttttaatcaaaaatataatttaatctaatttaaagttattttactttaaaaaagaaaaataagaacaacgctaacattttaaaattccacttagtttatggtctcctagagcacgttacccagacttttttgttaacggacataaactgttcattctctttagagggccctttttcagactaaagagtactctggcaaataatgtgatctttctgaggttgtaacaaatggttttacagtcatacttcacccttagatcatgttcctgagagtgccatagatttgatctttattcagaaaacatttcttaattttagcatcatttgctatttttttctgatgaagctggaaatcttcaaaatcagaaagcctgactccattttggaaccccctctttaggttggttatctgtctcttgtcacattttactataagcagccagcactttcaagactctgggtagaaatcaccttaattagatcacccagttcattaggaacatcttctaccttcacactacaggcaacagtgttgatgtactttctgaaactgtatgacaaagacactcttttttctaattttcaataatattttcctcactttcctcaatagcctccttaaagtccacagttttaccaacagtgtgcacctcaagctttcactaacactccttcagaatcttacagctttaatagctttctccctctgaggtaaatgaacatcatatcttacatatgactggtactaatggctattaaataagaactgtagagcaagcccatgcctttagagtattccaatgtcactgggttcagctgtgtccatggcacagacatactatgccagggtctacacaagtctggctggagatttgtgactatacaaccatcagcagcatctcagacatactcagtcctcctcaagttttcttctgtgattggttcactgagtcacagctagttccttgttccaaagagtttgataacatattttccaatctcctgataagtccagtcgctgaaacaaccacattttccaaatcattttaccacttattccactgggtaaatggcaccaagaatagctagactcaagtatcgccaggatgtacattaaaacccaatgaaatgacctctcatgcattcttctttttcttagcgttacctacgtttacatttctgttccaagaaaaataaaacagaacatctcaatcgctgaaattctgtagcttgggggatgtttagtttcccctctttaagtcagtgggtttcaactgaagattcaatcagaatctcttgtgggtctttctaaaccacacaattctctccatgaactccttccctaaattctggcatgcccttcaggtttgaaaggtccccaggtcatattgaaatgtttccctttcacacaccaccccccattatcaattgtgcactaccaagggaaaccttgatcctggatatgcaatcatttctttttaaagaatattataatccttattagataccttaagttccttttagattggtagaaccaggtaaaagtacatatcaatttaataaacacatctacggttattgtgaaaatgagacacacccctatagttattaagaaaaggaaagttctgcttttcttctttgctttgtatgagggatcggcacacctttcttggtaaagaggcagacaaaaaatatttatggctttgagagtcattttatctgttgcaactattatactaaactctgcctttgtagcatgaaaacagccataggcaataacataagcaaattgggtgtggaagtgtttcagtaaaactttgcttacaaaacaggtgtgccttactcacctgggcacacacagttgcacctgatgccctgctggatgaaatctgcagccacagattttgtgaggccaatcacggctgccttggttgtgctgtacacacatctgttcacaactcctgagggtggaggaaaggttcaacaattgaaggaataaaaaatgtattttccttcagaaaggtaacacaaataagttttcccagtagccattttcatgctttctcccacattcctccccttttaaaaagattgatatcagatttttttccttcaatagagtcagtttctggatctagggaaataatatcagtataggcacaacttaattgagacttaattgaaatgctgaacttacttaacattggtagtcttagtttctcatcatcagttgccataactcttaggcagattccaaaagaaaatgaagattaataacaaaacaaaacaataaaacaggaggcctaggcacttctttacattcctctcttgtgtatgttgaatatgtgtatccttgcaaagagaagaaatggtatctcagcagtaactatttcattttaaactcacagatccaactatgccagattgtgacataatccacattttgtactgctgtccttgtccttcaacttgacttcttgctgatggctcagatcaactgtctttgtgaagcattccacaaactcacaggcagttatttccctgtattttgacagcgctttgtacaaacctctgttatatatcatcacactggagaagatgatgtttgctgccttgctcctagttttggactgtgaattcttttatggccagagcacataccggtgctcaatacactattttaaattaattaaatgttaaatggttctttctcccagtttgatgttcatttccatgtccattagaaagaataaaagggagggcaaaaataccccacattttaatttaattttaccactggctcacatcgagagcaaaagatctgtggttaaggaacttaataccaattttgaaaaaagcagttttgaaatcatttcaatacttgaaattataatctctgctatgcctgttcccaaacgcagagctcttaatgatgtgcgtgtatgagcatcgcagtcctcggaaggagacagacccacctttgacgctggaagccacagaagacatgttgataatattgccagatttctgagcaagcatctgccaaaacaaaacaaatacaaaaaaaaaaaaatccactttgtgggctaaaatactaccttttaaaaagatttgcattttcttagggtttgcagaatgaatttaattactgtattagctagtcacattaagcactattaagcagtcttaacagtgaacccaaaacacctcatcaactattgctgggaaatgatggcaatgtgactgcactcactggcatttcccagggggattaccaccttcccatggtacaagaatgtcagcaagactacgagtgaatgctgacttaaatgaaatgtgaataaatgttgttattgtgtgttactgatgttgggaaacttactccattcaacacataatttttgaatacctactgaggccaggtattgtgctaggtccaggagattactgcctacaggaggcaaccagtctggttagagtggctcacataatccacatccagccacagcagagacctccacagagatctaacagcagggtgagggcagaaagggagcaattcaggctgggcgacactcagaggggacctcctgagaaggaaggatatgggctgaattttgaacactagagtattagtcagaaaaataaaagaaaaggatgttttgaggagtgggtacacaggtataaaggttccatcgggaactgggaggaggggctgggtctggctggaatgcagggtgtggaagcaatgaggctgcagaggtcaacaagggctgaatttagaacctgggttttaccctgaaggtgatgcagtgacactgaagggtttaaagcagagaagtggcatgttcagacttggggattgcaaggattactgtggtgcccagagactagtggaagctgatgcaggcttcaggaaagagtgataaaggtggagctgcagaaatgtctatgggtagctgaggaggagagggctgaggcaggatgggcaggaccttgtagatggttgctgcagggatggtgggcctcaccaatttagggcagtgtttcctaagaacaccttcttcagaattcccccactaaagtgtgaatttattaagatgagggtctttggctgttttgtcctcctagacagtgtacacagtaggcagtcaataaatgttgatgaatcagaatctcctgaggtgctagtttaaaacacagattgctgggccctgtcctatagctaaataaatatataataaagaaaactgctatgaatttaaaaatgttttcaaactttactaattataacatgtacatagaagtctcaataggcagtgtaaagggccagagaaaaaaaatgacttctgttgggacgagtttctttagcagcttttagaaaaagaggtgtaggaaaggaaaaagtaaataattgaatggatccaggattggtgtggccaagatgattgatttcttaggatattcttctgactttgttctgagatttagctactaattgcccctaaaaacagaatctaaactaaccccaaggcactatgctgaatggagtaagtggatacaaggagaggctgactgtaacccaaccaagctaaggaagacagcaggggaaaaaataatgtttaacttaattgtgtgttttatataataaagaggatcataatgaaatggggttctcataaaaagtgtcaagaatgttggtcaagtgtaatggtgttgaaaagtaagccttaaaattgttctttcttatccaatttagcaaatagcattccccatttaaaatacatatagaatacatataccccaatttaatacataaagatgggttattatgtaggttcaatctctagtcctctctagaaatgcaatattatctcaggcaaaaccttagaataaagccacctaagagacattacattagtgctgccccctaacacttgcactatccattcaaccaagttcaaccgaggtccctctgctgcttctagagcccctagtcagtacctgttcccatgctgccttcccagtccaggtcaggagctgtcgtcatggtgtcaggctctccctggctccccatgcaatagccttctctggcaggcatgactataaagtcaagtgcctggtacatagtactgctatctaggattgacctcccagaagcttaggtaggggctagaaataccccttaagagtccctggagctgtatctagttagtcttactctgacccagcccttctgtctccattggccagagctcagcccctaaccctggtggaacctggccacttgggtctccagtggttcctgctggactaacaaccttgattcatttatttatttgacaaatgtttgtggagcacctctatacgctgaagactcttctaagacacagcaaggtgggggaaaaaagcaagcaaacaaaccaacccaaataacaaagatatccccaaatctttgccctaatggatcttctcttctggtggagcctggattctgcattgacctcttcttaaagtattttcaacttgttctctgccttttgactgatcttccagtcttggaatgctttcctgtgtatctatccatgaataaaaatttcctatgagtgttcctatgttctgaccagctgaccttccagagctgcctagactccaaatcctagcttcccctggaaagttctaacatgggatatgtgtgtcatagttaatgatacagaggatcatagataattatggctggaagtgattgtgtaacctatcatcctcattttttagctaaaagaaatatgtactgagagggtacaagtgccatctctatggcacatggccaattaggggcagggcgcagactgcacctaaggacttctgatgatagagtccaagaccaggattcgattttgtcaaggtcactttaaacaagaggcactaataccatattcctgccattaacatctcttgggatttttttttaaacaaatctgtgtttttggcccacatggataattgttaagatattgtaaatcacaagcaaactcactagtttgcaagttaatgtttgtatattttaaaaattaacacaagtttacatttcagctccactgtactccacacctacttcctttactaaaatttgtaaagcattttagagcctggttttgcaaatgagtctcatgcatgtgcaacagtcttacccacgatgacctaagctttcctcctataccacagtctctgctctacccctgtaacctatgcaaaggatctgtcttcaaaaatacattcgtgttccaaatactatagtttctcataaactccaaataggctaaaaaatcaacttacattaaaaaaaacaatttgttataaaaatttgctagttcaacattctgtggacccacccaaaaatcccttctaagcactaaacaagtagatttttcaaagtcccttcattactaagtcagtttctctaattttcctgttaatgttcatctggaaccttcttaacattaggttgaatattcagagtagaatatcagccctgctgtgccattaacaaagctcttctcctgcccagacatggacaggacatcaaatccagctgggatggaagggaaaagttgttcttctgcatttcactaggttcaatttacaaccttgagttgagctggctctgtacccagtcaacccctttcattgtctcagcctgcactgtctgctactactggtttataagctcatttgaaatcagggatgtacgctgctcatgtttatactcccctagaacactttatatagtgatttataccaagaggtacttaatgctagtttataaaataaaattttaaacattgatgcgttgtgtgaaggcttgagaattcaaggaggaatgctgtcttgagcacacactgtctctcacctgcccagtaccactgtggttcagatcaaaacaagagcgaagggagaagcttcagggcagagaaaagcaatggggtacatccctcttgagagtgtgagcctagactgaaattcacgaaggggctcaacgtccaggcttcaaatcttggttctaaccatgtgctagttgggtgaccttgagcaagttgtctgaactctcagtttcatcttctgaacaatggatgagataatagtatctacctcatacgatcattccagtctcgtgtgcctccctgctgttacctctgcctggaatcatctcccaaggtacctgaatgatcagctgtctcacttcttggactgctatgccagtttcacctttgcggtggagtccagaggggccgcattgatatcctagcttctttctcttcattatatttaaaaccacgccacatattctatgtctatttgattactaattgtcccatctcacccccaataatggaacctgccttatagaaggcactttgtttagttcacttatgtgtcttctgtgcctagaatggagcctggcatgtggaaagtgcttaataaatattccttgagtggatgagctggaaggttaaatagattaatttatgtgaaatgccttgatataaatgttcaatgcaagttaatcattgtgttagttattatcactcttcagcacatgtgggaatcccttctgtgtgcccagtacagagacctaatgtggtgcttatcctggtggtggtggtggtggtcttactttaggaaggaatgccttgatcatcaggtacatgctgcgcacattgagattcatcgagaagtcccagtctttctcctcacaatccaggacagttccatgatggacaaaactagaagagtgattaaacaatggaagaataactgccattaaaatttttctattccatctgctgattatttttattgtcacttagtgacttagaccactgtctctttcccttatcaagactttaaacaattcatagtatcacttagtatattatattagtaagaatcccaacaacttaagctagaaatgtcatctgaaaacaagatccttgttttccaaacaaaagtatggtcaccgaacataagaagctttatattaattgtgctggaaacatcaatgccattaaaaacaaacaacaaataaaggcgaacagggctaggcatggtagcacacacctgcagcctcagctactttgaaggctgaggcaagaggaccacttgagcccaggagttttaggatgcagtgagctatgatcattccactgccctctagcctggggaaccaagacaaaccctgtttcagaaaaaaaaaagagagagagaaaaaacatctgccctatttgcctatgtgattcctatttcaagagcaacagtgccctcaggtggcacagatttagaattctcaagggaaatcaaaattgcaaggaaaacaagtgtctgaacatctcagagcagcaaagtgatactgctagtgttctaacatactgagagatgttagtttgttgtaagagagacgttaaggcagaacaaaacaaacccgtaaagtagctttcactatttttcaagttacgttttctgagggaagcttccaaaacactggaacccttactgatttggtcctctggacccaaattatgtaattcattataaaatattgttggctgtgacttccatgtaccaaagctctgctatttcagtcagaatgtcagtttcatgacagcaggaaccacatgattatttctacatcccctacatggctgaaaatttaatagatgctcagaaactaactttgctaactatttgtttcatgtttctgggtgtattcttacatgaggatggaagactatttataaaatagatgatcagaaattattgctttaatttaacttccatacattgtaacacataatacagctttgtatcagtaccatctgtcttgagtagacctcatttgccccagatcatgtcaaactctaaggctgtcttacctgctgaattttatgtgtaatgaaaatgctgtgtaaaatctagccatatttcccaaggaatatgtcatggttcacaatgaatgattttgccacattatgaaaattctttgaatgaaagtcatagaaaactttctgtaaggaaagtgaaactaaaaagttatgaattacccagcaacattaaagagaacatcaagtctctcaacttcattggcaaactgatcaatttgtttcttctttgtgacatcaaggacacgagtttgaatacctgaaaaataaaacaagaggcactattcctaaaaatgtttagccttgaaggtttagctgttttgaagtgtgaagtgtgaagattgcaacatctatccagctaggcttcatagattgctgaccttcttactagggtcttaagaatcttcagagtctcattagtaaacttaaagtccatcttgactcctccaataacccatccgtccctcttccttcctctctgtccattttccaagttgaataataagggtcctttctgagcaatggctttatagtaaagaatgactggtgtacattagatgtttctcagtaagccagcagtaataactgaaaatgggctcatttgaagttcttacaaacttcaaacattaattttctcctctttgcagcttttctcttaattttctcttctttgaggtataattgagaaataaaaattgcatatattcaagatgtccttcccctatccttcccctgccagagactgggttgctggtacctatacagtaatcagaattttgtctgagtgaggggtggagaagagcaagtgttctggaataagagactgtttctatttgtgagcttcccctttatgtcatttccattatttattagaaatgactctgttagtcaagggtatccagtcaaatacatgtatttctggactaaactgcaaggagaagaaatgagagggtcagaagaagggatgacacccttgaaggctagacatgagagatctggcatggcgggcacctgagagatacacactgcactagttgctgagaaactccaaacagtgtctaacaaaagcagcagtcatcattataaatatatacacatattatttataatgtgcataatatatattataacatatagtaatataatttataatatatacaatgtattaatatgtatacatataatatataataatatatgaataatacatataatatatagtaatataatttataatatatacaatgtattaatatgtatatgtataatatataataatatatgtataatacatataatatataattatctataatgtgtattatattttataatttataatatattataaataatatgtatatggtttattttgggggaatatagaaataaaagattcataaagaaagggaagacttgaaattttgtttcagaaacatttccttatctttgtgcttccccagtgcagcagctttactttgacttgtttgaattataattcaacatattccaattcaattaactaattcaaggaactaattgctgtttgattatgtaacctgttctattttgctgtaagggttacctttcatataggttctctgttctgatttctttgggtaaactgcaattaaaatcctttggtgttggagtttggttcagtggggtgaagaagtggtggtacacacctaataatctgggtactctcttagggtttctcatgatgatgtgtgattttagagctaagctgtctccagccacatgtggctactgagcacctgaaatgcagctagtctgaaatgaaatgtgctgcaagtgtaaaatacacatgaattttaaagatttagtatgaaaatattgagacgttggtcaaagggtacactcttgcagttataagacttaatatacagtacagtgactatagttattaataatgtattgtatacttgaaatttgctaagagggtagatcctaggtattcttagcacacacatacatacacacagaggtaactaaatgaggtaatggatatgttaattagcttgactgtgataatcatttcacaaggtattttacaacatatatgaaaacatcatgttgaacatcttgaatatatgcaatttttatttctcaattatacctcaaagaagagaaaattaagagaaaagctgcaaagaggagaaaattaatgtttgaagtttgtaagaaacttctaataatttaaataaaaaatttagtaagaaaaaattaaaatattaattttttaacttgagtgcatgttgagattatattttagatatattggataaaagaaaatatattattaaattaattttcacttgattctttttacttttttaatgtggatactagaaaatttaaaattacacaggcagctcacaacatgttactattggacagggctatcctagaggaggagggcacagaagtgaaaagctgtcatgaaaagttaacctaacaactagtaaattttcacatgtaagtttgtaattaggaactgaatccctcaaatgtgttagctaaataaaggattttaagtattcgtcctcaaatttttctatgcatgtaagtcacagatttttgtctataggttcacaaaatatagatttcatatcagagagagaatctaaaaagcacggcagtggagctcagtagctagggaattttctttcaacatgtgagcgccatgctttataataccttgcagacactgaatcccaaattcaagctgctgagttgcttacccgggtacttttccagttcctgaagtttggactcattaatgtctgtggctatgactttggcaccttctcttgcaaaagcctagtagacacaaagtacaaataaatcctttgtttacttgaataaactgtgctcatgaatggaacatcatgtggtctttttctcctttatcttattttcattgttcttttccctataagatagctagaattttaaactatctagtcttaccccttctccattgttattatttttatcattaattagaacaatgtgacatacattgtgcttgtcatctgacttagtccctttaagtaatatcaaacaaaataacgttcttaaaaaaatgacagctgttttcaatactctcaaaatactgctcttctgtaatgagactatatatcatttctgagtttgagttactaaactccaaataataagagaaaaattggttgtttcaacacttttcctactaagagtatgctagtgctttcataaatgtcaaaccataccctgccattatacttaaggtactgttatacttaaggtgccgatattagcttaagtggggtacataatgtaacagaaattgatataaatcaggagaacaaggtaacctgtcttataactctggagtcatatatctaaactgacacaatttcagaaagctgtgtaaccctgtttgccctctgtagcgaatatatcatgatgcagagaaactgaagtagagaagtttctcagagtcaatggttatcagtgatgtcatgtactaaatatgaggtattcattccttcatctgcctggggtcaggagtagggacctatttatttatttgtttatttttataacttaagacaacagaagcacaaaagtaaaaaaataaaaaagcagagcagaagtaaacaaccatggcatcagtccacataattcaatatgtcaagagttagtaggcaaacaacaaagatagtaacttataacttactaaggcagctgcttggccaatcccctgagcagcggccgtcaggatgatgactttcccatcaagtcgacccataatggaacctgtggtttaatctaaagacatgtgtgtttaatgggttatactgtagaacatgatcttgagcaggcagtaacatctagaatgaatagttcagtgtgctcttttaagaataatttagtgagctccttcaggaacttgaagacagcacctctgtgcaagtagtcccatcatctgaattctcctagaatgcttactctgcatacctagctttgtatatcaaacacatttaccataacccactgaagtaatgactggtgacagacattggccattttttttttttttttttttttttatgagatggagtttcactcttgtcacccaggctggagtgtaatggagtgatctcggctcactgcaacctccgccttttaggttcaagcaattctcctgccgcagcctcctgagtagctgggattacaggtgcctgccaccacgcccagccaatttctgtattttttgtagagacgggctttcaccatgttggccagactggtctcaaactcctgacctcaggcaatccacctgcctcagccttccaaagtgctgagattacaggcctgagccactgtgcccagcccagatattgcactttaacctaccttatccttccttcagtacctggagaggacagcctctggtgctgagtttcctcactaccaccatcactctctccatgacccctgcacacattgctatgacattatttgtgtccttactactcagggctgcttcttgatttctcttccataaacttttgttgaggtttgcactatcaattgcttatgattttttttctcttgaaaagatttcatagttggtctcagatattcatcgaaaaaaaaaaggatggaaaaatcaaatcacatccaatactcccattttacagatgaggaaactgctgaaacatgcccaatgtcatagagccagtcaatgggaaagccagaactaaacttagacttccagactcttgctatgtgaacagtccagcccacaatgctgccgatcctcttataaagtttaagcatgcagtagtaacacattaacaggcataatcagtaatttctaaatgattgagaaacactgacaccggggctcatgtgcatgagatatttcaccagtgcttggattatagatcacaaagtgagagaaagagctagtagtgaggctgggggtggagaagagccaaatgaccatcaaatgaggctgtcttcaaggacacaggctccaagtcttgctgggctctgtcattaatgtgtgcctctgacctcatacgaactcacaaagtggctgctttgtccaaggcatcatatccacatttcaggcaaaaagaaagggaggagcaaaagccaaaaggctttcagagaggtctcacctttctatttaagaaggaaaccttctcagaaattcccacctgcagttcattcaccagatctatgctacttggccactcctagctgcaaagaggttggaagttgagacttttgtttccagctttgataaagtgaagaataggagaaagtgagttggatggtgttgatgaaccaacttacagtacatgcaaactagcctacacaatcactctgttccattatctgcctgattttgtacaggttgatagccttgcctaaagggcttatattacctagtcctttctctttgaacttatttcagttctctctttagccaaacttttttttttttatacccaatatgctcttccatttcaaacctccacacttggtccaaggtccacatggtgaagggcaagttactcctataggcaacagccactgaaggatttatggaaagggtgtgaaatgatcagattcgtattttggaaggactgctgtggagaacatacctgggcaggagcatggggtgccattaggaggctgctagggttatctagtgggggcgctggtgaaatagcagggctggagaaaatagcagggatggagagataggtggattggagaagtgtttcagagatgagataggtaggacctgatcaccaacgtggctaatttcaaagaaatgttatttgcccagtgttttgcagctatgaattcaaacctaggccttcttgttgcaggtccaagggaagatctcatggcattgtctcatggtactcaaagccctgcgggcctctctaaatccccactgtggcaccaggagcctgtgcctcgcagaccgctgaccccaggaagtaatggacaatgaggcgcagctgctgctgcctctctgggtttgtgctgaggccaccttctcggggccgttacaagccagtgcctgagcatgcatgcttactaaggcagactcatttctgggagacatagacctcctccccaacggatgactggctagagaagctccttattaccttgctgaagttctcttagactgcacagctgtctgggatgcttccactcaacctggtttccttcttttcctccctcgcgggtggacttgcatcgaggtctgatggctctcacagccttacctagttctctcctcattctctctcacaacagcatttcccctaataaaatccatgcatatttaattctatcttggagtctgcttcttggaggagcagactaacacaattatgtaagaactggctccagggatcagcttataatcactgacttcctctgagtttgtccacattttttaggcgatggggaagcttggctttaacagtgcctgacctactttgatgcaatgaatttttgcttttttacttcttacacaaaagataaacatggaatgtttatcatttcaacatggaatgacagtttctaaagtataactttagaaagatatactttatcctccttgaatcctaagcatggtgcacaaaagctattttacaacactgtcattagtgatattgggtgtatggccctgtaaagcctccagtcaaaggttttgctaggaatctttgccaaccgaagaagcacttccagaacaaatgccgaagcacagagcagcctttctatgcactctgaaaacctcctcttagctggccttcctgtctttctgggaccagattttggggtcaaagccttaacatttgataaactgtaatctcaaactaaaacagatttctttgagaaaatgagagcaaacacggcctgaaatggtaaaacaaggcacctctcaatatatccaatgtgaaaaccatacatgttggcttccttagtccaaaagttagaatcaaaatgttgatttttgattagcagagacacaaacagcatattcaggaagccattgttttcaagagccaggaagaaaactcttcacttaggataccgtaagaatccttttttcttgggctactttataaaacatacataccacagagtttcaggctctttaaaaacccatctttacactgatctaactgctcagattaattttgaaacaggcaacgtgcagaaaaaaacaacatctaaaaattaaacctcccctctttccgttctaaagtttcatttcaaaagtattaggaaatcttactttaagcagcgagctgatggcgttctccagaactcggtttgagcaacaaacttgagacaacctttgtctggaagcaagtcaagcgcttaataatgcatgctgggatttgtagtttccctgctttcagagtttagtggctccatccatacactttataaatgtatgtgctgccatctagtggaattcaggtagaactatgaattccaagtggaaggtgaaaagtggaaaagcaccttagagcttacttaggatgcggaaatcatttccttcacttcagtctctccacttctctgttttgtttatgcctactatatgcggtgccagggtagacgagattggctgagctggaaactgcgtgtggaagatagcagagcaacaaaatagagggaacccaggtcactgaaaattctggagccttcctgtcacttggcctggattgttttaagggagagaaataaaaaaaaaaatcctttttgtttgagatacagttgtgatttttattttttcatgctcagaatattctaacactaatgcacatttagtggcagaatgccaggagccttttactacactgggaatggggttggggagaacgtgaaacttggatgacagggtggaggcttaaaagggaacatgttaacagcgaaaaaccccagtttggctgaagagaacagagatataaggtcaaaaagaaaggactagatctcatgagccctctaggttaggatagcaacatgtgctttatctgtagtgccagtgagcagagtgattgtgtaggctacttgtacatgtactgtataaattggtttcctcagcacccatccaactcactttccccttttttcacttgtcaaagctggaaaacaaaagtctctacttcatagccttgtttgctgctaggggtggccaagcagcatagatgttgccaatgaaatgcaggtgggaatttctgaggagggcctccttcttaaatagaaaagtaagcccttctgaaaggcttttagcttttgctcctccctttctttttgcctggaatgaagataggatgccgtgggacagagcagccatttagtgagttcatctgaggccagaggcacacattaacgacagggaccagcaagagaaggagcctgcggccctgatgacagcctcaaggcaacaactcctctggacttcttatgtgaggacaataaactttagtgtttttcacgttttttgttacatggagctaagtgatttctaacagtcacaggggataagaacaaagactgtggcgtcagtaagactagagcaagtcccatatctctctctcactagctaagtgagtaaatcacttaaatctctgaacctcttatgtttctcatctgtaaaatgaaggtaaaatagcacctacctcagggatgtggtgaggaggaacgactaagcctgtgaatccatcagcacaatgtttgccacacaggtgcttaatacatgttagtgattcttatgatgaagacattgttggagaaatttaattataatggatggtaaaagttgcgctttttaatgttcttttaaaaactggacttagtttctgcatgtgtctatatgaggtctatggtaaaattgtccctccttgttcattgtttcagcaacttctaatgctggctctaacaatctgtaatcacatctagctttgttcctgctttactaataatgccctttgacttttgaggcttttggaacagactttatgagagttctctaatcaaagccaactccaatgcttcttgatgtagctttcttcagcatccctctgtaatcttcagcaacaatgcttacttgataacagcctaagtcacatggtattgcaaatacttgcttacccattagtattctcagcagactaaatttcttcaagggtggggactatgttttacacctttacattgtgattagctcgtattaaaagagtattagttacttgttttcttatctacaatatgagttccacattggtagtgcctttcagtgcctaaaacagtaattggcagatagtagatgctcattaaatatttgctgagtgaatggcagtttcttaataagtttcctgaatataattctgccaggctctcaagacaatgtttgtgataattaattttaggtgtcaacttgactggatttacggatccccagagagctggtaagcattatttctgggacatctctgagtgtttctggaagagatcggcattggaatcagtgaactgggtaaggatctacttcacccaatgtgggcaggcactatccaattggctgagggcccagataaaacaaaaaggcagagaaaaggtgaattctctctcttccggaactgggacatccatcttctcctgcccttggatacctgaactccgaccagattctcaggccttcagacttggactgagccacgctcctagtttccctggctctccagcttgcagacagcctatggtgggacttctcagcctccctaattgtgtaaaccaattcccctaataaacatcctctctctctctctctgcatatatatatatatatatttttttttttttcctcaagcttcagtggggttacatcccaataagcccattgtaaattgaaaacattgtcagttgaaaatgtatttaatatacctaattcactgaacatagagcttagccgagcctacttaaatgtgctcagaacacttgttagcctacagttggataaaatcatttaatacaaagcctgttttataacaaggtgttgactgactcatgggatttattgaacagagtacactgaacagtgtcagttgtttactcgtgatcccgtggctgactgagagctgtgtcttgccgccactgcccatgatcacagtagagtattgctatcttatgaagagatcagaattcaaagtaaagttttcactgaatgcgtatcgctctcacaccatccctaaagttgaaaaatctcaagttgaaccatgacaagttggtgaccatctgtgtatattctattggttctgtctctctggaaaatcctaagacagattttggtaacaggagaggttctagaggaacaaaattttaaggatgagtttcctgagttggttttggggttcctggaattggctcttagtctgattagatttgaaaatgctaaaggctctactctttgagatggggtcacactcttgaacaggttggagtgcagtggcaccatcatagctgactgtagccttgaatacctgggctcaggccatcctcctgcctcagccctccaaattgtttttttttggtagagatgaggtctcagtatgtagcctaggctggtctcaaactcctggtctcaagtgctcctcctgcctcagtttcccaaagtgttgagattacagggatgagtcactgcgcccagcctggctctccttttaatagtacagagagcactgattgtccaagaaatgaactgttcatagaggtatgcaaaatgtctgcattggatactcctaatcaaccacttcttagaggtgaggaacttaagtgactctatatataatacttttttttttttttccgagacagagtcttgctctgtcgcccaggctggagtgcagtggcatgatctcggctcactgcaacctctgcctcctgggttcaagcgattcttctgcctcagcctctcgaatagctgggattacaggcacacaccaccatgcctggctaatttttgtattctagtagagacggggtttcaccatgttggccacgctggtctcaaactcttgaccttgtgatccgcctgcctcagcctccctaagtgctgggattacaggtgtgagccactgtgcccggccctataatactttcaaatatttatggaaaactaagaaatataccaatgttggttggttgcttctaatattgttgggcaaaattatttaaaaaaaaaaaggatgacttcagggattcaaattcatggctcaagctccacataagtaacctaagagcttataggcgtgccctgaaagaggatcttctctcctgtagacatgaggctaaaattgctgaaaatcaaacaccagtcttcatcatttgattggtgcaattacaaaaggcctcagtgtgtctactggtaaaataagccacagtgactgggagagtgagattctataagttgggatggggacgtgtgggaagaccctgaagccaggaacattgagtttttttttttttttttttttttcagtttcaccctgttggccaggttggagtgcaatggcatgatctcggctcactacaacgttgacttccagggctcaagtgatcctcccacctcagcacccccgagtagctgagactatggccataagccaccatgccaggctaatttttgtattttttgtagagacggggtttcactatgttgcccaggctggtcacgaactgctaggctcaagagtcccacacctcagcctcccaaagtgctgggattacaggtgtgagccaccatgcctggccagttcctacattctgatgagtttttttttttaccagctgtagtggcctctccaacctcattggggttggtaatggcctttccacctttgtctgaagggttaaccctgcattgcctgaggaaataataatggcctcccctgaggcagctgccaagcaagacaatgctgattctcctcaggacctacccccaccacccctctatgctcctagacctataactagactcaagtcccagcagatccctaatgtgaggtacaaagtgtggcccatgaggagctgcatcacaatcaaaagaaccacttgagttttctaacttatataagcagaaatctgagaaaaatgtgtggggatattaagggtgtgggataatggtggcagcaaaagggacagagcttatttgaagaaataatggccacaaacttcccaaatttgaggaataaaatggacacccaaattcaaaagttaagcaatattctactaggctggctacctgacaactagatttttaatggctttaatgtagttttatcaatcaggtaaacaaccactactttgggttacttttgttcagtggagaagcagacataaagaatcaaacctgcaggcatgttagtgttttgtttggataagggtggaaagcagaagacagactctcaaggtacaggtctgggggaaaagattttaggaagggatagtttccccttagtctttgttaattcctttggtggtatgttaagatacggagaaatatccaatccacagactttgaaatactagatatgatgcaatcaataatctctccctttgaatgaatcttaccaaagagccgagaatgacttgaaatcactttacctctgttctataacctaatgcaacttgttttaagtggtttttcaaagtcatatggtataaaagtaatatcaaatatcctctaaaaccatagttcttagatttttacaggatcacgggcccctctaagaatatgataaaacaaagtataaaccccagtatcccctccccccaaataaatccacacaaaaaagttcataaaaaatttcaaaaattttacagattacaagaagtccatccatatatgctttatctatctgtggggactccaggtttagaaaactttactttgataaaaactctggtactgtttccttatgtctacaatgaagaggtagaataaatgatctataggttcctccaggctgggagtgaggggcaatgaaaaacaaagtctataataaaccaaccaatttagagagtttgtatagggattgggataggtaggttaccagaaatgtgagaaagaacttctgtggttattacagtaaaaggaatattagaactggaaagttaagaggacatagcctctgctatcctttaagaatttaaatccagatccagaaaacttgtgtatattttcatagcaaaatactgagtcaacaagagagactacctcaccaagaaaccattaacattatatagaagagcggtgattcagaactactaaacatttattgaatgtgtaaggtattaaaaacatttacaattttgttaataaaatgatgttttatattaatgtatgtattatgctttggaatatgctaagtcatgtagataactttacatttctttcaataactttattctttacaaaatatacaaataaataaaacaattcaacttttaaaagtattaccatatgcaagaagaaggtattgctatcaccattctaaattaccacaatgcattcatttcctgttcccttatctttcaactctagtggcaaagtaaagactgaattgaaattaagctgcactacaacatcattaccagggatagacacataaacaaagtcatttccaaataaggaatgctggatctccagagaagtgacaaagaggagtctactgagttttgcactcaggcacatccttgcctgaggaggcgtgccaaggacctggctgagaatccacactctctgctcctgcattttgcacctctgagaaagaaaatgaaaacaacattcatcctattacaaaaatacacaaaaaccaagcacagctggaagtggaaaggaggttaagacaggagagatgtgaagaatgaaaaatggcaacgtgattcaccgtgtttggtcatgaagatggtgtatttcacctcagagttggagaagtttactccccattttgtcctaaaatgaactattagacaaaccatagttaaactgagaggtaataaagttttatttggaattcttcaatttgaaattcaaagtgaatcaaacacgggctgattgagttttcttttgtcctgtttttcaaaataaatggtgtgctaaacaaatagtattttagagaatatttaatcatctttggaaagctttctgtgagcctttaaaaaggactttagctgcatctatttgcttataaacaatatttattttacaattattatatttataaaagtaaatctaccataactggtcttggcaattaccttagtttaaggtaatttagattaccttttataattaaaagtaaaaactcacatttatttttttaaagactggtattaattcaagctgggactatctcatttaattctgaattggtcagtttttgatttatgtattcttctaggctactcttttatttatctaaaaacagtaccagagagatccacatattaaaaaaggactcaaacatttttatttgcagtttgatgaattcacattatgcatatgcctctggcactagcagacaaaatcaaaaggtgattacagctgggtgtggtagctagcatgcacctgtagtccttgatgcttaggaggattgcttgagcctaggagttcaaggccagtttgggcaacatagtgagagagttccatgcaagtgttagctagccaatagaaggtccttaaatgtttgttaaatactatttaatgaagagaatatttcaaacatgtttttattccaaatgtttctgtgcctacctatctccctaagaacacttttagactgtcaacttgatctaattttgatgtagttgatgagaatggatagattttttcttaatcacaaagtagaggtttataaactctggcaaatagtgctcaaggttttaaatgatttggcaactgcctttcttactgtacaattttgttgctttagatttctacagttgcataacagggtacctctggtagggtaggcagacacactgtcacaaagggctgtgcacagtagatgctatgtggtgagaaagactacaagaaatgccgtgttaccgtttctcctgcaagtccccccacttctgtggacaacctccatgcagagctgggggtgatccttgatacctccccactcctttgttcaatcaggtgcctggtgttgctgattttactccaaaatctctcccgtcggtctacttctctccttctctactccaagtccacactaccatcatgtcttgtttagacaacagtctaactcctgctcctattatttgctggtcaccttagagacgaggtgatgttttcaaaatgtataactcatgttctcctgccattgcttaagatctttcaaaggcttcctctacacaataaatgaaacaattcctttatataatttataaaagtccagcatttctggctcttatttctctctttggcctcactgacttcacccacacaagcttgtactcactgtgctctgaccacaccatatttctttcaactcttcccctggtcatgttcccacctaccctaacgctgttgctgttccatctgcctgagatgtttttccctctgctctttattaagataactcatgttaaccttttagatctgatctgtttccttcctcaatactcctcaaatacttattatatttctcatagtcttttgtacttgcactgctataatttcacttttttttttttttaatcacttgattactgtctgtatcttccatgagaattaagctctatgaaggcagggatcatgtctggttttgcttatcaatgtgccaccaggatctaatccttaacacatagtaggggctcaaaacaattttattgactgaataaatgaataagtaaatgattcatctattatctggcttgggtaaagtaaatataatgctattggatattttggtccattgaattgataagacttttcagtaaaagttgctttttagggtagtatcttcatgtccttgagaaagttgcttgtctctctttggacgaaactaaaggcttaaagggtagactaaagacttcacttggggtaaaagtgaattgcacttcactgtgtggggtgccttggagaaatcaactttcttacagagtcagcaaatgaagcctgtcattgtagcttactcaactaaatcatctcttatctaaacttgccctttgggatcacatattaatgataagttccaactgttaccctctgatttccaagtaaccagtatatttacttacctggacaaaggcctaaacttgagttatcaaaatagcgaactggatgaggtgatggtaaagactttgatcggctatcaaaaaaacaagattttggtgattcctttggcacaggatcttgtaaattccgttccttgcattgagagggtgtaatttgtttctttttagaagctgttccagtcactttaggagactttggagaattctcacaagttacttgtttgtgagcctctcttttaagggttctttccttccaagttttgacctcattggaaagatgctgattattgcttaaatgtgggggaagaaaagagagactgtaagacttcttgattcttaagatgtattcacatttatatttaaaaattaaaaataaattgtgatgaaatatatataacataaaatgtacattttatcacatttacattttaatttcaacctcatgcttcctgttttgactattttcaaagttcagaaaacaaaatggatctatataaattgaataatatagtaagtttccatgatcatggagtcttgaaaagaaagctctaagtacaacattaggttttcaaatgaatcaatgatataatccagagtggcttatctattgatgctttgccacaataatttgacaaattagtctcctggatagatgaatctttgatgtacctttcttactgtaaaataaatattacactgtgcttttctagttacaatgctgcttcttacaggagatgccaccagcatttatccagttcctccggagagaaacctgggaagcaatcctagagacctcactctcttttattttaagtcatccaagtctcttgatacactctcatcctatctatcaaattcacttccttgtttttatccctattggggccaagctagtccatgctaaaattactttttgtctgaactaccataaacacattctaaaatttgatccctctataatgctctagcagccaaagatgctatatgatctcatcaggccactagcttaaaaccctccagtgcaggtaatcctgccattacatttaggataccactccatattcttcaaaatgaactataagggcccatgtaatctgaatctagttacctctggcaccttgtcttgcactttactctgtctcattctctacattctggccacactggatgtctttcagtcccaccaattagttattcttcttaactcaaagcccgtgaacatgttcccctggcctggaaaacttatccttcttccctcatctagcctaattcctactcatttttcatatctattctgatataggcataccttggagatattgcaggtttgtttccagatcactgaaataaagtgaatcgcggaaatcttttgggttcccagtgtgtatagtagaaagataagtgcaataaaacgaggtatgcctgtttgttggcttcctgatcaaccaaccctccacccctaacacctagataacgttggatctctctctttcataatataacccttttataatgtcctttttgtttttgtttcttttttaatagcactcatggcagagttagttatttgtaaaattatttaacgcttttttttctactgtatcatagtagagtgcttggggaaaagattctactcttccacgtggtagaagccgaataatttgttagatctgtttataaagtaaaaagcctacaataatggacgtaaggagttcctctctaagtaaagcctcactggcttgggtatatggacttgtggtgtatttcagctgccccctcaaaggtctttgtttctttcctatttcttgccttggttaagaattggtcagttgatagacagcaaacattggaatagtgctaccatattctcattttttaaaaaagatacttattacctgagctctaaaaattactttccccataatgactgaagtgttaccacctgcaaaaaatacgtgcatataccatgtccctacatatatgtaatagccgtaagcataatatccgtatcatgtaagcagatcttaccttaacaattcattcttttgttttattagctgttcattttgctgctttaacttagaaatttctttttctagccttatatgttcacttttcaaaataagagcttttgtgttttgtacaatgccgctgccacctccacaagttaagggtttatttgaaggctgaggatcagtatgttctgatatcactgtgggaggaaaatatacaaataggtgataattttaattgtctccaaagttcaaaataaaggaaatactaccaagtacaataagccattatagagacccaaacagctcaagtcttatttccctggaagtcacccttgacttctgccttctaccttactccctctgcttatttgaccaaccattaattctatgcctctagaatccccctcaaccaattccactaacatatcctgatcctgatcaccaagctctttcaccctgactgcagcaatagcaatcctctccacttactgctgtcctttattgatctatattttctacatcagttttcccctgaagggcttgttacaacacactgcgtgtgtggcggggaggtgaggtagggtgggagggccaccccgtcattcagtgcattatatgtattcaatacatattattaactaaatatatgttacaataatattaaagcacatattaaatattctacactatgtgtgtaaagagactgtgttttgtaaattgtaggcaaagttgcacaaaatgtgagatagttatgaagtggattaatccattaggtcactgggaattcacaaaagagggatagtgtgtgtgttgggggtgattcttgatgtctattttattttgaattcatctacactatgtacctgaaagtcatctacaaatcaagaataaatatcctcaaccttctgaaacaaagaatcctcacttctatttttacccctttaagttttctcggtaggtgctgtggttatcctgtaacagacactagggaagtttaagctacaacaggtactaggtaacaccttaacacctttagcaccatctatttttggaaacaagtggactataatacaagcaaatatcatcttatgttttgcttagtatttggaattttcaatgtgtttttacccacaactttcggtttgatctttatgtacgtgtgtgtgcgtgtgcatgtatataaataagtgtatatgtatatacacttttttaaaaaagacacttattacatgagctctaaaaattactttccccatgactgaagtgttactacctgcaaaaaatatgtgcatataccatgtccatatatatgtgtgagcataactatatatatgtgtgcacatgcatatatatgtgtatacacttatatgtatcctgtaacatataatatacagaattctatatattctgtaaatatataagtattatatataatatatattgcatattgaaaattccaaatactaagcaaaacataagatatttgcttgtactatatacttataagtgtatatatatatacacttatatataagtatatatatgtaagtatatacacatatatacatgtgcacgcacaaatatacacttacatatatatgtatatacttatatacttatacatacatatacttatatatacatatctatacatatatacttatatatactaagtatacttatgtatacatgtatatatacacatatacatatacatatatacacttataagtatatatgtgtatgtatgtatatatacttataaatgtatacatacttataagtatatataagtctgtatatatacttgtaagtatatataagtggatatatacttataagtatatataagtctgcatatatacttgtaagtatatataagtgtatatatatacttataagtatataagtgtatatatatacttataagtatataagtgtatatatatacttataagtatataagtgtatatatatacttataagtatataagtgtatatatatacttataagtatataagtgtatatatatacttataagtatataagtgtacatatatacttataagtatataagtgtacatatatacttataagtatataagtgtacatatatacttataagtatataagtgtatatatatacttataagtatataagtgtatatatatacttataagtatataagtgtatatatatacttataagtatataagtgtatatatatacttataagtatataagtgtatatatatacttataagtatataagtgtatatataagtgtatatatatacttataagtatatgtgtatatatacttataagtatataagtgtatatatacttataagtatataagtgtatatatacttataagtatataagtgtatatatatacttttaagtatatgtgtatatatacttataagtatatataagtgtatacatatatatgtatatattagaaaatccttcacagcagttctgtttattctcctgtaaaaaagtatgtatgagtatataagtacatatactcgtatatatacttctatagacttataagtataatacttctaattatataagtatttactatatatacttatatattacttatatatattacttacatattacttatatataatatataacttatatattacttatatatgttatacttatatatattataatatatattatatataatatataacttatatataatatataatatataagtaatatatattttatattacttatatattactcatgtaagtaataaagaagtaatagatatattacttatatattatacacttatactatatatacttatatatttattatgtatacttatatatgtataataagtgtatatatacttataagtgtatatatacttataataagtatatatataagcatacatatatgcttataagttagaaggtcaggtgctaaccccacgatttcatatagccattgagatctgcatcttagttcagtacttgttctactgcgtaaagctatctcaagtactgttcaagcattctttcttttcaaatggaacatgacagacagaatatgaataaaggtagtttgaggaatgcatgtatattgagaaatttgaccaacagatctaaaaagtatctcagataaatttcaaagacctttgcaagtaaatattaacttggtatttttagtttcaagaacaaacagaatagtatttatttttactgtacaccaattataacttattagatgcatacaattaaaatctacgaagacatgtgtttcgttttattgggaagcataattccatgttgatatagtataagtcattcctttattgcctgaaggtatcttcactaataggtaaagatttgacaatacaaaagcagagttcgtatttttcaagaatctataatggataagcatctaagattacaacaaacgatgtcacaagatatctggaaatatggttccaataaattcatttaaaaatagattagtggccaacttctgtttactctcgactgtcacatactacataatattagtcttcaaagtctgttgtgtgttgagaagtaaaatttcatctgaaaatatctgcattttctacttacctgaggtatcttgggcctgttgacttcttctgagattttctctcaatagccttataacttccttttgatattctacagtggcttttgtagcactgattctaacaaaaacaataaaaatatgtaaaaagctcagcaactgattttttacaggagaataaacagaactgctgtgaaggattttctaacacatcacattgacataatgcctgtaagtggcagtagataagccctcgtgatacctctctggtgccatgtgccttatggcattaatgccatcaaactagaagcattctgcttgggtgcagggacagtccgattttcttatattgagaaaccccagttcttttaaagcttctggaggcctaattcattgtatattgaacaaaattataattacctaattattttttaccatggggtcctagaaatatttgaaggtataaggagcatgaaagagaaagtgcagctttatttctgtatggtcaggaaagcaaaccctgactgcagctctggtctaaggtgctacaaaggtcaaattctgatcactgttctccagtagaaagagacattttatgagttgttagtttacgcattaatcagtaacgataaattataagactttctgcctttcttaatgactatgaattatctgtatctgctgaccctattctttacttttcttttctttttttttttgagacgaagtcttggtcttgtcccccaggctggagtgcaatggcgctatctcagctcactgcaacctctgcctcctgagctcaagcgattctcctgcctcagcctcctgagtagctgggattacaggcacctgccaccacgcctggctaatttttgtacttttagtagagacggggtttcaccatgttggccagactggtctcaaattcctgacctcaggtgatctgcctgcctcagcctcccaaagtgctgggatcacaggcgtgagccaccgtgcccggccctgctgaccctattctacaagtaaaattgtttttataattaagaatctaatagatctatgtttcactgaaaccaatagactgcttagagagcatgaaaattccaatgctacttcctgggcaaaataagagatcattaaatatttattcaagatttatataggaagaatgaaaagtgttaaaagccaggaagcatcctaacaaatcctctaaataaacctttccttattgattatgaatgcgaggaccagagagaataaacagtgtaaggtgatgcattagtaagtgagaacatatttctttttttttttttttttgagatggagtctcactctgtcgcccaggctggagtgcagtggtgcgatctcggctcactgcaagctccgcctcccgggttcacaccattctcctgcctcagcctcccaagtagctgggactacaggcgcctgccaccatgccggctaatttttttggtatttttagtagaggcggggtttcaccgtgttagccaggatggtctctatctcctgacctcgtgatttgcccgtgtagccctcccaaagtgctgggattgagaacgtatttctacttcagtttccttgactctctttaatgttcttttcattatgctataccacaaagaatttaggcatgctgttatgtataatgctacctataaataaatcaataaaaagaggatttgctcttgggccctagggaactataaactaaaaggaaatataatcttcacacagaaacacagtaaggccaacaaatgaaattaagagaaccaacagaagccttagtaaaactgctaaatacacacacacacacacacacacacactcttaatgttcactttcaggcatacaaaagccacttaaaattgtttatattctgtatgactaagaagtgttcaaagacacagcgtgttaattgatcagaattgtgtttagttttaaaaactttgcatatgtaatgagaccagtatatttaaaatctatggatgtgtacatttttaaaaaaagagctgtaacaatattttcataaattatattttaaaaagttaactaatgaaaagtatatgtagtttaggaagaaaatttaagctattaaaatcacattaaattaagacaaatacgtactccttttcaaattctttggcatttttcattttctctaggtctattttcacaagcttcattttgagatcttcaatttcttctttatatggcttagctcctaaagcaactttgtcctaaattttttttagagaaaataaaaataattattagaggcgcttcagtttctccagttgtaaagaatggttagctgtctttgctctaataaggacattttaaaatagcaaacaattccaaatatatgaaaaagcatcaattttaactgaataactagatattgatatgaagtctatttgaagctaatatgcaattagaaacatgattttttatttggagctatcataatatgcaattagaaacatgatttttatttcttaaaataaatattttttttctaattgaaaatacctacaaaatgaaaaaagttggaaataatgaaaagggtggaaaaaggtaaatcagaaaatgaaacaaaaagatgttggagcagtgatgtaaacatcaaactagaactaaatttaagccacaaaacaaagcattactaagtatattttgtactgaaacagttccatccagtgattcaaaacactatattttacagcagcaggtttccagaaaaatggaatggaaaatactgggagttcctacatacccagtgtcccctattcctttttccccatattaacatcatgcattagtatgctgcatttgttataagtgatgaatattgatacattattattaaaatctataatttccatgacagtttatttgtattgtacattctgtgggttttgacaaatgtaaaatggcacatgtccatcattacagtatcatacagaatagtttcactgtcctaaaaaaccccgtgctttgcctattcatccctctcttctccattatccctggcaactgtttatttttttactgtctctgtagttttgtctttctaaaaatgtcatatacttgaaatcatacagtatgtagcctttccagattggcttctttcactaaccaatgtgtattaaaagtccactcattttctttcctttttttttttttttttttttttaagacagagttttgctctgtcacctaggctggggtgcagtggtgcgatctcggctcactgcaaccttcgcctcccgggttcaagcgattctcctgcctcagtcccctgagtagctgggattacaggtgcttaccaccatgcctggctacttttttgtatttttagtaaagacagtgtttgccatgttggggaggctggtcttgaaatcctgatctcaggtgatccgcccgcctcagcctcccaaagtgttgggattacaggcatgagccactgcgcccagccctctcatttcttttaattgctgaatactattccactgtatgaatgtaccagtttatccatttacccactgaaagacagtcttagcaattatgaacacagctgctattaacatacacatgcagccctttgtgtgcacatatattctcagctcatctgagtaaataccaaggaatacaactgctcaatcatacaagtatgcttagttttgtaagaaactgcgaaaccatcttccaaaatggctgtaccattttgcatttccactagcaattaatgagaattcttgttgctccacacaccagcatttggtggtgtcaatgttttggattttggctattctggtaggtttgtaatggtcgattattttaatttgtgattctctgatgacatatgatatgaagcatctgttcatatggttatttgtcatctgggtcttttgccaattttaagattgattggttgtttcctattgttggttttaagagttctttgtatattttgtataacattccttcaccagatttatcttttatatacagtttctgccagtctgtggcttctcttgattctcctgacagtgtcttttgtaaagcagaagtttaagtctcaataaaatccaacttaccagtttttttctttatggattgcacttcttgtattatatcttaaaaaatcgccaaacccaaggtcacttagaacttctcctatgtcatcttcttggagttttctagttttgcattttacatgtatgcctatgatctattttgagttaatttttgtgaaaagtataagttctttgtctttttttgcttgtggatgttcagttgtctggcatcattagttgatcagactatccttttcccattgagaagcctttgtttccatctctcccagaatagaaatgagagttcttaaaatagcttacagggcctttatgatctggtcctctgctacttctcaccttattttctacctctatcctcttgcttattctgctctggatgcacaaactttcttgttgttttcagtttgctatttcctttgcctggaatatttctccctggctacacagttcaccctatcacatccttcagatcatcttactggtgtgacattcctcaactcctgtatatacaatcatctctcttcccacacatgtccactttcacccagaaccatgtacccccttgtctggcttaattttttccatttcacttttcaccacttgagatataatatacctcttaatatatataacatatataaaaatataccttctatgttttacatttttaattaatattctgtctccttcaactagaatgtaagttccttgatggcatggtctttgttttttcattggcctctagaacagtgagtgacacatagctggtgctcagcaaatatttgttgaatgaataaaaactgtgatcaattatttgtaatattaaaaaattacaacattctaaaactttacagttgaatttttttagtttctagctataacaattgttgaaaaaacaaatttaattttttcttttgcctctctgctcatgtctcactgaatagaccagaatttttagaacaatgttaaataatgaataaagcaggcattcttgacgtgttcctaattttaactggagagaaaagacactggagcagaacagcaaatttaaatatgccaatttggatcagactcgagtagaagaaatgtgggaagtggctggaactaaaacaagagggagctgtaagtagtgattaatgagtgtgtgatttgtctaatgacattcaagttgaaaaacatttcagttacggttcttccccccaaaacaggtcagattcagcccatgggatatcaggtgggactcagtaacagaggcagtaagtaggaaaaaaagaatttaaaaatttacttatctaatagtattatatattttgataagcaatttttgaaaaatgaaaaaatatacactaaactataaacaacatgtatatcttaaaaattattcttccaacataataaaaataatattttatatgacaatatgctcctacatttcacttctaagttaagctgcttctgcttgagtactgaacttcagaaacacataggtaacagtaagttgttgtgagagggaagaatagagcacaaggagatttgctgaattcaataggttaaacaaacaaacaaacaaacaacttttatttttatgtttaagttacctgaagtacttgaattgtctcttttgttttttcaaggcatttatttgattcatgaactttggcttgaagttttgctattatgtcattagtcacctcaagttctttctgcatctttataatcttgctttccttatgcatagcactttctttagcttcatgcagtgaattttccagctctcgaattttctattagaaaaagcacacattcataagctctatcatcaagacagaatcacagtatagaaatttgagacagagatgatcatatttagatattgttaatttttcacagattgtattaacaatggatagaagagaggccaaacatcattcaatctacagacatgttatttccctcatttagatgatgatttttggattgaaaatgtcaaaggtttatattataatctgtctgcaaattcttaaaacatgcagttaaaaacagcacagtggttatgcgatttattagttagcatagtgctaagcatattaaataggcactcatattttacatgaacaccacttaaacaaaggacattggttaattgactctctaaagtaatatatatttatctttccctttaattttattaattttttttttttgagatggagtcttgctctgttgcccaggctggaatgcagtggcgcaatctcgactcactgcaacctccacctcctggattcaagcgattgtcctgcctcagcctcccgagtagctgggactacaggtgtgtgccaccacgcctagctaatttttgtacttttagtagagacggggtttcaccacgttggccaggctggtattgaattcctgacctcaggtgatctgcctgccttggcctcccaaagtgctgggattaaaggcatgaaccaccatgcccacccttattaatcttaaatagaaaaacacaaatatgtggaaaaaaattcaaagacatataatgaagagtaagtctccccatctcagacccccagttgaccctgaagcgatgactactaaactttttcaggtgtatccttccagaaattttctatctataaccaaatatacatgaatatatagtttctaaaaatagtatacacacaatatactaaatatagttctgctttattttaaaacttgagaacatattttttccagatctttccattatcaacacatagatctctcctattttttgttttcatggacatatagaatctcatttcataaaggtatcatataattcacatgtacacactcttttttgtttttggcaaaatgtctggatttttgggggcccatttagaattcatttttgtttaatgaatgagataggaatccagccttacttttttccagatggctatcctgttgtatcaaaataatgcactaagcaaaccatcttttctttctttctttttttttttttttttgaggcagtgcctcactctgttgcctaggctggtgtgcagtggcatgatcatggctcactgcagtatcgatctcccaggctcaagtaatcctcccagctaagcctcccacatagctgagaccacaggtggatgtcactgcacctggataatatattaaaaaaacacttttttttttgtagagacagggtctcactatgttgtccaagcttatcttaaactcctaggctcaagtaatcctccaaccttggcctcccaaagtactgggattacagactcacacacctggccaagtaaaccatttttttttcccactgaattgaatgttactgttatcatacacctgtactaaattctcatacttaattgggtatatttctgaaccctctattctgttccactgctctacttgtccatttttgcatcaaacttgtctaatgatagtagcatgtattttattatctgctagactattttctttggtcattgaagattgaccaactttccttttgcttctttaaattactatattggtagatggatttcatctttcctctattttatctgtagcagctgactgaggtctgtaatgccctacaaatcaaaacactgtatactagtgatctagttctcattaagctggtggttgatgttttattataagtatttattttggtaaaaatgataaattgtaatttactattgggttccctacaagtcgttttgtgtgctaacaaaatacaacattttacgcatgttgttagattcccgagtaagggtagttaataaggtaatttggttatcaaataatgtactggttcttagatacaagttaacctgcgtaacaatcttgttatattttttaacctcttatatttttattgtgattataacattaagcaatattaaatacgctgatgataatgagaaaagctgaattgctatttctctccaagctaatatttgttctgcatacggacatagatcacagttcaacagaaagtcacataatttggaaaacttttgtggtaattgtacgttaactggtagtaacttaaactatagtttatgaatgtaataatcaaatgaagctacaatttatgttttataataatatcttacataatgtctagctttataattagtttagttgaacgatagccatagtagaactactagtaaaaatcaagcccatcacttacaaaaataaatgtgttcatgttcagtaataagtaaatactataattttgctctaaactctgtgatgaagctgcaaactgaagaacattttataagaaattatatacctctgtggttaactgtgtagctcttgatgtaacatgaggattcttattgtcttgtgtggtaggattaacctgggcaccagatgccaaggaagtcttcaatgtttggtagtttttaaatagtttttcatttttctctttcagtgatttcaggtcctgttcccactctttggatatggtagcacttctttcctcaaactctgttgattcattcattatggcctattgaacagtaaaataccattatagctctaaaacgatttatagtagtccccacttacctgcaattttattttccatggtttcagttaccctcagtcaaaagtggtctgaaaatattaaatgggaaattccagaaataaacaattcacaggttttgaattgcacatcattctgagtagcacagtgaaattttgagtcatcctgctcagtcctgcctgggatgtaaatcatcctcttgtccagcatacactacttgttcacttgatagccaccctgattatccgattgctgctgtattgcagtacttgtgtccaagtaacccttattttaattaataatggccccaaagcacaagagtagtaatgctggcaatttagatatgccaccgtgaagctgtcaagtgcttcttgtaagtgagaaggtaaaagttctcaacttaataagaaaaaaaatcatatattgaggttgctaagatctatggttagaatgaatcttttatccgtggaattgtgaagaagggaagagaaatttgtgctgtttttgctgtagcacttcagcctacaatagtgtgtgataagtgcttagttaagctagaaaaggcattaaatttgtggtagaagacaagaacagaaatgtgttccagttgatgacaatgtgttgtaccagcaagcattgagcatctaggaagacttcagcaagggatcccctgaaaaaagtgacaccaagccctttactgcaagtaagatttattcatggattcaggaatacagaaggtcaatagtagtctaagactatatcaaaatgtctaggtcattcatattccttcatcttatcaggtaggcactgtatcatctcacatcataagaaaggagagtgcagtaaaataagatattttgagagagtccacattcatataacttttactatagtatattgttaaaattgttctattttattagctgttgttactaatctcttactgtgtctaatttataaattaaactttatcataggtatggatgtatagaaaaaacagaatacatagggtttggtaccatccatggcatcccctcgggggtggggggtcttgatatacatattttaaaaaaacttcaaaaaaccctagaattctaggacagtgtatatgctgaagttcattatttagaacattctaaaacagtactttaaaagaatgtgaacattctttgtagtttgcatcagtttctgaaatttcagatgttggatgtggatgatgacaataaaatgaataatgactagagaggattcatattgatctgcaagatgataatctcactttattagatttgtactaacatatgaagagaacctgaagaattatccaggttaaaatcattatatatgctatggctgataatgaaacattaactgatatctaatagcagagcacagctagaaacttaacaattatctattgtcctgcttcattacaaacctcaatgttaatagggaaaataactcactgattgttggtaattaatctgaatatcttgtatttctgtacagggaataacaatactcttttatattgaaggctaactaactctgaaattattgatatcttttttacttcctaattcctgcagattgtactttctgctctcatcatgaatgccccattagtctcatccctaacttctttgtggctttgtggtcattctaccaggctttgtggtcattctaccagatcttaaattcgtcgtgttcctgacaccctggacactccttggctctggactatgcacctcacaccataccaagttattaatgcctactcttatgtgctggaagaagccacatatacatgctgatccacatagtagaaatccctgctttctaatcacaactgggtctccagtattacaagaaaaacaacaaattacaaatagacatgaccttatccaaacattggttttgtgcctttctctactgattgtggacttctttgttttttcttgaaatagccaactgctatttggctagctctgactaatcaataaacaggatgaactttccaagcgaaaactttttaaaaaaggcattgttccttatttcaacaagattccaatatgatttgcagatgaaattaaattgtcagaaaagaactatccaaacatatgaactataaaatgtattttggaaactataatattaatctagctaccattgctccaatttaatataaataagcaatcttttgaatattacatgttttaccaatgaaacagagaagggattacttctgaaagcagaatgaatactgcaattacttttgtacccaccaaataccaatcactgaaatgtaaaacaagttaacaaactggtcttaagcaatgttggtccttatgactcagtacatttgggctgatcaccttgggaacaatgattaaaaaaaaaatcaaaattttggaatttctagtttagcattttaggtgtttagaagttgccagtccaggacgggtgcagtggctcacacctgtaatcccagcactctggcagtccgaggcgggcagatcatgaggtcaagagattgagatcatcctggccaacaggtgaaaccccgtctctactaaaaaaaatacaaaaattagctgggagtggtggcacgtgcctgtagtcccagttactcgggaggctgaggcaagagaatcgcttgaacccaggaggcggaggttgcagtgagccgagattgagccactgcacactccagcctgggtgacagagtgagactccatctcaaaaaaaaaaaaaaaaaaaaaggagttacctaacaaggaaaaagcaaaacaaatgaaaaaaatccacaactctgcttagatccatcagagaagtgaggtcgcagggcaaagggatgctccccaaactggagaggcagagaggcagatacagagaattacaacttagagcagaaaccctttgcaggaaccagttatggggtaggaaaacctgaactgcaatgatgaattattggagctcagtgtggcaactctgagagttaaaaacttcggagacctagtcatacagtggccgccacacttttgtattttaccttcaggagctctaccaagtcatcacagttaatattggagaaatccctttgtgagtctggcaggagaggagaaaaggaaccattttaaaacaaaacacagcattttttttttcttaaggcctgacctcagcagaaactatttcaccagagcctaacatgctggggttttgtcagggcctaatatatctggaggagggggaaatactaagtttcagctggctcttgccttccatgtgaaggcagggaaatatactccgcctgccacccaccacacacaccttgccactacattactaaaggcctatttgctacagttacttttacccagtaaatcatgcctgcttttcagcaaaaaaaattacaagacatactagagggcaaaaaacacagtttgaagagactgaataagcatcagaaccacaggcagaaatgccaggaacatgagagttatcagaccagaaatttaaaaaaaatggattaatatgctaggggccttagtggaaaaagcagacgacttgcaagaacaaataaacaatgtaagaagaaacatagaaattttgagcaaaaaaataaagaaatgctagagatcaaaaatgctcttaagagaaacgaagaatgcccttgaagagttcattagcagactggctgaagaaagaaactcaacttggaaatatgacaatggaaacttccaaaactgaaaagcaaagagtaaaaagactgaaaaaatccctaaacaacatcctagaagtgtgcagtaattataaaaggtgtaatgtatacataatgggaataccagaaggtgaacagaaaaagaaagagcaggaatatttgaagtaataacgactaagaatttccacagattaacaacgtacaccaaaccaggaatccagaaaactcataatgctaaacgggacaaatataaaaaaaaaaaaaaaccaaaaaaacccccgaaaaaaaacccccaaaaacaaaaaacaacatctaagcatatcatattcaaacttcagaaaaatcaaaggtaaaaaaaaatctttgaagaagctagaagggaaaaaacaccatacctataggggagtgaagataagaattacatctgacttctctgaagctattcaagctagaagacagtggagtgaaaaaacatactaacctataattctattccatgtaaaattattcttcaaaagtaaagtagaaataaagactttctgagacaaacaaaaatggagggaatttgctgtcagtagactggtcttgcaagaaatattaaaaagaagttcttcagaggaaaggaaaatgatatagccagaaactcagatctacataaagaaaggaagagcacaagagaaggaataagtgaaggtaaaacaaaaacttattttcttattcttaactgagctaacttatgtatgcttatgaataagtgaaatgaataacggcaatgatacaatggatgggagggagaaattataaatattttgttattataaggtacttatattatctgtgaagtggaaagtgttatttgaaattgggctcagattagttgtaaatggatatattgcaaactctagagcaaccactaaaacaagatagaagtgtagttgtatgctaagcagagaaaatggaatcataaaataatttaaatcataaaaggcagaaaaaatgtggaagacaaaaataggtacaaagaataagggcaaaaaatagaaaacagaaacaatatggtagatattaatccaattatatcaataatcaccttaaacgtcaatggtctaaatacaccaattaaaagaccgactgtcaaagcagatcaaaaaataagagctgactgtatgttgtctacaagaaacccatcttcaatataaggacacatagattagaaagtaaagggatggagaaagatacaccatgttaaaactagtcaaaagagatgaagtagtgatattaatttcacacatagcagagttcagagcaaggaaaactatcagggataaagggacattacgtagtgataaagacatcaataccccaagaagacataacaatttttattttgcatgcacctaacaaaaacgcattaaaatacttgaggcaaaaactgataaaactacaaggagaaatagatcaatttattatagttggagacttcaacgcctctctatcagaagtgaacagatccaccaggcagaaaaatcaggaaggacatggttgaatttaacagtaccatctatcaactggatgcaattgacatctattgactacttcatccaacaacagcatattatatattcttctcaaactcacattgaatatttgtgaagacagaccacattctggaccaatcataccattctgctctcagaccacaatggaattaaactagaaatcaaaaacagctgaaaaatccctggataattagagatttaaaaaatacatttctaaataacatacgggtcacaggagaaataaagagaaattaaaatgtattttgaactcaatgaaaatgaaaatatgacttatcagtatctgtgggatgcagtaaaagcagtgtttagaggaaaatttatagcattgaataccagtattagaaaagaggaaagacctaaaaaccaataaatgaggctttaaccttaggaaactaaaagtgaagagcaaattaaatccaaagtaagcagaagaaataataaaagtagaaatcaatgaaattgaaacaaaatcaatagagaaaataaatatcctaaaaactggttctttgaaaagatcaataaagttaataaacctctagctaggcaaactaagaaaaagaaaaagaatacaaattactaatatcagaaatggatgacaggacatcactatagagcccatggacattaaaaaatattaggaacaactcaattattacaacccacaattatgaacaacccacaaatttgataatttaaatgaaatggaccaattctttgaaagacacaatctaccaatacacaagaaaggcagttcgattaggcctatatctatcaaagaaatggagtcagtaattaaaaactttccaaaacagaaagcaccaggtccagatgagttcaatggtgaactctaccaaatatttaagaaatttaaggaaaaaactatacccattctctacaacctacaatctcttctagaagatagaaacggaaactcattctatgatgtcagcattattctaatactaaaaccagatgatgacattatacaagaaaactacagaccagtatctcccataaaaagagatgtaaaagctgggtgcggtggttcacgcctgtaatcccagtactttgggaggccgaggtgggtggatcacgaggtcaggagttcgagaccagcctgaccaacatggtgaaacccgtctctactaaaaatacaaaaattagccaggcgtggtggtgcgtgtgtgtaatcccagctgaggcaggagaagtgcttgaacctgggaggcagaggttgccgtgtgccgagattgtgccattacactccagcctgggagacagagtgagactccatctcaaaaaataaaataaaataaaataaaaaacaaagatgtaaaaaaagatgtgaaaatctcaacaaaatattaggaagtcaaatccaatcacgtgtaaaaatgattatacatgaccaaatgggatttatcccaggtatgcaaggctggtttaacattcaaaaatcaattaatgttccatcacataggctaaagaagaaaaatcacatgatcatatcaatggatgcagaaaaaatttgtcaaaatccaatacccattcataatttaaaactctcagcaatagagatgaacctctacaacttgataaagaatgtctacaaaaaactacagctaacatcatagttaatcatgaggaactagaagtcttcctgctgtgatcagaaacaaggcaaggatgtcccctctcacctctagttttcaacactgtactggaagtccaaattaacgccataagacaagtaaagaaaatacaaggtacacaaatttgtaaagaagaaataaaacaaaactctctttgtttacacatgacatgatcatctacatagaaaatctgaaggcatcaacaaaaatactcctggaactaaataagcaactatcgcaaagttgcaggataaaaagtcaatatacgaaagttaatagctttcctgtataccagcaatttacaagtgtaatttgaaattaaaaatacattaccatttatactagcaccccccaaaataaaatacataggcaaatctaacaaatatgtacaagatctatatgagaaaaactaccaaactcttataaaaaaataaaagaatcaaataaatggagaaatattccatattcatggataaaaagacacgatattgtcaagatgtcagttctttccatctataaattagaagcaatcccaacaaaaccataggaagttattctgtgaatagggacaaactaattccaaagtttatatggagaggcaaaggacccagaataaccaacacaatgctgaagaacgacgtcagagaactgatgttacttgacttccagatttactataaaaatcagcagtttccagatttgctataaatgaaagaacaaatagatcaatggaatagaatagagagctcagaaatagatcccacatagtcaaatgatcattgacaaaggagcaaagacaatataattgtgctgaatctggacttctacaagcgaaaaaaaaaaaaaaaagaccttaagaacttcagaaaaattaactcaagatggatcattggtttaaatgtaaaacaaaaactatggaagacagcataggagaaaatctagatgatcttgggtttggtgatattttagatacaaactcaaaggcataatctatgaaagaaataattgataagctagacttttttttaacattaaaaatctgcactctgaaacacaatgccaagggagtgagaagacaagccacagattggtagaatatatttccaagacacatctgataaaagaccaatattcaaagtatacaaacaattcttaaaccttaacaatgagaaaacaaataacctgactaaaataagggcaacagacctgaacagacacttcaccagaaaagatacacagatgacaaataactataaaaaatgttcaacatcatatgttattagagaattgcaaactgaatgagataccactagaatggtcaaatactacacttactacacttactagaatggtcaaaatcccaaactgacaacaccaaatgctgatgagaatgtggagcaacaggaattttattcattgctggtgggagtgcaaaatggtaccgcccctttggaagactgtctggcagtttattacaaaactaaacaaacttttactgtatgatccagaaattgcattccttgatatttactcaagagagttgaaaatgtatgtccacacaaaaagatacatatgtatgtttatagcagctgaattcataattgccaaaacatacaagccaccaaaatatcctttggtaggtaagtagataaacaggtacatacacacaatggaatattattcagcattaaaaagaaataagctatgaaaccatgaaaagacatggacaaaacgtaaataaatattactaagtgaaagttgtcaacctgaaaaggctatatactgtatgattccaacatatgacattctggaaaaggggctactatggagacagtaaaaagattaacagttgccagggtttaggaaggtgaagtgatgaatacaggtggaacccagggaatttttatggcaggatagtaaaattactctgtatgatactgtaatgatggatacatgtcattttacaattgtaactcatagaatgtactatgccaagtgtgaaccctaatgtaagctacggactctcttgggtgataatgatgtatcaatgtaggttcatcgattgtgccaaatgtgccaccctgatgtgggctgttgataggggagattgtgtttgtggagatggggtataagagaactctctgtactttctgctcaattttgctgtgaacctaaaactgctcttaaaaaaaaaagtttattaaagcacatgaggcccatctaaagtagctggccaggcttgtctatgactttaccacagttgctgcccatagcttgaaacagactcatgtcttacgatctctaaggctactcgtggaaaaggctcagttcttacagaagcagtgagaaggagaagaaaaagaggacaatagtaagaggattcaagatttcacaagtggaaactaaatattatacaacaagatttcgttaccttgatcagtatgaattgataaggaagaataatacattagaggaagaacacgttttatcaaatcaatttttttaaagcatatacaaataaagaaaatatacataagttgcccttttaagaatgaggtaggacaattaaagcaaacagcaacaaaaaagtagtacagcaaaaagtaatacttacaattattctgttattaaagaagttattcacttgacaaatcctatcattttctttctggatgccatttttaagcttttctatatcaaaacgagtatttaaccactcttccaaaaactgtgtcatttctttcctattacttagtacttgttgaaattcagtctttatgctagggaactcactttctgagaaatctttgagaatttcctgtgtgaaaaataagcgtcaaattgtttaaacattaggaaagttttgatccaaatattttatttatatatatatatatatatatataaaataaaaagagggcaatacctagtggactcttgcttttcttccttttaatatcatttcttaatattttaaagtaaactaagaaatataattgtaagttaaaactttattctagttatttgcataatataattttggcagtatacatgatgtaacagattgtacctattagaattaaagcttgtcaaaatgacaaatttgtgactaattgctacaatacctgaagtgcatcttaatttttattttttgagatggtctcactatgttgcccaggctgatcttgaacccctggagtcaagtgatcctcctgcctgagcctcttaagtagctggaattacaggcatgccactggggctggcttcatgaagtgcttctaaatgtagcttttcagtacatatagcagaccttacatacatgttgggaattggatgccagcctcacatagatgaatgcaagtaacacattccatgtggagttgttgtaataaagcggtttctgactcccagcatagacataagttttcctgtatctattgaggtctgaagagaggctagtccattatttgccagtctttatgtctggccaggtatcactctgcaacgtatttttaatttctggtaaatgaaaatagctctaagcacatgaaaaagtacctttctacttgataaaaaggcttaaaatctaactaaatccatttaaaataaattatacctcaatatgtagatccatattctggttcaatttgagatcccttaattctctggatggtacatcacaatcttgttgaaggtgctgtattttaattagcaattccttttgcttttccacttcatcaataaaatccatttcaaatttattgatggattcatgttgttcttcttttatttttgtaacatagcttaacacatacttgcagaaaaaaattaaacaaattggtaaatgaaaattttgtcacatgtagagaaagttttcatccttgagactatgaggtaggatgacatctcttatttacctatatcctctcacaagtgaggaaaagggaaagagcttctctctatccccagtttttcctcttagtatcttaggagaataactaactcccagacctataattccttatttctgacttcttaccagatatacttcttggatgtcttacaagtacttcaaattcaacatgtttaaaacgtaacatgatccctttctctacaagtcctcctttttctattgcccagtttttggctaattacattaccaatcacccaggtttcccagttaaactcatgagactcattttcaacatcctctcctgccaacgctgattgggtaaccaaaaagatgaagttacatgcctcaagacttccttgtcggccggacatggtggctcatgcctgtaatcccagcactttgggaggctgacgtgggcagatcacaaggtcaggagttcgagaccatcctggctaacacagtgaaaccctgtctctactaaaaatacaaaaaattagctgggcgtggtggcaggcgcctgtagtcccagctacttggaggctgtggcaggagaatggcgtgaacccgggaggcggagcttgcagtgagccgagatcatcacaccactgcactccagcctgggcaacagagcaagactccgtctcaaaaaaaaaaaaaaaaaaaaaaaagacttccttgtcaagcatatttagatatttggcttcaagagacaataatttcaatgccaaatgtctcatggacttcatgaataattctagatgtctgattaccaggatttgtggaagaattaccagggcccgaagggcaatctacccaggtagggcagataccagcttacttattcctcaacttccaccattccttaacctcttataatctggtctcttccttaactacccagttgaaactgttctctgacaatgatcactaatgagttctattatcaccacattgagagaatatcttcagtccatattctgactctctgaagtatttgccactcataacttcatctttgacatactcttctccactgatttgggtagcagtacttttgctagtttctctcctgtatctttgacttttccaaccttgaacccatgtgttgctcccttttctgctactgcctcttagacatttatcttttccagagttctgtttttatcccaaggctcttagtcttcattatgctttctggatgatcttacaaatgtattatctatcacctatatgctgatcagtctcaaatgttagttcttatttttctcctgccaaacctcaaactcaaatctaaatgtctacttggtttctcttcttggatgttccatcataggtatttcagcccccaaacatctcaaattaaacaatctcctgcctcatctaccttgtttctctttcttttttatttttgaatctcagttaatggtaccactatcgacaaacctgactaagcccaaatccaagaactccatctaaacttctctcccttatgtccactatcaattatttcgacctactattttaagctgctaaatatttctttaatctcgtttgtcctctccagccctgtgaaaccctccctagtagtacagtcacatataatatctcatctggaccactgtaactgcctcttattgctttctgctactaggcttatctccctcaaactcatttcttctgtattctttagtttagtacctaagtggtaatcagatcctgttaccaccaccacttaaaacaatagtctaatgattccccatctacaaaaagaactccaagctttgttattgagtctggcttctactacagtttcatcttctgtaattttatttagtacgtcatataacttgcatacacttctatcattgcacttaatacttgtttatatgtctgtctcaccccagactatgagatctttgagatgttaactcacatctgcctcctgaacatcctgacataatgtctaggcccacaggcagagttcaggtgttgctgatatcctacatattactatgctcagacccacataatctttaatttggtagtaagaatactaaatagcaaatatgccggcacctgaagcaggacttaaatacattgatgtttataactgaaatatttaaaaggatattactaaaaaagatggtaccttcagtttcttcatgattctgtggaattccatggagcatctctggtttgcagtaaaaagtttttcaatgtgtttggtttgtaaatagggaagtgagaggtttgctttaactctcattgaaagctctttttggaattcaatttccttctccaagtcaagagacaatctattcaagcactcataatgatcatccatctctgagtatctcttcaaaagctcctaaaggaaatgagaattcactcaatttataacaattcattctaatatcacaataagtagttacaactctagaattgtaacaaaacttatgctttaacattttctgtaggagagaaataaagacctttgtgtctaaaaacaaaaggaaactcttgttgtcattttggataacagaaataatagataattattatggcaatttaaaaaatttaagcaaatataacaaagaaagccaggaccaaccattcttaacattttgatgcattttcttttagttttttgaatatccatgatatgaatcaacattgacaaagtctgatgagaaatttgagtaaattcaattaagtatgtattgtagttcatggttgagtgctggtttatgtttatagtaggcagtctgagttagcagataaaacaagtgattaagaatcaaaccacctatttgtcagcttggtacagatacttcacacaatcctactatctgcctacaatctgttttctaaccctttatcagaggtagagttcaggttccagctctgccacttcttgactggggaagtcactgagccattttcacaacaacaggaagactacaataattaccacaaagttttctggggtcaagtaaaatatatgatctatacctatatacctatgtaatctataaaacagacacagtcatttaacttgaaggagacaaaattatgtttataaacatgtttctatacccaagttttgaactaagtcagatacaagtctgacttagtttaaaattctgattctaacaatttactagctgtgtaaccttgggcaactgctaaacttcctttctgaggaaggcagtttccttgtttatgaatggagcaataaagcctatatcatgaggtaaagcacccagtatggtacctggcatacagtagacatgcaataaatctggacccatagactcaagtgacttgaggctatgcaggtgacacactggtcagagcacaggtagagaaacatgtaaaattcaagttactgtaatcatgtagtaggtaacatgtttagttcaggctgctaaacaataaaacaagggcgttctcacaagaatgagccctttatttttaataatttaagaaaagctagatgttaatcaatctggaatgttggagaggggattcctgtttttggttttaggatgaatcaactacggtatacagcagcatattgaacactgacttatgtcaggaatgtgctaaatgatgtagtcataaacaaaacaaaaatgtccttagagatcttgcattccaacaggtgtgactgtaaatcctgttggctttcccttcaatgtatattcagaatctcaacacttctcactacctctattgctccctctctgggccaggccaggatgatctctgcctgggtgattgaaatcagtctttataatggtcttcctgcttccactctattttcaatataacaattaagagtcatccctttaaaatgttaagtcagattatgtttctcttgcggtaaaaattccccaatggatctccacctcacttaataaaactcagtcttttttcatgtcccacagcttgcctcttccctgctaactctctgatctcattcattagcagcttgccctcttttcgatattccttgaaccaccacagagtcttctgcctcaggaactttgtactcgctgttccctttgcctataatggtcttttcagacatctgtatggcctgaccctttacctcgttcaggtatttgctcaagtatcacttttctggtgaggacttaaattcacaagctcccattgttgtttgtgtatgtgtgtatatatgcattatacccacacacctgtactagattacaatgtttagaaaaatactgagcactatctatttattccagaggttccttcaatcccacttcaggtttcggtaagcctttggaagacaaccaataatcatttgtagttttaacagggggtacttacttttattctagagcacttttctctcaggctttccgtaaggtgctgttgtccatcacttagtaaccttttttcaggttttacttggtggttctgtcggtcctgctttggtaaaaagaaaataaacagggcttttgtcatgactatattcacatataatgtctaatcgcacacttctaaattacatgacatttcaataatggaattaaatattatacttgtcactcaaaagcaatgttaaaatgatcagaaaatgaataatagtatcagtaagttttatagggagtgaccttaactcattggtaaaaaagtagaaaaatcatctaatttttggagacaggatttgtttttcatagctacaaattaggttttagggccaggcatggtagctcacgcctgtaatcctagcactttaggagatcgaggcaggaggatcacttgagctcaggagctcaaaaccagcctcagcaacatagtgagaccctgtctctataaaaataaataaataaataaataaacaaccaggaaaacaaataaattagattttaatttctgattcctactcttccaaatctctgcattattcacttgtagttttaacagtggcacttgcttttatcctaatgcactttattggcgccaaccaaatatactggcaaaaccacctgtactgtctatggtgtttcaaaccctagtcatatattcttcccagcaccttggaaaagttcatatcctgtgtacattttgcatttctgattaaaaagtataaagtgaaacaaaaacattttctcccacttatcttgttcactacagtacctagaagaatatttgatgaatgaattaaatctctctataaatttagttcaggcccacataaagaaatatgagaataaaaaagatttttacagattttaataaacttgtctgaactctgttactttcaaaaagaggatttaattagatattttaagatatatgattctgaatatctataaatagtcataccagaggaacttaatttttatatttatcttcccttttttccttttaacttcaccaataagagcccaactctagaactccagcatgtataggtagagaaatgggaatatttgctctcttacaaatctaatccttcaaatatttctccatttagaataatgctatctcttgattaaaaaaaactttaaaatgttatattaagggaaatagactgctttaacacagtttataaaaataaagaattaaatgttattttctgaaaatatttttgcttcttttaaaactgttttctattgtgtaaaaattagagtaaccatttcccactgtcctttactgttcataggaatttccagagaaagaaataaaaacattgtaattcttttcaaaaaagcttaattcttattaatagttactacacaaaggaagactctgaactcactctagctatcatttcccttaaggttgctatgaattggtccctttccattttgagagattcttttatcctccttagctcatctctttctttagctacaattcttatttcttcaaggctttcatgaagtttcttagtcaactggaagttatccattctcacactttgcatagataagttttgggcctcaaattgcttcttcaactgttccatttcattaatttttttatgactcatattgacatcttctttcactctaagcagttgaagttcttttttctgaagttcttggatcttgagataattgtaaaacaagttagaatgtaagcagtttcttcaaggaaggcaaatagtgtctacttgtgttctatatgcacatatctatctacatatctgtatctatatctttttaattccacaaataattttgggcacagttacttccaaaagaagaacaaaacaacacatacctttttctgtaattcatcttttgatttatctaaatccttttgaatgtctgaaatttgaattgtcttttctgaaattttttctctaagtttatcaacagtttctttgtgttcttttgatagcatacgagcagtttttagttcctgttgtatttccagatcctttatggttagaagaaatcaagaaatgtaatgatataaaggcacgttacctttacttaatgattgagtttaaacaaaatcttaaaaattatacactcacagttaaaaacaaccattatacaacctcctaaattagaagagtaaagtaaaattttctgctggtagcctcacccatagccttctcctttcataccacttggacatctttctaaatcaatatcacaaaaagaataccccattcttatgcttagttttccattatacagatagtgccttattattggtggacacttagattatttctaggttttagtcaccagacacaacgctgcagtgaacactgtatttttgcccaaatatgtgaatataatggtagggtaaagagagaacacaactcactctagctttggtttcttgcaggctttccttgagttggtctctctccagtttgagtgtctcctctactcttcttagattatctctttctttcattacagatttcatttcttcaaggttttcatgaagtttctgagccaaatttaaattctctatttctaatttactcagagttaagctttggtcttttatttgtttctttagttgctccatttcagacacttttttctgtgtctcattgacatctttttttaacgtaataagttgatgttcatttgccttaagttcttgaatcttaagataatcataaaataatatgttaggtggctttttagggacagataaataatagtttctaaattgattaagacaactgtctacccatgttactctcactgatatcctgcacaattccacacagaattttactttcttttgaggtataatatatataaagcatgctcatcttcaatgtataacttaattattcttgacacaggtgtaaatctatgaaactacaacccagattaaaacagagaatatttctagcacttcataaagtttctgtgtgctccttcctagagacagccactattctgacctttatcatcctggttcagttttgcctgcttttgaacctatatatcacaatgtatgtatccattttcctgctgatagacatttgagttttcagttttttgttattttgaataaggctgctataaacattcttgtgtctttttatagaagtatgtacgtactcttttctcttatgtacatacccaagaagtggaaatgttgggcctcaggcaggctacatccagcattagtaaatactgccaaggtgttttccagtgtggttgaaccattttatatccccaacaattttaggcacaaacaaattagatatccaatcaaacaatccccccataaaaataccttttcttgtaatttagcatttgaattttctaaatctttttgcatatttgatagtttatctgtcttctcagaaacaattcctctgagtttgtcaatagtttcctgctgctctttcagatgcatgtgagcaattcttagttcctcttgtattttcagatcctttaccattagagaaattttaaaaacagtgacatatcttaatattagtttttaaaaaataaagtgatatattttcttagtaaaaataataacactgttactctatatctttgctgttgtttttaaggtacaggctttctcttccctgtcctcctctcttcacactctacttctgctttccagaggcaaacacattacacatatattactttttttaagtgttgcatagtatttcgatatattgttcatatttactgtttccttctgaggaacatttagattgtttcagatttttaattaaaatcactacaataaataacctgtggcatatgtatacgttgtgtttgtatatacacacacactcctttaacagtatatatgtaggctaaagtccgtaaggaaaatgataattgcagacttgaacttttcaagaacagtaccaaattatctgcttaaaaggctgtatcatttcattcttgccaacagtagtacttggttcaaagaagggttcattgctgtaagaacacaatacattgaattgccagggagaggaatgagcttactttagcttctatttctctaaggccttccctaagttggtcttgctccattttaaagatttcctctactcctcttaggccatcattttccttagtaacaaatcttacatcctgaaggttttcatgaagcttctgagtcaatcttaatttctgcgtttctacactttccagagttacattccaggcctctaactgcttctttaactgacctgtttgatacatagtttccctaagatcattttttactttaagaagttgaggctgggcctggcggctcatgcctgtaatcccagcactttgggaggccgaggcgggtggatcatgaggtcaggagatcgagaccaccctggtcaacacggtgaaacctcctctctactaaaaatacaaaaattagctgggtgtgatgacatgcatctgtaatcctagttacttgggagacttgaggcaggagaatcgcttgaacccgggaggcagacattgcagtgagccgagatcatgccgttgcactccaggcgacagagcgagactctgtctcaaaaaaaaaaaaaaaaaaaaaaaagaagttgatgttctttctcctgaagttcttggatcttgagataatcatacaataagttaggattatcagtagatataaaaagatcaatgatagtttctaaattgagtaggcaagtaagtcttcacttgccttcaattttagggtaattcatatcttgtttcattacacaaaaagtttgattcaaactctcagtaactgagataacttaaaaataaaatacctgtgcttttaaggcatcatttgagtgttctaagtccttttgcatatttgatatttcatttgttttctctgaaacaatccctcttagtttatcaatagtttcttggtgctccttcagatgcatgtgaacaatttttagctcctcttgtttttctaggtcctttatcaatagaaaaataaaaataatacattgagagtagtaccatccacatgctatagaaaggtatagggcaggaggtaaaaatcttccaccctcttctgaggcctcctagttctcaccctctaagctacttttagatgtcaatacattctagatacactattcctgaacttaccctgttccctaacaggacacttcacccttcaaatcagcactatagctctaccacattttttatttgtggcatagaattccatgacgtgaatgtgctgcacttatttaaccagtcccttaccaatggatggttagaattttccctgtttttgtttgtgttatttcattattgcaacttgttgcaaagaatatcctacaaatatctttatacagttgtgcaaatgtgtggaggatagttacaactggacttgtggatcaacgaataaacctttggaaaaatttggaaggtatttccaaatataccctcaccaactttcctcaatattggaccaattttatcttattttattattttttattttattttactttttgagatggagtcttgctctgtcgcccaggctggagtgcagtggtgcgatcttggctcactgcaacctccgcctcctgggttcacgccattctcctgtctcagcctcccaagtagctgggactacaggcgcccaccaccacgcctgcctaattttttatgtttttagtagagatggcgtttcaccatgttagccaggatggtcttgatctcctgacctcgtgatctgcccgccctggcctcccaaagtgctgggattaccggctcgagccaccgcgcccggcctggaccaattttatactcccaccaaccctatggcagatttttctcttaggactcaatgtcatagttactagaggtgtagagagatggtaactcactctagttatagtttctctaaggttttccttgagctggtctctctctactttgagagtctcctccacactcctaaggtcatctctttcttttgttacagatctcatttcttcaaggttttcatgtagtatctgagtcaaccttatattctccgtttctatgttttccaggtttaacttctgggtctcaaattgctccttcaagtgttctatttcacacattttctcctgagtctcattgacagctgtcatcttaagaaactgatattctttttcttgagattctttcatctgagaaaattataaagtaagttacaacataggcagaatttttttaggaaaaggaagaactgttcctaaaataaggcaatcatttttacattgtaatctaatgtatgtagtactttctttcataagggatatgagtaacaataattagatgtcattttccaatttaacaagtcccactttttcctgtaattcaccatcagaatttcctaaatcccaatgaatatttgctacttgagctgtcttctctgaaatattctgtctactaacagtttactggtactcagttgaatataagcagtttttgattcctcttttatttccggtccctttatgattagaggaaaattaataaaacttaacatgaacaccgtcattatcaccttaacactatttctgtatccaaaaaaaaaaaaaataagatgggaacttactttagctacaatttctttagtgttttctttcagttggtctctctctatctgaagggcctcctgtactcttttcatttcctctttttccttaatcataatttgtatttcttcttgactttcttgaagtctgttggtcaactcgagcatcttactttctatactttgtagtgctgaatccttggctttgcgatgctccttgaattgtttcagttcattcactttttcctgaacctcactaatttgttttatattaaattgttcctctttctcataaatctcttggatcttaaacataattataaaataagttaatagtcataaaaatatgtaaacacacacacacacatacacaacttaagaggaaaaggttgcttcccaaaacaattaagcatgccaaatagtagtcttcataattcagttagctactccaaacccacccatttcctcccactgtttcttcatccccaatttaccttgttctgtaatttatcattgattgcttctaactgcttttgaatggttgatatttcagtttccttctctgaaagattcactcttaactcattaatagtttcctcttgttctttcaggcaacaatgagcaactttaagttcctcttcagtttccaggtgctttattattagaggaaattccaataaatttatagaaacattataactattttgttgtaattaactcccctttccaaatatttagggtttataataatatttggttacaaaatattttttaaaaacatggtgaaagatgaaacctactttagctacaatttcttttatgttttctttgagctggtcactttcagattgaagaacttcttgcagcctctgtaggtcatctttctccttagctacagatttcatttcatcatgactttcttgaagtcttttggacaatccgagcatttctatttctatccttagtagtgctgaatctttgggtttgaattgctccatctcactcacgattttggtagtttcattgtctttttctttcatatttaaggactgttcttgtttgctttgagactcctggatcttaagagaatcataaaacagtacagttgatatccagagatattgtgttttaggggaaaataaatcaggatgctttctaaaacaattaaggcaggattcagtgcctcatttacagagcaatctctccattctcccactcttccattattcaggcatttaatgctttttaaaaattgaggtctcactgtgttgtcagcatcttattcgaggctggagacaaaatgatgagacttacaggatctctctctttttgagacttatacttcaaggacaaagatagatatgatgttgaatcttaccaaatagagatgctggcttctcctacggcccaagtgtcaaatataatctattgtgaatgataggaagggattcctagaggagaaagctttaactgagatctgaaggataagagcattagttaggcaaaaaggagtatggaggtactgcaggtagagagacctgagaatctgaaagccatgagctgcggaagagagttgctggagaacaaagaataggaagaagaatgaattgaaataagaccggcaagatctgcacctagggcctcataggccacataaaggatcctggtctttatttaaaaagtagcaataagatattaaaagaatgtaagaaaggataacttaggcttagtatagaaactggattagagaagtctaagaatgagtgtgggaagaccagttaggagactactgcagatagccagggaaagaaatgatgttgacttggattagggtggtggcagtgtggagagaaaagcaggatgacttttaaaatacacactcaaatcaataagatttggtgactggattacagaataagcagagaaggaggcatattagtagggatagctcccagatttctgactaaaacaatgagaaagcacagtagtgctttatgaaacattaaaggaacaggtttaaaaaagaaaataaaacaatctcatatttggtttcaccctttcttgtaatttagaattattttttctaaattattttttgaatatttaagaaaacagttcttttctctgaaacatcttctctctgtttcaataccttcttggtattcaagagcaatttttaattgttctgtttctagtcatttcatgattaagagacattaaaaaaactggtaacataattataatacaaacattataactataacacaaacacaagccttgattcttataagacacttgttaaaatgggaggaaaatacgaaacttactttagccaaagtttctctaatatgttctttcagctggtcatgtttaacttcaagggcttcttttatcgttttaaggttgtctctttccttggttagagattttatctcttcctgactttcttgaaatttttcattcaacctgagcctttccatttctattcttgccagtgttgttgagtccttggttgtggactgttctgttaataactccagttcattcattgtttcctgagtctcactgacttctttcacattaggcagtaactcttgttcctcatgaagcactgggatcttaggacattcataaaataccaaggttactatcaggagattatgatcataatttttttttttttgagacggcatctcactctgttgcccaggtgggagtgcagtggcgcaatctcagttcactgcaacttctgcctcctgggttcaagagattctcctgtctcagtctcctgagtagctgggattacaggtgtgtgctaccatgcctggctaatttttgtatttttagtagagacggggtttcaccatgttggccaggctggtctcaaactcctgacctcaggtgatctgcctgccttggcctcccaaagtgctgggattacaggtgtgagccaccgcatcccactggccattatcataaatttttaaagggaaaagatcaggatacttttcacagcaaggaaagtcatcttgaaccctcaggcctaccttggatcacaaactgctcattattcattttccctcaattcctgctaaagctattcatgacttttctgggtcacattctgtcatacttttctttctttgtagcttagacccaaagtgaaccaattatactttgctagcagtctgtttcatacttatttctccactagtttccaagctataagagaaaaaccatagctgagcaaactatatcccaataaatgtatgatctccattttcagatgggctccaatgctatgtctcaatttttctatgtgtatagattgatttctctttccatgataaattagtggtaccatgtaattttgcgtatttctgcatttaccatattggaattaagggattttctttctagtttataatggggggaaagaacaatgtcttatttatatctacagtctcaatgtctggcatggagtaggcttttaatacaggttggcccagtaatcccaatgtttcactttctccatagcatttaccactatttaatgttttcttgttcatttgattgcttatttatcagctactttctttcactacaaatggatcagagggattttaggggttttgtccaccttgttctcattgcatttctataacctaggagtgtgcctgccacattaaacactcgacaaatacttacccagtcaattaatgaaccacatcctagctacttcttactgcttatctttccttcaaaggagaaaggaaggaagaagtgacaaaggatgaaaggaataaaagacatacctcttcttgtaatttggtatgggatttttctaagtcctgagtatttattatttgagctgtcttctcagatacgcttcttcttagttcatcaatagtttcttggtgttcttttaggtgaatatgagcaatttttagttcttctttggtttgtaggcccttggcgagtgaaatttaaagaatattgtaatattcttccaacattgctcccctctttccaagtggctcagattttaaaagaaacacttaatagatgaaggaaaagggtataacttactgtagcttcaatttctcttatatatcctctaaggtggtctctctctgtttcaaatgacttctgtaattcctttagaacttttctttctttggttatagatttcacttcctcataattttcattaagtttctgagccaactcaagcctctctgtttccatatgttccaatgtcaattctttgttctttaattcattctttaaattctctatttcattaatctttttctgcatctcactcatctcttcttgtacattaagaagttgttgctgtttttcttggagttgctggctcttaaaatgcacaatttttataattaccattttacttatattctcaaaattcttacacaaaatcattaacagccttgcctcctatcagcatataaataggtaagtagcattaaaagtaaatgaaactcacaggcataaatgtctgcagtggtttgaatattgtcccacccaaaattcatgtctcccaggaacctcagaatgtgaacttatttggaaatagagtctttgcagatgtaattggattaggattgagacgtgatcctactggagtaggtcttcattccaatgagtgtatttataagagacataaaagcacatagagaggcacagagaaggaggtcatgtgaagcagttacaagccaaggaatgcgaagggtagctgggagacactggaagctaggaagaagtaaggaatgattcttccttagagccttcagagggaatatggtattgctgacacttaaatttggacttctaggactcagaactgtgacagaatatgtctctattgtaagccatcaagtttacagcaatttgctatggcagccctaggaaactgatacaggctgattaaggagataaactgattaaggagataaggggaagatgagataaagtaaaaaagcaaagagactaattaaatatacaaatacagctaccaaataactataattcctcatcctcttaaaaaacttttggagaatttattttcacttccaataagatgcttatgggtggctcccccaaatactgagacattaaccttcacaggctattgattttaccttttttataggagtatgaaatagacataaggttttagtaaactcaattaggtgagatagtgaaagggatcagaattaaaagaaaacacatattaagaaaaaaacaggctgggcatgatggctcacacctgtaatcctagcactttggaaggctgaggcaggaagactgcttgagcccaggagtttgagaccagcctgggcaacacagtgagacctcgtttctaccaaaaatacaacaattagctgggtgttgtggcacagctaatttagtctcagctactcgggaggctgaagtgggaggacagcctgaacccagggggggttgaggctacagtgagctgtgatcatgccactgcactccagcctgggtgacagagtgagaccctgtctcaaaaaaaaaaggaggaaagaaaaaagaaaaaatattccacagaataataacagaaccgtactatattatctattatgcaagtggcactgcccttagcttatatagaaagatctctatgggtgcattttagaatctcttgggaactacagctgttacaggggtcttagctcttacacaaatatcccaataacacctaacttctatataagaaatgattcaggaaactgcaaacatctaagagatggtaatagtgataaatcttacatttcaaaatgactaatgcatctctgcaaggaaagaatctttgttttgttgactaatatatctcaagtgcccaaaacagtgcgtggcccatgacagtgctcaataaatatttgatgaatgaatacatcatatgatttgtttaaatgatacaaagccctctctcacctaaagactctggaataatataatcctcataaggtatgttagtttagatctcagtgtaagttaaaattgtccaaaatactagcattgaaatatgttcatttgggaggtatgtgctatttctggatttaggtctacagaaataaaaattaccaaaaaaaaagtttagttagaaaaaatggccagggaaataactttaaaaattcaccttttcctttagtttttcttcaacttctgccagtctgtcacaggtcctagaaagctctccttctttctttatggcatggttcttttcttgtgcaactatctcttgttgctttttaagttcatccccaagaagtcttaattcttcctggttttcaatggtctagaaagaaaaaaaaagttgagattaaagtaaatattagctaacatttatgaaatcaggtaaaacatcagcatttctctcagtctgcaaatgaagaaatcagggaaaactatataggaaaagacaaatttcaaaaaagaaagtccttattttaataatataagatgccaagaatctgctttttatactgtttctttactgctcaatttacattcctaccatgagaattagaattgcatttaacattctatcatgagagcttagcttatttctacctttaagtcaaaagagactttttctgagctatcactgagtaataatgagactacagctatagttttttcaaacactgggatggctttggttttagcacagatcactgccagcgagctcaaaatggcagccaccctctgctagcatgacttgggctgatcctggttattaggctcacacagtgacattctcacgtatcaagaccacaaaaacataacaagccagagactgagaagaaaataccattgtttgtttgtgtgcttatttacattctgctcttttgatgaaggagacaatccccaaaacttataaaattaaaacaatacaaatggtcgcattctactatgatccacagtgaacttctccaaatatttatttaaacttatacacattgtatcacccctaaacatagaaaacctaagtgtgaaaatattggcagacatcaacaacaaacaattaaaaataaaatttaaaaattatgacagcaaaaaaaaagagaaacatttaggaacaaatttaataaaatattaaaagacctatacactgaaaatctacaacatacctctttgagaacagacaaattacagaagaagatatacaatggtctagaagcataagaaaaaatgttcaacatcttagtcattagggaaaggcaaattaaaacaacagtctgcacacccattagaatggctaaaattaaaagcaccaataaatatgaagtgttggtgaagaaggatgtttgagccaccagaattctcttaatttgctaatgggaatgtaaaatgatataattactttggaaatcagtctagcaaattctcatcaagttaaacatattcttccctgtgacacagcaattccatttagatatttaccttaagtaaataaagctatgtaaataaaaagagttgtacgagaatgtttacagcagttttattcaaaatagccaaatactgaacggaacccaaatttccatcaataggaaaaagaataaaaaaattatggcgtattaatacaatgaactattccttggcagtaaaagggagtgtagaaagtcaaacataagagactacatactgtatgattctatttgtataaagctctagaagagacaaatgatttaaggtgaacatatcaggactgataatctggcggggaggaggtgatgagggtctgtgatagaggtgtgaggaaactttctgggggtgatggaaacatcttctatcttgactggggtgaagaggaaatgggtagagacatttgttaaaagtcgtcagaccatacacttccaccagatacatttattgtatataaattatacctcaataaagttgataaaaatctgaaacaaatgaagacaaaaaggtaatgccaagtatacagtgctaaatcctaccatttcaatattttcctttaggtcagtcttcaattgttccttttctgctataacactctctaacatttgttggagttcatttttctcctgtattaaagaaaatatcttcctttgttgctcaattatctcattatccttaacatctgcagttagtgtttgggtatttttagcttccaaatcctgttttttatctatgccaaccatctaaaacataaacacattacagaagaatttcttaagtagttaacaacaactttaaaaaataataaaaatagccaacacatctattatgtgccaggtactattctcatatcttaacacatttaatcttgacagtaactttatgaggtaggtattaccataatcttcatttgacagatgaggaaactgaactggagagaggtaaagtcacttgcccaaggtcactcagaggtttagctaggttttgaatccaagtgatctggctccaaagtttgtgctcttacgtctgttcactaatcagaacaatatggacaactacaaatattaataattgtcttcacgtatgataggttaacatgattctgcatgtttacttatttcaatgacattaatacattaattaaaggatatctgcctttagtttgtacacatcttccataaatattttccaagtttcattctagtagtagtttgtttatttactactaaacgagtaagcaatcttgaactctatcactttatctatttcctcctaaaagctgggaatcattccctgtctcccactccctgcaaatctttattttcagaggcagtcctacttacaaaaggctggagttttattatatgtagggggataaataattttgataaagatctatttcataagggtgaaattcatcttttcttaatatatgtatattttatatactgcttaagaaaaatgttatataaattcatttattcataaataagtcacgaccaaatgtaacctaatacgtgaacttattggtaaagggagacagagactgaaattactattgctggtacaaatttagggtattattgtatgacattacactagttcagcaaacagctccatattgcctacacaggtatttaaaagtttttataataatctataatcacattagaaaacaatagaaaaataaaggataaaaatcatccactgtcaccaacttcacacaacaaactattagaattctggtaaatttacttctggagttttttccattaaaggttttttttttgtttttttgttttttaaacatagctattataatgaatttatatgtgtgattctttttagtttttatcttttccacttagatcatatgtattttcacatgttgttatgtaacctacaaataatttttagtagctgcttgattctctagagtagatataaactgtactttatttagcaacccccttattgttggcaatatgcatgagcttctagaagataacagtgatcacagagctaactacatgagaaattaaggtagggaacacgtagtcttttgggactagtctgttagatattataattcagaatctcatatctttcaaatacaaagcagattgagacaaaattttctgtaatgatagccaaggtttatttcaaatctgaactcagcctagaaggtacttcaactaccacagttatgaataaaatctaatagatctaattattaaataaaaaattattagaacctgtgaaaaaggaaaaaaattgtcctttatataagaataagcttactaatcataaaatatttttgttgagatacattaaaaatactgcatttccagaaacagacacatcaagtaggactaaaaatgagcattccaaggagattcatgatagacctgctagtgcagctctctggtgcctagatgaacaggggagcacctggaaatccccatttccactcttttattcccatggcagattccagcatgagcatgatacaagaccaaattgatctcagccttccatcccagactttaggatccctggtgaacagaatggcctcagaaaagccccagctacatccttttatcaacatggataaatgactccagcatatacttggtaacataggatcttagctgttcccagtgagtataactctactcttcccttcatcttctattgtctctataactgcattttggatttgtttaaaacagttattgattgccatatattattgtcaaaagtctactaaaaaaactttcccatcataaaagtggaagttattatttctttctttttttttagacagggtctcactctgtcgcccaagctggagtgctgcagcatgatctgggctcactgcagcctcaaccttcctgggctcaggtgatcctcctacctcagcctcctgagtggctgagactacaggtgcattgctaccatgcctggctaatttttgtatttttttgtagagacggggtttcaccatgttgcccaggccggtcttgaactcctggactcaagcaatctgcccaccttggcctctgaaagtactaggattacaggcataagccattgtgttgagggtaaatttcaaattgaggtcaaatgcctttggcctatggttattccaaattataaataagctgagaacataagatacagaaaaagtgagagagaagaactaaagcataaggagatggaaataaaaaaaaagttccattttccaaggcagtattttgccccggagtaaatgggggaaaatgcagctcattttatagaagtaatatataaatgtacagatatttatttatatcaattggatcttactgaattactttgaaatgtgtatttgcttttatttaataatgtattctgttaaaaatgcatgactgtacaaacatcagtagcatttctgtacactaacaatgaacgatccaaagaagaaattaagacaattttatgtataatagcatcaaaaaagaacaaaatactaagaataaacttaaccaaggaggtgaaagacatctgctgaaaactgtaaatgttgctgagaagaaattaaagaagacacaaatggtaagacatcccatgttcatggattagaagacaatatttttaagacatcaatactaccgaacaatctaccatttaatgtaatccctatcaaaatcccaatggtgtcttttgcagaattagaaaaatctatcctaagattaatatagaaccttaaagggccccaaatagggaaacgaatcttgaaaaagaagaacgaagttggaggtcttgtacttcctgatttcaaaacttataaagctacagtaatcaaaacaatgtggtgctagcataaagacagacatataaaccattggaacagaatagaaagaccagaaattaatgcttgtgtatatggtcacagtatcttcaacaaggatgccaagactactcaatggggacaggatgatcttttcaaaaaatggtgttgggaaaacaatagccacacacaaaagaacgaagttgtaccctgaccttacactatatatacaaataaatgcaaaatggattacaggcctaaacgtaagagtgaaaattacaaaactcttagaagaaaacataggggaacagattcatgataagggtcttggcaatgatttcttggatatgacaccaaaacacaggcaacaagagtaaaaataaataaacttgactacattgaaattaaaaacttctgtgtatcaaaggatacaatcaacagagtaaaaagacagccgatggaatgggaggaaatttttgcaatattgcatataactgataaaggggtaatattcagaagtataaagaactcctacaactcaatgacaaaaatcaaacaacccagtataaaaatgggaaaagacttaaatagacatttctgcaaggaagataaacaaatggccaaaaagcacacgaagattcaacatcactaatcattaggaaaatgcaactcaaaaccacgatgagatactgcctcacatccattaggatggctactatcaaaaaaaaaaaaaaaaaaaaacagaaaatagtgtgttggcaaaggtgcatataaaccagaacacttctgtcctgttggtgggaagtaaaatggtgcagctgttatggaaaacattatggtgctttctcaaaaaattaaaaatagaattaccatataacctagcaattccacttctggatatatatatccaaaataactgaaagcagggttttgaagagatatttgttcactcacattcataggagctttattcacaacagccaataatgggtagaagcaacgcaagtgtccatgatggatgcatagataagcaaactgtggcatatacatataatggaaatttactcataaaaaggaaggaaattctaacacatgctacaacatggatgaagacattatgcaaaatgagacaggtcagtcacaaaagataaatactgcatgattccacttatatgaggtactcagagtagtcaaattcataaagacagaaaaataaatggtggtagccagggtctgtgggaaggaaaactggggagctgttgctcaatgggtatagttttggttttgcaagatgaaaagaattctggaaattggttgtatcacaatgtgaatgaattttacactagtgaagtatatacttaaaatggttaaggtggtaaattttatgttatgtgtattttactaccaatttaaaaaatatatactactatatactattccaagctatatatttacaaaagattatttcaccagtctcctattgaatattttaaaattctagcagtaaatactctggataaaataatatgaactataataaaaatgagacatgttattacaaaattactgttaccaatatatcttagaggtgttgtgggaaagtagaaaagaatactgttaataaatgaaaccctggtataacgttataaggcaatcccctctgcaatggactgaattttaaactctaagcaagtttagtatagtaaatttgacataaaataagtatcagctatgcaaaatttggactaatacatttttgggccctttccctttctaattgattataaacatattctatcataagttatttcaaaggcattagggataagcttgtaaaattattgttagttattaccattgtgagtaacaaatgaaattgagaatattatgcatttaagtatttgaggttaaagagtatatatacaagcatatgaaaactctgaaaataaacaccctttaccttttgctgaaattcatctttagtttctcctgtattttcctccatatgcaaattcctggaaacttcctcagaaattttcgattttagtgtattaattgtttcttgatgttgtttcagagactcaagagcatttcgtaattgttcttgagtatctatattctttgttagaaaaatataaaaacaatttccattagaatatgaaacaaaattattttgtagctactacataacataatcataaataataaatgatggcctctgcaatgtttttaagagtctccaatttttcaaagtttaatcaatcaaaaccttaccatgttaacagtatcgtgaatatcacttttgagttggtccctctcaatttgcaagctttcttggagttgttttagatcatctttttcttgagttaaagtttttacttcttctaaagtttgctgcagtttctcagtaatcagtgttttctccctttctacagtttgcagcgtagaatctctattttctaattgttccttcagctgttccatctcatttagtctttcttgaacctcacgtgttttctcctgaagttcttgggtcttgtaagaaagctttaaaaaagaaaaagtaaatgtcacacagtaaaagcagagcagtctgaggcatacatatatacagaaaccaaaaccccagaagactaaggagcatttctcaaaatagcatcttgtaccaacctcggtcttcaaagcacccaaactcgaatcaaatttttgggcttctttagagagattaactatttcctgattcattctctcattctcctcaaggaccatcttatacttttgctcaaagtccatatgaagggttttgaaattttggaattcttgatcagtgcttttataattcgactgtgtagttgctaggtcatcttttgttttcccaatttcttcaagtaaaccttgaactctactctccttatgaactacttcagaaaacaatttatctttttctgatgttattatatggagctcttcagatttgtcttgtatctatggaaaagaaataaaatttagggatgttagcaacatatgattcactgaagcaatttttaggaaaaaaagctttctctgcaaaaagagaagttatttacattcagcaaaaatttgactgtggaaaggcaatatagtagtactcttattgtcacttttccctaactcagcttgtttaactctacctttgatgttttattttctaatctctttgtattctagaaagtaaggtctgcatggaaaatagtaaaggcacataatcagattgtctttatttccttacctatcattttaaagtgttttctaactttatcatgtggcaggcatttctcagaatttgacatttttttccctaaaggctttgaatgcctctcaggtttccaaaaacttaatcaatgaataatttaagtaatgtttaatcatttaaaattgttatttaagaagtatcttaagtggtatggtccatgaaaaaaataaaaatagaagtaccacttaagtaatatttaaataattacataatttaaataacccatatcttgtatattaacagtttaatcactgtgaaagataagggcagagagagatgagaaaaaaagaagagataaaggagggacaaagtaaagacgggcaatacagcgtgtagctacaatcacgggtttaggaggcagatttatgtggctcaattatgagtttgataatgggttattgggactaaaaaactacctatttttgaagagtttataagacgagtaaatgaaataatgtttttgaagttctttagcatgatgtttgccatacagtaagtactcaaatttttgccatttttcttttagacaagtagaaagaaaaactggcaggccatggatttacagaaacattcaccagcctgcaaggtttgcattaacctctaaaactttatcagtgcaacctcttttccctcattactgtcttttattcaacataatgatactactactaccaaaaaaaatggtaaagactaagggtgggccgtaatactgtataaatgcaacatttgaggactacagaaatggctgctacatggattatattactaagtattctgttaaatacaccttgaaaaaatatattttttaatctagtagcataagaacaaattagaagatgaactatattcatttctatttctaactagtcaaaacgtttacagtatctctcttgtctgctagtttaaaataaactataccaaaatatttaaggcactattatcgcaaaggtttttatttcaaaataagggataagtgcttataaatgtgtttacctctttcctcagcctttctacttcagaaggtaaagatttcaattctgaaagcaaaatgacttcttcccgcaaagcttcattttcttcaacttctttatttagttctttctgaagatcagtaatctttccttccaattccaaattacagagcaaatctagaaagttttggtaaattgtataaagatccaatgttgccaaacaggtaatttaatttttaattgtccttgaatcacctttttcaggatcaggtaaagtttatttgaaaaataatcccttatgatttgaaacccatggaaatctttataaatattaataccaaatgaaactaaaacgtaatattgagtttttaaaaagtcagagtataatgaatttttaatcattgaaatatgcttgtcaaattgtttaggtacatttctagaagaagtcagatttgaaaaaagatgtttaaaattacaaaataccttttggaactttgccatctataagggaggtgagttttgttatctcattaaaagcagattgtaattctttctccagatcaacttgcattttcttttttgcctccaactggctttgatataactgaatatcattttccatttgcttgtatgtagttgcaagttctttctattgagaaaaacattgcaaatgcacaaaaatacactgatcattacaactactttattataaatattacaaaaaatacttaccattttctccttcagctccagattttcacttctaagaaaggctgattctctcttggcatcaagggctacagtttcagcatcaaacagagtctgcttcatttgttttgggtcttcaatgctttcctagacagatgacaaaaggggttcactgaaatctaattttcacagagttggaaaattcttaagagaacatgtatataaatgttaactctagctaatcaaaaagcgtacaaatatgctagttaccaaatatataaaaagaaataatgttttcctaataaaaataatttttaaaaattctggtcatatttttcaaattatataagcaatatatcaaattatataagcaatgtatcataatttagatctgttttgtttaaaggttaaaacaactgttgttcggcaaggctgatgaagttttctatgtatttttattttgagttattctcttcagcacatgataggtaagtggctaacagttaaattaaagatattaacccacaaattgaaaaggaaaaagacaaatgatctaatagaaaaatagagaaatgatatgaacaagaaacttacagatgagaaaatgcaaatgaaaaatacatgaaaaaaatctacaacctcatttctaaagagaagtggcattttaatatgactttagcttatatgaaatcaatgatatgtccttggaaaaaaattaataaattaatacatgaatgaataaggaaaaagaaatagtaatttttaaaaagtgggcagttctgcttgccacgctatgaacagacactccagaatacataaaagtgccttcctatccagggcctcagaataggatgatatgaaatggtatgaacccctttgaaaagaatcatttgtcacaaataaaaggcaacaaaagaatagaaggtaacaaaaactaaaaaactcaactgaaaacagaagaacagaaactagtcttttaaaagttccagctagaaactgttatcataaaaaaaaaagtattaaaaactggaaccaaacatatataagtaatcaggtatactgaaagcaaactgaagcgattaaatgacatcatcatcagattcaatgttagttaatgccaagatcttatatcaactaaaatcatctagagctataaaattgtgaaaaaatatcccagtttaatatttaagatcttgactatatactactgcatgcatttgtataaaactactgaaaaaaattcggaattttaaaattttactgatttttttttttttttggagacagagtcttgctctgttgcccaggctggagtgcaatggcatgatctcggctcatggcagcctcaacctcccaggctcaagcaatcctgccacctcagttacccaagtagctggcagtacctgccaggcttatttttgtatattttgtacagaccaggtctcactatgttgcccaggctggtcttgaactcctgggctcaagtgatctcccacttcggcctcccaaagtactggcatcacagggatgagccactgtgccctggcctaaaacttactgatttttaatgggagcctgtccttaacttccttatatttactcaaaggatgacatgatcaactttccacaaatgtgactttatctctaaaatggcaaatatactaacagtccctatctcatagggttattgacagatttaatgaaatatatataaatttattacaacaatacacagcacaaagtaggtccagtataagcatttgctaagatgatggtatgctatatatatttatgtgattacacaacaaaatacgcctgatttttaccaatgagtatgacaagtccatttttatattttctagcttttgagagtctatgtattcctgtagcttcttaatctggtcttccttttctctaagcagctctacttttgaactgagttcattctaaaagaatcaaaggagagagtaacaatttagaatctgatttgaagtctaagggattaaaacagaacttatatatattagtttaaattcatagtaaaattcaaagtcactaatattttaaaaacataattcccttatttctgacatcatgttcagttacatatgttgcatgttttatagttctaattgcttatcaatagaaataccaacatgaatgctcacctcaagatcttgattatatacttctgcatgcttaactaaattctttaagttcgaaatttcatgaattagttgcatctgtaagagcatgtgaacaggtaacagagcaaaccaatagttaataaagcaaagcaaaaaaaaaaaaaaaaagaaaaagaaaaaaaagggcactggttcactgcttcagaatcacccaacagttagaaaggactgagatcaattgttcaagctatcgcaacaaagcacctcattatttaaaaatactagaaatatcacccaaaacatatcaaacaaataaaaaaaaacccctcagcatgaccccaccaagtagctatatcatctgttaataaagctacaataatgtcaatagcaaattagtatgcactacttggaggagagatttaaaaagtggtaatcaaaccttgaaaaatacacgtttagtagatttttgttttcagtcagttaagtacagaaatgtattaattcttataaagttttttcttcccataaagtatccatcagctctacattagtgtactttttaataagttctgatttggaatctaggtttggattagggttgtttcatgcagtgcctttacaatattattacttttcaccagtgctacacaggtatggaatgatcaactatgaccttgatttattccagaggaaatattgcactccattatattgttcaaccatgtaaaagtataaaggtagaagtatttctattgaggtgtcctttctaccaaaatatctgtagcattaaatatctgagtaccaaaaagtttgttgaaaacaagtaaaccacacataaccaagataaacattttcccttagaattatttaatcttcataatcagatgagcacttacagagtaaaagcaaattctaatagtatgtaaggggcttgaaaatagtatcttatttaaatattttctggatgtttaactgagtcctgactagttttaaatttcagactagtgcaagtgttgacattactattttaggtcagtgctatccaagagaaacataatgtcagacacatatgtaatttaaaatttcctagtaggcacattaaacctaaaaagaaaaaggcagaattaactttgagaacatattttattcaacctaatatatcaaaaatatttcttccaaaatgtttcttcaggtaatctatccaacatgtttctttaggtaatcaatataaaaaaaatgaacaattttacattcttttttatatactatgtcaattcagtctggtcccatttcaagtgcttaattgccacatatggttagtggctaccccactgtagaacacagtcttagacatttgtactgcttttaatttaaattggctccttctttcaccttttcttccttatttttaacttctgtgaaagaaaatcacatttaccaataagaaagaatcaaaaatcaatcttaacttttaaaaatacttagaagagatcgggtgcattcagggtagtatggccatagataatgaaaacatttaaagaatactaatttagaaaagaaaattttcctacttcttatttgaaatagcactttatcttagtactggttcttatgcatagaaaataattagcttttataaaaataaaagtgtaatctcccaatgacatgtttaagatgcagagcatgaagtgaaagtgtgtgaaaaggaaaaatgatttaaacatatgatctgatctacagttaatccattgctaccatttaaattgcagatttaaatggtaattgtcattaggtgaaatgaaatatttaacttacatctccaagtagtaaaaattataaaattaaatacaccaagttaaaataggtagacggtaaagatttttctcattcctcgagtatggtgatacttgacattttccattctccctctaaaacatactatttaagcatctcatgttactatattcccactagaaaattatctacaacttgggtgatttttgacaaaagctttaggaaaaccagggaaatggctccatgtcctaaggccaatttgacttttattcccttttagctaaacctttccccaaaatgtaggttttggaacatattttgctacatacacatagacttatatttttagtttaacatggactagatactgcaaaactggttttgaacaggatgtttttattacataatcttttaagtaaccttaaattttgtgtcgaattaaaagtaaagggcctagagcagtggctcacacctgtaatcctagcactttgggaggccgaggcgagcagatcacttgagcccaggaatgtgagactagcctggccaacatggcaagacccccgtctctataaagaaaaagttttttaattatatgtcttttagattagaaagctgagctttgtgttttaaaaaaaaaaaaaagaaaaaaaagaaaaagaaatttaaaaagaacggagtaggattcttcctcctcaactgtggttaaaatgggagaaaaactgcagtgtgatacatgtcatatattctgtggtatttttgtaatctttctctgtgttgactcaattcaataagcttcaatttttcttattaatatattaatgatgtgagaaaaatattagagaaattattaccacttatcccaaacgttagttttatgtcatgttattatcacatataaaaaacatacaaaaattagatgaaattttaaagtcagaagggaccttggtgagcatctggtctctacttcaagggtggagaaatacaggaagccctgagattcagtgacttgcccaaggccttggcaacaattcataataggattggatctgcggtaagtttataagtggcaaaactgcggcttaaatccaggcaatttcactctagagaccatgttcttaatcatgacactaggccagtcccttccataaaacctagttttattgattaaagtccaatggttttgtcatgcatgacattttgcacttcattaacatgcattttaaaacaagctaaatgaaaccctgtggagaacttatagacttttacctctttgaatatagtacctatgaaataaagcaataattttaatttgtaggtagaatggaaataatagctttggcatagaattcttttttcctttaaaaatgaaaagaggttgagaaactgaacaatgatatcgaggaaaaagggtcatggccttttgggctagccacatagaagtctgaagagtagctgcaaattaattcatcttttaactacataaaacactgggtcttatttttttttgaaggggggatgttcacgaatcactttgcaagtctgataacaactacagattcttgttccagaaaaatgaatatgcattgaaaaattctgcaaaataatttcacagcatctgtggcctctaggttaaggacactttacactaataactccctttaatcttttggacaatttctgagtccctaaagtctgatggtttctggattaagttctcttaacgtgtagcctaatattttatacttagaaaatgagtgatctgtttctataaattccattataactatttagtattagttatactaattttcacataactctcttagatggagaaggaaaaacaaaacgtacaaaattagcttctccagctattctaatgttttaattatttagaaacatactttctaaagaaaaagaaatccattaatatgtagcatccatatataaaatagtcatctagatattaaaattcatactgatctcagtaggaaactgctgtgctctaggtagcatttatatatgctcaataaaatgtaatatacaaactataaggaaacaatttcaagacaaatccatcaagaggtagatacaccaacccttcccatagatgcttttaattcctttttctcttgcataagcaccagggaaagaaacatgatttaactatttttaaaatataaatgaagaaaatatttcttaaattttctaaattgtatatacatatgaaaaatggttagatcttcaacatctcaatcttagaaaaaaaaatctttaagacaatacttctgagtgatgtcaagaagatgacagaataggaggtcacctgctcacatccccccaaaacaacaagaattctgtacctattacagacaagtctttttgtgggagcctttggattcaggtaggaggttgtaaaaccccagtagaactcaagacctggaagtgttgtttttgagagtgcataccaacacccaggtgggagtcctgccaattgtgctcccaggttcatatgcagaaatggtcccattccttgaaggacttagctacagccctgtttggcctagagtctgcaaccaaaactatctgtcaaggggtccaggagaaatcacacactctagggtctcggcagatgggctcttctgcctgtcgacattggtcttggcagtggacccaaaagttagcctataacttggctcctgccctcctcaagctgtagtcctagcttagtactgcttgcacaaggacccagaagggaacatgcccatctgagccaccaggacaggcttgccggcctctgtctcatagcagattccgacggggacatgtactggctccagccctcccctgctgcagcctccctgctctcacccacacagagaactgccaagagatgaacctgtctgagccactgggtcaggcttgcagtcctccatcccacaatagactgaaggggccctgtctcagcttcaatgcctctttgctgcagtcaggaagctatctcgactgtattgggaactgctgggtgaagcacctgccccagccaccaggacaggtttcatgcatctttcccataatagatcctaaagcagtcttgtcttgactgcagcccctctctactgcagcctggcagttatcctgcctgtgtaggacaggcctgctggcttccatcacatagcagttctggaaagaaccttgaatgtcacagctacagaatgcaagcaatcctccctgcataaggaactgctgggagtcttgactgctggtgccaccaggttaagcttaccaacattggttccatagcacattctgaattaactctgaagcttggtttcagtttctcctagcgatagtctgagaatggttttacccagccggggtcctaccgggagacaggcgtatccaagtccctgtggcaggttttgcaacccttgtccatcagcagattctcaaatggccctggatcttgatactgacccctctcatctgtggaataagaacagctctgcccacctggggacctaaagagaaaggtgtccagtagtgcctctgcaggataacatggtgacctcagtcatactatagatcttgaaaagaccttataaagatggtgaagactaaaacaaatagctacattcatcttcaatgtgcagacactgctgcatgaccacaagcatcatgatcagggaaacatgatgtcaccaaaagcacaaagtaagatactggtgactgatcctaaaagatggagatgtattatctgccaaagaattcaaaatagctattttaagcgagctcagcaaacctcaagaaaacatagagaaacaatccagaaatttatcaaggagactgaaataataaaaaaaccaaacagaaatcctagagcaagaaaatacaatgaacaaaatgaaaaatgcaacaaagaacatcaatagaagaatggatcatgcagaagaatttgtgagcttgagacaggctattttaaaatatagagtcaggaggcaaaaaaaaaaaaggatgaaaaggaatgaagtttatgggacaacatcaaaaaagcaaatatttgggtcactgcagttcaagtagagaaaaataaagggacagaaagcttatttaaagaaataatagcagaaaattcccaaacctgaagaaagcaatacatatccacatataggaaggtcaaaggttaccaatcaaattcaatctaaatgaccctgccctaagatatattatattcaaactcaaaagtcaaagacaaggagaaaatcctaaaagcagcaaagcagcaagagtaaagaggcaaataacatagaagggagttccattatggttagcagtagacttctaagcagaaatctcacaggccaggatcattaaaaagtcaggaaacagatgctggagaggatgtggagaaataggaatgcttttacactgttggtaggagtgtaaattagttcaacattgtggaagacagtgtggcaattcctcaaggatctagaactagaaataacatttgactcagcaagcccattactgagtatatacccaaaggattataaatcattctactataaagacacatgcacacgtatacttattgcagcattgtttacaacagcaaagacttggaaccaacccaaatgcccctcaatgatagactggataaaggaaatgtggcacatatacaccatggaatactacgcagccataaaaaaggatgagttcatgtcctttgcagggacatggatgaagctagaaaccatcattctcagcaaactaacacaagaacagaaaaccaaacaccacatgttctcacttataagtgggagttgaacaatgagaactcatggacacagggaggggaacatcacacactggggcctgttggggattgggggcctaggggagggatggcattaggagaaatacctaatgttaaatgacgagttaatgggtgcagcacaccaacatggcacatgtatacctatgtaacaaatctgtatgttatgcacatgtaccccagaacttaaagtataattaaacaacaacaacaacaacaaagaggaatctcacaggccaggagggagtgcaatgatatagtaaaagtactgaaggaaaacagttgtaacatcaaaagttagaaaatcaaatattcagaaagtgggaggagataaagtgtggagtttgtttgtttgtttagtaatcaatgataatctgttatcagtttaaaataacctgcataactgtaagactttttcttgtaagcctgatggtaaccacgaaggaaaaaaacctataataaatacactaaaaatagaaaggtatcaaaacatactatcagagaaaataatttatccaataaggaagacagtgagataagataaaaggacctaaaaaacaaataagaaaataattagcaaaatggaagtagtaatttcctacctatcagtagttcctacctatcaatgtaaatggactgattctccaattataagatagagtggttgaatggattaaaaaatccaaatatatgctgcctgaaagagattaacttcacctgtaaggatacaaatagatggaaaggaaggggtggaaaaagatattccatgcaaactgaaattgtaagagagcaggagaagctatacttatatcagctaaaatagactttacatcaaaaactgtgaaaagagacaaggtcattacataatgataaaggggtcaactcagcaagaggttgtaacaattgtaaatatatatgcacactgaacatggcagaatatatataaagcaaatattaatctgaaggaagagagactgcaacacaataataatagaggattttgaaactacactttcagcaatggacagattattcagacagaaaatcaacaaagaaatagcagatttaaactgcagtctagaccaaagagacctaacagatgtttacagaacattccattcaacagctgcagaaaacacattcttatcaactgcacatggaacattctctaagacagatcatattaggccacaaaaacagtcttaaaaaatttaaaatcaaaattatatcaagtatcttttctgaccacaatgacataaaactagaaattaataatagcagaaattctggaaatattacaaatacataaaaattaaacacgctcctgaacaaccactgggttaatgaattaaaagagtaattttaaaaagctaagacaaatgaaaatggaaacacaatataccaaaatgtataggatgcagcaaaagcagttctaaaagagaagtttatagtaataaacatctacatcaaaaaagaggaaagaaatcaaactacctaaactattacctcgaagaattagaaaaacaagaacaaactaaaccccaaattagcaaatggaaagaataaagatcagagcagaaataaacaaaatagggactttaaaaaaatccacaaaataaagagttttttttttttgaaagaaacaaaatcaacaaacctttagctagactaggtaaaaaagacagtcgactcaaataaataaaatcagaaataaaaaaggagacattacaattgataccacagaaatacaaagaacaattatatgccaataaattgaaaaacctagaagaaatgaattcctctaccacattacctaccaggactgaattatgaataaatagaaaacctgaacaggccagtaatgagaaaggagacttgaatcagtaataaaaagtctcctatcaaagaaaggcccaggacctgatggcatcactgctgaattctaccaacagttacagaagaactaatagcaattcttctcaaagtattccaaaaaattgaagaggaaggaatttttcctaacttattctacaaggccagcattacactgataccaaaaatagacaaaaaaggaaaactataggccaatatccctgaagaacagacagaaaaaccctgaacaaaatactataaaactgaatttaacagcacatttaaaagataattcaccatgaacaagtgggatttatcccaggaatataagaatggttcatcataaacaaatcaataaacatgacataccgcattaacaaaacaatgaaaaaaagtcatacaatcacttcaacagatgcagaaaaatcatgacagagttcaatacctcttcatgataaaaactcttaattaggtatagaagtgatatgcctcaacacaataaaggccacatacaacaaacccactgctaatgtaataccaaatggggaaaagctgaaagccttttactctaagatctagaacaggataaggatgttcccttttgccacttttattcaacatagtacaggaagttctagctagagctattaggcaaaagagaaaaataaaacataataggaaaggaggaagttaaattgtctctatttgtagatgatatgatcctatatacagaaaaccctaaggactccatccaaaactgttacaactaataaaaaactcagtaaagttgcaggatacaaaatcaacataaaaaaaagtagtatctctatatgttaatggcaaactatccaaggaggtgtcagatctctcaaatgaaaactataaaacgttaatgaaagaatttgaagaagacacaaatgggaagatatgcatgttcatggattggaagaatattgttataatgtccatattgcccaaagtgatccacagatgtaatgcgatatctatcaaaacaccaaagacattcttcacaaaagtagattaaaaacaatcctcacattcgtatggaaccccaaaagaccctgtatagccaaagcaatcttgagcaaaaagagcaaatctggaggcatcataccatctgcctccaaaatatattacaaaactatagtaaccaaaataacatgctactggcatagaaacagacaacaggccaatagaacagagaacgcggaaataaatccatgcatatacagtcaactgatttttgacaaaagtgccaagaacatatgttggggaaaggatagtctttcttcaatagtggtgctgggaaaactgaatgaatatctatatgttgaagaaaaactagatctcctgtctctcatcatatacaagaatcaattcagaatgagttaaggacttaaattctaagacttgaaactatgaaactactagaaaacaagatagtggaaatgcttcataacattggtcaggacaaggaatttttgaataagaccttaaaagcacaaccaaaaagaccaaaaacaaataaacggaattacaactaaaggcaaaggaaatcatcaataaagagacaatatttgcaaaatatttgcaatatttgcagaaatatttgcaaaatatttgcaatatttgcagaaatatttgcaaaatatacatctgacacatggttaatatccaaaatatataagaaactaaaacaactcaatagcaaaaaaacccccaaacaacccaattaaaatataggcagaagacctgaacagacgtttctcaaaagaagacatacacataatatgttcaatattactaataatcaaggaaatgcaaatcaaaaccacagtgaggtattgcctcatcccaattagaatggcttatcaagaaggcagaagagaacttgttggcaaggatgtggacaaaagagaatccttttatactgttggtaggaatatatagaaaacagtatgacggttcctcaacaaagcaaaaatagaactaccataagatccagcagtcctactactgggcatgtacccaaaggaacttaaatgagtatgttcaagaaatatctgcattcccatatttactgcagcactttccacaacagccaagatatggaaccaacctaagagtctaccaacagaagaatggataaagaaaatttggtataaagtcacaatggaatattcttcagctatttaaaaaaaaaaaaagaaatcctaccatttgcaacaatatggatgaacccaaaggacattataaaccaggaacagaaagacaaatactgcatgatctcactcacatgcagaatcttaaaaagctgatctcttagaagtacaaagtataatggtggttattggaggctggggtgtttttcagggagaagaaaatggggaaatcttggtcagatgacataatgacagttagatagcaggaataaatttcaacagctctattgtacagcaaggtgactatagttaatgacaatttattgtattcttaaaaaacataaaatttgtggatactatgtgctatcaccacaaaaacaataactatgtgaggtagtacatttgttagctagatttaaccattccacaatgtatatatacttcaaaacatcatacatcatgttgtatacaataaacacataaaatgttatctgtacatttaaaaaaaattaaaaaagcttacattatagaaaaaagagaatacttcttttaaaagtatgcttttagtttagttttacatttctgtctctcttacctcttgatcttttttagtttttctttctagagcctcaaattcatccaaatcattcttttcttttaatttcaattccatttcttctttttctgttcgtagttgttcatagtctaataccagattatcatagtcagcacgaagtgagttcaactcactttctatattctcctattataaacaagaacagattttccaatcagaaaattcaaatattttttgtttccttaataaaatttgaattatttaaataactactttaactttgatttgatatctttctaaagttctacattttggcaaactagctaacttagaatagattattttgaaagaaggagaattttaaaaatatatcaataaagtgtatgtttgcctgtgcctgacagggaattttgaccataagtcctcaagctcctcagtaataaaactgataattgaattccccaatctaactaactcttattttatgtctcagatggttctgaattcaagaatggaaacagagatattatttattgacttctaaagctaatgacaactgtgttttactataaagaggcctatttctattttctatattattataagagaagagataaaccatgagttaaaaaaatacttttttacaccagagattgtaaaaaaaacccaagaaacttctaatgtatgtattaggaacaaaaaaacactttatcaataatactttataggaattaactaacaataataagtagtaatgcaattatattctaaaattcaaatgaaaatgtctattactttatacaactatacatctttaaacacgagcaatctacaaagtaaacacggaatctaaacttactgatgtattcaccaaaattacctctccctgatatattattctatacattataaatgcctgagaattgacacttttaaaatcagtcttgttaccctaatgaagtttaccaaggcaaaacagaaactttacaaacattgtgaatactaagatctgctagtaaagagctagaggcaaaggtttacctactagcacatgtctgccttatgaaatttttagccttcctctaggtgcctgatggttatagagtagaaatgtaaagagaaaagccttcattagagccaaaatcattactgaaattaaatgagaacaagtaacaaaacctaataacaaaagaattttaaaaagagtaaaagcattatatgctgtaaaatacattaagttacctgatttagtagctttgttgctggattccattctatctcacttaatgtatcaagagtgttactgaaaacatcagactctgaacagacagctataattagagaaaaaaaaaatttgtccatgaacatgtttaccaaatttcctaagtcaaattaaagattactaaaaaaattcttatcagagatactaagaacttcaaattaactactatgtgctcagagtatgaataccaaaagtacattaatagatatggtcatttatgttattgtatgaattaagatgatcactggttggaattagtgacacaatacaggatccttaatgaaatataggttaaaaggacaaattctgaatttgagatttgatcattataagtagatttaaaattcccccccaacagactgtactattgaagaaataattttgaaacagattcctatgtcaatgccactcttttaagattagcaaaggcagatgccatataactaacaatttaattgaataataattagaaaataaaaacacctgtctcatgtgtgtttcaactagtgcatcattcttaggagattcagaataaagaacttatgattactttctatttatttatttatttatatttgtttgagacagagtttcactcttgtcacccaggctggagtgcaacgggtcttggctcactgcaagctccgcctcccaggttcaagcgattctcctgcctcagcctcccaagtagccgggattacaggcgcctgcaaccacgcacagctagtttttttgtatttttagaattacttattttaaatcatagtctccattgtaatcacatatgaaatacacagtatttaaacatgtttatcacattaactgagctataaacatagtttctctttataaggatgcttttataattaaacatagttccacttgaaaaaagcactcacattcatcaatttctcgtaataaatttatagaaagcttatgtgtttttgttgttatatttgttggtatattaaattgatctgcatagtttgagttcttcattttgttaattttgccaaggcaccaagtaactcttcgttttcttttagcctaaagaagaagaaatcaaaattatgtcatatagatctgtattcaaacataataaaacaagggaactagtttctatttttgaaaaccattgacttggtagaattcttattaagcctagtttaaaattttattagtctaaggatattgcttaaaaaaaaaatcaaactcttgactctttacttcactctaactaccattttctttttttcctactttgtcctcctcatcatttatccactccttcctcaacacttcagggacccatctcctggttcttaccttacccagctgctgtccttaccactcactctgctttgctagtttctcttcctgtgcctgcctcttaagtgtgtttctccaggtttcatagccaccattcttctcttgactctttactgggtgcaagtatcatctcatcttatttgactctctcggcaaccctagggttgtaatcacatctgaaatacacaaccctaaggttgttgagagaatcaaataagatgagatgatacttgtatcgagtatcaaccttactacatctttttaacagatgagttgggtgcccaacaagtttggagaagttgcataaggttgtatagccaattggtggctgagcccattgtctattacttcagagcctatccatgcaaccattccgtcacattgcctcttaagattacttgttgtccacagaatatactgcatactgtcatgcctctctgagtgctgtccttctgcttgaaatggccagccctttccacaccctgctctgcaaaagccccatcatattcaaatcctcgactccaataaccttcagtttaatgccagttgctaccaaagccacacctggaccttgtcattatctgaaagtcataaactagacctcttgctctcattgccgttgctgtccttccaaatcattaatttagttaatcccactatagctatttagctcatcaggggctatttagctctgttcccttgttgcatgacttttttttttttttttgccatctccctcttggttctcaccctatcatcttagattccatagatcactgtaatcatgtttgaaatttgaggtcaatgttctcaaattatttgacccactctctgtcccttacatgtaccctacacggcacactcaaatggcactgtgttcaagacctttatcagcctcctgagcactgccagagccacacagccagaagaccggctgacaagataaactggacctttaatgttgcatggcaatattcccttcccccttgtcagctttctttttcattacctacaaaggctagcctatttcaaacccttagtatctctgcaaacttatgactctaccatcacctgccatctcagcagaagaattaaacctatttcacaaagaaagtataaacctaaactcctaagagtactacctgcacagaagcctatcctttcctccatgtttgctccaattcaagaggtatttctcctatgttagtccaattctttctactatattcaagattccatccatctaggccacctcaacacactataaggtggctttcatccccatcacttaaattacttttgcaaatgagctctgtgtttctaaatgcaaataatttttgtccatctttatcttatttaacttctcagcagaatatgacactgctgaccactacctccctgaaatattctctccccttagctaccatattcactaggttttattcttaactgtacagctaaacctgggctgctttatggattcttctttctctgccttacccaattggagttttgccttctgtcactttgcctcctgttgccttctctcaacatgcaaccagaacaaactttaatttggatctgtagtagttaatgcccaaattgatatttatatctcaaatcttctacctcatattcacacatttgcattttcaacagcctgacatctcaaacaaaagaaatcccaaataaaacacccaccatttccactgctctttattcagtgtgccttaactcaaccaatattgttaccagctacccatgaagccaaggaattgcttgcaagtcattccggacacctccttctccctttctctgccctcaacatccaaacaatcacaaagtcctgctaagtttaccttccaaacatttctccaatttatccaattcactccaactccagagccacaatctttgcaggcccaagcaatctgatgtgcacagtagctacatctttctcaactataattctgatgtcacacacaaggctgttctttgttgttagcaaaacatcacattcaaatccctcaaggaggtttaaaacgcccctgctactagaacatcttaagtgcaaggaatgcataatgtttcttcacaactccaagcttttgtacatgtaggtctcttttgaaacattcttctctaggtctttcattgggctacttcctgctcaccactcaaccaatagttcttgattgtcttctatatacctctgtacataatgcttattcacattaacaatgtacattagttgagaatatgctgtgtggaaagtgctgtgttgagctaattctacctattatctcatttaattctcacacaacacttatgaggtgagtatcaagctattccacactgctacttccacaggaaaaagcagcaaagtgaattcaagaaattgtccaaggccaagagtcaggaaatgacagattcaaatccaggaagtctagctccagaggtcattctcttatccatgacaccctcacaccccaaaaagtctactgaataaataaattcctactcaattaaaaacaaacaaaaaatcacaccaacaaagtaagaattttgttcactatgttgtttttctttcaccagagtctacattgacacaattatgttgttttatattctacaccaattttcctgagattaatatttctgtttaagtagaaaataatatttccacatattctagaaacctatggcttccaatcacccagtttctctagaatttattaagcagaatattgcaaataaattatttaaatacattccaaacttgttgaattagaatctctacaaataggaatcagaaattggcatttttaatgaatctcttaggtactatgaaacacaaaatcttctgggtttcttgaatatactgtatcaaaggatagaaagtgcatactatataataaacatatagaaataccaattctattctctgtacatcaagtttaagctgtcatcttttaattttacctttaattcctgttgcaacgtgagggaagaagaggtcaccagcatccgtgttaagttttcaattttctcattctgtactttctgaagcaaatctttttcttccaaaagttgggccaattggtctttttccattgcctgagcccgcgtctctaaagaaacctatagaatgcaatattggattatgttaataataaatgtggctaagttttaaaaccttaaagtagcataaaagaataaaatattaaatttgtatatgaactataagaattttaatttcactgaaataaaatatactctaactgtagaacaccaaaatgcagttaccataatcaataatttctcagacttacaataaaatacacatttcttctcatgtaactattctatataccatgtataagacaccaatgctgttaatataactctattaattgcctaagaagatatgaatagtcagaagtcataaaacaaagacttgaattctgatagtaaagatagagatgttctcataagattaccatttgatattttagctcattttaaaaaagatccttaatgcgtgattttttacaaaatatgggaccatgatggttaaaacaaactaaaatgataagtaattatgctatattattagattgctatctaagggttagaagaggaattcaggataacatgaaaacacagaaggtggttctaagtaactctgtagtttctctttttaatcgaattcatatgtatttgtgaaaaattttaagaaatgtctctacttggcccatttgataatctcagattttgcccgttgaaaataaaaaacaaaatctaaaataatttcaagaaccaaatcttacaatttatagtaaattaaactaaaatttttatgagtggatttcttcttctttaaaagtgattaaaaacctaagttgtagcaactcagatattcaggaatgaagagtctctgagcatttgggcaggtctccattctaaattggttctttcaatttaatgaaataaatgattcatacatacctcctctaattgttttttaagatccattatttcttttctataccttttcaggagagcttcatcagttgatacctcattaacataaggagtattcttcatatatttagcagtactggcaaactggaaaaaaaatacgaaagtgctaagtgttcaacacttaaaaaaattcgaatttaattaataatatttagctttcttatattcaagattaaaaaaatcaatactctttctagttggcttaatacttttgaacaaagggaacattctatgtccttataacaatgctctgtaacttatcctgggtgatagtcttcgggagaataaaaaagatatattgagagaacttaaaaacatcagcttattggaatctcatttacccctcaaggtccagtgctaacgcctcctctactctgaagttttgcttctagccaaaaatatctctccttcctttaaactctatactagttattaaccacttaactactaatcaaaggcaattatgttgcaagacaagtgttatgtgccttgtcacagaattcattaattctgttaagccagggactctagtttctctttgcacctctgacagtaccttgatctggtgctcaacagctatttaaagcaatgtttctcagagtataagtaccataagtaactttaggtgggtacaccaaggtgaccattagataacattgaatccttcattgagaaagctaccctactgatatttctcatttttcctttccttttttttttttttgttttttgttttgagacatagtttcgctcttgttgcctaggctggagtgcaatggcgcgatctcggctcaccgcaacctctgcctcctgggttcaagtgattctcctgcctcagcctccccagtagctgggattacaggcatgtgctaccacatctggctaattttgtatttttagtaaagacagggtttctccatgttggtcaggctggttcctttcctttttaaaatagaaaatgtaggccttaggctcagagaaaatgaaggcaacagttaactaccaggaatttcagaattattttgttatacagacagacacacaattttttttgttaccttctatttgtggcaagtaataatagtttcccattgataggactaatattaaagtttccttttacaataaattaagtacaaaaagtgagttattttaaaaatatcaagtcaatttcagtaaaatagtgttgggtgtggcaaaaattatgaaggtaagatacaaataatcgaagtctggcaaaattaaattaagaaatgctatttagtagacaacatatcgattataacaggcgagttaattaaaaaaaactatgcttaattttagtaggtaatgttttcttcttcaagctgatcttcccctatattaagctgagataaaaatcaaactcacctggagagcagtaagtgtttcatcaaaagatactggagtaattgtgcagataatacgtgtctttgcatttcctcccaaggaattctggagaattcgtgttaacttgctatctcgataatttatgaaaccacttagcaaggaataagtttacaggagaaaaagattgagaacgtttatataataaagtagttggtttttaatgcagaactcttaaatcagccagagtttcaaaaattagtttacaagttatatgaggcagattaaaactactaaaaaatatttaaaacagaaagtaaattcagtagattataatcatatgtataagtttttgaatatatggaagaaatcagtacatttgagtgtcatcgaaatgttgcaatgttcaacctaatgaaaaatataagaatcagtaggtaagtgcacaacgggataaacttacccaacttgtccatcactaagtttcttgatcacttgtcccaaaataaataagcttcgatttatattacagccttccttgagccgcacacctgaatttattaaacaaatatgaaaactaaacttgactccttttctagatgataaacttatttatcactaagttaatgagagaaattagagggcagatgctaaagtctatgctctggtttagacatgagcccatctttaatatcagtggtagaaagagctctctccctattggtcccacttcaagtgaatcagaaaggttattacctgagaaaaatagtaaaaagaaaaaaatgaagagggagggaagaatgcagggaaaaaaaacctgtttcctgaaagagcttctctagctcttcagttcaaatcaatttttttccaacatctaaatataggcaactatgaacttacaaccaaattagcctctaatttcttatttttaaattgttaatatgctcacacggttcaaaaagtttaaaaaaaaagtacactttgaaaaagctcccttccacttttatccccattcaaccagttcctatacctctaccaggaaaccactgttattagtttttttctttagagatttttaaaaatacaagttcgtatgtatttatttccttccttcttcactgatatcaatagtaacagtccatacatactattttgcactttgctttttctcacttggcaacatatcttggaaaaatttccatatcggtaaacactgatctttttcattcttttttaaagtataaaattccattttacggctgcatcagacttcattcacccaccccatcccctgttgaaggacatgtaggttttcagtctactgcctatacaaaaaaaattgtaaaaataattttgaacagatgttatttcacaggtgcattaattagctattgctttaacattactacctaaccaaccggctaaaacaagcatttattttttgttcacaggtctgaggatggactggtttggtggatgtaggctaggctcagttgagtggctctacaataggttgcagaatgagctcaagtctgttgaacaaacttctaatcttccttggatcagcagctcttctaatggcaagagtgcaggtgcaagctaaaccatttaagcattatgaactattcatttatatcctttgcccagttttttgttggtttcttttaagcttttaaggcatctggactttgtatcagttacaaaagggttttcccactgtaagttgacttccaacaatttttagtttttttatattgaaatttttgagctacttataatgcattccttggtgtatgatatatggatccgacttaattttttttcccaaatggctatcaattaatgaataatctatcttttctttacaaatttgaaggaccatctttattgtattctaacttctgtatgtatttgggactcttgatggattttctattctatttcactgggctgacaattcacacagttttaattactatggcattataatatgttttactatcttatagtaagatagtaaaatcttaaattccactttctgctttttggaattttcctggctactcttgtctgtttttatgtttccatacaaattttaaaatcatcttacctaatttaaacatgaaaatgtactcttgatagtcttattaggattgtgttaaatctagaaattaacacagaggcctgatatccttgtgattttgaatcttttccatttaagtatgcttctccattttttcaagtatttgtttgtgtccttcaagtctgatttacaagttttcttaggccgggtgtggtggctcacacttgtaatcccagaactttgggaggccgaggtgggcgggtcacttgaggccaagagttggagaccagcctgaccaacatggcgaaactctgtctctactaaaaatacaaaaattagctgggcgtgatggtgcatgtctgtaatcccagctacttgggaggctgaggcatgagaattgcttgagcccaggaggtggaggttgcattgagctgagatcgtgccactgcactccagcctgggagacagagtgagagtctgccttagaaaaaaaaaaaaaaaaaagttttctttatatcagtcttgtacaaatctttgttgagtttcttcctagatatcacatcttttaggttattataaatggagtctttttgtctactaaatattttaacttgtttttattaatattttaacttttaaaaattaatatctgcatattaattttgtaccacattatctttcttaatttccttattttgaaagtttaaatggtttttatggaattctcatgggctttcctgctgtacaatcccatcaattgtataattttcattttttaattgatgctattgtagactaaaataaaaattaagcagatacagatgctgatttctatgttaaacttttatcagaaaatcacaattaatgattcattattattaataatgaatataattactttatcaatttctaaaaatgcctggtagtactttttaaacctgtaaaataggaagacattaagactaacatatttcatgagttttaattacctgcagcgcctgtttgagcagctctttcactgcctgcaagatcaaccaaattctgtaagatagataaaaataaatccttagggcagataatttgaaataataaaattcaaactactgaaagaacatttttaatacatggtatatctgaatattcgatctgtatccatgtctcccatgctactgtttaggcattcccttttttctctgagtcaaactgttctctatctgttcctttctttatatcttccataatgccaccagtataggttctgtttcctatacaaggtccaaaaacttactatggcaaatataattctttataagctggcacttgcactgctccaactttgtatttatccatcccttattcttacctctagctgaactactcactattccccaaacaccccatgtacttctacacctccaagcaccagctttttgctatttcctttattcagttagttctaatgttctattctgtccttattctttattcaagaaccaggcacaaagattatctcctcagcatagctttgcctactttatccttcctccccgccagatttcagatgaactgctccttgaactgcataaccagaaatctttataaacatgacttatagatacgacttacatttatagcacttattttgttgggctagtcatgcatgctagctgtactatgctgtagcaataccatgactttactgtggcatctttaagagctggacctctctttcatttcacaaatattactgaaaagaagtggctgcttattatgctccaggaagtacatcaggtgctagggctacaaataaataaggtctctgctctcatggagcttacattctacatagaggaggaggctggtaagaagagataaaaagacaaataagaaacatgttgtgataagtgtaacagagattatttaaatagagctggaaaaggggccagtagctttaggttcataggactggatagcagtggaaggcttgtcattaagctgcgatctgaatgacctgagaagaggaagctggtcccaaaaagatcaagggaaacagtagtctagacaaaaagaatagccaaaacacttagtcacaaagcagaatgtgctcagtgtgttcaaaaaaatagaaaaggcagtgtggcacagttggtgaagtgaagacaggaaaagacagaataagagaagtagacaggggccagattatgcaggactttttaagtgagatctaaaactctgaaatgtttatattcaatgagaagccattgcagggctttatgcaagggagtaatagaaccctgccttgctagattggggaagttctcctggataatatcctgcagagtgttttcctactttgttccattctccctgtcactttcaggcacaccaatcagacgtagatttggtcttttcacatagtcccatatttcttggaggtttgttcattacgttttatcaaattcaggaaatacagagaatgccacaaagatactcctcaagaagagcaactccaagacacataattgtcagattcaccaaagttgaaatgaaggaaaaaatgttaagggcagccagagagaaaggtcaggctacccacaaagggaagcccatcagactaacagctgatctctcagcagaaactctacaagccagaagagagtgggggccaatattcaacattcttaaagaaaagaatattcaacccagaatttcatatccagccaaactaagcttcataagtgaaggagaaataaaatactttacagacaagcaaatgctgagagattttgtcaccaccaggcctgccttacaagagctcctgaaggaagcactaaacatggaaaggaacaaccggtaatagccactgcaaaaacatgccaaattgtaaagaccattgaggctaggaagaaactgcatcaactaacaagcaaaataatcagctaacatcataatgacaggatcaaattcacacataacaatattaactttaaatgtaaataggctaaatgctccaatgaaaagacacagactggcaaattggatagtcaagacccatcagtgtgctgtattcaggaaacccatctcatgtgcagagacacacataggctcaaaataaagggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagtcctcagagacctacaaagagacttagactcccacacaataataatgggagactttaacaccccactgtcaacgttagacagatcaacgagacagaaagttaacaaagatatccaggaattgaactcagctctgcaccaagcagacctaatagacatctatagaactctccaccccaaatcaacagaatatacattcttctcagcacatcacacttattccaaaattgaccacatagttggaagtaaagcactcctcagcaaatgtaaaagaacagaaatgataacaaactgtctctcagaccacagtgcaatcaaactagaactcaggattaagaaactcactcaaaaccgctcaactgcatggaaactgaacaacctgctcctgaatgactactgggtacataacaaaatgaaggcagaaataaagatgttctttgaaaccaatgagaacaaagacacaacataccagaatctctgggacacatttaaagcagtgtgtagagggaaacttatagcactaaacgcccacaagagaaagcaggaaagatctaaaattgacaccctaacatcacaattaaaagaactagaaaagcaagatcaaacacattcaaaagctagcagacggcaagcaataactaagatcagagcagaactgaaggagacagagacacaaaaaacccttcaaaaaatcaatgaatccaggagctggttttttgaaaagaccaacaaaattgatagaccgctagcaagactaataaagaagaaaagagagaagaatcaaatagacccaataaaaaatgataaaggggatatcatcaccgatcccacagaaatacaaactaccatcagagaatactataaacacctctatgcaaataaactagaaaatctagaagaaatggataaattgctggacacatacaccctcccaagactaaatcaggaagaagtgaatctctgaatagaccaaaacaggctctgaaattgaggcaataattaacagcctaccaaccaaaagaagcccaggaccagatggattcacagccgaattctaccagaggtactaggaggagctggtaccattccttctgaaactattctaatcaatacaaaacaagggaatcctccctaactcattttatgaggccagcatcatcctgaaaccaaagcctggcagagacacaacaacaaaagagaatttcagaccaatacccctgatgaacatcgatacaaaaatcctcaataaaatactggcaaacagaatccagcagcacatcaaaaagcttatccaccatgatcaagtgggcttcatctctgggatgcaaggctggtttaacatacaaaaatcaataaacgtaatccagcctataaacagaaccaaagacaaaaaccacatgattatctcaatagatgcagaaaaggcctttaacaaaattcaacaacacttcatgctaaaaactctcaataagttaggtattgatgggacgtatctcaaaataataacagctatctatgacaaacccacaggcaatatcatactgaatgggcaaaaactcgaagcattccctttaaaaactggcacaagacaaggatgccctctctcaccactcctattcaacatagtgttggaagttctggccagagcaatcaggcaggaggaggaaataaagggtattcaattaggaaaagaggaagtcaaattgtccctgtttgcagatgacatgattgtgtatctagaaaaccccatcgtctcagcccaaaatctccttaggctgataagcaacttcagcaaagtctcaggatacaaaatcaatgtgcaaaaatcacaagcattcttatacaccaataacagacaaacagagagacaaatcatgagtgaattcccattcacaattgcttcaaagagaataaaatacctaggaatccaacttataagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttatagattcattgccatccccatcagctaccaatgacttttcttcacagaactggaaaaaactactttaaggttcatatggaaccaaaaaagagcccgcattgccaagtcaatcctaagccaaaagagcaaagctggaggcatcatgctacctgacttcaaactatactacaaggctacagtaaccaaaacagcatggtactagtaccaaaacagagatatagaccaatggaaaggaacagagccctcagaaataatgccacatatctacaactatctgatctttgacaaacctgataaaaacaagaaatggagaaaggattgcctatttaataaatggtgctgggaaaactggctagccatatgtagaaagctgaaaccagatcccttccttacaccttatacaaaaattaattcaagatggattaaagacttaaatgtgagacctaaaaccataaaaaccctagaagaaaacctaggcaataccattcaggacataggcatgggcaaggacttcatgtctaaaacaccaaaagcaatgacaacaaaagccaaaattgacaaaatgggatctaagtaaactaaagagcttctgtacagcaaaagaaactaccatcagagtgaacaggcaacctatagaaagggagaaaatttttgcaatctactcatctgacaaagggctaatatccagaatatataaagaactcaaacaaatttagaaaaaaaaaaaacaaacaaccacatcgacaagtgggcgaaggatatgaacagacacttctcaaaagaagacatttatgcagccaaaagacacacgaaaaaatgctcatcatcactggccatcagagaaatgcaaatcaaaaccacaatgagataccatctcacaccagttagaatggcaatcgttaaaaagtcagggaacaacaggtgctggagaggatgtggagaaataggaacacttttacactgttggtgggactgtaaactacttcagccattgtggaagacagtgtggtgattcctcagggatctagaactagaaataccatttgacccagccatcccattactgggtatatacccaaaggattataaaatcatgctgctataaagacacatgcacacgtatatttattgtagcactattcacaatagcaaagacttggaaccaacccaaatgtccaacaatggtagactggattaagaaaatgtggcacatatacaccatgaaattctatgcagccataaaaaatgatgagttcatgtcctttgtagggacatggatgaagctggaaaccatcattctcagcaaactatcgcaaggacaaaaaaccaaacaccgcatgttctcactcataggttggaactgaacaatgagaacacgtggacacaggaaggggaacatcacacaccggggcctgttgtggggtggggggagggggggatagcattaggagatatacctaatgtaaatgacgagttaatgggtgcagtataccaacatggcacatgtatacatatgtaacaaacgtgcatgttgtgcacatgtaccctaaaacttaaagtataataaaaaaataaataaaaataaaaaaacgtaaaactggaaaaaaaaagagaaccttgcataaagctcagcaatgactctcacaatggatccactatgactactgggtggaggatggattgggaaggggcaagagcagctgcaggcagccccatcaggcagctggggcaggaatctcggtgagagataataccagcttgggttagggaggtggcagaggagactgcttgtaagagaagcagtgaaggggtgtcttgtttattgtttttttaatctcagagcccaacaccatgctcagaagacaataacaacttagtaaatattgtgagtgatttgaaagaaagtcaaagctttacgttatttctctctgtggagatttttgagactaggcaggtaaatatgtattaccagttaaggaggctaatttttcttgcacagtgtccactacagatgacacagatacataataaaagggcaaagtggtaatgaaggcagcatgagtgaaggttaaagatgagaacaagcattcatattcaaagatactcagaggcccaatctatgagggaggagttcatgtagagcagaaggaaataaagttagattggttaagagtggccaaatcttgccccaggaagtgatatacaaaagcaatggttagtatattcgaaatccttatgatgacttcaagaaacaaagacaagggtcatggagacaaggttccaggagactgacatagtaattcaagagagatgagaaagtaaatgagtgtagcacccatggaaatgtttaaaggtaggatcagtaagaaatgggacaagtggacaaagagaaaggcagaaaaagatgagtcaaaattgacttaggtttccagcttaggcagctaggataatgctggttttactggaaataaggaatattcactatggtaggaagaaaatagtttcgttttagacatattaaagtttgagataatgatgggacacaattataaccatctttaggaagacatgaattagaattcagagactataggtaaaatatttggcagtcatcaacatggaaatgatgacagaacatttgagagcaagaacttgagtaagaaacgtcacagaatacctccaagtttttttttttttaattatttttttaggagggtagggaaaaagaagccagggtagaaaacagaggagtacagctaagagaaactggatattatcatcccaccaaggccaggagataatcagaaaagagccacctctaaagagacagagatgactctttagagacttctttccaagaagattcttagagtaagtgggtaggctggagggttggaacagatggaacacaaatgacagagcatcacgtaacatgaggaaaatcatcaagtagatcactgaatatgccaagagtattaaagctaaattattaaaagttaaaattatatgaaatatcacagtcttggatgagaaaactaaagaggttagggtttggttttttattgttaaattaaaacaagattaaagtctactaaaataagttatacaattttatagcaaaatagctaaggtgaaattaggattgaatattaagtaattaataatctaattttataaaatctgaaaatgaataaacatattatagattgcttttttccctgaagttttctaatcaaataatcttaaatcatatcccacatcaagctaaagaatttaggccctaaaaatgcagaataaagcaatatggtaaaagatagaaaaggagcaagaaagaaacagcaataatttagtgtggaaagaaggaagtgaaggtttactaatgtggaatataggaatgtttgcataatgcatatattcgcttattcagcaaatctatattagacataaaataggtataatgtgttggggctaccaggatgaatgcagtatcactcctcaatggatttacagtctaaagtactacgtttacaatacaaaatatattttattgttgtacttaagtaaaacctaaagtaatgtgattactttttaaccatccaacctagatttttgttgatcacataagtctaaattacattggctgagattttacaaaaagaccctcaaattctaagatgatctaaagtgttaaatgtgtatagaaaaaaattctactgcattagtggttagaaaaaacatcaattcctataaccctatagccctgacatttaaattttaggagatggcaaccatgacataacaggaagaaagatcctctgaatttttcctacgacattttagctaggaatttgatgatactgacaagactaagcagacaatttgtagatttcctcccacatttagtttagttaacagttcttattaaaccaaacatccagcaactaaattaaattttgttttggcccatacagtacattattatggttcattaatactcaccaaatgggataccttaacagatccttcacaattagaaggttcacccttctctctgctttccaaaatctagatagaaaaggcaagctgtagaaaaattagtgcattcttacttggaaagatctaacagatagatagaattacctaccatcctaaagatggtatgagaacgactgcttctttgattcatttttgtttctccataatgcctgctctctgtaaaaatgagttatatttcagctgcatatataataaaatccatagaaacacaataatttttattttaacttaaaaaagtatgatttgaggtccaaacgtgcttgattgaaaagatagtttttacaagtgttctaaagaaatacagcataaagtcttactttctccctttgtaatccatttcaaagccatttctgatgtatatacaacttcttctgtgagatcagcaacatacacattcctctgaaacaagtttaattatggaaagattagagaaatagaagtcacaagtttgcttttcaaaagaaggtgcaaactattatagaattcatttgtgaaagttaaaagtggcaaatggaaccataattctgtaggaatgtaacaaataattctatgaatacccacaatttatttcacataccaaagcacaacaaattctaacctgatacttccaacttgctatttttacacttaaaccaaaatattagagctgtcagtattttaaaactattcatattgtttaaaagatgaatataaatacttcaaaaaaaccctcacatactatagaaataggagacactttaaaaactatagaaattaaaggtaaacattcaagaacaataatctcaataagtcagtcaattttaaagctcccttaagtctgctactcacattgacatcttctcgaataattaaaggtttcattttttgagtgccacagagtaaatctgtaatggtttcattgtatatttccatgtaagatacacgtaagagaaattccctatcaggaaactagaagaaaaaaaattatataaaaacaccaggaagcatccaattgtgaaaacctaatgctaaatgctcatgtgcttaaagaggtaaaatgtatgtaaaacaaactaagaaaccccttggttctactgttgacaaaataatgaacacaaaaatataaaagcatcgttacagaaataatgaaaagtgaagtaccataaagctgggagaacaccaactctaggctcaaactctaggctcaaaataaaaccctctcaaaagatgttcttattttaataaaaatgctaatttgaaaccaactaactcggttgcctattctggctttctgcttcccttctttttttacctacatccactttctactgttcctttataatcactgatagttaaatggttaggtggagctaaccattctgataacattttcttgttccttaatgcctactttttgttgagagtattattgttgcagaattcaagagaaagaataaaagaactttaagctttataaagtaagttgtggagataaaagtgaatctatgctatgcctttcttctttccccatggataatcaaacaataactgtaaatctacttcctttcatctttacaagagaaatacactaagactggtacccagtttttactagttttacctgtacgtactagaaatccagttaagttacttaccttcttaattttttggaaaatgtcatgaattgccctgggtataactcccaaatgatcttctgaacccatcatggtatatgtttttcctgaagcagtctgtccataggcaaatatagtacctgcaaaaaacaaaacacacatacgcaaagattaaaaacaaacctataatgggtaaaactatgcatgcttgttgcacagacgcccaagactaaaatgtttctgcagcattgagtgaatacaaaccattgtagccttgtatggcagaatcgatgattggtgctgctatttcttcatacacatttttggtagtttcattaccatgaaagacacgatctaaacaacaacaacaacaacaacaacacagaagttaaatcaaatgagtccactgtgttttcattccaaattagtaattattcccaaaagtaaaactgtcagaatgtaggatgatcaactatttaagacacagtatttttttcaactttttggttctctgaaaatacccttccctaaggtaaaatgagttcattttcacacacaaaaaatacactacaagtcaacttttctatgttctttcaagaggcaataaggtatagtgtttgcacatgggggtctggaatctacctagatgcaaattagataactgtgattataactgttttaaatgccaattggttaccttacttaaatacatgatggataaacaattttgtttccagtgaagcagtttatagaaggcttagtctaatctttagtgacaaatctaatattattgataagccttttgtacttttaatagcaaaaggataacaaggtaacttttgatgctattataagcttaccaaaattgaaggatttacttccatcaacttgataaatgacattattgtcagttttccagtaaacttgggcagtttctccaagtgattcttctctaaaagaataaaaacaccgcattttaaccagtcataaaagtcatgtcataggaggaataattgaaaagatttcacctgctaaagaatattttgaaagatagtaacataagagaatgacagaaagtccatctttgaggattcaactcttaaatggagcttcagtgaccttctgccgcctcaaaagtgttttcttgtgaaggctttcattctcaccctctcccccagtactggtaaacaaagggatggattcaaaatgcaactctgattatgtctgtcttgcttaaaattcttaaaaccttttggaaacttatgaaatcctcagcagggcacgagtcctagatcatgtcatttctctcttccattttcctctgaattcctagatacatcctaagctctacctgaaggtcttccccaaatgacagatgtaacctctctgtgcctggaatactctgacttccctttccattaagtaacatagggattatttcactcatgaaaagcgtcaagacttttctgacaccagttcaccccacgggaagctttcgtctctgatgggctaataactcctctagcaaacattctctacctgcccatcataacacttgtcaaaaggtatcctaatggtttctttatgtagccgtttaaggcattagataatgagctcctcaaaaataggaaattcctgatcttggtatttgcatttattaaaccccgtgttcaataaaaatttctcacacacacaaagtgttagcatttcgggtcgagggccagaagctagtgaagcaaaccgatttcatttattcctcttcctgctttttctccctagcacttattacctacatatcaccacttaacatcctacattttcaactttactttctgtctcgtcccattagaatggaagagccactgggcaatgacgggagtgtctgtgttgtacaaagtcactaaaaaaaaattgataaatatttgtagaatgatcttgagtgacgattgaatgtaatgtgacaagacagactagcccttgtcttcagagggtctggagacagcagttaggtgtaaaatgactaactgtgatgagggccaggaaggcacggtcccatacgacttctctaggcggggaatggggcagggaggagcagatgccgcaaggcagagcagcacagaagggaaggtctgtatgtcagcgagactgagttaaatttaagtgaatctcgcagctggaaagtatcttctagatctccgatcctcccctgtcactttacagaccctgaaacgatggccagcagccgagtcactagacagcagagccgggaagcagcggctcctggaaacatcgtaggcctcgcccctccggctcagggcggcgccgcaggcccagcgggcaccgggccgtggtgtggcccccctacctgctgttcagcggccgcactcgcacgcagacggccacggctccttcctccgccatcctatcaggctgaactggtcccaggaaaatggccaggaccctccgcggccggcacttcagggctcacaggccgccccgcctttaaatttaaaatttcccaaacgccgcatctgattgagccgtggcctcgtgacgtcatgggccattccacgtgcggagcagcgcgggggacgcaaggcgggcggcgtgaccactgctaaacaggagaggggatttaaagggcccagcagagagtcggaggagagggccgaagggaggggctcccaggagtgggcagagagtggtggtcctggaataccagaatactattatctgccaaaagctagcgaacgtcatcctccaccccatccttaaaaagtttggaacctgtagacgaaactaggtagagatacatgtatttttcactacccaaacagaattgccgtcttttaaagaaactgcaccaacagtttaaaataaactttcaacagcaagagttgaaattcgctgtccagtccagaaacgtgacaagcctgttgtgcgccttagaaaatctgagtttaggcttttctcctgtttctctctctctgtaactcgtttccattagctgtggcttcctcagaggttgaattagggaaaataaataccgaggactgaaaaactcattgagtaatgggttgatactttttttttcttcttttttttggaaacggagtctcgctctgtcaccccaggctggagtgcagtggtgcttatctctgctcattgcagcctccacctcctgcattcaagtgattctcctgcctcagcctccccagtagctgggattacaaggtgcccgccaccacgcccaggtaatttttgtatttttagtagagacggggcttcgccatgttggcaaggctggtctcaaagtcctgacctcaggtgatccacttgcctcggtctccaaaagtgctgggattaaaggcgtgagccaccgctcctggcctggtttgttacttttattaactaagagggaaagctattctaaatacagtgattttttcccaaaaataatgcttattttccctttcttctctctctctcttttttttttttttttttttttaaataaacatgagttcttgctttgtcacctaggctagagtgcagtaggctgaacacagctcactgcaggctcaactcctggcctcagcccaagtggggttcccaccttaacctcctgagtagcttggattacaggcacatcacaagcccagataatttttaaatttttttgtagagacggggtggtggggggattagggtagggagtggggtctcacagtgttgcctaggcaggtcttgaactcctaggctcaagcaatcctccttgccttggcctcccaaagtgctgggattacaagcatgagccatcgtgcctggcctagctttttatgtgtactttagaaagctatccaagatgtttcatttattaagagaaattcaaggtgcacggttatgtacacagaatatgtctggatatacatacataatttttggaaagatacacagaatatgcctaatttccttgcagagtgaggactgagttagatggtagactgagttagatgaaagtagtttctttcaatttaaagaaactagtttatagataagaacagtaaagaaaaatgagtctattcattcaagatttgttttggttaactagctgtgaggtagtataaacaactcttttttattgctagactgtaaagatacttggttgtatctagtaagaaaatacagagttaaggaaggtatattttaactgttgtttttgttttaattgtgggcaaatatgagacagctgaaggcaaggaacctatgaagaagaagggagatgtgattaatcaaaatttctaatgagacaagaggagattggttcacgagtaaagagaagtcatcagcctttcatagttgtgcttatgatcgttgctatgactgtctttttttatcatcacagcaggtgacatttattgaagatttactatatgccaggctctctattatatgctctctatccaattttttcatctgactttccaaattgttcatcaagaaatattcattgaacaactgttatgtgccagatacggttctaaggtcaggaagcacaacagtaaatagaatagacacagtacctgttgttgtagagttgctattctcttagaggagatgggtaatacagaaaaatctcagtctctctctctctctctctacacacacacacacacacacacacacacacacacacacacacacataatgtaatgattaataggatcaggagacagagagagagtgataaggtgggttaagagtgctagtttcttatgaaacacattcttgtgggaagcagcagacaatacataacaaatatatagtaaaataatgtgttgggaggaaggtttattttagatgagatgttcaagaaagacctgaggaggtgacctttgaagtgaaacctatgtgagaagagtgagccagacttgggaggacaagagaaagggcgtaccagacagaggaacaagtaagtcaaagaagccaaggcttgatcgagtttgtcatctgtctgagacacaaaggggagggccctgtgactgaagcatttgtggcaatggagagaggtaggcaggtccaggtccaggacccatggggccttgtgggctgtgataaaatgtttggatcttattctcaagggtgaggggaagcctatggagggttttaagcaagggggtaaaaagggattcattaattccttcaaacaagacactctttatttcactatgaaaatagaagcttccagaaaagactttgccctaattcctgtcaatctggctactcactatgtgcatttgtgcttgcatactcgccttccagactgtaactttataaacatctgtgtgttttccactctggaaactctccatgtgtgcactggatacagtcctctccttctcactctctgtcctgcttgtcattttctcctgctctagaaaaccagtcttaacagcaaacatatgccttaattcctcccatattgagtgtctaatatatatggcaaacttaaaatgtctaataccaaattcatgctcttcccctcaaaatctgctcaatcagcagttttctgcttctcagttgttggcaagtccatccttccagttatccaggtgcagactctggagccatgctgctcagcttctcacctgaaaattctgtcagggccaccttgagaaaatttcagactatgaaaagtttgtcacaacttacgcttcagctacctggtccgaaatatcatcatctggcactgagctaatctcagtgtttccacccttgcccacccccactgccagtctgttctcaacacagcaatttgaatgattctgtgaaaatgtgtcagatcatgtcactcctctctcaagacccccagtgccacaccttcacccccaccctctgatttctctcagaacaaaacccaacgtctttcagttgtctcccaagcctcacatgatcttgccctttgtttgtgctctggccttacctcctaccactgtccctcccctttgctctccccactccagccacacgggccatgggcagtttcctgaatcccagacaaaccccctcttgagacctttgcactggctgctgtgtctggatggaaggctttcactccagatatacatgtttccctccttcccattgattccagtgtttactcaaatgtcaccctctcatagctctctctctataaaacaccaactccattgtatgttacttctatttcttaaatcttcttcttaaattagttacaagattatttgtaacttttagacataatatgtgtatgagtattaatttatgtatatatgtctcctcccactagagtgacatagtttttgtttactccttgtcccctgtgtgtacaaagatgcttggcatagagtaaacgttcaattaaaaattacttattacttaagtattactcaaatacttattggcataatttctggaaagatacacagaatacacctagctttctttggagggaaaggactgagttggaaaacagattcacctttcattttatattatttcataacaatattttaaccacatgaatattagtttctctcaagttaaagaaattagttgacataaatcagtgtgtaaaatggagtctactcattcagatttgttttggttatctagctctgagctcatagagattatcctttttcatgactaaattgtgaagaggcagggctgcttctaataagataatccagagtattgtggtgtatacatactatggaatactactcagccatgaaaaggaatgaaataatgggattcacagcaacctggatggaattggagaccattattctaagtgaagtaactcagaaatggaaaaccaaacgtcatatgttctcacttataagtgagagctaagctatgaggactcaaaggcataagaatgatacaatgaactttggggacttgggggaaagggtgggagggggtgagagatgaaagtctacacattgggtacagtgtacactgcttggttgatggctgcaccaaaatctcagaaataaccactaaagaacttattcatgaaataaataaattaaaaatcaataaataaaataaaaggataataaccaacatgcatggaactggaggccattgtcccaagtgaaatgactcagaaacaggaagtcaaaaactgcatgttgtcacttataagtgagagttaatcaatgagtacacatgaacattgtaatagtctgttctcatggtgctataaagaaatacccgagactgggtgatttatagagaggtttaattgattcacagttctgcatggctagggagccttcagaaaacacaatcatggtggaaggcgaagcagaagcaggcaccttttccacaaggaggcaggagagtgagtgggagcaggggaaatgccagacacttataaaaccatcagatctcttgagaactcactcagtaacagagaacagcatgagagaaaccatccccatgatccagtcacttcaggtccttaccatgacacatggggattatggggattaaaattcaagatgagatgtggtggggacacagccaaaccatatcagacatatagagtgaataatagacactggcaactccaaaaggtgggagagtgtgaggggactgagggatgcaatactaaccatttggtacaatgttcactatttgggttatgggaacactaaaaacccaaatttcatcactacgcaatatatccatgtaacacaactgcatgacatgcacagatgtaccccctaaatctagaaaatatttcaaaaagagaaaaaagaaataaacatgttctaataaaaaagagatggatcaagtaaatctgactaaaaaaaagttaaaaaatataaaaataaaaagaaattgagtggtaagggaaagcataaagattaaataacctatctaaagttatggaacttctggcaagagaggcttaacatttggatgcctaccatttctctgataggcaatcgaaattttttgttaatttttttttttacctgaaagattaatacctgcatatggtcaaaagattcaaatgaacagaagattcacagtgaaaaacaaatcttcctacattgactcctaaggtgtcatttcacctccccagaggcaactgtgccatttcctaaagtgttctcatcaaaataatttacagataggcacacatatacatctttttctatattgcatatcttttacacaaaaaggtacctgtcatacatgctgtagtgaactgtgcttaaatatgatctttatgtaagtgttttcattcagtttaggaagaaaagtgaatttctgaggcatattaattgcacacacttttatgttgatgtttcaattactgtttttttccccaactgtgttatttatgctgaagctgcagagggcactgtaatctttcccaaaacatggcatagccttgaatggtattttgaagagtgtgaatatggtgcaaactgtaggattcggagaagctactgatattaaaaatatacatcaattcaaattactcacctgttctctctcattttaatgcatttcatagaaaattaatagtaatatacttattacatataatcaccttcaatggggtaatttttatttcaaattttattttaggtacaggaagtacatgtgcagatttgtcacatgggaatattgtgtgatgctgaagtttggggtatggatatcatccatagtgagcatagtgcctgataggtagtttttcaactccctcctccctccctctctctcccttctagtagaccacagtgtctattgttcccatatttatgtccatgtgtggtaaatgtttagctctgcttataagtaagaacatgcagtattttattttctgttcctgcattaagttgcttaggattatggcctaaataggagtaatttttgtttaacagagagaatgcctaattttcaaagcatctatttgaaagacatctatttggagacatctatttgtaatgatcacagacatagtatttctcaccttttaatcacagtaacaggggatttgtatggcatcatgggaactgctctggcctgggtcagtccaaagactatttctaagctatgctgcattggaaaatcatttatctctgtgtgtcaccattttctcatccatacaatgagataattggatgagaaaatttctaagggtttttttcagcttcaataattctataatgtcttcattaaggaaagaaaattgaatcgctaagagaatagattttaagttactcacacaaaaatatgtgaggtaatgcatatattaattagcttgatttagccattccacaatatatacatactattaaactcatattgtaccccataaatataagtactttttgtcagttaaaaaaaataaaaaaatttttaaaggaaacttgttcaaattgagtatggatgagtgtaaaattgaatacagatttgtgagggagtaggaaaagtgatctgtgttaccaagaaaatctaagatagtcacaatgtggcagaggatgatggcagcccaccaaaatctattctcttctttctggccagaaagcaagattacattcccagcctgccttgcagttaagggccacttctaggcctatatagaattccaggggtgcacttttcctgcctcatccttggtgagcatcctttctccttttcttcattgattcttccaaatcctgaccactttcttcaagcccaggtttcatcttcatctttattgagaaatcaggaccatcaggcaagatgtctcaacttccaggtttcccaccctacctcctgcacttctactgatttatatcctcaccaactcttccctcttttcatgcacgtccagagtgaagtgtctgtggtgtctgagatgagcccttccatttatgtccttggctcctttctctccagtgtcctctacatccttgctcaggcagttattttctctcttatttcagaaaaatgctagaaaataacaaaaagaatcatctgtaatttcaccttaaaaattatctaaattgcctagtgaatgttccttctattacccagtcatcaaatttcatcttccctaaggtaatctatgttaattaaatttatatttcttgaatatatgcaataaatctatgtggataaccagatgttttcatattttcaagaataagattattctgtaattgatctaaaatttgctttttacactaacaaatcaatatatagatctgccttttatattggctgcataatattcaattatatggcagcattatagtttattcaaccatttctttcttttcttttctgttttttgttttgttttgtttttttttggagatggagccttcctctgtcacccaggctggagtgcagtggtgcgatatcggctcactgcaacctctgcctcccgggttcaagtgattctcctgcctcagcctccccagtagtggggattacaggcacccgccaccatgcccagctaatttttgtatttttaatagaaacaggatttcgccatgttggccaggctggtcttgaacccttgacctcaggcaatccacctgcctcggcctcccaaagtgctgggattacatgtgtaggctaccgcacccggcctcaatcatttctttatgtatatttagattgtttctaattttcaatattgcttataatacaaaaatccatctgcatatgtctttccatacttacgcttttattttcataaactagattgctagaagctaaaatgccgactcaaatgatgtgcttgttttgaattataacaagtactaccaaattacttctcaaataatttgtaccaattatattacaaccaagagtctgtgagtgtccacttccccatttcttcatcatcactgggtacaaatcaatatttctaatttttgtcaattttataggaaaaagatattttattttcatgtgcaattccctgattactagtaggattgagcatctcatcactgtttattggtaatatttatatcttattttttgcattgtacatttgtactgtgtagtcctttgctcctttgcccagttttttttcatatggattgtccttctaattgacgtgttataagtctttaagtattacagattacctatctagcaaatatttccatttggtcagtcatcatcttctaaattgtctttgtgtaaggtttctttatagcgtccttgtttttgtccatttgggaaattcttccctactttgaggttataaacatgttttattactttttcttttaacttttgttattttatttctttcatttacaaatttaattctttcttgtggcttttgtttttaactctcttgatgggtctgtccactcagtgtataaatattttaggtcttttttttaatatatataatttgaaagcttttctttgtgttaccctgcatgtatctgaaagcctttctcatttctttcttttagtctatgaagtaattatatttactgtctcacttctttgttttccatttaatcttcatatacttataatttggcttacaatcctactgtcatgttaatacaattaatctatgtgcaccacagtaagtaaatttctgaaccaaatggacatttttcagtgctttggggcatttttagtgcctttgggcattaggtagtctccaaagatggctgctttgattttctcccctcgctgttgtgcattcaccactctaaccatcaaaagatggattcgatttaccctcgtctttaatctggtcctctttcttcctagcacagtagtctcaggatagctaaatttcttacatgatggctggctttgcagaataagatggaagctgctaggcctctgaaagtttaggcccagagctggcagagtcattcccaccgtaatctcttgggctaacttcacaagcccaagctagccacgtgacgaggccacatggaggagctctaacatgccagacacgagtgaagcctctttgaccttccaggttagaccagtttctgatcaatgctgctttgtaaatttccctggctaatgctgcatagagccaaagaagcatccaactaactccagttgatcccctaaattgtgagaaataataaaattcagtctctttggtgaatagttctaatgaagtttgacaaatacacggaattgtgtgatactcaccagaacagttccatcatcctccaaaattcttttgtgctgcttgtttgtagtcaaccctcccttacatccaagatttggaaaccactgatctgttttgtgtgctacttttgccttctccagaatgacataaatggaattttacagtttatagctttttgagcctgatttctttcacttacgttaatggatttcagattcattgtgttattgtatcagtactttgttccttttaattggtgagtaggattctgttttttggatttatcacagtttgttttattcaatcaccagctgaaggacatttgggacatttgttttcagtgcttagaaattttgaatatagctgctagaaacgtttatacactggattttgtgtgaacatcactttttatttctcttggataaaatatctaaaatttaattttataagaaattgccaaactgttttccaaagtggctataccttacattcccaccagtagtgaatgagttccaattgcttcacacatcctcatttgagtttggtatggtcattaaagaaaacccctagacattctaataggtatatagtagtatatcattgtggtattaatttgcatttccttagtaattaacgatgttgagcatatttgcatgtgcttacttgccatatatatatatatatcttcttggtgaagtacctgtttagatagtttgctcacttcaaaaaatttgattgttttcttacttttgagtcttgagagttctcaatatattctggattcaagtcctttactaaatatagagtttgcaaacatattctctcagtttgtggtttttcttaacagtgcttttctcttaacagtggcttacacacatcaaatgtttataattttttgaagcccagattgtaatttttttctttcatgaattgtacttttggtataatatctaagaactcttggcatgacccagagttacaaaaattttcttctacgcttacttttaaagttttataggtttacattttaaagtagatctatggtctattttgtgttaatttttatataaggtgtgagatataggttgatatttactttggggcatatggatagtcatttgttccagctcatttgttgaaaaaattgtctttactccattgaatcacttgtgtaccattgtaaaaaaagtcatttgatcttacttatctggttatattcctggactctgtattccatttcattgatgaatgtgtctatctttagttgttactgttttaagccattaaattttgtatttgtttgttatacagcaaaatgtaacaatatgtgacacagtcactgtgaagaactttgaaagggctgaaattttactcctcttgaaagctaacaagttagtctgccacagtttcatgaatcctggtggaagactcaagacttctgggacaaggatgaagaaaaatttactaatcaaaccaatagccatagccaaagtatttgcatttttgtgttggttttctaaaccccaattcccataaggtgatgcaaagagggccaggtaacacctatacacacaggtataatttaatcactgatgcacaagagatacagtaataccactattagtataagtggtaagtgacatagtagttccactgatgtatttcagcctccccttctttctgtggctgattttttttccagaatgaggtcagacattatcttccaagcagcctctggttattttatcttctgagttcctgtagcatcatatgtagtattatgactgagtattttatcttccttattaggcagtgagctcttcgagagtaggctctaactcattttccttatactctaatttgtcaaactattaaaacatttgatgtacttccttttgaagcatctgttgatacagttaccatgccttcactatcttgatgatttcacaagaaatggaacaaatggaatacttgtaataaaaggccctatttttcttgatgatcgtttcccaaagaagttatttctgttctgaaggaagtagctgaaaatacctatgaagtaactgctttcctgaaaatagtacttgttatagtataagtagaaggggccttaacatataatttttaaaaggcttatagctgtgggtaatacgaagtctctaaaatacgtgcatgccagtaatattgagaacaatgccattttattccaggatccaagaagggcattgcataattagcagaacaaattgacaagcagggcacatagtttacatttccatggtaggtaagaatgactattttgattacaatttcatgtgttttgtttacttttttttggtggggggacagagtttcactcctgttgcccaggctggagtgcaatggcatgatgttggctcaccacaacctctgcctcccaggttcaagtggttctcctgcctcagcgtcctgagtagctgggactacaggcaaatgtcaccacgcccaactaattttgtattttactagagacggggtttcttcatgttggtcaggctggtcttgaactcccaacctcaggtcatctgcccacctaggcctcccaaagtgctgggattataggcatgagccactgcgccgagcctcctttgactttcacagccttcaatgtcttcatcctagtacaagaagacacattgaatttttataataaaacatttattaaatttggtgaagtatgagatctgctcaccagtaaaacatcctggtttaactttattattgcttatatttttgtaagtattttaagcataactatttggtttggtttttgaaagttattttctgaatattttggcaaatgaacgtgcaagaacatcatgagttttcttggtgcacagaataataatgctatgggtttatctgggaacctaatagtagagcttgccatagcgtaacatggagctctttgctggagtgtactttctgttgttaattttttagtttcttctaaacaggtttgtaatttgacttttctatttctgagaaaatctgtcatcttaaaagaaacttttagagagttaactgaaagtgaaagcaagttccaaggaacccccaaagaaatatcataactcatcactttatcctaccaccaacttttgctgctgtatgaagcaacctaactcaaccttgtaggaatttatgcatctactatttggaaacatagagttaaatgcccataatatatagctaagagatttgaaagagtttgcctctgaggagggggtgtgggcagtagatgcggagtagggagtgtaaagtatggtttttgttttcagccttctagcactaacttatttgaaatttatgtgcacatagtatttcaataaaaatagaacaagttataaaaagaaaacataaaaagaaatgatcaacccccaaactgggcttagttcttgtattatttcttataggctggaaatagacccacaaaaaggaggctggattgaccctcctttagtggaggtttccccaaagaccctcctggagtgaagggtccccagaggagagtgaaacacaggagttaggtggttgaggcatgagttggccatgagcaaacagtgaaggtgataaaggattacttataccaagagaaccacagatgagagaatcttccaacatccccaaataaaaaaagtcaatacagttgcttcccaatgcagtctactccaccctgctttccaaagtctgatgttccctgtttaaaagggaatctgactaaaaagccagcagttttgggattctttgacatgtggcttcttcaccaaatcctggtatcatctctgtgagaaagatgagagcagaatccacttgcatcatcaaatgttctgggtcttctttgcttgtcaattgaaaaaatagtaaaataaaatgaaagtatctcaaactggactacaatgtcattcttaccaatctttgtaccttgaccaaactttgtcatttgaattagagtgttctatattgggaacaaagttggccagaatgacttaatggcttataatgggagctaggaaagatgggacaaggattgctgcccactatataggtatgacttgctatggtccattccctttggaggcattgagctctggtttgtcatcagtggtatttatctggttatccagataaaccagaggaggtctccatgtagagtaaaaggaaaaaggaatgtagggctttggtggactctcctggattgtagggaggagtcggtaagatagagggcaagtagtggagctaaacatcccctgttagagcaagtgcctctagagagataatatcagcttttccaggcagatggctacaaatgacattctttctgtctctcccagaatcaggatgtctaaagctattattttattttcatttccctccaggatcacttcagtccactaataatcacacaataagaaagatcatgaactaacaattagcctacctaattgtatcacttaaccagtcttatttctttaactgttgcccccaaaacaggagccttctcaactgaattaatgaaggcaagatacattatgtcaactacataatgctgattgattattgagtatctctttatgtcaggaactaggcacttgggatgcatctttgaacaaaacagataacaatattttgctctaattatgcattttttgttttaatcacatttagtgatagcttagaccaagagattaaaaatttcaagtacatctccattccttgtagacctttgtgctctacacacacacacacacacacacacacacacacacacacacacacacacagagacatcttaacatttgaggtgtttaatggtaaatgttgaagtacaaatgtgcttttaactttattgttttctaccactcttatttttttctgctaatggccataaagtacattctttccgaatcttagttatatttgcttctttttttgctaagatatttttaaccactggatagcaagagtcaaataatcatgtacaagtttttaattttatctctctcaaacatgtttttgcttttgaagcattatgtatactgttttatttctttaagtaacaattaaattcataaagttagagtttgtcttatatagtaataaagatggtttccttactccacttcctgtattcaaactattatcaatgatagataatatataggagagaaaattaaaattaagttagaatttttatgaactagaaatgacatagcagtataaagtggtgaaaaggctaaagcccaggatctgctgggagtctagtccctatgaattaaagggtcgggcaagaaaaccaagccagatttgagtttgaattcaggaactacaatagaacttttctattcagcagaggagactgataaaatttactatcagtatctgcctagagctgtggtttaataaagcctgagtctatgaaggtttctggatatagtgttttgaacagatgttgagccaagcttccttctggtgcagcaaattaatttattttatgttcaatagtactgagaggcaggagctcagaccaaccaatatgatatttggttctggactgtaaaactactgggaaaaagagaggtgagcggagacaagagaacatcagcaagaaccttcaactagagaaaaaaaatccaaatttcaaaatacgtggaaaattaaatttaggaaacacatccaataaaatcaataagtgaaaggtcaatgtatcctagatgaatgaaaataaaagcatgatctgaagggtcttttaaaacatgttgaggcccctcaaacatacaaatgaagggataattcacaacaagaaaaaaaaacaaaaacaaaaatgaagaacatatgcatataaaaaatgaaatcttggaaatggaaagcataataattgaattaaaaaactttaatgttatctgacttcgaattgtactacagagctatagtaatcacaacagcatgtaactggcacaaaaacagacacatagaccaatggaagagaactgagaacccagaaacaagcctacacacctacaatgaactcattttcaacaaaggtgccaagaacatacactggggaaaagggagtcccttcaataaatggtgctggaaaaactggatatccatatgcagaagaatgaaactagatcccctatctctctccatgtaaatcatcaaatcaaaaaggactaaagactgaagtctaagaccgcaaactatggaagaattacaagaaaaccttggggaaaatctccaggacattggtctgagaaaaattttttgagcaacaccccacaagcacagccaatcaaagcaaaatggacaagaaggatcacatcaagttaaaaagcttcttcacagcaaaggaaacaaacaacaaagtgaagagacaacccatagaatgagagaaaatatttgtaaactacccatctgaccaagggttaataaccagagtatataaggagctcaaacaactctataggaaaaaatctaaaataatccgatgaaaaaaatgggcaaaagatttgaatagtcatttctcaaaggaggacacacaaatggcaaacaggcatgtgaaaagatgcttaaacatcatgagtcatcagagaaatgcaaatgaaaactatactgacatattatctcacccctgttaaaatggcttatatcctaaagacaggcaataacaaatgctagtgaaaatgtggagaaaagggaacccttgtacactgtaaatgtaaattagtacaactgccatggagaatagtttggaggttcctcaaaaatctaaaaatggagctaccatataatccagcaatcccactctggacatatacccaaaagaaatcaaagaggtatctgtactcctatgtttgttgcagcactgtttataataggtaagatttggaggcaacctaacagtccatcaacagatgactgggtaaagaaaatgtggtacatatacacaatggagtactagtcagccataaaatagaacgaaatccagtcatttgcaacaacatgaatggaactagaaatcattaagttatgtgaaacaagtcaggcagagaaagacaaacatcacaagttcttacttatttgtgggatctaaaaatcaaaacaattgaactcatggacatagagagtagaaggctggttaccaaaggctggaaaaagtagtagggggctggggaagaggtagggatggttaacaggtacaaaaaatgatagaatgaataatacctctatttgatagtataacagggtgactatagtcaataattacttaattgtacattttaaaattacttaaacagtataattagattgtttgtaactcaaagaataaatgcttgaggggatggataccccattctccttgatgtacttattttacattgcatgcctgtatcagaacatctcacttatcccataaatatatacacctactatgtaactacaataattaaaaatgtaaaaaatctttagattgggaaaacaaactataatgtctactgatggatgtcctacatactggaaatgtagtgaaaatggtgatggtgatgtagaatgaggaactggtgcttgtgaagcaggttcactgtgcactgcttaccacttcagaatcctgggctgcacttttactatgtacctgagtcttgtgagataaaaaaactctctcacacacaaattgcatagttttgttacttatagatgggcagaaagggacaacagaagcctacgagttatgatgagccagtccccgggggctcaggaaatctgctcagagcagatggagtctcctctgagagtgccttattgctcccagggtaaaaaacccagggtgggctgctttccagggtcccttgtaccacagctgagggaccctggaaaccagcccaccctcaatttttcaccgtgggaacaataagacacgctggctgaagcgatgaaggatatactgtttctaggggcaacagggacagagtctgtgctcttctggccacctcctccttatctcaggatgttgcatgtccagcacattctagttaattctgcagaactacaagtaagaaatgggggagaactgggttggttcaacaccacccatggaactgtcctgcagtaatgtcatgtatggaaaattatacgggaatatgaaaaatcagtagaaagaaagaaaaaaagatattattagcacatagaataaactctagacaggtcaaaatcaaatagaaaattagtaaattggaagataatatttagaaatgggctcagaatgtagctgagataaacaaaaagtgatttaaaaatatgaaggattcattaaaagaaatgaaggatagctgcaaagactgcaacatacatacttatagacactctatgaaaccctacaagttccaggagatgcaaataaaggaaataaagaagcaatattcaaagagatcatttctgaggaattttcaaagtttgagaaagatgtgacttcttagattgaaagtgtaccccaaaaagcatgtaggaccgttaaaggtaactccatacctagtcacaaatttgtgaaactagagaacatgaagaataaagagaaaagtcttaaaatcttccagaaagaaaaagagaaaagattacctaaaaggcctgacaatgagaatgtgagcagacttctcactactaatagtatgtgccagaagatatttgttaattatcttcaaattgctgcggtaaaattactgtcgactagaattttatatctagctaacctatcacaagagtgagggtaaaatatagacgttcacagacatagaaataagagaacttaactaaagcatattccgtaaagagaggaggaacgaaattaaaaaaaatgataaacacaggaagtggcaaaatatgttgatgaattttactaacttaaaaagaagattgagggaggctggccaggattgccaactagaagcagctagtgtgctctgctctcagaaagagaaatagaaggggcaagtaaatacagcaccttcaattgaaacatccaggtacacacattgggactcatcaggaaaacagctaaacccattgggaacagagagaagcaaggcaggattactgcccacctgagagtgacagggagccagggcagcctccctctttcagggaagtggtgagtgagtgagtgaccccagggacccatgcttctcccatggatctttgcaacccttgggtcaagagagctccttgtgaacctctccaccagggacttcagtctgacacacagagctacgtgaagtcttggcagagcagctgctcaggtacatatggaacctggggagacttagatacctgggcatccaagcaaaagtggttgcaagtccagcaaatcagaaggttagacccctatacatacccataagaaaagggatgaatccaggggcctgagaagtgacagtttgcaggccctgcttctacagcacttggcaggacaagacccactggcttggatcctatttctcttcactggccagaatctattgactgaggtctgcaaccacccccaccagtgttttccaggagacatcagttccaaacctccctggaatggagcttccagagggaggggcaggccacaatctttgctgttttgcagccttagccattgttgccttcaggctttggagagctcaaagtgactgggggctgaagcagacccctagtacagcacagctgccctatgaaaaagtggccaggctgcttttatgcagtaggtccctgatcctgttcttcctcactgggtgggacctcctgaccagggtctcctgccatctctgccagtgtgtttgggctggaaacccatccatacctccctgggatggagcttccagagaaaggggcaggctgacatctttgctgctttgcagacttcactgttgataccttcaggtaataatagaaaatccaaggtgactagggactggagcggaaccccagcatactgcagcagccatatgggaaaatggccagactgttttccgtacatgtcctggtgcttacttctcttcactgggcagagctgcttgacctgagacaccaccacagccaccctgccattgcctgaccacttcaatcagaggcagcccagcatttctgtaaggagaaaatcctaaagtcaacccacagcccctctgccactgcagttgcagtggtactgccctaatagcctacaggctggggaaagaataaaggcctagtcactcactccctggtacctccagcacaccacagccaccatatggagaggagtccagcccctctgccctaggaatcttccccctacactcttcaccagtcagggcctccacctcataactgcagaaacatcccacccatggtggagtatacccactagtagtggcttggagttttcttgtgaagaggcttccagaggcatcccacagccattctgccactgccaaagcagcagttctatccctgctgcccttggtctggggaagagacaaagagcctgaggactatacctcaggttacagaacaccacatccaccatatggggagaccagtatctcctcccagtgagcccttgaccccctactccccaacaacagagttctaagctcataccactagtgctgctgtcccaccccactggctgaacactcccagtaacagcagctctgcatttcttggaggtggggccctcagaggcaacccaaagtccccctgccatggcctctgcagtggtactaccccttctacccttggactaacaaaggagcaaaagccctaagtaccttatccatacttcaacaagcagcagttgacccaaggagaggaggccagttcatcttgcatgagtcccacccaccccactgctcatcactaagcagggaacccccagcttgggtccacagcacagacccctaacttgggctgattacactgagagatagctgacctgtatctctctagagcaaagcccccaggagacaagtaaaagaccctcatcacaaccactgtgaaggtcctgtcctctgctgcctccaagttggggaggaaacattaaccttgagattaccccagaactgtgttgggcagcctgggaatgccaagctgtgatctacagccagcactgaagtgggagaggagctcacactttcagagcatagagaggcagcatggctacagctgtgaggaaatataggagagccacaagactgagcaagagactcttactgaccattatgcctaagtgccacccactggatcacatcccaaaacttcaacacctaaagtatctcaccaactttgtgaaaccaaagacaagaagctacaaataattaccctgcacaaagccttggtcctgtgaaaacatccagaaaagaagtcaagaagtctattgattttactcaatcttcactgcagttaaaggaacacccacatgcagagatgagaaggaaccaacacaagaactctggtaactcaaaaggccagtgtcttatgtcctccaaatgactgcactagttctcaaagaagggttcttaaccaactcattggctgaaatggcagacatagatggataggaatgaagatcattgaaattcaggagaacagcaaaagccaatccaaggaaactaagaatcaccataaaatgatacctgtgctgacagatgaaatagccagtataagaaagtatctaactggtctgatagagctgaaagagacactacaataatttcataatgcaatcacaagtattaacagcagaatagatgaagctgagaacaggatcctggaacttgaagactagctctctgaagtaagatagtgagatgaaaataaacaagaatgaagaggaatgaacaaaaactttcagaaatgtgggattatataaagaggccaaatctacaaatcactggtatccttgacagggatgatgagacagcaaacaacttggaaaatatatttcaggatatcatccatgtaaacttccccaacctcactaaaggggccaaaaataaaattcaggaaacacagagaacccctgcaggattctacaccagaaggtcatccccaagacacataatcatcagatttttcaaagttgaagtgaaagaatgttaaaggcagctacagagaaagggcagttcacctacaaaggaaaccacatcagactaacagttgacctctcagtggaaaccttacaagacagaagagattgggggcctatattcaacattcttaaagaaaaaaatgttcaaccaagaatgtcatattcagccaaactaagctttctcggcgaaggagaaataagatccttttcagatgagcaagtgctgagggagttcattaccatagagttttgtattgttactagccaatacaaaaacacacttaagtacacagaccagtgacactataaagcaaccacacaaacaaaccagcataataaccagctaacaacacaattacaatatcaaatctatacatattaatactaaccttgaatgtaaatgggctaaatgccccatttaaaaggcaaaaaatagcaatgtggataaaaaagcgagacctgatagtatgctatcttcaagagatccatctcacatgcagttacacccataggctcaaaataaagggatgaaggaaaatctactgagcaaatggaagtctgaaaaaagcaggggctgcaatcctgattttagacaaaacagactttaaaccattaaagataaacattgacaaagaagggcattatattaatataatggtaaagagttaagttcaacaagaatacctaactatcctaaaaatatatcctgtgttcccaacacaggagcaccaagattcatacagcaagttcttagagacctccaaaaagacatagtcttgcacacaataaaagcggaagacttcagcactccactgacagtattagaccaatcattgaggcagaaatttaacgaagattttcaagaactaaactcagcactggatcaatggacctgatagacacctacagaactctccaccccaaaacaacagaatataccttcttattgctacatggcacatacactaaaatcaactacataaacagacataaaagaattctcagcaaatacaaatggactgaaatcataacaaccactcagttggactgcagtacattaagattagaaatccagagtaagaaaattactcaaaaccacaaaattacatggaaattgaataacctgctcctgaatgacttttgggttaatcatgaaattaaaacagaaatcaaaaagttatttgaaactaataagacccacaatacaacataccagaatctctaggacacagctaaggtaatgttaagagggaaatttattgcactaaatgcccacaacagaaagtaagaaagatagcaaattaacaacctaacatcacattgaaaagaactagcaaagcaagagcaaaccaactacaaagctagcagaaggcaagaaataaccaaaattggagctgaaataaccaattgaaggcaagaaataaccaaaattggaaactgagcagaaaaccattcaaaagatcaacaaatccaggagttggttttttggaaaaaagaaaaaagataaataggccactatttatcttattattgtaataagactaataaagaagaaaagagagaggatccagataaacacaattggaaatgacaaagggaatattaacactgactccacataaatacaaatgaccatcagagactgctacaaacacgtttatgcacacaaactagaaaacccagaggagaaggataaattcctgggcacatacactctctcaagactgaactagaagaaattaaaaccctgaacagaccaatgatgatattcaaattgaatcagtaataaataggctaccaaccataaaaaacccaggaccagatgaattcacagccaaattctaccagatgtacaaagaagagctggtaccgttcctactgaaattattccaaaaaattgaggggagggactcctcaattcattctatgaggccagcatcatcctgataccaaaacctgtcaaagacacaacaaaaaataaaacttcagaccaatatccttgacaaatattgtttgtcaaaaaaatactggcaaatcaaatgcagaagcacatcaaaaagctaattcaccatgtccaagtaggctctatccctgggatgcaatgttggttcaacatatgcaaatcaccaaacgtggttcatcacataaacagaactaaagacaaaaatcaaatgattatctcaatagatgcagaaaaggctttctataaaattcaatatctcttcatgttaaaaaccctcaataaattaggcagtggaggaacagacctcaacataataaaagccatttatgacaaacccacagccaaaatcatagtgaatgagcaaaagctggaagcattccctttgaaaacctgcactagacaaggatgctctcttacttttcctatttaacatagtattggaagtcctggccagaacaatcagcaagagaaagaaataaaggacatccatataggaagagaggaagtcaaattaccattgtttgcagactacatgattttatacctagaaaacccaatagtcttggcccaaaagcttattaagataataaacaacttcagcaaagtttcaggatacaaaatcaatgtaccaaaatcactaacagtcctatacatcagcagcagccaagtgaagagccaagtcaggaacacaatcccattcacaatagccacaaaaggaataaataacctgggaatacagctatcccgaaaggtgaaagatgtctgcaatgagaagtacaaaacaattctgaaagaaatcagagatgacacaaacaaatgaaaaaacattccatgttcataaatcagaagaatcagtataattaaaatgaccataccacccaatttacagattcaatgttaattgtaccaaacttttaaacacattcttcatagaactagaaaaaattattttaaaattcatatggaaccaaaaaggagcccaaatagccaagacaatcctaagcaaaaagagcaaaactgaatgcttcatgctaccagatttcaaactatactacagggctagagtaatcaaaacagcatggtactggtacaaaaacatacacatagagctatagaacagaatagagaatccaaaaataaggtcaaacacctacaaccatctgatctttgacaaagtcagcagaaacaagcagtgtggaaaggaatctctgttcaataaatggtgctgggataactggctagccacatgcagaagattgaaactggaccccttccttacaccatatacaaaaattaactcaagatggatcaaaggcctaaatgtaaaacccagaaatatagaaaccttggaagacaacctggacaatacgattctggacacaggaactggcaaatatttcatgataaagatgccaaaagcaatctcaacataagggaggagaccaccccacatattgtcttatgcccaatttctgcctccaaagaaagaagtaaaaactaaaaggcagaaatgacatccacaggcagacagcccagcgccccaccctgggcctggttaaagatcaacccctgacctaactggttatgttatctatagattccagacattgtatggaaaagcactgtgaaaatccctgtcgtgttctgttctgatctgattacttgtgcatgcagcccccagtcacgtaccccctgcttgctcaactgatcacaaccctctcacatggacccccttagagttgtaagcccttaaaaggaacaggaatttctcacttggagtgcttggtttttggagatgtgagtcttgccaaagctcccggctgaatacagcccttccttctttaactcggtgtctgaggggttttgtctgtggcttgtcctgctacatttcttggttccctgaccaggaagtgaggtaattaatggatggatggttgaggcagccccttaggcagcttaggcctgccctgtggagcatccctgcaggggactctggcctgcttgagcaacatggatcctgagagcactcctgggtaggcatttgacctggtagaatgccttgtcagagtggtgcatggcaggcctctgtggaggatcaacacagtggctgaacactgggaaggaactggtacttggggtccagatatctgaaacttggtaagaccagtctttggaactagcccactccatttgagtggaagcgtggcctgatcacccacgacatgcctgtactggcactttggtttttaacttgacttggattgcttgatactttggttttggttttgacctggcttggatttcttggtactctgattttggttttgattctggtttggtgtaaactgtaaaagtgtgtgtgtgtgcctttttacccgttctttgttttgtggtgtacgtgtggtttgagcatggtgttttgtctcaaggaagcatgggtcaggcacaaagtaagcccgccccaccaggaactatgttgaaaaatttcaagaaaggatttaagggagactatggagtactgtgacaccaggaaaacttaaaactttgtgtaagattagaggtgcgttggccatcggaatgaagcctggacaggtcccttgtttcaaaggtatggcacaaggtaacccataagccagggcacccagaccagttcctgtacatagagatttggttacagctggttttagacaccccccaccacagtggttgagagaatagcagcataagttgctggcagaggaaaggaaagaccagcagagagagacagagagagagagagagagaggaaagagacagagagagaaagaggcaaaaagagagaggaaaagacagaggaagagacagagagacaaagagggagtcaaggagagagagagagaaagagacaggcagagagagagaggaagagacagaggcaaaagggaagtcaaagaaacaaagtcaaagacagaaagaaacagagaaagagagtaatatacaagtagttaagaaaaaataaaacagtgtaccctattcctttaaaagccagggtaaatttaaaacctataattgaaggtcttctccatgacactacaacacgacaataccaccttgttgtaagtgtaaacaagggcatagcccgaaagcactgaggccactgacaacctgtagcctccctatcaaaaatccttaacccagtaacctgtggatggcccagatgcattcaatctgtagcggcaactgctttgctaacagaagaaagtagaaaaataacttttagaggaaacctcattgtgagcacatctcaccaggtcagaagtatcctaagtaaaaaaaaaaaaaaaaaaaaaaaaaggtgatttaacattaaccactgaaaattcccttaactcagaaggtttcctaacaggggatctaaatcttaattaccatacaaaggtctgaccagacctaggaggaactcccttcaggaaaggaggatagatgtttccttctgggtaattgaagggagaaaaaaaaaaaaaagccatctataccggttctaagttaatttggactaaacaagatcttattaatagcaaaggataattgaaatcccaaacttacaaggttttcaacaaaagtaaagtttgctaaaagttaacagtgtaacatgtattatagtaacttctaatcttgtggccttagacagtctagtccacagacataaaggaagttcactttggaaaagaatggttatcatcttccagaaaaaaaagtgaaataaaggggggagggcagaatttatgtaaaaagaatgttatatggtaaattattgtcctgaaataacttaactggttgtttaaagaaaaaaatgtttgtaataagtcagaaaattgaggcatgtcaaagaattgtctgtgaaaatcatgaaaaaatgttataaaaaagaatttatgccagaaatgcataatttaaaagtaataaggcctcctgagtactattgaagaaacagtttatgtgcaaggtgtataaggaaagtaaaatatacctttggtaaaaggattataaggaggcatgagaaagcaaatttttacatacactaaaatatcaaaaacatttttgttttgaaggtttaagcaagttttaaaatgtcaattgtaaagaaaattctgtgtgtaaacatattagctaaagttaaaggcgtatcatccagtttttctttgaactggacattaaaggaaaaacacaaagggtttttcttaaagcactaacctgctctttaacaaagattataaaaggttaaaaagagtctataaaaatcttaccttatggtctgacattaaaaattaaataaatatatctacaacgttttattaaaactaagtttaacattagtaacacactaatataaaggtgaaatttagcttatctggtataaaattatacaggaagcattgtcaaatataaaatggtgtttggcttctttgatctaaaaactaataaaaataggtgctgaatgaaatttctcagtagaaaggcactaaggactataaaataaagtccactgctgatgtccccacatttaaaacaaaaggtcaatttcttaaaaattatatacttggtttatcttccactttcctttccctcaaaactaaaagtctttaaacacatgtaccacccctagaatttccagtaaaccagcaccagcctgaagatcacattctcatcaaaagttgaaaagaagggaaactcgagccagcctaggaaggaccctaccttgtgctgctaaccaccgagaatgctgttcgtacagtgaaaaaaggatggactcatcacacccgagtcaagaaagcgccaccccctccagagtggtgggccatagccccaggggaaaaccctaccaaacgaaagctaagaaaaatttaaccctttcatctattctattactctttcttttttccttgttctgttgctgaccatctagttattaacataaccaagtcaatttcacctcaaactgttgcatttaatgcttgccttgttataccctgtggggacttgccaagtcaaagacagctctctacttcagaaaagtacctctgtccctcctgactctcctcagactgggcattagtaaattaggaccatttaatctggggaaatttcgataaagactccagtgtcaaccaggagtctagccccccagtgtggagcttttatgctgtagttggtctaacgttctgtggaccactaaagagcaaggatggtctgccccaacagatttttgtaatttcctaaaattatacattcattttactagaggatcatagaagttaaagacttaaaacaaactttggcaattaagacaggataccaaggtccaaatgcctggttgaaatggatcaactattccatccacatgttaaacaaaagcaattgttatgcttgtgcacatggcaggccagaggcccagattgtcccctttccactaaggtggtactccagtcgaccaggcgtgggctgcatggtagctcttttctaggattctacggcctggagtaataagtcatgccaagctctttctgctacatcccaaagtccggcaccctgtgggtcagcccctgaggcccatccagcctccgtctcccaacactaaggtcactttgtgtctctcacaacagggaggaaatttagcgttccttggagacctgaagggatgcagaaaccttaagaattttcaagagcttatcaatcagtcagtccttgttcatccccgagcaggtgtgtggtggtattgtggtggacctttactgggcactctgctgaataactggagtggcacttgtactttagttcaattggctatccctttcaccctggcatttcatcaaccggagggaggaaaaataagacattgtaaagtgagagaactcctttatgggtctttcgactctcacgtctatttagatgcaattggagtctcacagggaataccagatcaatttaaagctgaaataaaaaagctgcaggattttaagtcaacattttggtgggtaacagttaataaaaatgtagattggataaactacatctgttacaaccaacagcaacgagcttttcatgagttaaaagaaaaactcatgttggcctcagccctggggctacctgacctgacaaaagcctttacattctatgcatcagaaagagaaaaaatggcagttggagttttaacccagactgtggggccctggccaaggccagtggcctatctcttaaaacaactagatggggtttccaaaggctggccctcatatctaagggccctggtagcaatggccctgttagcacaagcagcagataaactaacccttgggcaaaacctgaatataaaggccccccatgctgtggtaactttgatgaataccaaaggacatcattggctaacaaatgctagattaaccaagtaccaaagctagctatgtgaaaatccccacataaccatcaaagttggcaacaccctaaaccctgccaccttgttcccagtatcagagagctcagttgaacatgactgtgtagaggtattagactcagtttattctagtgggcccaacctccaagaccatcctagaacatcagtagactgtgagctgtacatggacaggaacagctttgccaacccctgcaaagtgactctgaaggaaacgacaaagccctgctccattcacaccctgaagctgactggcccacacatggccgaagcatgagaaaactcattgtgggactcattttccttaaaatttggacttacagagttaggacttcaactgaccttcctcagactgaggactgttcccagtgtatacatcaagtcactgaggtaggacaaaaagttgctacagtcctattattttatggttattataagtgtaccaggactctaaaaataacttgtttgtataatgctgttctatacaaggtatgtagcccaggaaatgaccaacccgatgcatgttatgacccatctgagcctcccatgaccacagttttttggttttttgaagtaagattaaggactgagaactgatgggggctcataaatgatgtgagttagccaaaacagaagaaaaaggggtgcccagacaagtcaccttgaaatttgatgcctgtgctatcattaatagtaataagttagcaataggatgtggttctcttaatcagaaaagaggctatatggcagaaaatcagtacatttgtcatgaattaggactgtgtggaaatgaatgtggatactggtcttgtgtcatttaggctacttggataaaaaatgaaaagtatcccatccactttcagaaaaggaaaagtggccgttcctgtaccggttgtcagtgtaaccccttagaactagtaataaccaacccccttaatcctcgctggaaaagaagggagtgtgtaaccctaggaatcaatggggctggactagatcctctagtaaatattgtggtttaaggagaagtttataaacgctctcctgagccaatatttcaaaccttgtatgataaactgaatgtgccagtaccaaaaattccaggaaaaacaagaaatttgtttttgcaattagccaagcatgtagtctagtctctcaatgtcacttcatgttatatatgtggaggaactgtataggagatcaatggccatgggaagcccaagaattagtacctacagacccagtttctgctgaattcctgactcaaaagaattaccctgataacttctaggtcctaaaagtctcaatcattagacaatactgtatagcaagactagggaaggacttcacccttcctgtgggaagactcagctgccttgggcaaaaattgtataatagtattacaaaaacagccaccgagtggagttcaaagcacattaagaaaaattcatttggtaaattcccaaagttgcaaaccgtgtggacccacctggagtcccaccagtactggacagcccccactggattatacaggatatgtggacatagagcttatgccaaattacccaaccagtgggcaggtagttgtgttattggcactattaaaccatctttcttcctactgcccataaagacaggcaaactcctgggcttccctgtctatgcttcctgcgaaaaaagaagcatagctataggaaattggaaagatgatgaatggccccctaagagaatcatacaatattatgggcctgctacttaggcacaagatggcttatggggataccggatcccatttacatgctcaaccaaatcatacggttacaagctgtcttagaaataatcactaataagaatagcagagccttgactattctggcccggcaagaaactcagatgagaaatgctatctatcaaaatagattggctcttgactacttgctagcagctgaaggaggggtctgtgggaaatttaaccttactaattgctgtctacacataggtggtctagggcaagtagttgaagacatagttagagatatgacaaaactggcacatgtgcccgtgcaaatgtggcatggatttgatcctggggctatgtttggaaaatggttcccagtgctaggaggatttaaaactcttataataggagttataatggtaatagaaacctgcttactgctcccttgtttgctacctgtactttttcaaatgataaaaaacttcatcgctaccttagttcaccaaaatccttcagcacaggtatactatattaatcactgttgatgtgtcttgcaagaagacatgggtagtgagaactcacactaataagtgaaattctcaaagcaggggaataagggaggagaccacccctcatattgtcttatacccaatttctgcctccaaagaaagaataagtcaaaactaaaaggcagaaatgaaatccacaggcagacagcctggcgccacactctgggcctgtttaaagatcgacccctgacctaaccagttatgttatctatagattccagacattgtatggaaaagcattgtgaaaaatccctgtcctgttctgttccattctgattactggtgcatgcagcccccagtcacataccccctgcttgctcaatcgaccacaaccctctcatgtggacttccttagagttgtaagcccttaaaagggacaggaattgttcactcagagagcttggtttttggagatgtgagtcttgctgaagctcctgagccacataaagcccttctttctttaacttggtatctgaggggttttgtctgcagcttgtcctgctagaaacaaaagcaaaaattgacaaatgagatctaagtaaacttaagagctcagcacaacaaaggaaactatcaaccgagtaaacagacaacctacagaatggaaaaaaattttcgcaaactatccatctgacaaaggtctaatatccaacatctataaggaacttaaacaaatttacaaggaaaacactccataaaaaagtgggcaaaggacatgaacagacactttccaaaagaagacatacatgtggccaagagtcatatgaaataaatctcaatatcactgattattagagaaatgcaaatcaaaaccacagtgaggtaccagctcataccagtcagaatggctattattaaaaagtcaaaaaataacagatgttggcaagcttgaggagaaaaggaaacacttatacactgttggtgggagtgcaaattactcgaatcattgtggaaagcagtatggtgagtcttcaaggagctaaaagcagaactaccatttgacccagcaatcccattactgggtgatatggtttggctgtttcttcacccagatctcatcttgaatttccatgtgttgtgagagggacccagtaggaggtaattgaatcatgggggcaggcatttcctgtgctgttctcatgatagcaaatatgtctcataagatccaatggttttaaaaagggaagtttccccacacaagctccctcttctcttgtctgccaccatgtaagacatgccttccaccttctaccatgattatgagcctccccaggcacatggaactgtaagtccattaaacctctttcttttgtaaattgcccagtttctggtatgtctttatcagcagtgggaaagcagactaatagagtaaattggtaccagtagagtggggcactgctggaaagatacccagaaagttgctgggagcaatttgttataggaagaggttagaacggtttggagggctcagaagaagacaagaaaatgtgggaaagtttgaaactccttagagacttgttgaatggctctgaccaaaatgctgataatgatatggacaataaaatccaggctgaggtggtctcagatggagatgaggaacatgttgagaattggagcaaaagtgactcttgttatgttttagcaaagagctggtggcatttttcccctgtcctaaagatttgaactttcaacttgagagacatgatttagggtatctggcgaagtaatttctaagcagcaaagcattcaagaggtgacttggggctgttaaaggtattcagttttaaaatggaaacagagcataaagttcagaacatttgcagtctgacaatgtgatagaaaagaaaaatcccattttctgaggagaaattcaagccggttgcaggaatttgcataagcaatgagaagttgaatgttaatccccaagacaatgggaaaaacgtctccagggcatgtcagaagtcatcacagcagtactcccatcacagcctggagacctaggaggaaaaagtggtttcatgggctgggcccagggtccacatgctgtgtgcagtctagggacttggtgccctgtgtcccagctgctccagccatggctgaaaggggccaacatagagctcagtccatggcttcagaggatgtaaggcccaagctttggcagcttccatgtagtgttgagactgtgagggtgcagatgtcaagaattgaggtttgggaacctcctcctagatttcagaagatgtatggaaatgcctggatgcccaggcagaagtttgctgcaggggaagggccctcatggaaaacttctgtgaaggtgatttggaagggaaatgtcagagccctcatacagtgtccctaatggggcagtgcctagtggaggtgtgagaagagggctaccattctccagaacttagaatggtagatctactgacagcttgcactgcgcacctggaaaagctacagacactcaatgccagcctgtgaaagcaactgggagggaggctgtaccctgcaaagccacaggggtggagctgcccaagaccatgggaacccatctcttgcatcagcatgacccaggatgagagacatgaagtcaaaagagatcattttggagctttaagatttgacggccctgctggattttggacttacatggggcctgtagccctgttgttttggccaatttttcccatttggaatagctgtatttacacaattcctgtaccccccactgtatctaggaagtaactaacttgtttttgattttacaggctcataggtggaagggactttccttgtttcagatgagactttggactgtggacttttgagtgaattctgaaatgagttaagactttgggtgactgttgggaaggcatgactggttttgaaatgtgaagacatgagatttgggagggggccaggggtgaaatgatatggtttggctgtgtccccacccaaatctagtcttgaatttccacatgttgtgagagggacctggtaggaagtaactgaatcataggggcaggcctttcccatgctgttctcatgatagcaaataagtctcatgagatctgatggttgtgaaaaggggagttgccccacacaagctctctctcctcttgtccgccaccatgtgagacatgccttctgccttccaccattattgtgaggtgttgccagccacatggaactgtaagtctattacacctctttcttttctaaattgccctgtctcaggtatgtctttatcagcagcatgaaaactgactaatacactgggtatatacccagaggaatataaagcattctaccataaagacacatgcatgtgaatgttcattgcagcactatccacagtagcaaagacatgaaatcaatctaaataaccatcagtggtatactggataaagaaaatatggtacatatacaccatggaatatgatacagccattgaaaaagaatgagatcatattctttgcaggaacatgaatggagctagaggccatcatccatagcaaactaacacaggaacagaaaaccaaatactgcatgttctttcttataagtgggtgctaaatgataggaacacatggacacaaagaggggagcaactgacagcaggttctacttaagggtggagggtaggagacaggagaggatcagaaaaaaataatatattgggtccaaggcttagtaactgggtgatggaataatctgtacaacaaacccctgtgacacagtttacctatgtgacaaatctgcatatgtaccccagaacctaaaataaaagttaaaacaaaagattataaaaataactcagcttttagaatgtgtttgtttgtaagagataacaaaaccctagcaaaaaacaataaggaatacagggtagtagtaatattcaaagtgtagttgaagcatgttaaagattttgtttgctttggaggaaacaaaatgtctccaataacgccctcagattttgttagaaaaacttacggttaactatgcaccagttaggttctatagattagctagaatctcctttaccatgatacctatatatctgtgcgtaaattccacttcctgaattcagaaatatacttggatgaggctttcattggtgaggttgaaggtgacaagtccgggctgtggttgtgtctgagtgtgctgtgctattctataccctgccatattacacagttcatgactccagattgtcatccacctgtaccttgtcaacccgcatccacagatcctgactggcatatgagcatatggacaaggagaaggacatttatgctgactgaatttctgatatgtcccttaattatgtagacattattatccatacaggtgaagctcttaaagtttgaactgctatctcttctagagaatgttactaatattttttctgtaaattctatttttgatggctttcttccctatcctttagagcagtaaaccctgtttgatctacccaaatgatatttggtctgtcatttcttccaatatgatcttacaaattattatactataggttccaactagtagaggaaatttataaccctcaaacatgaagagaaaaacaatgtacatgtgtatgtgtgcatgtgcatgtatgcgtgtgggtgtgcttgcgggaagaagtatagaaaatgttatcaattcaacagaaagcaggaataaggatggacaaagtatgagatagaaaataccaaatcagagtagaaatgagccctgatacatagaaaatttctctaaaaagtcactcataaaaaagagattatcactttggacacaaagaaaaaacacattaatgttgcttttacaagagactgatttaaaacaaaataacacaggaatattgacaatagagtgatgaaaagagatgcaccagatatctgttgtcctaaaagaaacagtacaaaagtaacataataatcatgaatttgtatgtgctagcaataaagctttgaaatatggaaagtaaacatggatagaattttagggagaaattgacaaatgcacattcaaataaaaaatattaataaggttatgcaagtgttaaacaacttgattaataagcttggtcttaacaagtgttaacaaacttggtttattatagaaatttatcctgcaaaataaatatgcgtttatttttcaggtacatagaattaattacttatttttatcctacagaaactctgtaccatggagggtttagcagtgctgtaccgctactaccactcttcctactaaaattattaccactattattactgttactagtttattactaatagcctacactaatttagcatttaaatgtacatgaaacatgcctaatatgcattttctcatttaaaaaccagaacaatattttgaatatacatgctttctcattcaaagtgcaaagaatatcagtagtgacaaaacattttctgttatttaggttaagagtattgtatgtgaggtaatgcatatgcttattagctagatttagtcatttcacagtgtatatatacttcataacatcatattatacaatggtaaatacatacaattttatctgttgatgtaaaaaaaaatttaagaagcatattccatcactgttaatggataacctatcagacgtaatgagaagaatcttttaaaaacctacctgccatgaaagcatcactatagaaaacatatcactactatcagaatggcagagaaactggatcaattatacaatgctggtgggaatgtaaaatggcacagccattctggaaaacagcttggcagtctctttaaaagaaaactaaatatgcagtaaatatgcattattgggcatttatcatagggaaatgagaacttatgttcatgcaaaatcctgttcatgaatattcttagcagcttattcgtaatatcaaaaactggaagcaactcaaatgtccttcaacgggtgaatggttaaacaaactgtgttccatccataccattcaatactacttagcaatatgaaggaatgaactattgatacaagcaacaatttggatgtatcttaaggtaattaggccgaacgagaaaagccaatcttaaaatgttacatactattggccaggcatggtggctcatgcctgtaaacccagcactttaggaggccgaggtgggcagatcacaaggtcaggagttcgagaccagcctggccaaaatagtgaaaccctatctctactaaaactacaaaaaattagctgggcgtggtggagagcgccttaatcccagctactcgggaggctgaggcaggagaatcacttgaacccaggagtcggaggttgcagtgagccgagatcacgccattgcactccagcccaggtgacagtccaagactctatctaaaaaaagaaaaaaagttacatactatcagattctgtttatattgtgttcttgaaataaaattgtagagatcgatggaacacaaattagtagttgccaggtgttagggatgggaggttggagttgagtgggtgttgccataaagaggtagtggttatgggagccttgcagtgataaatcagttctgtatcttcagggtgatggttacacagatctacagcagatcacacacatacacacacgcacacacacacacacacacacacgtacttacaaaactagtgaaatctgataaactctgtggattgtaccgatgtaattttcttggttttgatattgtacattagttatgcaaaaatgttatcattgggagaaactggatgaagggtaaaaggcacctccctgtacatggtttttttttttttgaatttcctgtgaatctacaattatttaaaaactaaaagttaaaaaagtgatctattcaatatttgtcttttacagttgattatcataatttttgtgttaaaaattgtgaaagccctgaatcaatatttaataagataagtttctgtgaatgtggatggtaggctctttacattccagggaacatagttataaatgtttttccttttcttgacaaaggaagaggtttttggtttgtttgtttagacaaacccacatgtttttagaaaaaagtaatttatttattttattttattttattttatttttgttgttccagttatatcttttttttattattatactttaagttcaagggtacatgtgcacagcgtgctggtttcttacatatgtatacatgtgccatgttggtgtgctgcacccattaactcatcatttacattaggtatatctcctaatgctatcccttccctctccccacaccccacaacaggccctggtgtgtgatgttctccttcctgtgtccaagtgttctcattcttcaattcccacctatgagcaagaacatgtggtgtttggttttttgtccttgtgatagtttgctgagaatgatggtttctagcttcatccgtgtccctacaaaggacatgaactcatccttttttatggctgcatagtattccatggtgtatatgtgccacattttcttaatccagtctatcattgatggacatttgggttggttccaagtctttgctattgtgaatagtgccacaataaacatatgtgtgcatgtgtctttatagcagcatgatttataatcctttgggtatatacccagtaatgggatggctgggtcaaatggtatttctagttctagatccctgaggaatcaccacattgacttccacaatggttgaaatagtttacagtcccaccaacagtggaaaagtgttcccatttctccacatcctctccagcacctattgtttcccgactttttaatgatcaccattctaactggtgtgagatggtatctcattgtggttttgatttgcatttctctgatggccagtgatgatgagcattttttcgtgtgtctgttggctgcataaatgtcttcttttgagaagtgtctgttcatatccttcacccacttgttgatggggtttgtttttttcttataagtttgtttgagttctttgtagattctggatattagccctttgtcagatgagtagattgcaaaaattttctcccattctgtaagttgcctgttcactctgatggtagtttcttttgctgtgcagaagctctttagtttaactagatcccgtttgtcaattttggcttttgttgccattgctattggtgttttagtcacgaagtccttggccatgcctatgtcctctatgtcctgaatggtattgcctaggttttcttctagggtttttatggttttaggtctaagatttagggctttaatccatcttgaattaatttctgtataaggtgtaaggaaaggatccagtttcagctttctacatatggctaaccggttttcccagcatcatttattaaatagggaatcctttccccatttcttgtttttgtcaggtttgtcaaagatcacatggttgtagatgtgtggtattatttctgagggctctgttctgttccattggtctatatctctgttttggtagcagtaccatgctgttttggttactgtagccttgtagtatagtttgaagtcaggtagcatgatgcctccagctttgttcttttggcttaggattgtcttggcaatgtgggctcttttttggttccatatgaagttgacagtagttttttccaattctgtgaagaaagttattggtagcttgatggggatggcattgaatctataaattaccttgggcagtatggccattttcatgatattgattcttcttatccatgagcatggaatgtttttccatttgtttgtgtccttttttatttcattgagcagtggtttgtcgttctccttgaagaagtccgtcacatcccttgtaagttgaattcctaggtattttattctctttgaagcaattgtgaatgggagttcactcatgatttggctgtctgtttgtctgtttttggtttataagaatgcttgtgatttttgcacattgattttgtatcctgagactttgctgaagttgcttatcagctgaaggagattttggactgagacgatggggatttctaaatatacaatcatgtcatctgcaaacagggacaatttgacttcctcttttcctaattgaataccctttatttctttctcctgcttaattgccctggccagaacttccaacactatgttgaataggagtagtgaaggagggcatccctgtcttgtgtcagtttccaaagggaatgcttccagtttttgcccattcagtatgatattggctgtgggtttgtcataaatagctctcattattttgagatacatcccatcgatacctaatgtattgagagtttttagcatgaagggttgttgaattttgtcaaaggccttttctgcatctattgagatagtcatgtggtttttgtctttggttctgtttatatgctggattatgtgtattgatttgtgtatgttgaaccagccttgcatccaagggatgaagcccacttgatcatggtggacaagatttttgatgtgctgctgtatttggtttgccagtattttattcaggatttttgcattgatgttcatcagggatattggtctaaaattctctttttttgctgtgtctctgccaggctttggtatcaggatgatgctggcctcataaaatgagtgagggaggattccctctttttctattgattggaatagtttcagaaggaatggtaccagctcgtcctttcacctctggtagaattcggctgtgaatccatgtggtcctgggctttttttggttggtaagctattgattattgccacaatttcagagcctgttattggtctactcagagattcaacttcttcctggtttagtcttgggagggtgtatgtgtccaggaatttatccatttcttctggattttctagtttatttgcatagaggtgtttatagtattctctgatggttgtttgtatttctgtgggatcaatgatgatatcccctttatcattttttattgcgtctatttgattcttctctcttttcttctttattagtcttgctagcggtctatcaattttgttgatcttttcataaaaccagctcctggattcattgattttttgaagggttttttgtgcctctatctccttcagttctgctctgatcttagttatttcttgccctctgctagcttttgaatatgtttgctcttgtttctctagttcttttaattgtgatgttagggtgtcaattttagatctttcctgctttctcttgtgggcatttagtgctataagtttccctctacacactgctttgaatgtgtcccagagattctggtatgttgtgtcttttttctcattggtttcaaagaacatctttatttctgccttcatttcgttatgtacccagtagtcattcaggagcaggttgttcagtttccatgcagttgagcggttttgtgtgagtttcttaatcctgagttcttgtttgattgcactgtggtctgagagacagtttgttacaatttctgttctttaacatttgctgaggagtgctttacttccaactatgtggtcagttttggaataagtgtgatgtggtgctgagaagaatgtatactctgttgatttgtggtggagagttctatagatgtctattaggtctgcttggtgcagagccgagttcagttcctggatatccttgttaactttcagtctcgttgatctgtctattgttgacagtgggttgttaaagtctcccattattattatgtgggagtctaagtctctttgtaggtctctaaggacttgctttatgaatctgggtgctcctgtatttggtgcatatatatttagggtagttagctcttcttgttgaattgatccctttaccattatataatggccttttttgtctcttttgatctttgttggtataaagtctgttttatcagagactaggattgcaacccctgccatttttgttttccatttgcttggtagattttcctccacccttttattttgagcctatgtgtgtctctgcacttgagatgagtctcctgaatacagcacactgatgggtcttgactctttatccaatttgccagtctgtgtcttttaattggatcatttagcccatttacatttaaggttaatattgttatgtgtgaatatgatcctgtcattatgatgttagctggatattttgctcattagttgatgcagtttcttcctggcatcgatgatatttacaatttggcatgtttttgcagtgggtggtaccagttgtccctttccctgtttagtgtgtccttcaggagctcttgtagggcaggcctggtggtgacaaaatctctcagcatttgcttgtctgtaaaggattttatttctccttcacatatgaagcttagtttggcaggatatgaaattctgggttgaaaattctttaagaatgttgaatattggccccctctctcttctggcttgtagagtttctgccgagagatctgctcttagcctgatgtgcttcctttgtgggtaacccaacctttctctctggctgcccttaacattttttccttcatttcgactttggtgaatctgaaaattatgtgtcttggagttgctcttcttgagtagtatctttgtggtgttctctgtatttcctgagtttgaatgttggcctgccttgctaggttggggaagttctcctggataatatcctgcagagtgttttccaagttggttccattctccccatcactttcaggtacaccaatcagacatagatttggtcttttcacatagtcccatatttcttggaggctttgttcatttctttttattcttttttctctaaacttcttttctcacttcatttcattcctttgatcttcaatcactgataccctttcttccaattgttcgaatcagttacggaaacttgtgcatttgtaatgtagttctcgtgccatggttttcagctccatcaggtcatttaaggacttctctacactgattattctagttagccgtttgtctgatcttttctcaaggtttttagcttctttgtgttgggttcgaactacctcctttagctcagacaagtttgatcatctgaagccttctcccaactcgtcaaagtcattctctgaccagctttgttccattgctggcaaggatctgcattcctttggagggggagaggcgctctaatttttagaattttcagcttttctgctctgttttttccccatctttgtggttttatctacctttggtctttgatgatggcgatgtacagatgtggttttggtgtggatgtcctttctgtttgttaattttccttctaactttcaggaccctcagctgcaggtctgttggcatttgctggaggtccactccagaccctgtttgcctgggtatcagcagcagaggctgcagaacagcaaatattgctgaacagcatatgttgctgcctgatcgttcctctggaggcttcatctcagaggggtaccaggctgtgtgaggtgtcagtctgcccctactggggggtgcctcccagttaggctactcaggggtcagggacccacttgaggaggcagtctgtctgttctcacatcttagactccgtgctgagagaaccactactgtctttacaactgtcagacagggacatttaagtctgcagaggtttctgctgccttttcttcagctatgccctgcccccagaggtggagtctacagaggcaggcaggcctccttgagctgcagtggcctccacctagtctgagcttcctggcagctttgtttacctactcaagcctcagcaatggtgggcgcctctcccccagcctcactgctgccttgcagtttgatctcagactgctgtgttagcaatgagcgaggctctgtgggcatgggaccctctgagccaggtgcaggatataatctcctgttgtgctctttgctaagaccattggaaaagcgcagtattagggttggagtgacctgattttccaggtgccatttttcacagcttcccttggctaggaaagggaattccctgaccccctgtgcttcccaggtgaggcgatgcctcaccctgcttcagctcatgcttggtgggctgcacacactgtcctgcacccactgtctgacaagccccagggagatgaacctggtacctcagttggaaatgcagaaatcacccgtcttctgtgtcgctcacgctgggagctgtagactggagctgttcctatttggccatcttggaaccaccccccaatttatttaatttttatagattgccaattatgtagaacttcaaggtaatactgtgtcttagttgtctttatttgcttctatagcctgaaacaaccaaaatacagtaatcatttctgacactcaacacatgcttgctgatttcttaattttgctgcccctattctgcactgttatgccagatgtgtaactccctctttccttggtgttcatgagaaaacaatttgagcaatttcctaactaaggcgtttgtgtgggcagctgacttttcaggtatgactaaatgaatatggtttacatgatacaatgcaggccacttaatatttaagattttaaatgcctctttttaaaagttctttggtggcttttttcatagacctgttatctctgtaggtggtagacttctgtcatgtagccttaatcctttctctctataaacttttcccacttctcccttttatattctttcttgcccatacatttttttcgttaaacaaattcagagtggtttttggtctaattgttctcttctactcatctgtccagagcctcacctttcattcctaacaaagacaattttttttttttttgagacagagtctcactctgttgcccaggctggactgcagtggtgctatctctatctcggctcactgcaagctttgcctcccaggttcatgccattctcctgactcagcctcctgagtagctgggactacaggtgcctgccaccatgcctgtctaattttttgaatttttagtagagacggggtttcactgtgttagccaggatggtctcgatctcctgacctcgtgatctgcccacctcagccttccaaagtgctgggattacaggcgtgagccactgcacctggccgacaatttctttttaagtggagcttagacactggttattgattacttgcaacttgtcctatagcagttgtaaaaaacctctttaatgctttttgcaacaatttggggtgtaagtgaacaaataaaagaaagttttgtatatactacacagaaatgtgtaaatatatgactaaaatatatgcataaaaatgttcatagcagcattatttgtaatggccatgaaaaaaaggaaacaaccaaatgcttatcaacagtggaatgaatagtatgttcatcctatattctgcactatattacattagtaatatagcaccaccaccaccactaccctttaccctgcttcatgatatttcttgcagtgaagatccccacctgataattaacatgtatttatttgtttgttgtttatcttaccaaactagcatgaaacctccaaattgcaaaggatgtgcctatttcttatatagtacaaaatagggacaggaaaattaagaaaccagcaaacatgttagtatctgaaatgattcatatgttttgttcattataggctatagaaactttgctccaacccactgggataggaaaccactaaaaaattgcagtcctaatactgggactaacccgtggcagggaatgttgctgccatacactcctagagacaccacagggcatgcacgtctgatcctgatctgcccatcctgcaccatgagcagaccccaactggagatggaggatgacggtgaacataggcttgtcacccctgatgacactaccagggtcctcacaatcctggctggagggcagcaacagtcacagagcaggggcttggaggggatggctggctggaatcccaggtactaagtaccagggacctagagcaggtggctgaaaacctatccaggggaggtgggaaggcagcaggctgtagggtctataggactaagactccaagtcctgaaacatgctccattgtcctatcagatttcacttccataatacaagttcaaacaaaaaattaaggatttcaagaaagtgactgtggagctttaagcccaaagtacggtgcctttctgagtgttggtcctgtgtggctgcacttatctcatggttgtggagccaggcctgtgtgcaacataagaataaaaaaaaaaaaaagaaaagaaacaaagataactaagtcctaccttaaagttgtacataattgacaatctatagcaatgaaatacaatagagctaatgctacattacagtgacatgggtaaagctccacaattcaatgttgggcagaaaccagacataaaaaaataccgtttgatttatttcgataaagttcacaaataggaaaaacaaatcagtaatgttagaaatcaggatagtggtttcttttgggaaagtggccttagggggacttctagggtactggtaatattttatttcttgaaattcatggaggctacaaaagtatgttcactttgtgaatgttcattgcatttgtatattatgtattatggtatacatagttggtatagtaattataatagctagtttatagtttgtgtattatttatatcatacttcagttacatagtttctttttagaaaggcgagttaagtattctcatttctatttcttaattgtgcaaattaacttagaagattgatttatttggcattgaatcagctgtagaacacaggtctagtgcttctgtatcactgctacagctttcaaaaaaagtttacttaaattaacatccatttagataattaaacttttcctgccattcttcaccttttactttctctataaaagaccatgtagtagatattttgggctttaagggtcatatggtctctgttgtaacaattcaactttgccaatatagtgcagaatcagccatagacaatacataaaagaatgaatgtgatggtgtttcaacagaactttatttataggtaataaaacttgaattttatataatttttacgtattatgaaatagtattcttcttctgttttctttgcaaccattcaaaaatatcaaaaccattcttagttcctgagccatacataaatgggtggcagactagatttgtccatgagcctcagtttgccaacccctgtttaaggaggtttatttgcagtattgatgttagttataatttatatccataatttatgtgtttccttatattcatgggcaaaggagtagcaccccaccttccattctgtcaagctctttaaattgtaacattttcaacttgtttagtatatcactaatttcatggctcataggttaagccagaaagttccctggaaaacacttcagtttgcaagttctctcctgtgttttctttcatttcttccctttgcatttaatgagaataaacaaaatgttctggaataagaacaagtagattcatcaaatgtcaacagctgttgaaccatctgttattgaaaaagtgtttgattagcaccctagggcaatcaagccactttagctgcgggtgtactaagtgaaagaggaaatagaaggcacagctaactaatgatgggtttcactattgataagagcccacctcatttggaaaaagatggacataacaaaggagtagtaactaaaagactgctaataaactgtccttcgtaagaactcatgtttattttggtgaaaatattaaagaaagtcatggaaggtgaaaagaaagagctgaaaaagttacctgttaatatgtgaaatcaaaatctgttggtctgtatgtcattgattctcagttgacttcctgggcttgaatgctagacatttcccacaaatgtggtaccagattttgctcatcgagttttggctacagctgagaatgaaagctattttagaaatgtctggcagactgaactcacagccctgagtgtcataagatgtggtgtagttgatcctacttccataaagctggaaaaaagatgtggtgaagagtggagcaaaaattgctgcaaggaacatagaagaggtggcatacatccacaaacttagcacctaggaaagatttgggtttactgaaacaaatgagaatttggccggtggagattatgggatggaattcaaggcagtaaacgcttctattcaaacagcaagacagtgctaaaggtcatccaaggaaatgcagtaatatgtgactacaactgcatttctttgaatgtgcatccaaaaattccagtattttgtgtaaagtgtgccatgaacacaatcatggcttaaataagtgtttctcaacgtgaacactgctgggacattggggagggtaatttttttgttgtaagaatagtctcacatgctttgcagggtgtttttcatccctggtgccacccactaaattatgaccatatcccccagctattgtgacaactaaaacatctttacatcttcacactcttccaaatgcctgttagagatataataccaccaatcctcattaagaaacgctggtttaaataatacacttcttctatgttgtgaatcttattcacactggaactttgtcaggctatttgatggacaggtggcttatacgctactagagtttgcaaaaatagacgccttggcaataatacatagagatatgaaatgcttcttttgccctacagaagaacaaagtaagaaggacacattaaataaaagatgttcatccctaaaattaaagtatattgttctttattctctcttttatatacataaggggtatattaaagtttgtatttggccatttctaataagcaggacttaaaaaaatttcaatagatttagggatacaagttgtttttggttacatgaatgaattgtatagtagtgaagtctgggcttttagtgtatccatcacccaaatagtgtacattttacccaataggtaacttttcatcccctcccctctccaaccctccctgcttctgagtctccagtgttcattataccactccatttgccttttcatacacatagcttagctcccacttataagtgagaacatgaagtatttagttttccattcttgagttacttcacttaggataatggcctccagttctatgcaagttgctgcaagtgacattattttgttctttttttatggctgagtagtattccatgatatatacacatgtatgtgtatatgtgtatgtgtgtgtatatataaaaaagtatataaaacaaaatcacttttagttacatgaactaatgcctcatataaaataaaaaatatatatgatatacatacatatatgtatatacatcatggaatactggtgtgtatatatatgtggtatgtatgtatgtgtaatatacatatctggtgtgtatatatatatgtgttgtgtgtgtatatatatatatgtggtatataaacatgcacacacacagacacacacacaccccacatttttgttatccactcatcagttgttgggcacttaggttgactccttatttttgcaattgtcctgcaatcaacatacatgtgcaggtatcttttttttttccctttttgcacatatcaaagttttattcaacccattaatgagagaaccatccaaaagacaagatctctacttcctagagtatgtgaacagagatttatagtctgttagcaaagcaatactgaaataagattcctaaattagatacacgttggttagtttcccacagggcaatacagttgtaacttttggggtaatctttcctaccagacccatgaagcaaaaagagacagaggtggaaaggaggaaatggtgatacctcgaactcaggagaaactgatactggatttatctttcgcaatatccaatgtctccttcaaacatctggacctctctcaaggacaccagctattatcttttgcccttgctcttagctgttaaagctttttttttacagaattttcataaccactgctttcttttccttcccactgatacccttacaaacttcagtttcttatcatctcgttgtgaaagtcagttaagcaaacaaaactcttctggagtgtttaagattccagaaaacttctcaaatcacttttcatttctactataagttgttcatttaacaccacaaagacaaatggaactcataaattgtgaatactctgcccctttaagaaaactttagtatgtttttacatttctttttttttttttatttcactttaagttttagggtacatgtgcacattgtgcaggttagttacatatgtatacatgtgccatgctggtgtgctgcacccactaactcgtcatctagcattaggtatatctcccgatgctatccctcccccctccccccaccacacaacagtccccagagtgtgatattccccttcctgtgtccatgtgatctcattgttcaattcccacctatgagtgagaatatgcggtgtttggttttttgttcttgcaatagtttactgagactgatgatttccaatctcatccatgtccctacaaaggacacgaactcatcattttttatggctgcatagtattccatggtgtatatgtgccacattttcttaatccagtctatcattgttggacattagggttggttccaagtctttgctattgtgaataatgccgcaataaacatacgtgtgcgtgtgtctttatagcagcatgatttatagtcatttgggtatataccctgtaatgggatggctgggtcaaatggtatttctagttctagatccctgaggaatcgccacactgacttccacaatggttgaactagtttacagtcccaccaacagtgtcaaagtgttcctatttctccacatcctctccagcacctgttgtttcctgactttttaatgattgccattctaactggtgtgagatggtatctcattgtggttttgatttgcatttctctgatgggcagtgatgatgagtattttatcatgtgttttttggctgcataaatgtcttcttttgagaagtgtgtgttcatgtccttcgcccagtttttgatggggttgtttgtttttttcttgtaaatttgtttgagttcattgtagattctggatattagccctttgtcagatgagtaggttgggaaaattttctcccattttgtaggttgcctgttcactctgatggtagtttcttttgctgtgcagaagctctttagtttaattagatcccatttgtcaattttgtcttttgttgccattgcttttggtgttttagacatgaagtccttgcccatgcctatgtcctgaatggtaatgcctaggttttcttctagggtttttatggttttaggtctcacatttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgtggcattatttctgagctctctgttctgttccattgatctatatctctgttttggtaccagtaccatgctgttttggttactgtagccttgtagtatagtttgaagtcaggtagtgtgatgcctgcagctttgttcttttggcttaggattgacttggtgatgcgggctcttttttggttccatatgaactttaaagtagttttttccaattctgtgaagaaaggtattggtagcttgatggggatggcattgaatctgtaaattaccttgggcagtatggccattttcacgatattgattcttcctaccaatgagcatggaatgttctgccatttgtttgtatcctcttttatttccttgagcagtggtttatagttctccttgaagaggtccttcacatcccttgtaagttggattcctaggtattttattctctttgaagcaattgtgaatgggagttcactcatgatttggctctgtttgtctgttattggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaattgaataccctttatttctttctcctgcctaattgccctggccagaacttccaacactatgttgaataggagtgttgagagagggcatccctgtcttgtgccagttttcaaagggaatgcttccagtttttgaccattcaatatgatattggctgtgggtttgtcatagatagctcttattattttgaaatacatcccatcaatacctaatttattgagagtttttagcatgaagggctgttgaattttgtcaaaggctttttctgcatctattgagataatcatgtggtttttgtctttggctctgattatatgctggattacatttattcatttgcttatatggatccagccttgcatcccagggatgaagcccacttgatcatggtggataagctttttgatgtgctgctggattcggtttgccagtattttattgaggatttttgcatcaatgttcatcaaggatattggtctaaaattctctttttttgttgtgtctctgcctggctttggtatcagaatgatgctggcctcataaaatgagttagggaggattccctctttttctattgattggaatagtttcagaaggaatggtaccagttcctccttgtgcctctggtagaaatccgctgtgaatccatctggtcctggactcttttttgttggtaagctattgattattgccacaatttcagatcctgttattggtctattcagagattcaacttcttcctggtttagtcttgggagagtgtatgtgtccaggaatttatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcagtctatcaattttgttgatcctttcaaaaaaccagctcctggattcattaattttttgaagggttttttgtgtctctatttccttcagttctgctctgattttagttatttctcaccttctgctagcttttgaatgtgtttgctcttgcttttctagttctttgaattgtgatgttagggtgtcaattttggatctttcctgctttctcttgtgggcatttagtgctataaatttccctctacacactgctttgaatgtgtcccagagattctggtatgttgtgtctttgttctcattggtttcaaagaacatctttatttctgccttcattttgttatgtacccagtagtcattcaggagcaggttgttcagtttccatgtagttgagtggttttgagtgagattcttaatcctgagttctagtttgattgcactgtggtctgagagatagtttgttataatttctgttcttttacatttgctgaggagagctttacttcccagtatgtggtcaattttgcaataggtgtggtgtggtgctgaaaaaaatgtatattctgttgatttggggtggagagttctgtagatttctattaggtccacttggtgcagagctgagttcaattcctgggtatccttgttgactttctgtctcgttgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgtttttcattgacttggtagatcttcctccatccttttattttgagcctatgtgtgtctctgcacgtgagatgggtttcctgaatacagcacactgatgggtcttgactctttatccaatttgccagtctgtgtcttttaattggagcatttagtccattgacatttaaagttagtattcttatgtgtgaatttgatcctgtcattatgatgttaattggttattttgcttgttagttgatgcagtttcttcctagtctcgatggtctttacactttggcatgattttgcagcagctggtactggttgttcctttccatgtttagtgcttccttcaggaggtcttgtaaggcaggcctggtggtgacaaaatctctcagcatttgcttgtctgtaaagtattttatttctccttcacttatgaagcttagtttggctggatatgaaattctaggttgaaaattcttttcttcaagaatgttgaatattggcccccactctcttctggcttgtagggtttctgccgagaggtctgctgttagtctgatgggcttccctttgtgggtagcctgacctttctctctggctgcccttaacattttttccttcatttcagctttggtgaatctgacaattatgtgtcttggagttgctcttctcgaggagtatctttgtggcgttctctgtatttcctgaatctgaatgttggcctgccttgctagattggggaagttctcctggataatatcctgcagagtgttttccaacttgattccattctccccatcactttcaggtaaaccaatcagacgtatatttggtcttttcacatagtcccgtatttcttggaggctttgcttatttctttttattcttttttctctaaacttcccttctcgcttcatttcattcatttcatcttccattgctgataccctttcttccagttgatcgcatcggctcctgaggcttctgcattcttcacgtagttctcgcaccttggttttcagctccatcagctccttaaacacttctctgtattggttattctagttatacattcttctaaatttttttcaatgttttcaacttctttgcctttggtttgaatgtcctcccgtagctcagagtaatttgatcgtctgaagccttctctcagctcgtcaaagtcattctccatccagctttgttccattgctggtgaggaactgcgttcctttggaggaggaggggtgctctgctttttagagtttccagtttttctgttctgttttttccccatctttgtggttttatctacttttggtctttgatgatggtaatgtacagatgggtttttggtgtggatgtcctttctgtttgttagttttccttctaacagagaggaccctcagctgcaggtctgttggaataccctgctgtgtgaggtgtcagtttgtccctgctggggggtgcctcccatttaggctgctcgggggtcaggggtcagggacccacttgaggaggcagtctgcctattctcagatctccagctgcgtgctgggagagccactgctctcttcaaagctgtcagacagggatatttaagtctgcagaggttactgctgtctttttgtttgtctgtgccctgcccccagaggtggagcctacagaggcaagcaggcctccttgagctgtggtgggctccacccagttcgagcttcccggctgctttgtttacctaatcaagcctgggcaatggcgggtgcccctcccccagcctcgctgccgccttgcagtttgatctcagactgctgtgctagcaatcaacgagactctgtgggcgtaggaccctccgagccaggtgtgggatataatctcgtggagcgccattttttaagccagtcggaaaagcgcagtattcgggtgggagtgacccgattttccaggtgccatccgtcacccctttctttgactcagaaagggaactccctgaccccttgcgcttcccaagtgaggcaatgcctcaccctgcttcggctcgcgcatggtgcgcgcacccactgacctgcgcccactgtctggcactccctagtgagatgaaccccgtacctcagatggaaatgcagaaatcaccgtcttctgcgtcgcccacgctggaagctgtagaccggaactgttcctattcggccatcttggctcctcctcgcaggtatctttttgatatagtgaattcttttcctttgggtagatacccggtagtgggatgttgaattgaatggtagatctacttttagttctttgagaaatctccatactgtttttcatataaaataattgttaatgtttaaaagagtgataattttttaaataaaaagaatccttttcttttagacatacactgaaatatttatgaattaaatggaatgtttagtacttgctcttcattggagagtatcttgccccattgaccctccaggattgtttagaatttgtggtgatatctgaacagctcaggcaagctttagggtaacatattcataaagattgtacttcttggagaaaatgaaaatgaatatgcttaatggatcattctgccatctctttatcatccattaacttttcattatctacctctagcagagaaataggcattgcttgttcattgcttccctgaaattagattaaaatgtctcacttgtttttaggttttccacaatttcagcatggtcttggctttagtcttttgagagctatcttcagattttatgtcacttctgtatcatttgtgttaaaaactttgagatcataatatttttctctcctttctcaatacattttaaatttgctgtttgactatgtctagtatttcttctgctattagaagaggtaatttcctatttaaatttctatcctgctcatattacaaactagtccaaaataacatgttaaaatagcagttaaatatgtttcttcaggcttgtgcatgaggatattatcagaaagggaagcatgaggatattatcagaaagggaagaagtgatgaccaaaaaataaaaataaaagagggagagaagactagaatatatctaaggcagttttttcaaaagcaagatttgagttctagcagatattcagataatcgaaactccttatcactaccatctcttgcctgtgctgaatttgtcacctgtgttagggatgattcattcctgttttctacgtggaaatctgaatctgtaataacattatttctttctttctttctttccttctttcttttcttctttctttctttctttctttctttctttctttctttctttctttctttctttctttcttctttctcatctaaatgctctccactagattggcacagtaaggcttatgaatcaataagttttattcttgtatcatatctatgtagccactgttgagtttttatttccaaaatcatgatctttaatagaagcagaaggagaaatactacgtgtgccctcaaaccacctaagtttcctaagtagtgcttcaaggttgctctagttaaattctgactatgttgtttctcacagtgaatcagcagaaacaagtccacatccaatatggttatatgttttgcctgactcacttcagagcaattacttctctatcaaagttttgaaaataattattgtcatcttcatgataagtcttattcagtaatatctcaataatctaactaatgggagtcacttagtttcttttgtcaaaattttgagttatttttagtaagattttaatagtgcttagtccatatactgctatgtagtggtaccataccttagtagaagtagaaagaacatcagaaagggtgtcaaaaataaatcttaacataatggcagtagagtttgtcgggagtgtgacttactagtatgccctaaagttttctaatgctgtaagggagaaatgatgatacctgagatttttgtaatacatgtaaaagtacttcacgaacatttcatgtacacatgcaactataagttagtgtgattgatatatcaacccttgagtccctgtttttattttcattgatgttcttttctcttgtttccttctgtatatgattagacatcatctttgttagtttctttctatatcatacttctgtcttagaggcagtatactgagacagagttttaaaaccccaggtcttctttttttttcctgtaatttattgatttgttgcttatttgtaaagttaggataataatactgatctcatgaacttgttgtgagggttagatagaaacatgatagagaaatcaagagttcttgtgttgaattttttcccaaacccgaatatccaactatgtagtagatggtccctcattgattttcactatttcttctaactcaagtttttaaagattgaaggaattttctcatacaaatatcctcctgtgttctctatcttagtcagtaactgtatgatgtgtcaactagcccaagtatctgggactaatctcttttattccatcaacaattaagttttactgaattgaccatgtataattttaaagcttgtggctctctattccaattttcactacattagttcaggcacttgtgcttttatacctgggttattgcaatggccttctaactctccttttggcatatagaattctctgtcctgtgtccagctcattgtcctccttggtgttggtaggtgttttttacaatgcatatctaatcacctatctaatcccttgaaatattaaacagcaatggtaatagtaagcagagaaccttatgtaaaaattcatctaatgttcttccatcaagggtaagatcatattaaaaaagcatccactgagtcctgttttattaactattttcttcttttttaaaattgagaattgctgctaaactatgctaaatgcattttctatatctgtggagataattgtatgattttctctcctttgagctattaggatttcgtgatattgaacaatttttgcattcctggaataaacttacttggtcatcctgtgttttcctttcagtgtgctactggatgacatttgccaatacattatgtataatttttgcattgataatcataagtgatattagtttgcagtttttttattcttgtgtgaactttgtaacttaaggtatcagtattagcccagcatctttaaattgaatttgtttttttctctcttttatatatgctctgaaacagtttaaataacactagaattgtgtgatctaaaaatattgcgtagaactctccccagaaacatctgagtctggtgctctttatggagtagctcttttatctttctttctgttttcttttttgatggtaattggcttgtttacagttttacatttcttttttcttctgttagttgtgttacattgtaatcactagaaaattttccatttcactcaagttttaaaatgtatttgagtatagtttcataatacagttttcaaaactaaaattgatttatatggttatttggcctttgtcatttcttattttgtgtatttatgctctttcatttttattaaatcattttctattttagaaatgtatccaagtagcagattttaatttatatatcggttttactgtttttctgtttcctatttcatcaattttgaatggatacttaaagttcatatgctaaatgactatagatgcatagatttgactttaaaattcatgacataacatgtaaaatgtgtgcattcaataagtacttattgaatgaaatttttctcttatatattggagaatatttgaatatattacacatttagaaagtacacttgggttttttagtttttttttttctttttgagatggagtctcactccgtcacccaggctggagtgcagtggcatgacgtctgctcactgcaacctccgcctcctgggttcaagcgattctcctgtcccagcttcccgagtagctgggactacaggcgcatgctaccacgtccagctaattttttgtacttttagtagagacaggttttcaccatgttaaccaggatggtcttgatctcctgacttcgtgatctgcccgcctcggcctcctaaagtgctgggattacaggcgtgagccaccgcacctggctgggttttctagtattttatcaggtttgtcttttatggtgagtggttaatctgtccttagaattttcatgctaatattttagaaaaaagttttatgggctaagatttctgaaaggactgaagtggtacatcagtgaaaagtgtgctaaattgtagctacaactgcttttggactattagaaagaaagaaactaaaacgccatttgcaaaataaaagtctttatcaatggataatgcaagacatttaataattgctatgattaaagtctggggatattgttggtttctctgtagatatttttaatcttttggtgtaatataggaagtgccactataaagtaattaatatagtaatgttttatgtggcttatagcaagtatgccagtattctcagaaatgatatcaagagtggagaaaccaggatgagcgtacaccaaaatgtgtacagggagacattgtagctagtggaaagagaattggaataagagcaagaagaaccctgactctgcaaacagctggtcatgtgaatgagcccaaattacttgacgttttttacctgcaaaagcattgggttgtccctattcatcctttatatccattttatgatatcatgattttaggtttaaaataatttaaatgaccaatgaaagtgctgagattatgtgtagctaattagttcagaatgattatgtctaaaaaattaaatgtagattaaagttgtgtgtatgtgtgtgtatgtatatacgtgtgtatgttagagaaagagtttaaaagaagaaagcttaaagaggatgattatttgtgtaagatgcaatatggtagtaaaacttgcaatactttagtttgtattttatatttgggttattttgcttgtttcactgaaattgaaaaatattcagatcacatctaaactgagataagcatcttcaaatgctttttattaggttactttatattggattaaatgtggtttcagttgaatgaaatgtaaaaaggtgggtgtggaaaatcatgggatgaaaactgatgctagagaatttagaagctccatattaatttgttggtttatctctacacctccgtatctaacacaatacctggcccataatgaattctcaataaatctctgttggattgaattgtggcagtaaatagcaaaaataaagtatatagcaggtcattcactgttttaatataaagtctatactcatatacatatctttgtagtgcatgtggttacattttgctttgcagtaataacattgaaggttttacttgaatgaagcaggttgtcttgaatggatggttgctattttagtcttattcatcagtactttacataaaacacaaatttttatatttatctaaaaatattaatgtaaaacaccatagtaagtagcaaaattaaagagtaagggggaatatttcttacagtgcttttaacaggacaaacttccattacatttggcactctcctcactcacttttattgctatttacttatttcaaccaaaatttccttcatagacttaatttgtatgtgtttagcagtacatttaaaataccttacttgaagttgggagctcttcttggatgtttgcagtactctggtgtttcaagccagtcagcttatgataattgtttttgtgcccctttctggctacctcctgtgattaataattggccctgtgattctattttgtattctcttgaaataattctttgtggttttctacttcccaatttttcagaattctgctctcatctttcatacatcataaccccaaatagagtcttcaggtaattctctgcttttcaagaagagtgaaagctagaaacctgttttgtttgctgacctttgcttagagtcactagcacaatatttacatttaacataattgcactctcatattaatcacttgctttttatgtggtttgtttttatttctctgaattttaaattgagcacagagattatgtgtcatattaggttttgtgttttcacagcacttgtcacctgagactcactcaatttatatccagaatttgtaactgaaaatggtttcaggtttcttttactcctttcttcttttgtgaatctctacagcaacctgtaatgaatattattattgactttcaatactgctgctctgaaagatttagagatagatctaatatctttatggctacaaaaaagaatggataagcaaatttttattgcctttagtgactcattaaaatattttaaaaacataattcaagaaataataaaatcatgaaagcatgaattcagcaattattttgaaaagtttagcattttttctatacttggctctgtcataatgttattccaggcagaaaacttatatatctttctttgtggtctaaaaagattaaatcttcttgttacaataagaatgtcatttttttcttgttagagccccattactggtagagaatatctggtcctagttaccaataaggaaaaataaattttttagaaaatgtatcttttattcaatctgaattctacttaattttccatatatcaaatagtttactcaaatatagcttccagtttaatattttatgtgatttgtggtatatgttagtcatgaaactttttaaaaactttttttttatttcaataatacttttggggaacaagtggtgtttggttatatgaatgaattctttagtggtgatttgtgagatttttgtgcctccatcacccgagcagtgtacgctatacccaatgtgcagtcttttatccctcgccaccccccaatcctttcccctgagtcccaaaagtccaatgtatcattcttatgcgttttcatccttatagcttagctcccacacaggaatgagaatgtatgatgtttggttttccattcctgagttacttcacttagaataatagtctccaattctatccaggttgctgtgaatgccattattttgttccttcttatgggtgagtagtattccatggtatacatatatcacattttctttatccactagttgattgatgagcatttgggctggttccatatctttgcaattgtaaattgtgctgctataaacatgcatgagcaagtatctttttcctatattgacttctcctctgggtagatacctagaagtgggattgttgggtcaaacagtagatctacttttagttctttaaggaatctccacatcattttccatagtggttgtactagtttacatttccaccaacagtgtaaaaatgttccctttttgctgcattcatgccaacatctgttattttttgattttttgattatagtctttttttgcaggagtgaggtggtatttcattgtgcttttgatttgcatttccctgataattagtgatgctgagcatttttccatatgcttgtcggccatttgtatatcttcctttgagaactgtctagtcaaccccattttttgatgggattgtttgtgtttttcttgctgatttgtttgagttcattgtagattctggatattagtcctttgtcaaatgtatagattgtgaagattttctcccatgctgtggattgtctgttaactctgctggttatttcttctgttgtgcagaagctttttagtttcaataagtcccatctattcatttttgattttgttgcatttgcttttgagttcttggtcatgaagtatttgcctaagccaatgtctagaaggggttttccagtgttaacttctagagtctttatggtttcaggtcttagatttaagtctttgatctatctagcaattagttgatttttgtataaaatgagaaatgaagatccagtttcattcttctgcatgtgacttgcctattatcccagcatgatttgttaaatagagtgtcctttccccactttatgtttttgtgtgctttgtagaagatcaattgactgtaagtatttgactttatttcttggttgtctattctgttccattggtctatgtgcctatttttcataccagtaccttgatgttttggtaactatggctttatagtatagtttgaagtcgaataatgtgacgttttcagatttgttctctttgcttagtcttgctttggctatccaggctcttttttggtactatatgaattttagaattgtcttttctagttctgtgaagaatgatggtggtattttgatgaaaattgtattgaagttgtagattgcttttggtagtatggtcattttcacaatattgattctactcatccatgagcatggaatgggtagaatcaatattgtgttgcttgtgaattctctcagcagtgttttgtagttttctttgtagaggtttttcgtgtccttggttaggtatattcctaagtattttatttctttttaaagttgtggtgaaagtggttgagttcttgatttgatttttagcttggtcactgttggtgtatagcagagctactgatttgtgtacattaatttagtatcctgaaattttgctgaattcatttgtcatttctaggagctttttggatgaatctttagagtcttctaggtatacaatcatatcatcagcaaatagtgacagtttgacttcctctttactgatttggatgccctttatttctttctcttgtgtgattgctctggctaggacttccagtactatgttgaatagaaggggtgaaaatgggaatcttgtgttgttccagttctcagggggaaagctttcagcttttctccatttagtataatgttggctgtgggtttgtcatagatggcttttattaccttaaggtatgtctcctctatgcctatttttctgagggttttaatcataagcagttgctgaatttcatcaatagtttttctgcagttattgagatgatcacgtgatttttgtttttaattctgtttgtgtggtgtatcatatttatcaacttatgtatgttaaaccatgcttacattcctgttttgaaacctacttgatcatggtggataatctttttgatatactgttgtattcagtttgctagtattttgtgaggattttagcatccatgttcatcaggtatactggtctgtagttttttttttgctgtgtccttccctgggtttggtattagggtgatactggcttcatagaatgatttagggaggactccctctttctctatcttgtggaatagtgtcaatagaattagcaccaattctttgaatgtctgatagaattcagctgtgaatccatctggtcctggacttttattaccatttcaatctttctgcttgttattggtttgttcagagattctatatcttcctgctttaatctagtagggttgtatatttccaggaatttatccatctcctgtaggttttctaggttatgtgcataaagatgttcatggtagccttgaatgatcttttgtatttctgtgatatcagttgtaatctcttattttgtttctaattgagcttatttggatcttctctcttcttttcttggttaatcttactaatggtctatcaattttgtttatcttttcaaagaaccagctttttgtttcatttttttgtattatttttgattcaatttcatttagttctgctctgatcttcgttacttcttttcctctgctgggtttaggtttggattgttcttgtttctccagttctgtgaggtatgaccttagattgtctatttctgctctttcagactttttgatgtaggcatttaatgctaagaactttcctcttagcaccacttttgctgtatcacagaggttttgacagctggtgtcactattattgttcagttcaaacaattttttaatttccattttgatttcattgttgacccaatgatcattgaggaacaggttatttaatttctaggtatttgcatggttttgagggttccttttggagttgattttcaattttattccattgtggtctgagacagtacttgctataatttcagtcttctcaaatttactgagacttgttttgtggcctatcatatggtctatcttggagaatgttctatgtgctgatgaacagaatgaatattctgcagtttttgggtagactgttctgtaaatatctgttatgtttgtttattgtagggtatagtttaagtccattgcttctctattgattttctgtcttgatgacctgtctagtgctctcagtggagtattaaagtcccccactattattgtgttgccatctatctcatttcttaggtctagtagtaattgttttataaatctgggagctccagagttaggtgcatatatatttagaattgtgatatgtttctgttgaactagtgcttttatcattatatgatgtcctctttgtcttcttaaactgctgttgcttaacattttgttttatttgatataagaatagctactcgtgttcaccattccagttgcatggaatatctttttccacctctttactttatgtgcgtccttatgtgttaggtgagtctcctgaaggcagcagaattttggttggtgaattcttatccattttgccattcagtatcttttaaatacagcatttaagcactttacattcaacattagtattgagatgtgaagtagtattctattcattgtgctatttgtttcctgaataccttggttttttttttcattatgttgttcttatacaggtcctgtgagatttatgttttaaggagattctattttggtgtatttcaaggatttgtttcaaggtttagagctccttttagcaattcttgaagtgctggcttggtagtggcaaattctcccagtatttgtttgtctagaaaagactgtatctttccttcatttatgaagcttagtttccctggatacaaaattcttggctgataaaggaggctaaaaataggaccccaggctgggcctggtggctcacgactgtaatcccagcactttgggaggccaaggcaggtggatcacctgaggtcaggagttcgagaccagcctggccaacatggtgaaaccctgtctctactaaaaatacaaaaattagccaggtgtggtggcaggcacctgtaatcccagttacttgggaggctgaggtgggagaattgcttgagcccaggaggtggatgttgcagcgagccaagatcatgtcactgcactccagcctggccgcagggcgagactctgtctcaaaaacaaaacaaaacaaaagaaaacaacaacaaaaaaataagaccccaatcccttctagcttgtagggtttctgctgagatatctgttgttaatctgctaggttttcctttgtagcttacctgatgcttttgcctcagagctcttaagattctttccttcatcttgactttagataacttgatgactatgtgcctgtgtgatgatctttttgcaatgaatttcccaggtgttctttgagcttcttgtatttggatgtctaggtctctagcaaggctggggattttttcctcaattattccctcaaatatgttttccagacttttagatttctcttcttccttgggaacaccaattattcttaggttcagatgtttaacatagttccaaacttcttggatactttgttcattttttaaagttcttttttctttgtgtttggtggattgggttaattagaaagccttgtcttccagctctgaagttctttcttctgctttttcaattctattgctgagacttcccagtgcattttaaacttcttgtgtgtccttgatttccagaaattgtgattgttttttatttatgcgctctatttcactgaagaatttttttcctttcatatcctgtatcatgttttttactcatttagttgatcttcacctttctttggtgcctccttgatagcttaataattgatcttctgaattctttttctggcaattcagagattttgtcttggtttggatccattgctggtgacctggtgtgatcctttgggggcattaaagaacgttgttttgtcatatttccagagttgtttttctggttccttctcattttggtagactatgtcagagggaagatctggaattcaaaggctgctgttaagattcttttttcccacagagtgctctcttgatatggtgttctccccattcccctaggaatggggcttcctgagagctgaactgtagtgattggttttgcttttcttggtctagccactcagcagagctactaggctctgggctggtactagggagtctctgcaaagagctctgtgttgtcatctgtcttcagattttgcagctgtggatgccagcacctgctctgatgtgggtagcaggggagtgaagtggactctgtgagggtccttggttgtgtttttgtttagagcactggttttgtgttggtcggcctccagccaggaggtggcactttcaagacttcatcagctgtggtcctatagggaggatgctaacttgctctagggatacctggttaggtattctgatgtctcaggcagtgggcagagccatagaactcctaagagattatgatctttgtctttggctaccaggttaggtagagaaagaccatgaggttggggcagggatagatgtgtctgagctcagcctctccttggatggggcttgctgtggctgctgtaagggatggggatgtggttcctagtccaatggagttacattcccagggagattatggcttcctctgctgagtcatacaggtcactagggaagtgggagaaagctggtagtcacaagcctcacccagctcccatgcagcctgtagtcctaaaggcctatgtcattcccactgtgccccctcaatagcactgggtccatttccaggcactggtgatcaggtgtgagaacatgccccagagcacaagcctccctgttgagaaagcaagcaaactcacactttttcaccatctcagggagcctgcagcagtgatccagttccttcaaagggtccatggattctcttggctttcctgatgtgtccctatggtagttcttggagcaaaagttcatgatgtgtctccacatactgctgtgtccatctgagctggagctgcaagctagtcctacgttctattggccatctcctacaacagttctggtcatgaaattttaagcacaacagagcatatcacatctattaattatgtattgacttgcttcaatattgctatgaaaactttgaaagttaagaatagagtactatgtaattattttaatatttttgcatgcccattgcaaatactacccagtgcacagaacagcccctcacaacaattattagatccaaaatgctcatagtgctgagattgagaaactctgatttagatcgctgatatgtgaaataaaatctattagcctctgggaattattttctttctgccattaaaagatgtagaggatgacattgcttctttaatttaatttaattaattaattaatttattttttgagacgaagttttgctctgtcacccagtctggagaacagtggcatgatgttgcctcactgcaacctctgcctcctgggttcaagcgattctgttgcttcagcccagataacttttgtatttttagtagagatggggtttcatcatgttggccaggctggtttgaaactcctgaactcaagtgattcacctgccttggcctccccaagtgctgggattacaggtatgagccactgtgcccagttctgagattgctttttttaagtttttttaatttttaattttgggactgcttcttgtactgctggatgttgtcttgtctaaatgtgatacctggaactctggtagccgtcttgtgactctgaggggaacctaggtgtattagttatggttctccagagaaaccattaacaggctatacctgtatctatcatctatatctacaaagagatttattttattataaggtattggctcatgtgattataaaggctgagaagtctcacaatctttcctctgaaacccagaaagactgatggtgtagtttgaaggcttgagacctggagagctgatggtgtagatttcccttctgagtctgaaatcctgagaaccaagagcatcaagggcagaagatcaatattccagctcagtagtcagtcagagagagaaagagaaagagataaacaaattccattacttcatatttttgttctatccaaaccctcagtggattgggtcatgcccactcacattggggaagatgaatttctttgctcattctcctaattcaaatgctaatttcctcctgatacatccttatagacacacttagaagtaacataagtaatgtttaaccagatgcctaggcatccctgattcagagaggttgataaatacaactaattgtcacacatccaccctttttcaacttggcacccatatgcatctccttaaattatatttaatctccagacagagacaatagcaagaccatagttctgccatgatataattacactgcatacaaccaaaaatacactccctcttctgtcttagtctgctctgaatgctataacaaaataccttagactgggtaatttataaacaatagaaatttattgctcatagttctggaaatggggtgtccaagatcaaggcaccagcatattcaatgtctggtgagggtttgctttctgcttcaaagatggcacctacttgctgggccctcacatggtgggagagggcgagggaattcatttgagcttcttttataagggcactaaccccttcatgaaaatggatccccataacttaatcacttcccaaaggcctcacctcttaatactattacatttagcattatgttccaacacacaaattttggggggacaccaacattctgatgatagcacctttcctaaaagaagaggtaaatcttggagtgttgtttactctttttatgaatattctgtaatttaataattttgttgtaaaataaaatttatgttgtactcacataaaatcagtacatcttgttatatgataggggaataagagagagaagaaaacgatattttcagatacacacagaaacacatatgttcataacaaagtactcatgacaattacagtcttcatttttataactgtttacatgagttttataactagttacttgatttttataacttgtcacaggattgtagctgatataactggtacatgtaactgccttcttccattacccattttgtatggttttggttctatatctggtagattgacccaaacctttttttctgaaaggtctgtcattagtagtcctgtctgaattgagttgtgatagttttccattgatctaaatcacaaggcatgctaataccaaaaggcatgctaaaagatctactgcattcaagacattgtttttcttctattgtggagtagtagttcaattttcccctggtcattagcatcaatcaccaacatagtaactttgttcttttcttattgattcagaggcatgaggaattcaaagtgggcaggtggcagccttaacttccagttcaatggaatcattgctgtgtctcctggtagaagcatcttctctttgagactaggacatccaggccagcagaatatcaggttgcatgaataggaagcaaatattttgttagtgggtcactatggtaatagcagcaccactcctttttcacttcttgatttctgaacctgtaaatcctggctatgatggaaacagcatcatttatcagacgttgattcagagcatatcctcagaatcttgccccatccttgcaagttcttgccacccagctggtagttaactgagtctttggaagaatatcccaccattctatcaaaccagctgttttaggatggtggtggaacatagaaaggccagtaaaattccataagcatgggcctcttactgaactttttttgttgtgaaaggagatccttgatcagaagcaatgctgtgtggaatatcataatgctggataagacattctataagtcaacaaatgatagttttggcagaagtattgcatgcagtgaaggtaaatccatatctagggtaaatgttggttttagtaagaacaaaacactgctcttccatggtggaagtggtccaatgtaatcaacctgccaccaggtagctggctgatcaccctggggaatgatgccatatcagggaatcatatgtgttttttactgctggcagactgatcactcagtggtggctgtaaccaggttggccttggtaagtggaagtccatgttgctgagtccatacctaaccttcatttctgctaccatggccactttgttcatgagcccactggatgatgacagatgtggctggggaaagagatagattgctagccacaaaaacaatcatcctattcacttgattattaaaatactcctctgctgaggtcaccctttggtgagcattcacatgaggcacaagtatcatcatgttttttgcccattcagagagatctatccatatacttcctccacaaatttccttgtcaccaattttccaatcacattccttcctagttcctgaccaccctatgccccagctcaggaattgatatacaatcacaaattaagtcatttcttcttttaagaaaaatgaacaaccaggtgcactcccctatgttctgctcaccaagagacattttcttcaccaggaaattgcccttcagtgatgtcccagaaagtggttgtagtgctgctgctgtctttttggtggtgcttgtacatcatgcaaaaccatctgtaaaccaggcctgagtctcttcctctgccaactgattagagaaaacaactcatgagactgtaggtacagactcagagggagacagcagtgtagcaagggtggggaccatgggcatttgggccaattcttcatgttacttgttccttctggatgtccttagttctgatcacatacgtatcacttctacttgatgtagagatctgctgtacgtgctcaactttatggcatggtaagacagatgacattcagtaaatgatgagcagctcaggttccatggttacttggtggcccattgtcaagcattcagcctctactaatgcccagtagcaagccaggagccgtttctcaaaaggagagtattatctgtggtagatggcagacctttgccctgaaattccaaaggactaccctgcaattttccaatagggtctaccagagactccaagtagcatcctatctgccatttctacctttcaactactattgtatctgcttgatcatatggctcaagtagcagagcaacttgcacatcagcctggacttactggggagctttcttttgctctgaaccccactcaaaactaccagcttttggaggcatcacgctatctgacttcaaactatactacaaggctacagtaaccaaaacagtatggtactggtacgaaaacagagatatagaccaatggaacagaacagagccctcagaaataataccacacatttacaactatctgatagttgacaaacctgacaaaaacaagcaatggggaaaggattccctatttaataaatggtgctgggaaaactggctagtcatatgtagaaagctgaaactggatcccttccttacaccttatacaaaaattaattcaagatggattaaagacttacatgttagacctaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaagaaaccaccatcagaatgaacaggcaacctacagaatgggagaaaatttttgcaatctactcatctgacaaagggctaatatccagaatctacagagaactctaacaaatttacaagaaaaaaaaacaaccccatcaaaaagtgggcgaaggacatgaacacacacttctcaaaagaagacatttatgcagccaaaaaacacatgaaaaaatgctcatcatcactggccatcagagatgtgcatatcaaaaccacaatgagataccatctcacaccagttagaatggtgatcattaaaaagtcaggaaacaacagatgctggagaggatgtggagaaataggaacactttgacactgttggtgggactgtaaactagttcaaccattgtggaagtcagtgtggcgattcctcagggatctagaactagaaataccatttgacccagccatcccattactggctatatacccaaaggattataaatcatgctgctataaagacacatgcacacgtatgtttattgcagcgctattcacaatagcaaagacttggaaccaacccaaatgtccaacaatgatagactggattaagaaaatgtggcacatatagaccatggaatactatgcagccataacaaaggatgagttcatgtcctttgtagggacatggatgaagctggaaaccatcattctcagcaaactatcacaaggacaaaaaaacaaacaccacatgttctcactcataggtgggaattgaacaatgagaacacatggacacaggaaggggaacatcacacaccgggacctgttgtggggtcgggggggagggatagcattaggagatattactaatgctaaatgactagctaatgggtgcagcacaccaacatggcacatgtatacatgtgtaagaaacctgcacgttgtgcacatgtaccctaaaacttaaagtataataataataataaaaaaacaaaaacaaaaacaaaaaaacaaagcaaaacaaaacaaaaaaaacaaaactaccagctttttaagtcactaggtaagggggctggagtaacacacccaaatgaagaatacattgcttccaaaattgaaaggggcccactaggcactgtgcctttttcttaccgtaggaggggccagatgcatcaacttgtttttcacattagaagaaatatcccaacatttcccataccactgatccctagaaatttcactggagtagaaggcccatgaattttagtcagatttattttatatcctttgacatgaaaatatcttacctttacgtctagagtagttggtacttcttaattactgtgtccaatcaacatatcatcaatgtattggaccagtgtgctttcttgtggaagggaacaatgatcaagatccccgtgaactaaattaagacatagggctggagggttgatatgtacctgaactacaactgtgacattgttttgctgactttgccagctgaaagcaaactgtttctggtgggccttatggacaaatatggagaaaaagtatacttttccatagctacacactaggtactaggaatgtgttaattttctcaagtaatgaaaccacatttggtacagaagctgcaattaaaattaccatctggtagatcttacaataatctatggtcattctgtaagattcatttgtcttctgcataggccaaatgggagagttaaatgggaacgtgatgggaaccactaccctgcctctttcaagtcctttatggttgcgctaatctctacaatctctataggaatacaatgttgtttttggcttactattttcctaggtggaggcagttctagtggcttccattttttctcccataatagccttcattccacagattaggaatcaatgtggggattctgccagttgctgagtgtatttactctattatttattttttgagacagagcctcgctctgtcacccaggctggattgcagtggtatgatcttggctcactgcaacctccgcctcctgggttcaagctattctcatgcctcagcctcctgagtagctggaattacaggtgagcaccaccacacctgactaagttttggcatttttagtagagacaaggtttcgccatgttggtcacgctggtcttgaactcaagtgatccgttagcttcagcctcccaaagcactgggtttactggcgtgggccaccatgcttggccaattctaattatgctttctcagaactaaagaaataaccacagggtgtatttgaggaccttctgtgagatggacctgagctcaaactccattgatcatctgactcaataaacttctactgtgactagtaggccacagtgatgttttgggtctccaggaattaatgtcagtttagagccagtgcccaggagcccctaaaagttctgattattcccctttcctcaatgaacagttaccctgataactgtatgtccctttggggaagggtgggagaaagattagctgtacaaatttttggcaatgtaccagggctcttcctcaaggggaattggctaccctttcacccgaggtgttctgagtctgtaaactggctaaagtagaaaaacagattaaggaacatgtgtctctgtttttctgattcagattagacttttgtttacttgacctagaacttttctgcttatacacatcaaatatatatttcgtggtttcttattcatttcacttccaggaatgtcatgatcaactagctaattacacaggcctgtacgagtcagaccattctgcttgctgctttcactttgttatccatcacagtaacaatgcccgccatgcttttgatagctgagtgctgtcacttggctcctgccactctaggatctaattactctcattgtatttatgtttctcagtgtagcatgtgcagtttccactgcaagttccggcttactgagaagagcaatcttgagccctgtagcccaatgttgaagctttcctcacagattaatttctcacagtaatggtgtaaggtatgtcttctggatcctcccagcacgggtgggtaggtcttcagtaacaaatccactctaacattcttttttttttttttttttttgagatggagtcttgctgtatcacctaggctggagtgcggtggtgtgatctcagctcactgcaagctctgcctcccaggttcacgccattctcctgcctcagcctcctgagtagctgggactacaggcacccaccaccatgcccagctaattttttgtatttttagtacagatggtgtttcactgtgttagccaggatggtctcgatctcctgacattgtgatccgactgccttggcctcccaaagtgctgggattacaggcgtgagccaccgcgcctggccaatccactctaacattctaatctccttaatctccttaagtgtttgtatttattcctctacattcaacaaaggtaggttgggcatttccagtttccttactgtgggctacgttttggtctatttcagcccaccaacaaatgtactgctagagttcattctagctccctgagctcaagattacatgcaaaatctctgcttagtgagctgatatcagtagatttagcttgatccatatttatgttgcttctatggttacttcacacctttacaatccattccctgacatatttcctagattgtaatatgtataaattagaaaactcgggtagttcttttggagtgtaatgtaccttctcatgggtcacattttgtaccttacattaggggcctgctggaacttgagtctatttataggtctagaaacaaataggtgggtctttggtggaggtggatccctaggagaatcagcattgtcttgcagggcaactgcatcaagggaggccattacagttttctcaggcaacgcaaggttaatactcagctaggcatagaaaggctgataataaaagatgtgggaaggttgctactgctgggagtgaggagatctctttcactttcaaagaagactcatcagaatttagaagcttattgtctctagcatcattagggtcttcccacatgtccccatcccaacttacaatatctcattctttccaatcaaagttcattttaacagtagacactctgtgaggctgatagttcaacttgaattgtaatttagccgatcataggagaggacccgtgtttgatttccagcaagctcagccctgtagccgcaggagataaggattttgttcagaacaaacataggagatttctgatcattttaaaagcacttcatcgaggaatttgaatccctgagtgcatcctcttttttttctttttttcttttttttttttttgtccagcaacattaggagcaaccagctagtcttattctattagttagttttaaaaaatgttctgaagtagtcacccagcttccttccttttttcttcctttctttctttctttgagctaggatcttgctttgttgcccaggctggagtgcagtggcatgatcatcccctggctaattttaatttttttatagatacaaggtcttactatgttgcctaggctgatcctgaactcctgggctcaagtgatcctcctgcctcagccttctaagtactgggattataggtatgagccaccacacctggccagctcttcgcttcttataaatggtagtatccaattcagatattttatatatctctattgccatgttatgccatggttgatcattgctctctttattactggactttaattggattagaaagccagttccagaaattttagaaaaccaattcagaatattcatgcttaaaattctgttcccctccagaacaactcctggcaccaaacctttattagttagggttttatagagaaataaaagcaatagaatatctatagtctatattctagttagagtagaaatagctaaatacaatttgacctgataactcaatagacttaaaaggctggttgtgctcacaacttcttttaaaacgaggtgttttgcactgcacgtattgtaatatttattaccactgaataattttctttttttttaaattatactttaagttctagggtacatgcgcacaacgtgcaggttagttacatatgtacacatgggccatgatggtgtgctgcacccattaacttgtcatttacattaggtatatctcctaatgctatccctccccattccatccaccccacaacaggccccggtgtgtgatgttccccttcctgtgtccaagtgttctcattgttcaattcccacctataagtgagaacatgtggcatttggttttgtgtccttgtgaaagtttgctgagaatgatggtttccagcttcatccatgtccctacaaatgacatgaactccaaagctggaggcatcatgctacctgacttcaaactacactacaaggctacagtaaccaaaacagcatggtacttgtaccaaaacagagatatagaccaatggaacacaacagagcccccagaaataatactacacatctacaaccatctgatctttgacaaacctgacaaaatcaagaaatggggaaaggattccctatttaataaatgatgctgggaaaactggctagccatatgtagaaagctgaaactggatcccttccttacaccttgtacaaaaattaattcaagatggattaaagacttaaatgttagacctaaaaccaaaaacccaaccagtacctgccactgcaaaaacatgccaaattgtaaagaccatcaatgctaggaagaaactgcaactaatgagcaaattaactagctaacatcataatgacaggatcaaattcacacataacaatattaaccttaaatgtaaataggctaaatgctccaattaaaagacacaggctggcaaattggataaagagtcaagacctatcagtgtgctgtattcagagactcatctcaagtgcagagacacacataggctcaaaataaagggatggaggaagatctaccaagcaaatggaaaacaaaaacaggcaggggttgcaatcctagtctctcataaaacagactttaaaccaacaaagatcaaaagagacaaagaaggccattacatagtggtaaagggatcaattcaacaagaagagctaactatcctaaatatacatgcaccaaatacaggagcatccagattcataaagcaagtccttggagacctacaaagagacttagactcccacacaataataatgggagactttaacaccccactgtctacattagacagatcaacaagacagaaagttaacaatgatatccaggaactgaacttggctctgcaccaagcagacctaatagacatctgtagaactctccactccaaatcaacagaatatacattcttctcagcaccacatagcacttattccaaaattgaccacatagttggaagtaaagcactcctcagcaaatgtaaaagaatagaaatgataacaaactgtctctcagaccacagtgcaatcaaactagaactcagggttaagaaactcactcaaaactgctcaactgcatggaaactgaacaacctgctcctgaatgactactgggtacataatgaaatgaaggcagaaataaagatgttctttgaagccaatgagaaaaaagacacaacataccagaatctctgggacacatttaaagcagtgtgtagagggaaatttatagcactaaatgcccacaagagaaagcaggaaagatctaaaattgacaccctaacatcacaattaaaagaactagagaagcaagatcaaacacattcaaaagctaacagaaggcaagaaataactaagatcagagcagaactgaaggagacagagacacaaaaataccactgaataattttcaatgctggccttacagaggctattttttcctaggtattatatttgtaattaagagatattcagcaataggcaaactcagtaattatgcaatattcagtaaaagtaaaatttaataaataaaagtaataagtatatgatgggaatttgattttggatgtagaggactattttttcacttttttaaataaaaattttaaggaggttccactttggagagaatagtgtagatttcattttccttatttcttcctctcagtgaaactacaaactctggacattaaataaagaacaaataaggctgaggtgggaagatcacttgagcctggaagacagaggttgcagtgaaccaagaatgcaccactgcactccagctgggcatcacagtcagatcctgtttcaaaaaaaaccccaaaaccaaaaaccaaacaaaagcaacaacaaaaagcaaataagaagactctgaaaggtatgaaaggaagatagacgaagacaaactggccagggaatctggaacacagtggtgataagagccaaagattaaaaacacattccgtaaagggggaaaaaaaacattcaaatgacagcagatttctcatcagcaaccatagatgctagaagaaagtttaggcattacaacattttaaagtgcttaaagaaaagaattattaacccagaatttcatattgggtgaaaatattattcatgaatgaagaaaaaattaaaattctgagatgaacaaaaactaagagaatttgccaacagctacctactctaaaaaatggctaaaggaagttgtctaaacagaaagtaaatgatgaaaaaagaaatcttggaactttagaaatgaagaaaaaacataaaataaaaatatgggtaaatacaatagacttaatttctcctcttcagttttcgaatttatactttacagttgaaaaaaaaaacactgtgtaatgctgtcaatttatgtagaggaaatatttaagacaattataagttggggaggataaagaaacatagagagtgtaaagtttatacacttcattcaaactggtaaaatgtaaataccagtggatactaatgtaatacttagggtaaccactaaaacttttatcagaagaaatacactcaaaaacactagacatgaatcaaagtggaattctaaaatatgctcaagtaacatacaggaagatgaaaaaaagagatataaaaagaccagaaaaatcaacagaaaacagaataaaatggcaaacaagccttgacatatcaatgattacgttaaagtttatataatattcctctctgactttcagttggtgcatttagatcacttacactaatgcattaattaaaagacaaagatcagtagaatggatagaaaacatgaccaactacatgagttttctacagaaaactcacttcaactatatttatacacataagtcaaaagtaaaaggatgaaaaatatatgcaagcattgaggaaaataaaggaggagtggctatattaatatcaaataaattagagttcagagcaaagaaattacaaggaatggagagtgacattacacaatgacaaatgcatcgacccaccaaacaatcttaatgtgtgtgcaccacacaacaaaagtgcacaattatgtaaagaaaaatgaataaaactgaaagtaataataggcaaattcacaattatttttagacacttcaacaaccctttctcaacaactgatacaataagtagacataaaatcagtagaagagctcaacaatatcatgaaccaacaggatttagttgacatttacagaacactccacccaacagcagaagacattttttttcaagtacccatagcaagagacacaatattcagtcactcaacaaatatcaacaaatttaaaaatattgatatcatacagagtgtattctctgactgcaatagtataaaacttgaaattgacaaaggaaaattaacaggaaaacccccaaacactttgaaactaaacaatacatgcctaaaaattccatgggactaagaagaagtcttgaaggaaataaaaacatgcactgaactgaacaaaaatgaaaatacaatatataaaaatttgtagaatttagctaaagaaatttcaagaggtaaatttatagcactaaatgattacactagaaaaacaggaaaaagtctcaaatcaaaaatctaagcttctacttcagtatccataaaagagcaaaataaacccaaagcaagtagaaagaagaaagcaataaaacaagaacatgaatcagtgaaatcaaaaacagagaaacaatataaaagattaatgaaacaaaaaactgttttttgaaaatattaatacaactgacaaagctatagcaaagtaaaaagagagaagacacaaataacaaatatcagaaatgaaatggaagatctctctgtagatcttgaagacatcaaatgcctaataaggcaataactcagacaactccataaacattaatttgacaacttagatggaatggaccaatttcatctcaaaaaacataaatccaatttgcacaatatgaaatagataatttgatagccctttaacaaggaaatcaagtttataattaaacatttcccctcaaaaagaaagctccaggcccagacactttcactggataattctatcaaatgtttaagaattcacactgattctatacaatctgatccagaaaacaggagagaagagaatacttccttactaattctgtggtgcaagtattattctgatactaaaaccaaaaagagacaatgtaaaaaagaaaactgaagaccagtatctcttatgaatatagataacaacttcttaacaaaatactaacaaatagaattcacaaatagaaaaagctggctcaatatttgaaaataaattaaataacaaaattaacagactaaagaaaaagaccatatgactatattggtttattcaggaaaagcatttgacaaaattaaacactcattcatgagaaaaactctcagaaaactaggaatagggggaaacttccagaacattaaacaacatcttaaaaaatccccagctaatgtcatacttaaaaaactgaatgctttcccctaagactggggctagacaaaaatgttgactcaacattgctgttcaacagagtgtgcgaaattttaaccagtgaaataagcaagaaagggaataaaaagcatcagaaaaaaagaaataaaactgtttatagattatatgatggtttacaatgactccaaggattatgggacaaaaggccaatctcaaactgtgagaaaatatttgcaaacctgacacatttgctaaagacaaattttagaatataaagaactctaaaagctcacattaaaaagtaactgaagtaagaaacgagcaaaagacatgaaaagacattccactgaagataatacagtagtcttccctggccatggttttgctttccaaaaccaaaaatattaaatggaaaattccagtaataaacaattcatcatttttaaattgcatgctgtcctgagttgcatgatgcagccttgtgctgtcctgctccaccctactaaggacatgagttatatctttgtccagtgtatccccatgctgtatatacaacttgcctgttagttgcttagtagccaacttggttatcatatataaaaaaaatagtatatatagggtttgatactatcagtggtttcagacattcactgggcatattggaacatatgtaccctaagtaaatgagggggaactattatacacagatgataaataagtgcatgaaaagatggtaagacaaaagacaacaagtgttgccaaggatgtggagaaattggaatttttgcacacttttggtggggatgcaaaatggtatatatgctatagaaaacagtaggaaggtttttcaaaaaattaaaaatataactaccgtatgatccagcaatcccacttctgggtatttatttgaaagaattgaaatcatgatcccaaagagttattagaattcccatcttcactgcagcactattaacaatagccaagatatagaagcaacctaaatgtccatcaatagatgaatggataaagaaaatgtggaatgtatataaaatgctatttagtcttaaaaagaaggaaatttgcagtatatgactacatgagtgaattttgaatgcacttagctaagtgaaataagccagtcacagaaagacaagtactgcatgattccacttatataaagtatctataatagaaaaattcatagaatcgaatatgcaatggtggttacctaggctggacggagggggaaatggtccattacttatcaatggacattgattagtaatggactaacccattacttaaagttttaaagttaaagacttaaagttttagttaagtaacataaataggctctaaagatctagtgtagaacattgtacttatttttaataatatattatacatttaaagatttaagaggctgatattatttggctgtgtcccacccaaatctcatcttgagttcccacatgttgtgggagggacctggtaggaggtaattgaatcatgggggcaggtctttcccatgctatccttgtgatagtgaatatgtctcatgagatctgatggttttaaaaagaagagtttccctgcataagctctctgtctttacctactgccatctatgtaagatgtgacttgctcctccttgacttccaccatgattgtgaggcctcaccagccatgtggaaatgtaagcccattaaacctctttcatttgtaaattgcccagttgcgggcatgtctttatcagcagcatgaaaatggtacagtaaattggtaccagtagagtagggtgctgctgaaaaatacccaaaaatgtggaagcaactttagaactgggtaacaggaagagtttggaacagtttggagggctcagaagatgacaggaaaatgtgggaaagtttggaactccctagaggcttgttgaatggctttggaactgggtaacaggaagagtttggaacagtttggagggtgcagaagaagacaggaaaatgtgggatagtttggaactccttagaggcttgttgaatagctttgatcaaaatgctgataatgatatggacaatgaaatccaggctgaggtggtctcagatggagatgaggaacttgttgggaactggagcaaaggtgactcttgttacattttagcaaagagactggtggcattttgcccctgccctagaggtctgtggaactttgaacttgagagaaataatttaggatatctggcagaataaatttctaagcagcaaaacattcaagaggtgacttgggtgccattaaaggcattcagttttataaggaaagcagaacatagaagtttgaaaaatttgcaacctgacaatgtgatagaaaagaaaatcccattttctgaggagaaagtcaagctggctgtagaagtttgcataagtaacaaggaaccaaatgttaatttccaagaaaatggggaaaatgtctccagagcatgacagaggtcttcacagcagcccttcctattataggcctggaggcctagaaggaaaaagtggtttcatgggccagattcagggtacccatgctctgtgcagtctagggagttggtgccctgcatcccagctgctctggtcatggctgaaaggggctaatgtagagctcgggccatcacttccgaggatgcaagccttaggtcttggaagagtccatgcgttgtggagcctgtgagtgcatagaaatcaagaattgaggtttgggaacctccacctaggtttcagaggatgtatggaaacacctggatgtccaggaagaagtttgctgcaggagtggagcactcatggagaacctatgctagggcagtgtggaaggaaaatgtcgtgtgggagagcccacacagagtcctcactggggcgcttcctagtggagttgtgagaagaaggccaccacccttcagaccccagaagggtagatcctccgacagcttccactatgcacctggaaaagccaaaggcactcaacaccagccagtgaaaacagccaggagggaggctgtacccagcaaagccagagagccagtctgcccaagaccatgggaacccacctcttgtatcagcatgacccagatgggagacatggaatcaaaggagatcattttggagttttaagatttgagagccctgtgggattttggacttgtatggggcctgtagccccttcgttttggccaatttctcccatttggaatggctgtatttacccagtgccctcattgtatctgagaaggagctaaattgtttttgattttacaggctcataggcagaagggacttgccttgtgtcaagtgagacgtcggactgtaagattaatgctgaaatgagttaagactttgggggactcttgggaagggataattggttttgaaatttgagggcgtgagatttgggaggggccaggggcagaatgatttggtttggctctgtcctcacccaaatctcatcttgcattcccatgtattgtgggagggacctgtaggagataattgaatcatgagggcaggtctttcctatgctgttcttgtgatagtgaatgagtttcaccagatctgatggtttttaaaagaggagtttcctgcacaagctctctctctttgcctgctcccatccatgtaagacatgacttgctcctccttgccttccactgtgactgtgaggcctccccagccatgtggaactgtaagtccattaaacctctttcttttgtgaattgcccagtcttgggtatgtctttatcagcagtgtgaaaatggactaatacagaggctaaatctcatgttagtgttttcatcacatgctttttctctaaaaatatctttttaaataaaaaacctaaaaaaactctattataataaagtgacacacacatcacacatagtagaatttgtagaaatataactacctatctaatgatgtaaatttctgtcctaatattcttccctgtgactttaaatcttggttttctataagaatctttaaaaagaatttgatagcttttcagcatttctcagaatactactgtatcattcttgcttatttttcatgtggtacctgtggtataagggcagccattctgagtgtaagtctcctaaggtgatggcctctttatagcagggtctgtttactcagagaatgaggcagtcagtcagttctaaataagatataggtgacatgttaccatgggaataatttcctttattgaagcaatttttaagttcttaaattctgctttatgatcttttctccgagttcatttttttcttaaaatattctttctgaacatataaaacataactgaacaagattcaaaggatgcatgttacaaataggcagattttagttcaaatagcaggaattttctaatagtcaaagatattcaaagatgtgatgtattgttgtggaaaggagcaattaagctagagaaactttgaaatcacttccaactttaaggttatagcaataaagaaaagctgggctgggtgctgtggctcacgcctgtaatcccagcactttgggaggccgaggaggcggatcactagatcagggattcaagatcggcctggccaacacattgaaacctcgtctctatcaaaaatacaaaaattagccaggagtgtgtgcgtgcctgtaatcccagctacttgggagaatgaggcaggaaaattgcttgaatctgggaggcagaggttgcagtgaatggagatcataacacactgcactccaccctgggcgacagagggcaactccttctcaaaaaaaaaaaaaaaaaaaaaaaaaaaagctaacatttatacagtggttttcttttcagaaaaactaaaaaaatggcaagtgttccttttcaaagggaaatgatgcttgctgaaatcacatagagaagttgttgtaaattattaaaattataccccttattaataaacttatttatttattaattcaacaaatatttattaggttctactaagttctaggcatgattctaagtttagggctagaagatctagattaaagcaagtctctgctttcatggagcttatatctcagtggagagagggcaaaaaatacaaggatacatgataggcatgtggtaaatattgtttagagaaacataaatcaggatagaggcaatgggaaataaggggtgaggtgtgtgcttgtcattttatatagattagcaaagaagtcctctttgattaggtgatatttgagcctaaacttcaagaaagtgagacagttatgaagatattttgggtggatagggcgggtgggattgaattccaaataaagacagctgctgtaatgaattaggtatgttggcagaacaccaagcaggacaatgtggctggagtggagtaagaaagagagtaacagaggaagagcttcatcattaataacaatatattgtatatttcaaaattgctaaaggaatagatttttaaaatcctctccaaagaaaaataagttggtgagatgatgtatgtgttaattagcttgactgaatattttacaatgtatagctagatgaaaacatcacattgtacctcacaaatatacagaattattatttttcaattaaaaataaatttgtaagaacagaaaattttagagaagtggtggtggagcagacagtggttaaattataggacatggtaggccatgatgagtcttttagctttgttatgaatgagatgggaagcccttgaaagttatgagcagagaatgacttcatctttctcatgttttaaaaggattgttcttgctgctctgttaagaacatactgtagggtgtaagagtggaagcagagagactacttaagaaggagactactgcaataatctaagtgagagatgcaagtgcattggaacaggcttgggagtgggtagtggtgcaggtaagaagtggattcagcatataatttgaaagtagaaactacaggatttgctggtgaattggatgtaggatgtgagaaaaagaaataaataaaaatattacatccaaaatttttggcttgaacaattggaagaacataatactgaattaggtaaaatgcatcattgaaagtttccaggtgttgaggaatatgtctttgggcttgatgagcttcaacacatggctgttgctgctccttggttcatagttgaagacttggtgaaaatatttacttttcttcttcttgccacttgccaccacatatatgtctgtggtgcctggtaattcatggaagatgagcattagccagtgcttaaataaggtataccagtgacagaacatgaatttaaatattatgagtacaactcaaatcaatcaaggcaggatgatttagaatgcctgtcattttgtaattaggttttatatcattatgtgaaaaattttatgtgactgcttaactggacccattatttggtttctctttttgtctttaactgctgtattcctgcctagctgtacttccaaggctaatctaggttatcaaagcttttctttccttaaaatacaactttcaaaccaatagaaaaagttgacagctttcttttaaaacactactgcatgtcacctttcaacatatccaataaaatgttatttttacaatactgcctaggatgaatgatagtatccattttacttggaaggactttaactgttttctctgagtgatgtttttgggtttctctagggcatactttgagtgagtattctggaaatttttatttcaatttacacaacagtttactagtttttgtatgcttatttatatcagttaatttgacaagaaaatctgtgttgaaaaaatgtgttcatttgtctcatgagtactaaaatgtattatgggactttgaagaaatatgagtatgggttcaggggaataagagacaaaactcagaaataattagatggaacaaagttaaacatacagttacatatcaagaccataaaaatctataagtaactgtagtgttagaatagatttttaggtcagtcctcaagaccattgggattagcaggatagaaacacaagtaaaagcttcaatgattaatgaaataagatcaaaataggtactttaaaagaatgctgtcaggaatcataatcttgaatataaaattagttgctgtggtccagcagcagtgggaacagctaattgttgctgaatggtgttatgtagattgatagtgaggagtggggaaggcactgagaacttccctgggtgctgtaagagtagttagagatgcttttgtttgactttgcgatggcatcaccataacccaccaatgaatgacgagttactaccaatgggcagagcagtttctggaatgtactgaatgcaggtggttgtctgagtgccatgcttcgagaagcccattgtagctcagaggacttgaggaaggctgaacagatcgtacagttggccctaaaatattgagagtctcatactctaaaatcatgtactttcttctgtatggtacacatctttaggctgaatgttgcttatttataactactttttcccactgaatgctactctttagggctatttaaaaactctagagttggcctgaatcttaattttctaaaaacaaaacaaactccaagatcagggagaattaagcagaacaccatagtaggtatgacatgtgctttggaattggggagcgttctgggagaggattctgggtctaccacttaatttcgtgtgcaatcccaggcaaattgcttaattcctctgtgctccagttcttttatcagtgaaatggagtttctaatagtgtctacttcacagagttgttgtgaagaataaatataataatggatgataatggatataaagtgcatacattatctggctcaaaaaatagtagctcatattaacaggtcattttgttggcccactaagaaatatctttccacttccagaaaataataaagaggaaaaaaatctctgtgacgtttagtgtgcactgataggtaatatttaatctcaaaatttgctatttttaaataaaaaaactgctttttaaagtggggatttatctagcgattaggatttaaaatttttgatctaaaaatattcaaactattatagatatttagatttttatagggaaaaatttcattttctttaaggaggataacttccatctcttaatagtttgtagtatatacattaaaatattctggaataagctatcattcaaagtgaagcttaaaactaaaaatcagcaacaaacatttcatagaaactagaaaaattcaagaacaacgcgtcctttggtggtgcaggtctccaggcatgaccagttatggatgtggaaaggaaagccagtgtggaaatgattagatgactagccaaggcacaggtatagttttctttttcaccgtctagaattaatgcaggtttttagttgctttcctggctggcttcggctataaggcagcgggtttgttttctgataacaatccagctttttatgctctctcagatttaaccttacactgattatgttgccccttcacttttgtggtcagctgataacaaaggaaaggagcgcaaagaattcagttagaaattcacatccaaaacagcagacttttctttgaattctactatcagtttgtcttctcttatgatacttatactctgtagtggcattttggtttgcatataaaatttcccctactactgaagtgtaggtattggagagctttacacctaccactagtatttcttttctcacacctgtaacaactgattatcagcccctgctccaaaactttcagtcatcagaggttttacttcataacatatttttggatagataggttcccccaacaccaattttactgagctgaaattattaatattttattgggagaaatcacataacattttagttcaaaaagaataccttttattttggctcattacatttcttcatggatatttcccctagttttctctagttagaatccgcctccacaattcttattagcctgcaactcaaacacattatttttttcaaactggttccttctacatgagccgtctgaatcactaaagcaagaatcaatcagtcagcaatatttatcaagcacacactaggcgcagaaaactgtacaaagagctctaaaagtctgcaatattgattgtacctgtcatgccctgacatgtaaaggcccttatcacaagaaggaggtctccttaatgtaagtttttgattagcaggatgtgggatctggactgcagtgagagaaagagacattgcaaaacttctctgcctgggaaataaacagtaattttggggtggtgggggaggttcggggtgagtaattaagggaggagatatgaggtgaggaaagggtataggcaggtagggacctacaatctgataggagtctagagcctgggaagacacaactgttgaagatgcctctgaggcaaaaatggcagaagggagggctaatccttaactgtaacttgtcggcaatgctgagcagtgatgtgagcctcaggtcctctctccaaatttcagtggagtctcctgtaagaacagctttgagtctttggttgctgaatgacaaaagaagaggccagatggagtgggaaaagggagataagtataataaaatgaacacatgaacctacctcacctaagggagtagtattactaataatgtcaaggctgcctttgcaacattgtacccaagcaaggagcagattctcccaaatttaggagcctagtttattttaatcaccttattcctgagcttttgtttggtctttgcaggcttcttctaggacagtgaggagtaggaagccattggagcatgtggtgatggtggcagcagcaggaacaacagggtgtggggtcatacttaggcacaggtgagaaagattcctaattactatagatcctggctgattgagaatcacttgtctttagcctggtccagcagtgcaaagttaggggctgttgatcttactgaggtggcatgtttcacatctgtccctctgattctgaatatgcatacgcaattactaatcgtgatgtgggaaaggacaaggctttgcacaactactgatgtacctgcttatgtccattgcctagactcatctccttcatgaatttttagatagtcagattgtggtcttaaacctcaaatatctcactcttcaaaggcaaagacttacattttagggcttgttaagagtcttcagcttagcaatatgaatataatacccagaaagtgactgtatgtgccaggttcttgccaggaaagagatggcacactcaaactgggtaactgagtgagttttaaaaaatgacaatttatgaaggcataggtagggtttagtgaaagctgtaagacacaatgcagtgccctagggctagtatcaggtaggaactagcggacaaacaaaagatatcaagctactgccacgttgtttttctgtattttgagggatttaagcgttattcaaatataggctatcttatatcaggtatccggaggctactcatttcagccccgctgaataccatttcctccaagaaggctttctcataagcccagacagaggagctttgttaccctttgaacatctacagcaactgtatttctcatacttattgaacacagcaagatactgctttgaattcattgtacagaaaaacctctctgttaattattaattttttggctcctaaggccaaattggtgtctggcttattttttgcattctcccaaatgcctagcacaatgccttgtacccttttttcccactaaaagttgttgttttttgtttttttgaagttgccagccacagggtagcagggagaagattgatgcctacgcaaatataacagatccttgccttgtgttttcactcttgctaagataatccagtctctgcctggatgctactgacagcatttttagcaagattcatgacatcctccttctatgcaatctctaagacatggagcagcaagaattataaacttgaaatgttactgggatgattgttcccttgttgtgaagtctcttgctgtttacctacttcctgctttagcagtttcttttagactattctcatctgttccattctgaagtctaactccgttttcctcattactctttatcccaggctccttgctctagggttaagcaaagttgcttgttgctgtctcctcagtatgaacagcctaatttgcctcaggttttccacatgcatgttggtaagggccaaataaacgacctattaatatgagctactgttttttcagccagataatgtgctatccactttatatccattatcatccactatcatatttattcttcacagcaactctatgaagtagacactattagaaactactctttagtgatataagaactggagcacagaggaattaagcaatgtgcccaagattgcacaccaaattaagtggtagacccagaatcctctcccagaacgttgcccaattccaaagcaaatgtcatgcctactatggtgttctgcttaattctccctgatcttggggtttgttttgtttttagaaaattaagattcaagtcaactttagagtttttaaataactctaaagagtagcattcagtgggaaaaagtagttataaataagcaacattcagcctaagatgtgtaccatacagaagaaagtacatgattttagagtatgagattctcaatattttagggtcaactgtacaatctgttcagccttctgcaagtcctctgagctacaatgtgctgggatgacaggccctttcttttttaaaaattgaactaacttttagaaattattttaaaaacttttgttttaagcaatggggaaaggattccctatttaataaatggtgctgggaaaactggctagccatatgtagaaagctgaaactggatcccttccttacaccttgtacaaaaattaattcaagatggattaaagacttaaatgttagccctaaaaccataaaaaccctagaagaaaacctaggcaataccattcaggacataggcatggtgggcaaggacttcatgactaaaacaccaaaagcaatggcaacaaaagccaaaattgacaaatgggatctaattaaactaaagagcttctgcacagcaaaagaaactaccatcagagtgaacaggcagcttacagaatggggaacatttttgcaatctacccatctaacaaagggctaatatctacaatctacaaagaacttaaacaaatttacaagaaaaaaacaaataaccccatcaaaaagtgggcaaaggatatgaacagacacttctcgaaagaagacatttacgcagccaacagacacagcaaaaaatgctcatcatcactggccatcagagaaatgcaaatcaaaaccacaatgagataccatctcacaccagttagaatggcgaccattaaaaagccaggaaacaacagatgctggaggggatgtggagaaataggaatgcttttacactgttggtgggactgtaaactagttcaaccattgtggaagacagtgtggcgattcctcaaggatctagaactagaaataccatttgacccagccatcccattactgggtatatacccaaaggattataaaccatgctactataaagacacatgcaaatgtatgtttattgcggcactattcacaatagcaaaaacttggaaccaaccaaaatgtccatcaatgatagactggattaagaaaatgtggcacatatagaccatggaatactatgcagccataaaaaaggatgagttcatgtcctttgcagggacatggatgcagctggagaccatcattctgagcaaactatcacaaggacagaaaataaacaccacatgttttcactcataggtgggaaatgaacaatgagaacacttggacacagggtggggaacatcacagaccggggcctgtcatggggtggggcacagggggagggatggcactaggagaaatatctaatgtaaatgacgagttaatggatgtagcgaacaaacatggcacatgtatacctatgtatcaaacctgcacattgtgcacgtgtgccctagaacttgtaagtataacaaaaataaaaataaaaataaaataaaataggaaaaagaaaaacccaaaaaccaaaaaacaaaaaaaaaaacttttaagttcaggggtacatatgcaggtttgttacataggtaaacatgtgccatgggggtttgttgtacagattattttgtcacagaggtattaagcctagtacccattagttattttccctgatcctctccctcctcccaccctccatccagtgtgtgttgttcccctttatgtgtctacgtattctcatcatttagctcccacttataagtgagaacatgagctatttggttttatgttcctgcattagtttgctaaggttaatggcctccaactccatctatgtccctgtaaaggacataatctcattcttttttatggctgcatggtattccatggtgtatatgcaccacattttctttttcttttccttttgtttttttgagatggagtctcactctgtcacccaagctggagtgcagtggcacacaatctcatctcactgcaagctccgcctcctgggttcatgccattctcctgcctcagcctcccaagaagctgagactacaggtgcctgccaccatgcctggctaattttttatatttttagtagagacggggtttcaccgtgttagccaggatggtcttgatcttctgacctcgtgatccgcctgcctcggcctcccaaagtgctgggattacaggtgtgagccaccgtgcccagcctcgcaccacattttctttatccagtctatcattgatgggcatttaggttgattccatgtctttgctattgtgaatagtgctgcagtgtgtctttataatagaatgatttatattcctctgggtgtatgcccagtaatggtattgctggtcaaatggtatttctgtctttagatctttgaggaatcgccacactgtcttgcacaatagttgaactaatttacactcctactgacagtgtataagtgttcctttttctctacaacctcgctggcttctgttatttttttgttttaataatagctattctgactggcgtgagatggtgtctcattgtggttttgatttgcatttctctgatgatcagtgatgttgagcttttttccataggattattggctgcatgtatgtcctcttttgagaagtatatgttcatgtcctttgcccctttatcgggttgattatttttttcttgtaaatttatttaagttccttatagatgttggatattagacctttgtcagatgcatagtttgcaaaatttttttcccattctgtaggttgtctgtttattctgttgatagtgtcttgctgtgcagaagctctttagtttaattagatcccatttgtcaatttttgctttcattgcaatagctttttgtgtcttcatcatgaaatctttgcatgtgcctatgtccttaatggtattgcctaggttgtcctccagggtttttatagtttttgggttttacatttaattgtttaatccacttgagttaatttttgtatacagtataaagaaggggtccagttccaatcttctgcatattgctagccagtgatcacagcaccatttattaaatagggaatcctttccccattgcttgtttttgtcaagtttgtcaaagatcagatagttgtaggtttgtggtcttatttctgggttctctattctgttccattggtctatgtgtctgtttttgtaccaataccatgctgttttggtcactgtagccctatagtggagtttgaaatcgggtagtgtgatgcctccagctttgttatttttgcttatgattgctgtggccattgaggctcttttttggttccatatgaattttaaaatagttttctctagttctttgaagaatgtcattggtagttttgtaggaattgcattgaatctgtaaattgatttgggcaatagggccattttcacgattcttcctatccatgagcatgcaatgtttttctatttgtttgtgtcctctctcatttctttgagcagtggtttgtagttctccctgtaaagatatttcacttcccttgtttagatatgatcctaggtattttattcttttgtggcaattgtgaatgggagttcatacataatttggctctcggcttgactgttgttggtgtataggaatactagcaacttttgcccactgattttgtatgctgagactttgctgaagttgcttatcagcttaagaagctttcgagctgagacaatggggttttctacatatagggtcatgtcatctgcaaacagggatagtttgacttcctttcttcttatttgaatgtcctttatttctttctcttgcccgattgccctggcaagaacttgcaatattgtgttgaacaggagtggtgagagatggcatccttatcttgtgctggttttcaaggggaatacttccagcttttgcccattcagtatgttggtggctgtgagtttgtcatagatggctcttattattttgacgtacgttccttcaatacctagtttatcgagcatttttaacatgaagggatgttgaattttcttggaagccttttctgcatctattgagatcatcatgtggtttctgtctttagttggctgttatgtgatgaaacacatttattgatttgtgtatattgaaccaatcttgcatcctggggatgaagcctacttgatcatggtggacaagatttttggtgtgcagctctttctttttacctccctgggttattaggaagttgatgttgccctgaggttgtgggggcagatctcagcagaactggaaaaaaaactgcataaagcttgtttctcaatttggcattgtggtattttggggtctacagatagtgttcaaggttttccttaaaaaatgtttgcctttctaacttgggtttattagtataggcaattacatattggatcttgatttttctctcaaacatctgaatgatttctccaagttctattcatctgcactttttaaggcatagagtaaatttttttcatgcaaaatattggtgaaaacattaacataacaatttcttatgattaaatttgatacattaagcaacactctcatttcaggtaggcattaattcactcagttgtaaattatccagatcatatttctctaattaataactacatcattaaaaacttcaaatgctttgctacaacccaaatataatctttatgtcaacctggctatcagaaaacaatattagggctggacgtggtggctcatgcttgtaatcccagcactttgggagaccgagacaggtggctcatctgaggtcaggagttcgagaccagcctggccaacatggtgaaaccccatctctgctaaaaatgcaaaaattagctgggcatggtggcccatgcctgtaatcccagctactcaggaggctgaggcaggaaaatgacttgaactcaggaggcggaggttgcagtgagccaagattatgccactgcacttcagcctgggtgacacagcgagactccatctcaagaaagagaaaatgatattaggtttttgcataatttattctttataatgcaaggttggctgctagtggttagtacttataaatgttcatgcactctgttaatgatttgttcaaaatttttgccagtgattgaaatatgatttgaaagtctgtagtttctagaatatatatttgaaaaatgaaacatgtgtctgctaatcttcagtcttctgccaactcctttattcactacaatgtcttaaatactgatatttgtccttcattatgcttgaaaatccttttagtattagcgataaaatttgtcgtggtccctagtagtgggcttcttgcttcttcgttttgttctgactatattgtttattaccctttccccagaaacaaacaaattaacgaacaaacaaataaaaaacacaataaaccaagccaaaattaaaaccaaaaaccaaaacctgactaaaataacctcttttaattggaaggtctggtctcgggtgctgaaagcccagagaagaggactgcttctaacctgccttctgaggtttccatggtgttcagctattcttgtagagtttactttgctttttaagtatttttgcagcttttaaatgtatttagataacttttcattatactaccacatttttttatgggttaggaatgaaacaataattgccagaagtgcccagaactgtagagataatagcaagaattcacagacaggtgttctcctgagtctatttgcccaatatcagtttgatttgataatctcaccacagaatctcttactcatcacagtattagctacttcttttaaaactttacccctcagcttttgactctgttgttctcctctctgttcaacacaacaaaattccaagtcttatttataaagactgttcactagaacacctaaggtatttagcacacgggaaaaatgtgtgcatataaagtttttattatgctctttcatttgtgttgctgtggtgtatgtctgttctaagtatggatctttgatctgattagttgatttttgtgagtaattccttgatattttaagccagtagaggtgtgctttaattcaagatactaaaacacagttgctaaacagaacttggtactccttaaggattctgccttgtgatatatacaattgttataaggtacatttttcttatccaactatagacaatttaataatgttttaactataagaaaatcttttaggtgaagaatggcgtatatttattgttcactttttgctgaagagagacaaaacaaactgatattgaactgcacataaaggattgaaataaattttgagaaaaatttcttaataatgagaataaaatattagaagagaattctgtctcctttttgggaagtgaggtgggaagaaagaaggtagaaatgaggccactgagagttcatatttggggtagaaaattatattctatgattttcagatgggctttcataagatggtaggttaaagaaaatttaaattagagtctctcttggctaggtgtggtggctcacacctgtaatcctagcactttgggaggccgaggtgggcggatcatgaggtcaggagatcgagaccatcctgcctaatacagtgaaaccccttctctactaaaaatacaaaaattagccgggtgtggtggcgcacacctgtagtcccagctactcaggaggctgaggcaggagaatcacttgaacctgggaagtggaggttgcagtgagctgagatcatgccactgcattccagcctggcatacagagggagactccgtctcaaaaaacaaaacaaaaaaacaaaacaattagagtctctctgggaattcaaggaggatattagagggtgattgtatagcaaacagtattttaagatcttggttaatactacagttttatgattagctgtttttaacgattcagttgcaagtttactttacgtacatcacattttctataattaaaccaaacgacacacatgtattgaacatgatcatatagagggctcttctaagttggctgcaatttgtattttcctaagggcaggcattagtgcttaggggtagaaatgcttactctgaatactcaggttgggtttagatgattcatgaaacttcttctacccacccaaactctcaacttcctatggtttcattattttgtggaagtttaaggatactatgtgggggtgactctccatgtatagtgtatttggcagtctcacatgaggccagtgatgcaagttgatcatgtattatctgaaattctccaggtcacacagtaactactaggaccacccttaaatccaggtgaaagaagcctcttctttgggtgttgttatgagctgaattgtgtcctccctaaagttatattgaagttccagctcccagtaccttagagacatgttaagacttttgactgtaaggccaggaatgggggcaggaagtaatccagaatttacacctgggaaaggaagcattgtttacatatgcagatctctggggtcagataacctttggtgaatcataactttagcattttttgactgtggctgcatcagtccaggtactccaggtagcagatgctaagacaaagttaaaagtgtaagaaatttgttggaagtatacctagggaaagaaaaaaggcagggctagcaggagcaagcagggaaatccttcaggaaatgccactgttcagggtttcaatttcttcttgttttaaacttgagaggttgtatgttttcaggaacttatccatttcttctaggttttctattctgtgtacatagaggtgtttggattattctctgtgggtttttctatttcttgtggtcagtggtaatgtcccctttgtcatttccaattgtgtttatttggattttctctcctttttttctttattattctagctaatggtgttaatcttatttatccttagaaagaaccacgtcctacattagatcttttgtatgttttttttttgcatctcaatttcctttagttcagttctgattttggttatttcttgtcttctgctagctgtgaagtcggtttttcttgtttctctagttcctttaggtgtgctactaggttgttaatttgatatctttctaagtttttgatgtggacatatagtgttataaattccttcttaatactgctttagatgtatcccagagattctggtatgtggtatctttgttattagtttcaaaaaatttcttgatttctgccttaatttcactgtttacccaaaagttgttcaggagcaggttctttactttccacataactgtatagttttaaatgattttaaagtatttatatttttattgcactgtggtctaagagtgtgtttggtataatttcaattttttaaaagtttgctgaggattgtttcatggccaattgtgtggtcaattttagagtatgtaccatgtgcaaatgagaatgatgtgtattctgttgcttttggctggagtgttctgtagatgtctttaggcccatttggttgtgttgagttgggtcgtgcatatcatatctttgttagttttctgcctcaatgatctgtctactacagtcagtggggtgttgaagtctctcactactattatgtggttatctaggtgtcttcatagttctctaagaacttggtttttggatctgagtgccccagtcttgaatgcatatacatttagtatggttgatcttcttgttgaattgaatactttaccattatgtaatggccttctttatcttttttgattgttgttggtattcttttctttaagaatgctgaatataggccctgaatctcttctgccttgtaggtttcctactgaaaggctcatgttaacctgatgaggttccttttgtaggtgacctgccccttctctctagttgcctttactatgttttcttgcacattgaccttggagaatctgaagactatgtgtcttggggatagttatcttgtataggatcttgtaggagttttctgcatctcctgaatttgaatgttggcctctctagcaaggctggggaaacttttgtgaacattatccacaaatatgtcttccaagttgcttgttttctctccctgtatttcaaggataccaatgaatcatagatttggtctctttacataatttcatatttctcggaggttttgttcattctgttttatacttttttctttatttctttctcactgaattagtttggataaccagtcttgagctttgagattctttccttagcttggtctattctgctgtggtctacttgtgattgcattatgaaattcttgtagtatgttttttagctgtatcagatcagttttgttccttcttttaatggccatttattgtttcagcttctgcatcatttcattgtaatacttagattcctcggacttcaactttccctggaatcttgatgatcttcattcctattcaaaaaattgtgaattgtatgtctgtcatcttagctatttcagccttactaagatactctggctttttgagttgccagagttcttgagctggttctttctcactatgtgggctaatgttcctttaactgtgatgtaatttgagtacacttttatttgatttcttttctggatgttttcagagggccaaggctttgtgtagggtctttatttgtagctgacttcttgtccttggtttcacaggagggcatattagcaaagtatttttggtgttgaattttgggctttgatccagtagatggtgtttaagcataatggccaatagctaggctcttgcttggccacgtggctcctctgtgtttcctcatgattgcggctgtgctcccactcagtgctttgaagttgtgggctcctctcctccttcagtgctggctgtagatcttggcttggtataccacagccctggagtgagctcaggctttatgttccttccccaacttggaggcagcagggcaaggggccttggaagtggctgtggcagaggcagaggggctttcatttgtttcttggggctccactcaaaagaaaagcagagccgctgccaattggtgtgactggcctggggtggggcagctgtgttgtgagcccaagctgtggggccctgcctggtgatgaattgggggtggggagctcacaagggagatagagtggtctcttttccttagggagactgcagcttgctggagttgtgggtaaagccttcaggatctttgttccttccccattctaagggcagtaccactgcagtggcaggtgcagagggactttcagttgcctctgggagctctatctcagagaaatgcagagccactgttaatggaaatgttcagccatttccatgtccagccactggaaatgttcagcagtgcaggagtggctgcactgctggcttgagctggggggccctgattggcgaagagtggcggggggggggggggggggtggaaggatcacagagaggagagactgggctcctttccatatgacaacagtgaagtggcctcattgtttggggtgacacccagagcttttggtctcatggccaaggaaatcaaggatgtgacacaccaaggatgaggttgagaatagaaatttaataggaaaaagaaagagaacagctctctgctacagagagggatcccagaaaaagggttgctgtactgcagtgaaatgcaggggtttttatagacgagctagtggggaggtggtatctgatcagcatagagcatgaaaaaccagttaggaccaggtgtgctatctacttagggtacaaatctctggtagccccccaccccaatgttttattatgcaggcagttcctcagcttgagctattccatgttgcttatttctttcttactgtgcatctgctaaaaaggggaggtggaacccccatggtggacgtgcctggtcctttgtagccctttctatctgtgcaacggccagcatcccctcatgcaagcttccagcttccttatctatgtttgcagcccaatcttccagttgctgtttgttagaaaagaagtgatttcttgggctgctttttgtgagaagcgaagttctgtctgggactatttgccctcactatctgtctaaatcatttttatctactcctgtatcaacattggtgtgctggaattgcaagtaaagttcctaggctcttagtcgggtggcagcaaggtcagaatcacttcagtggcagtgacagagcggctgttgtttgcctctggaagctccaccccagagaaacagagccgctgccagtgggaatgttcagctgggggtggggcagctgctctgcagtcatgagcttggggccctgcctggtaaagagtccggggtggcggttcacagggaagaaagtctgggctcctttctgcatgatggctgccatgtgctggggtgccagcatagcgaccacaccctttcttcctctcccagaccgagagcagcaagggcagtaccactgaagctgcaatggcagagggactttgggttgtctctggagtttcctccctggagaaatgcaaagctgccactgactgaagtattcaggctggggcagagtggttgtgctgggggcccaggtggagaggccctccacggtgaggagcagctgaggcacggacctgcatcgaaacagactggccgcttttctgtaaggcaacggaactatgctgagggtccatgttagattctaatcactgcttttcctctggagtccgagggtaacaggagagaggactgtgtagcagcaaacatgagagcctgtctgctgcctctggtagctgcgtctcagggaagtgcagagctgttccccgatggagagctcaggagtggttggggtggctgcattacggtcccaggccagtgggccgtgtccagagaggtgcagtagaggtgaggcctgctgttcatccactgctcagtccacggattcggcccctatcctgggggcatgctagggatcctggcctccgatgttgcaggagctgcagctgctggtgctgggatgcccagggatcaaagagtcccgtacttctcatgtgcctgaactgtgactgtgcccagactccacatggctgtctttttcagtctggaggccccggctgggggagagtcatgggggaatctcttgatttcagggttgcaaagttccgtggcagaaatgtgggtccctaggaactctcactagctcactgtttcttcgcagtgggagtctcccatggctctgcgccactcctgggtgggtggctgtcgtgtctcactcttctctgttctacataggtcgtgttgcttccttgatgattcccagtgcgtcctcctggaagatccagttgaagagctagtatttactcaacactcttctctctgtgagagcggcccacactagttgctcctagtcatttatcttggccggaatcttctctgttctctggttatctccatgtctgccccctgccaacactgacacattaaaaaaaaaaaaaaaaaaaaaaaaagatgccttggaacagttccagaggatgaagtttttttctcactatttatgggaaacggggagcttcgcagccaagctcctcttcagcagcagcacagacccctgcctcttgcctcatttctcacttccaccctggaagttgcagaacacgcatgtgcactgcacaggcctgtgaaggtgggatcagcacgtcctgccaggcaccatctccagcgcaggatactggagctccctgttgagcagtgcaggttatatagaataggttaggagttagggcatagggcttgggttaggtgttagaatctacatggctgattcttgcttacactgttgaatttacttttgaggactaacctgaaaaatggtttctcagattcccttgaatcacaactttacagatattttttgacattttggcagtaacagtttttatagtgaaggtaatataaagatcaggatgagataatacagtcaccaataaaaatatgaaaattgtgagcttgagaaagctgactctggggattgagaacatgctttgaaaataagaccagctattatacatttagatgttaaaactgaatgagatacagaaatcaatttgaatttttgggtgtcaagttgatatacttcaagtgtctaattgttttctaattgactataagatgattttatttttcagagaaaaatactgttgagaaaacagagaaagattttcttttgctgctattttttgctattagtttagaggagctgaaggtggcaaagtgataaaagagtgcctcaggattcacacaaaacttaatagatatttgactcataaacccacggtgtggtaaacctattcccaggtcagaatacaacagtctttgagctaactttctagtgtgtattacacaaagctatttcttttcttatgctctttctagctgggagagtgcacacagtaagaattacagttcccactttacagggaattggggctgtaaccaccttctgatagttgcttctaattattttagtatgaaaatgagtttttcaaaacatatcattaaaaaaatattacatgttgtaaaaagtcaacctgtacataaatttaaagtgttcattcatttacttagcaattatttgttgagtgcctattgtatctcaggcactgttctggtcctgtgaatacatcagaaaatatatccaacaaaaattcttatctttgtgaagcttacattgtaatgggagaagacagataataataaaatagtaataaattatataagatgtttggagtgataaatccaatggggaaaaatagagcaagctaagagggactgggaatacaaaggcagtcggggagattacaacttaaatgaggtggtcagatattaccccatctataaagtgatatttcagcaaaactttaaaggaaatgggaagatgagttatgaggctatcagggaaaagagaatagataacagccagtgcaaaatacctgaggtggcagatgatggtgtagcaggaaccatgaggaggtcaatatggctcaagagggctgaatgggagaagtagtagaaagtaaactagaggagtgaaatcagggatgagaaaggaagttggtggacaaacttgggggagtttgttatgaagtctaagactttttacttggagagaaatttggaggcattggagggtttgagcaggtaaatgacttgttctgacatctttttaaaggagtattctggttgtttatgttaagaatagagtgtacggggcatgtgtggaagcagaatgaatagcaagaaggctactgttaaagtccaggagaaagatgctggcagccaggatcagggggtaacaatgaaggtggtgtggagtttctgggttttgaacatgccagtgttttgaaatgacagccaacaagatttctggataggttatatgtggggtttgagagtgaggagtcaagtatgactctaatctctttggcctgagcagctggaaggatggagctgacattgactgaaattgggatgattcaagtcaaataggttttaggggaaagatcaagagtttcagcttgagatgccagttcatcatccacatagactaagtgagtattggttgaaagtagtcccaggccagagatagaaagttggcatttgtttaaagccatgacactgggtaagctcatctagagaataagtgtacattgagaagagattaggaccaatgactgagctctaggaattacagtcttttttttgttgttgttgagaaacttctccaattttgttttattttattttaattaattaattaatttattatacttcaagttttagggtacatgtgcacaacgtgcaggtttcttacatatgtatacatgtgccatgttggtgtgctacccccattaactcgtcatttaacattaagtatatctcctaatgctatcccttcccacttcccccaccccacaacaggccccggtctgtgatgttccccttcctgtgaccatgtgttcttgttgttcaattcccacctatgagtgagaacatgcagtgtttgtttttttgtccttgcgatagtttgctgagaatgatggtttccagcttcatccatgtccctacaaaggacatgaactcacccttttttatggctgcatagtattccatggtgtatatgtgccacattttcttaatccagtctatcattgttggacatttgggttggttccaagtctttgctattgtgaatagtactgcaataaacatacgtgtgcatgtgtgtttatagcagcatggtttataatcctttgggtatatacccagtaatggtatggctgggtcaaatggtaattctagttctagatccctgaggaatcgccacactgacttccacaatggttgaactagtttacagtcccaccaacagtgtcaaagtgttcctatttctccacatcctctccagcacctgtagtttcctgactttttaatgatcgccattctaactggtgtgagatggtatctcattgtggttttgatttgcatttctctgatggccagtgatgatgacattttttcatgtgtcttttggctgcataaatgtcttctttcaagaagtgtctgttcatatcttttgcccactttttgatggggttgttggtttttttcttgtaaatttgtttgagttcattgtagattctggatattagccctttgtcagatgagtagattgcaaattacagtctttaagagtgaattgaagagattgaagagaagtaacaagcaaaggagattgagaaggattggtcaatgagagaaaaggaaagccaggggaggtgctgtctcaaaaaatcaagtgaaaaaagtgttttcaggaggataaagtggcttaagacctatactgctgacaggtcaggttgcagaaggattgaacattggccactggacttaataatgtggaggtcatctataacttgacaaaagcagttttggtggaggcatatggaaacaaacagttttggtggtgtgatagcttgatggaagtggatttcatagagcataggaaaagatgaattggaaacactgggtttagtcaacactgaggaatttgctgtaaaggaatataaagaagtgtacagttgctaaaaggagaaaagggcacaaaggaacttttttttttaagagtttgttttttaagcaatcacaacaaaagcaaaaattgacaaatgggatctaattaaacttaagaacttctgcacaagagaaactatcagcagagtaaacagacaacctacagaatgggagaaaatatttgcaaactatgcatctgacaaaggtctaatatacagcatttataaggaacttaaatttacaagtgaaaaacaaacaaccccattaaaaagtgggcaaaggacatgaacagacacttctcaaaagaagacatccatatagccaacaaaaatgaaaaaaacagtatcactgatcattagagaaatgcaaatcaaaaccacaatgagacattatctcacaacagttagaatggcaatattaaaaggtcaaaaaataacagatgctggtgaggttggggagaaaaaggaacagttatacactgttgataggagtgtaaattaattcaactattgtggaaagcagtatggcaagtcctcaaagagttaaaagcaaaactatcataaaacccagcaaccttattactgggtatatactcggaggaatagaaagcattctaccatgaagacacagcacgtgaatgttgatttcagtgctattcaaaatagcaaagacatggaatcagcctaaatgcccatcaatgacagacaggataaagaaaatgtgctacatatacaccatggaatattatgcagccataaaaagaatgagatcatgtctttggcaggaacatggatggagctggagctatcatccttagcaaactaacacaggaacagaaaactcagtaccacatgttctgacttataagtggagctaaatgataagaacttatgaacaaaaagaaggaaacaacagacactgggttctaactgcggggggggatgtgggggaagggagaggaactgaaaagataactattgggtactgggcttaatacctgggtgaaaaaataatatatacaacaaacccccatgacacgtttacctatgtaacaaaacttcacatgtacctccaaacataaaagttttttaaaaagtttgtttttaaggtagaagaaataacagtatgtttatatgatgataagaatgatccaggacagacagaaacattaatgatataagagaaagaaaggaaaatttctatatttaaatagcgggaaaggatggatctagtgcacaagtagtaggatcgctgatggagggagcacagatcgttcatctatgttaacaagagaaaggcagatgtaaggatgcaggtactggtaggatgtagtggtaaaaaaaaaaaaaagtcctcaaacctccaactctccaaaaccctgctctggtaaatgatttcttgtgcattattgtacataattgtgtgatgggattgcccttgctagaacttccagtactatgttgaatagagttgtccataaacatttaggtccccacttagctattttgaataatgctgctatgaacatgagtgtgcaaatatctcttgaagatcctgctttcagttctttttttttttttttgttttttgagatggagtcttgctttgtcacccaggctggagtgcagtggcacaatttcagctcactgcaacctctgcctcccaggttcaagtgattctcctgcctcggcctgccaagtagctgagattacaggcatgcaccaccatgctcaactaattttttgtatttttagtagagatggggtttcaccatgttggccaggctggtctcaaactcctgaccttaggtgatccacctgccttgggctcccaaactgctgggactataggtgtgagccaccacacgtggccttcattcttttgaatatatacctagaaatggaatttccgaatcatatggtaattctatttttagtttttagaaaactttatactgtttgccacagcaactgcatcattttacgttccctccaacaaagcacaaagttccaattcttccctattcttaccaacacttgttattttctgctttttaaaaaataatggcaattctgccagatatggtgggtcacacctgtaattccagcactttgggaggccaaaggaagatatttcacctatagcttacatatggaaagcaaatgaaaagtatgagcctccatcaggatggaagtggggggaatactccaagcacagcctctaactgtggtcctgcagtactttggtttacataggagtatatgtgtgtgtgtgtgtttgatcaatcccaaatcactgttttgctctctactcctgccattttctcaattcctctgcattccaaatgtgttacacgggaacttcggttttttttttttttttttttgaaggagtttcactcttgtcactgaagctggcatccagtggtgcaatctcagctcactgcaacctctgcctcctgggttaaagcaattctcctgcctcagcctcctgagtagctgggattacaggcacctgccaccacacctggctaattttttgtatttttagtagagatggagtctcaccatgttagtcaggctggtcttgaactcctgatctcaggtgatccacccacctcagcctcccaaagtgctggattacaggcgtgagccactgtgcctggcccgggtttttaattttttaaatttaattcaatttaatttaattttaggttccaggatacatgtgcagaacgtgcaggtttgttacataggtaaacatgtgccatggtggtttgctgcacctgtcaacctatcaactaggtattaagccctgcatgcattagctatttgtcctgatgctctccctccccccacacccccaataagacccagtgtgtgttgtttccctccctgtgtccatgtgttctcattgttcagctcctgcttatgagtgagaacatgtggtgtttggttttctgttcctgtgttagtttgctggggatgatggctttcagcttcatccacgttcctgcaaagtatattatttcattcctttttatggctacgtagtattccatggtgatatgtgccacattttctttatccagtctatcattgatgggcatttgggttgattccatgtctttgctattgtgaatagtgctgcattaaatatatgtgtgcatgtacctttatagtagaacgatttatattcctttggatatatacccagtaataggattgctgggtcaaatggtatttctggttcaagatccttgaagaattgtcacactgtcttccatagtgtttgaactaatttacattcccatcaacagcgtaaaagtgttcctatttccccacagcctcgcaagcatctgttgtttcttgactttataataatggccattctgactggtgtgagatggtatcttattgtggttttgatttgcaggaggttgaggctgcagtgagctataatcacaccactgcactagagtctgggtgacagagtgagaccttgtctttattttttgactcttttactttcagtttttgtgtgtccttaaatctaaagtgagcctcttgtaagcagcatattgtttgatcttttttttaaaaaaaatttatccagccactctgtgtctttttattggggaatttaatccatttacatttaaataattactaataaggcaggacttactatgatcattttgttgttttgtgtatatattatagttattttgtctctttttactccattcctgccttccttttgtgtttcattgattttgtcagtgacatactttgatacgtttctcattttcttttatgtatcttccatgcatattttctttgtggttaccatggatattatataaaacatcttaattatatcaatccattttaaagtgataacaatttaacttcaattacatacaaagctgtactctttcacatcccaccaccacccactttgtgtcattgatgtcataaattacacctttttattttttgtattcattaacatggtgtcctagtccatttgggctactataataaaataccatagattgagtggcttataaacaacaaaaacatatttctcacaattttggagtctgggaagtctgagatcaaggcctggcagattctgtgtctggtgatgggccacttccaggttcatagactgctgtcttcttattgtgtctttaagtagtagaagggaatttggacttgctccaaattacaccaccaccctttttggctctccaatttgtggacagcagattgccagcctgaataatcatgtgatatgattcctaaaaccattcaatcaatcaatcaatcaatcaatcctgctagttctgtttctctggaaagccctaatacatgcagttttatatagatttttaaaaatgcttttatgttttgaattctataccagaatttaaagtgatttatatgccaccattacaaaattacaggatgctatatttgtctatatatttacctttactagagagctctatattttcatatgctttcatgttgctgtctggtatcacattcttttttttcatcttgaaaaactccatttagcatttcttttaacgtagatatagtggtgccaacctctgttaacttttgctttttggagaaggtctttgtttctctttcattttttttaagaataattttgctggttatagtatttgtggttgacagttttttttttttctcctcagtactttgaatatataatctccttcccttctgtcttgcaatgtttctgctgggaaatctgttgataatcttatgaaaccttccctgtatgtttcaagctgcttttttcttgctgttttcaagattttttctttttctttgtcttttgacaatttgattataacatacctctgtactgtcctctttggagtcatcatagttggagtcttctgagctttctgaatttggatgttcacttccttcctcatatttgggaagttttcagtgactattttttcaaataagctctaaccatttctctttcttttctccttctgtaatttccataatgtgtatgttgattcatattatcatgtttcataagactcttaggctttcccctcacttttcttcttttcttttaaaatgacttttaaaattcactgattttttttctgttttctctagtttatcattgaacctcgctaatgatttttttaaaaattcagttattgtgttcaagtccagaatttctatctagttctttcttattgtttcaatttctttcttcgtattgtcattttgttcacacatcgtttttgtgatccctttggttgcttctctgtgtttcttgtaattcattgagcttctttaagatgactattttgaattctttttcaggtgattgatacatctctgtttcttttagagtcatgcatcccaagcagttgggatgccataactaaatgccgcagactgggtggctaaaacaacaaaaatttattccctcacattctggaggctgagatatttaatattaaggtgccagccaatttggtttctattgaggtcctcttcctggcttgcagatgtccaccttcttgctgtgtccttacatggtagagagggagaaagaaagaaagacagactctctggtgtttcttcttataagaacactagtcctgtaggaatggggtcccatccttttggactcatttaactttaatttcctttttataggaaattactcagatataggatctgagtaccatcagactaggtattagggcttcaacatacgaagtttgggaaggacaaaattcagtctgtatcaggtcagtttttggaaatgtactttgttcctttgattgggccatgattacttgtttctttgtctgtcttgttattttagtgattaattgatagattgctggaattttttttttcgtttgagaaggaagccatctctgcaaatctttaaggactggctttgtacagggaaagaccttcactgatcagtctgactagaggttctgggggcctttctttcaaaccttttctgggtatatgtcttctttgagcttgcatgtatcttttctttcttttaaggtgttgaaaagtctctttatatatgaaacagccttggtttggtactatatcgtttatgagactgaaaatgaaattacaggacataaaatataaaaaaacctaatccatatcatgtaagaaggaagcttggcaatttaaaggacttctcatgtgctacacttgaggccacaaatatggcatgtggagaggaaattagttcaaattatgctcagattgccttgttcaagggtaacacttcttccatgagctcaattgtgaagcctggcatccaagacaggtattgatttctgtgccttcccctgctcctcctccttctccttattcttttcaatagcaggtaagcttactgtaaaatcatcggctcttttattatgtaaaacttgtgaatgctttctgatcttaaacatgagcagtaaattattaagagatattatgttctctgaagacacagaggagaaaattttgagaggttttcaggagtttgtaatttcttgcttcctctggtgtctgtcttcagtaccgcaggttctccggcacagcaaagaactgcctggctctcttgctctcagcggtgtcaaggcattcaagctatgctggttcctgctagtgcttcaagttaagcaagacagaaaacagtccctcaggtagcccctgggaaagctaaaacattggatgtatgttctactcttctcttttcctctttagaaacaagccataagttgggcactttctcctgattgagctgagctgtgctagcttgggggaagggctattatgtggatgtttttggctttgcactcttgcctgtcgtactgtaatttcttgtttctgaagttctctaaagatttttagactgtatattgttaactatgtctgttttggggactgagatttgtggcttcctattttgccatcttactgacatgagtcctgatatgcacttcttttaaggatccttttacaaagccctaccctacaacttttgcttatatctcatttcccaggatactgccacatgatacctatctgcaagggaggctgcataaagtaatttttcaaaatctgggtttgatagtaatagaaaagttaagaatttacatctggtagtctagacttcctttgctactcaatatacatccatattcattcttcctgccatatgtggaatactctctctctttaagagagacaactccaaggtctcatatattcacttcatcagctaatttagtctcatttagtcacttcataagccatggtatactgccgtgattctcaagtcatgagtaccaaatccctgaggtatatataccaagcattatcagtctactaagttatattaatcaactaataatcaattatgctataattagcccaaaaagtcatacatacatgcacaaaaaattaaatataggatgatacagttgtgataactgaaacttaaaaaattttaaatgtagtggtgcaagattctgattaatgtaatgtcctcttcattggatcctaatatggcttctgtggttcagtagcttataaaccaaaagacaagctatctgtcccaagcaccacattccccccatccccattatatgaatggagaaaaaaaccaagataatcacagtaaaaccacttattaaaggggaaaattagaaatggcatagtggacattgcccataatgatgcttgaacagtgttggacaggaacatcaaggacttactgccttagctaaaggtgaaaattcttgattaggttatctggtagaccatgattctgttatctgggagaaactctctagtctactgtcctctcttatcctctggtaggtttaaatcttgtttttattgaattacatcattacaaacaacatgcagtgaacatcatgtatcctaattaaaaattaacagatatttcccaattgtcccctaatttagtttatacccagtgatagaatatttttggagtacccctttttaatacaaagaacttcatggttgcatatattatgtaattgtagttacagtccttgttgcttaatataatacataatgacaccactgcatttaaaaacttttcaattttagttataacagtatcatcctatatttatttttttgtgcatgtatgtataagatgactttgttggctaattatgacttaattgactaattgttactaatatgacttagtaggctgataatgcttggtatatatacctcagggatttgatactcatgacttgggaatcatggaactagaccatgagcttatttagctgcagacttatgcttggccctttgcagcatttggcaccaaggtttgcacatggctggtcctctggaaatgttagttggtttgcatcccttttttgatcactatcaattgcttcaaactggggttgctttcctctcaaaatcaccatcggaaagaaatgtagattctcacaatttatcctatccttttgaaatgaggctttttgttttctaagaatcatttttgttttggtatcaacaactactgggaaataagaaaataagaaaaagataccttcactttttggctgccttcagtaattggcattaggattgggagtagcatgggtctaaaaaagctaggccagggattgctagtagaggagtaatagaaggtgttgaggactgagtggactgtatgacaattgccatgttagagtgcaagcccatttttgctacagctttcatttattcaacagcagccagaaatgtagactttatgatgcatcctattaaaatgattaaaaataaagcatgacatagcctcccccctccaaaaaaaaaaaatcaagtctctgggttgtatttggtctgtagcttctaggtttataacttctgtgcaaggaaatctttatgctttggcttgtatctcatgcctttaaagttctcgttattgtaaatagcacaccaaatgtcaggaacactttataacaaacaatatcatatcatatgaaggcttttgcctagggtgcaagagggactttattagagaagcagcagaatggtaggcaatgcattgtgaaaaagcttgctaaggattagaatttagtgcaacaaaaagatgactgtattttgacaatttttagtaaatgtatagagttgtgtagctgtcatcataatccaattttaaaacttttctcatactccccaaatatccctcgatctcacaggcaattaatcccagttccactctctttactcccaggcaactattgatctattttctgtctctttaaatttgctttttctggatatttcatatatggaataatataacatgtcatctttgtgtctggctcctttcacttagcataatatttttgagattcagtaatttttaggaataaacacttcttcgtttgttgggtgcctttgttggatttccagtgggctaaaatggttgtttgtgacagttttgtccagctttaaagctgttttttgaggaccgggttgttgagctcttctgtttatgctggaagtgaatctcctctttggcaaatcttttgattttattgattgaattttttccatctcaagaaatttaatctaaaagtttaaatagaaaatttctgaaagaaaattctggctgatttctgtcatttcatggtctttacccctttatccctggttttttgaaaatttctgtgctctttatcatcctccaattcttctcatagcctgtggctgcatccctcaggtcagttggctctccatggcatgttcaaactgtcctcagtcgtaaaagaacacatgttcttgctttctaagccatagcttatggggattctttgaggtttcctcaatctgccttcctagaagcttcacgtagccatttcaaatacactcttgtatggccctgtttgtctcacagtggggatgctctataaatctcatcctttcccaggttctacatcgaagtaatgcacatatgtttttctgccttcagaaccttagttctatttaagggtttgctgttactctttacaagtctaaaatcatccttatgtggggttggggtacaaggccctttctaagataaacactgttttacaagggacaaataactaaagattattttttagatgatttctgatttctgtattccctctatccaaagactttatgtagtttggcatggggtgttttaactatctctattttttccaagttttttaaaaatttatttcatgaatattatgccctgaatctgttggaatttagattttgatatttgaaagtttcaatttcgaaactcagaagacttttctctcaaaagtgttttctctgccatgaattttagaaagttatgttaaaacccaaaagctatgaattattttccttttcttattatctgtgatttaatccctttcttgaagtaataggcattctgcttgaggcagcggagaaacatgggataaaatgaataaatgggactgagaaataaattatttgacataggtaaacattattttactacatatatattttaagagtacaaaaagtttagtgttgaaaaatctggggattttctattctgtggcatagaacatgagataacaataacaaattatgaagtagtatatctcatattttcaaccttcatttttattctttcttgtttcctaattcgaaggtatcaaaactaaataattcatggtagttagacaataaatactgataagtaaaagtgtgtggaatgcctaccattaccagataatatttacagattacaaaaattttttgtgtataatgctatacataaaaaagaggatttcattccatctttgggaataagaggacatggggtgagagaaggcagaacaatagcagccagcaaaaagtgttttggtgcagagagattatcttgtgatttgctccgcattctatcccaacatactgcctgactcttagtctgctggcatgggtctactttatacacacatctgaagcctcttgtgcctgttatgtctaaatatacttttaaaatccacatttcaaaaagataccccttttatttctctcttcatttataaacttcacttaaaaattaataaagtcctctcactttttttcctcacaatcaaacctatcaatgggagagactgaaaaacactgtcagcacaaaagctataattcacatgtatagaaacagctaatcttttgcaggtgtataattcctctgtggaaacacaagcatactccagagatattgtgggttcagtttcaggctactataataaaatgaatatcacaataaagcaagtcacccaaagtttttggtttcccagtgcatgtaaaatttatgtttacactatattgtggcctattaaggccacaatttgtaaattacacaaagtgtaaattgtatttacactaaaatacaatgtacttaatttaaaaatgcctttttgctaaaaaatgccaacaatcccctgagccttcaatgagtcataatctttttgctggtggaaggtcttacctcaatgttgatggctgctaactgatcagaatggtggttgctgaaggttgaggtggctttgtgtgggaatttcttaaaataagacaacgaagtttatcacattgtctgactcttcctttcaagaattatttctctgtagcatgtaatgtggtttgatagcattttacccaaggtagaacttctttccaaattggagcaaatcctcccaaaccctgccattgctttatcaactaagtttatgtaatattctaactcctttgttgtcattttaacaatgtttacagaatcttcaccaggagtagattccatctcaagaaaccactttgttcgttttgttgaagcaactcctcgtctgttcaagtttcatcatgagactgcagcaattcagtcacatcttcaggcttcattttaaaattcgaattctcttgttttttcccaacacatctgcagttacttcctccactgaagtcttgaactcctcaaagtcatccatggtggttggaatcaaccttcaaactctttttaatgttgatattttgatcccctcccctgaataatgactgttcttaatgctatccagaatggtgaacactttccagaaggttttcaacttacttttcctagatccaccagaggaatcactatctatggcagctataaccttccaaaatgtatttcttgaataataagacttgaaagtcaaagttactctgagtaattattctgagatgcagaatagatgttgttagcaggtaggaaacactgatctctttgtataccttcatcagagctcttgggtgaccaaatacattgccaatgagcagtaatattttgaaaataatcttttttctagacagtggcttaaacagtgggcttaaaatattcagtcaaccatgctgtaaacagatgtgttatcatctaggctttgttccatttctcgagcacaggcagagtagattttgcataattttttaaaggccttaggattttcagactggtaaatgagtgttggcttcaacttaaagttatcatctgcattagctactaataagatagtctgtcctttgaagctttgaagccaggcattgacttctcatctgtagctatgtaagtcctagatggcatcttcttctaacagaaggctgtttcatctacattgaaaatctcttgtttagtgtagccatcttcatcaatgatcttagatagatcttctggataccttgctgaagcttatccatcaacatttgctgttttatcttgcacttttatttttggaaatggtttcgttcattaaacctcatgtacccacctctgttagcttccaacttttgttctgcagtttccttacttctctcagcctttgcagaattaaagaaagttagggccttgctctggattaggctttggctgaagggaatgttatggttggttgggtcatctatccagaccactcaaacttcgtccatatcagcaacaagtttgttttgctttcttatcatctgcattttcactggagtagcacttttaatttccttcatcttcctttgtattcaaaacttggctgtttgctgcaagaggcctggatttttggcttatcttgactttcaacataccttcccctctaagcttaataatttctagcttttgattaaaagtgagatatgtatgactctttcacttgaacacttagaggccattgtagcacttttaattggcctaatttcaatattgttgtgtctcagggaatatggggactcacagagaaggggaggtgtgagagaatggccagtgagtggagcagtccaaacgcatacaatatttatcagttaagttcaccatcttatatgggcatggtttgtggtcccccagaacaattataatagtaacatcaaagatcactaatcacagatcatcataacacatataacaataatgaaaacgtttggaacattttaagaattaccaaaatgtgacacagatacacagagtgaacatatgcagttggagaaattgtgccaatagacttgttcaactcagggttcccacaaacctttaatttctttaaaaaacccccacagtctgtaaagcataataaatcaaagtacaataatataagctatgccaataaatagaatcttctatcaagattatccacattgtagcacaaaaatgcaaaaaatgcaactcctaataatctgaaggaatgactggctttagaaaatatttacatttaatattgcaaagagaattagacctatagaagataacctgtactgtctatatcatttactatattgttgtaccttctcagcaagaggtggtactttagattcattgaatgcattcattgtttggaatttcctgagtactaatgtaaaaatacatctgacatatatattataaaatacaatgaatactattattttctaattcacataaatggtagagcctagttactttgtttatggttttacaaagacttcagcttatttagaaattgtctctcataaaaaacttgcaactaagtttattatctttcagtgcaaaatattctcaaataattaaataatttatattttaatgccctgtaaaatataatagtgactgcaaggaaacagtcttggcataacaaaaatatgtagaattttgggggtatggtcttattactcctttcagaatcaattatataacaatttggataacttagatattttcaaacttgatttcagaaactgctagttaattgaaataaagtcatctttcccatcagtttaccttaacagttttcattctatacccaggctgtgtcagagatacttgtaatacttatgtatacacagagtaggtatctataaatatttattgaagtgatgaatcaatacctgtgctggccaaatatttgtagggtaaaaatgataagtgaacactaatgttgtacttccattgcgtgagatctccccacacatcctgtggcccaatgtttgctttaaaagggaagttaaggaataatatttataataaaagtctccagattagagtcctattagtgcaacatttagaagcttagccccacatgtgttttacttcttggtgggaggctctgatctacagggtggtccagggatgcaagtacccctattttgttgcttcatcagccctgaaagcagtacttctcaaacttcaaagtgtatacaaatcccctggaaatcttgttaaaatgcaaattctgttatttcttaacaaactctaggcctaattttatctctttgctttgtcagatactttatgttttgccttaatgcaggatgaaagcctgctgaagtttaattcaatttatttactgaaaatatgaataaccaataaagtacaaatagctacatttattcctcccaatgcatagttcaatccttgggttaattataaagcataaaattgccttatttgaatgctgtgggaataattgaatgccattattgattagtgaatctcgcttgtgtgctgtccttcttcaaggcttgctagatagacttgtgtactattgcaaatccccctgtgtgatttatttattaaactgaattgttttcttccatagctcaagggatggtattttgtgggtatctttgagtccataataacccctttttcatagtctgagctgacttctaaattcattgttattccatatcctctgacttaaactgttagcgtatgctaaatgttatatcttctcagagcagaaagggaaattaaacatgaaccatagggcactcgaacaaaacacatgctactgttataaattgagtgaataaatacatactgaaacatctcccagtgtagtctattaagagtctttggtttatttaactccatatatttttgttatgccaaatcagatttttttaaaaaggtagaacttccaccatcaaaggcatttttaaccagataaatatgttatagtggaagagtgaccactgcacagaggttttaagagctggccatctagatgacagggtgacaattgcctttaagcaaatgattgattgtaatgcaatagactcatttgtaaaggtaaaaacttgcaattggcctctattataggaactcaattattgaatttacagagatatcttttaggcctcttttacatttccttatctataaaatgggctccatgtgagttcactacctgaatgtccaactagaattaaaatgggcccggggtggtggctcatgcctgtaatcctgatactttgggaggctgaggaaggtggattgcttgagctcagagttcaaaaccagcctgggcaacatggtgaaaccctatctctgccaaaaatacaaaaattagccgggcatggtagtgtgtgcttatggtcccagctgctcgggaggctgagataggagggacgctggaaccagggaagtcaaggctgcactgagtcatgatgacgccactgcactccagcctgggtgacagagtgagaccctggctcaaaaaataaataaataagaataaaaataaaaatagattaaatacatacataaaattagaccattatgtgaatatgatgaaattcatggaacttcttcaagaaaaatgcacacatataaatatgctcaagttttttttttgctgtattttatttcagattcagggggtacatgtgcaggtttgatacatggatatattgtataatggtgagattttggcttctagtgtacccaacacccagatagtgaagattgttcccaataggtaagttttcaatcttcattcctcaccagcttctcccctttttgagatctttgtgtctactattttgatctttatgtccatgtgtacccatagttcagctcccacttatgagtgagaacatgtggtatttgattttaaattgatattctgattcactagatttgacatggaacccaagaatttttatatctaagaagctcttagattatactggtgctgctgctgttctcagtacaagcggagcagcaagattatacagtggtatctactgacaagtgaaaaaaatgttaccagaatattcctatatagaaaaaactattctaaaagttacataaattatcaaccatttctttaagagatatgtaatacaaatatgtcgtatatattcatatataggtatataatatttatatgcactgtaagttgacataagcatagtttgtgtgcatggctatctcctcaaatctattcttcctctccaacttggttttcattttgtattcctgatgcagttgagaattctaagagctttggaagaagttgtcaatcttctctcctcacttttttcggtttggtaaatatacatttgaatctgtcttttccttctggtaggcaagatcagtcaggttttggtctggattgaaattcaactttagcaaacaatacaaaagtgaaggatatgccttaaaatactggcagtgactgtggtaagatagtgtggttggggtgtttccattgaacttgtatacacttttccattttggagacaatatatcacttctataacataaaatatcttactatctatgtatgaaaatggcttttcttattggaggcaaatattgcctgatttactgaaaattctaaaaggtgtgtaacccttgatttgtttctgtatatggttacctttgtcttttcgtgtagtaccttcctcagttaaaaacatgccaaaaaacaatacttttccctctagttaatagcaccacatcaaatttccccattgttaggggagatgatgggcaacggggccagctgagttacagctatgtacagaatgaatgagtgaatgatcacatcttagctgacgggtggagtacagcttggcaatctggaagtgggtgacacttgaacatacaggcttggagatatttggtgtcaagaaataatttgataccattgattctaattcctgggctagaggtcaggatcagaactcttatatgtgagtaaggcccaggaaagaataagtttcagggttccagttttgaagatgctgtcgttctgggtatttttggaatcagggattcccattcacttactatgcagaccttccaaacaaggtaaatcttttcagtatctaattccagtgaaaatactgttaggaagcagttacggggcaaaaaaggaaacaagggaatactctagtaattcaaaacttcaaatgtaagattggggctggaccagagtgagggtgatggatactgaatcttgagtattgggttggtgtttcttaaattctacctgttggatttgattttagaatttcctgcttggggtgaggatggtggtgagaggtttgtgcttgcagaaaggaggaagtgtgaagttagatgcagagactgaaaatgaattaggtttgtgtttttcagtatagtactaaaaccacctgcatttggatcattttgactgcttactaaaaatgcagattttcagactaagtgattaagtgtatgtcaaggaatctgcatggttgtgaagtacctcaactgtgataagaaccacacatttcacagagcaaagacatgccctcaagatgagcctctgtctcagaatgtcttttgctttcagctctgctgatactcccatcctttgttattcagctcaaatgctatccctgttgcaaagctattctcaatcttcctagatgaaatatatcaagtagtcactgatgctttcatggtactttactgtgttttgaataagtaaatatccttaaaataccattatttgtacgtatggctctacttgcattggggcagtgcaatgtatcacagtggtcagtcagccgggatttaaggctcaggtccacctttcatctactgtataactttcatcaattgtttacttttaaaaaacgctttacttttttatctgtaaaacagaggtagttgtgaaaattaaatgaattaatgtaaataaagcacttaacagtgcgtggcacattgtgtatgctcaagaaacttttgttattattatcttctagggtaataaggcaccttatattatttttttgtcaagcaccctgtgaaaaagtaggcactcaagagaattgattaagttgaatgaaatttatctcataagacatgtataagcccagagggacaacatccaagggggaaagacacacttggttctctggaagaaatacatgaaaacgcacaatgtaatatttatggttttgaatttgagagtgtgacggtgaggagatttaatttaaagataccataaagagaaactagggtgaaagaattgccagagttttcaaaacacatcctatagtatatttgatatgctgccatgtatgtcttatagaaaataattgctactagctaaatgacctatacccttcctgactcttttaaaagcagaatgctggtttagaagcataccatgaaagcaaattcagaactatcaggcaatgtctcacttcctatttggcttttaggattctggtgtatgggagctcaattttcaagtaacagacatttactaattaataataaaagtagtaaggaaagtaaatataggatatatgggctttgtttgataataagatttgttagtatataaattcaaggaaaattttaattatgttttctacttaattacttatatttttgcctttttccacaaaagacttatggtccctatttagctattttgataaaaagcagttttttccaagctcttaaaatttagaatcaaaaaaatttctgtaagtggatccatttatatcttccataatcctgctactcatagcttagcaaaattccttactttaaaaaattaggtttattgcaacttgtcaaagagctgaatatgaaataaatctcatataattttatattatgtatctagacatgtttttaataaaaaacaaaggctattattttctttttttaaaactttaaagttcaagggtgtatgtgcacttttgttgcataagtaaatttatgtcatgggggtttgttgtgcagattatttcattacccagttattaagcctagtacccactagttattttttgtgatcctctccctcctcccatccttcactatctgacaggcctactttgtgttgttcccctccgtgtgtctgtgtgttctcatcatttagctcccacttataagtgagaatatgtggtatttggttttctgtgcctgagttagtttgctaatgataatggcctccatctccatccatgtcccagtgaagaacgtgatctcattttttatggctgcatagtattccatggtgtatatgtaccacattttctttagccagtttatcatggatgggcatttaggttgattccaggtcttcgttattgtgcatagtgttgcaataaacatacatgtgcatgtctttataatagaacaatgtatagtcctttgtatatactcagtaatgggattgttgggtcgaatggtatttctgtctttaggtctttgaggaatcaccacactgtcttctacaatggctgaactaatttacacttccaccaacagggtataaatgtttctttttctctacagtcttgccagcatctgttattttttaactttttagtaatagccatttggactggtataagatgatatctcattgtggttttgatttgcatttctctaatgatcagtgatgttgagctttatttcatatgattgttggccgcatgtatgtctttattttcaatgataaaaatacatatgactttattgatcaagagttagtgaacagtttcaaggaaccattggataatactgctttgttggtgtgtagtgtgagctggaggaaatgatcatttcaaaatttgtaaaagatttctatgttatttaaaatattctttttgtgtcatggctgatattctctgtttaacaaacgttgagagtaaaagcacttgcattcctacaataaaatattattttcagattaaatgttaagacttcaggacacaagtgtagtaaaatgggctaataaaaccatattaaagtttgagcctatgcagcagtatgcaggcacagatggccttggctggtacagaggctccaccttgtattttctaggcctgctgtgttttcagacaaagatctccaaaggcaaagggttttcttcagaaaaatctcaaagccatgtctctgtaaaacaccagtatctctacttccagtttacagtcatgatggagtaatggggaccagatttactctcctgcctaaaacaattttaaaagtagccaaaaatggaagaaacattttcaccttggcagtaggtaataaaaaggaaataaataagatgagcttttgattctccagtttactgcctggagagagtttacaggctgcagagcaggaaaagcaagctcatactgagcctggagaggtttttgagttgagaaaacagagttaagaagtttcaagatatcaaggcagctaaaagccatgcaatagggtactggggatgagggagttgcacagaggtataattctagcaatctgccaaagattcctccttgagtgttcagatgagtactgaacagtgcttatatatgatgaaattacccaacactggaaaagaatcacaggcaaggagctagtagaagaatccctgatggttacagagttgggaataggttgtatcttaccagccacagaagaaaaatacatggatattagtcagaatactcagaagggtaatgcttcagtaatggggcaaaattagctctgcaccaatggccacagtcttgcctaatgaagcctaaaagaaaacctcaaagggatgaaacattccaaccaatttaacaatgttacagaaaaaaaactcagtaatatgaaaatatccagcacccaaaaggtaaaattcataatgtctgacttgcaaagaatcagaaaaaataggactcatcacaaagagaaaaataatcaattgaaagagatctgtaaatggcacagatgatggaagtagtagacaaggacattaaaaccctgttacaactctactccatatgctcaagaaagtagaggaaagcatgagtatgatggtaaggaaattaaaagatgtgaaaaaagacccgaataaaattctagagatgaaaaatacgaggtttgaaatgtatgcattgaattaacagtagattagatactgcagaacaaaagacttatgagtttgaagaaattgcaatagaaacaatgcgaaatgaaacacagtgagaaagagtggggaaaaaatgaaaagagtatcagtaagccttagaaaaacttcaggtggcctaatacatgggaaattagaatcctcaaaagagaggtgagagggactaggatggaaaaaaatatttgtagaaataatggctgaacacttcttcaaaattgataaaagctaacctacagatccaagaagcttaacaagttctacatgtaagaaatatgaagaatatttaccccaggcacatcataatcaaaatgcctaatagtagtgataaaataaaaataggaaaaatagctgggtgggacagaatacattatgtatagagaaatgaagtaaaaaataatagtgacttttttttcagaaacaatgcagagtagaagacaatgagtgtagggagtgacatatttaaagtactgaaagaaaaaaattttaaaaacctgtcaacttaaatatataacccagcaaaaaatattttaaaaacaagataaaaatagatacatttttagatgtataaaagctgaaaaaatttaacatcgtcagatttacactacatgaaatgttaaaatgttgcttcacaggcaagaggaaaaaagtaccagaagtaactgaattgacacaaataaacgaagagctactgaaatggtgaatatgtgggtaaatataaaggacagaaacaaaactctcaaatgctgctattggaaatataaaatagtacgataactttggtaaacagtttggcagtcattttgttaaattacccatcacttaccatatatataaaccattcattctattactgggtgtttactcaatagaaaagaaataagacttttaaattattatttataatatttttattcaagataactgaaaactagaaacaacccatacaactatcaacaggtaaaggaagaaacaaattttgtgatgcgtccatataatgaaattgaatactactacagtataagtatcaatatgtttcaaacaacagtaataaaaagcaataaattattgataaatgcaataaaatggatgaatctcaaaatttgtttctgcctcatataggctaaatgggatgcatactttatgatcctatttatataaaattctataaaatgtaaactaatctaaaatgacaagaagcagattagtgtttgaggatttggagttcagagaaagggctgaattacaatgggacaagaagaaacttttggggttgatatatgtattatatgtattcattatcttgattgtgcagatggcttaataggtatgtcaacatcaaaatttgttaaagtgtacactttataagaagttttattgtgtaataatcatacctcagaaaagctataaaaatttatattaaatatatctacttttacctttttctgtcacacacgggtttatcactcacataacaagtacatggtaggataaaagagagataataccactaactatcatatgtgcagttctgcttcatcaaagatctcagtgtgcttttacattcattactaaatgtagtacatgccttagccagaatgtgattcagatgtgtggccatattaggccagttagcatggtgggccaattatcattgcattcacatgaagattgagaaggatgttgcaaagttcatcctgaaggaaggaggaagcagacatgataagcttgatctagcaagaaaatcttaatgagtctctgagagtcagggacaatgaagaaaacatgccagggtgtctcattcctgtctgtattattcagcactggctgctataacaaaagatcaaagactgcgtggcttcaacaacagaaatttgtttattatggttctggaggctgggaagtttaagatcaaggtgatagcaaggtagatttcattctgaagcctcttctcttggcttgtagggtactgccatctcactgtatgctcgcatgaccttttttctttctttctttctctctctttctttctctctctctctctctctctttcttttctttctttctttctttctttctttctttctttctttctttctttctttctttctttctttctttctctttctttctccttccttccctccctccttccttccttccttctttctttttttttctttttcgagatgaagtctcactctgttgcttaggctggagtgcagtagcaccatctcagctcactgtaacttccgcttcctacattcaagtgattctcctgcctcagcctcctgagtagctgggactacaggcacgtgccaccacatccggctaattttttggtattattagaagagacagggtttcaccatgttgaccaggctggtctcaaactcctgactcaagtgatctgcccaccttggcctctcaaagtgtggggattacagtcgtgagccactgtacacagtctcacatgaccttttctttgtgtgtgtgtggaaagaaagagtgagtgagcgagagagatctctagtgtctcctcctctgcttctaaggatatcagttctattgcattggggccctaccctattacctcatttaatcttaatgacctctttgaaggccccttctccaaatacagtcacattgggagttagagcttcaacatatgaatttgtgagggtcatgggggacacaattcagtccatagcaccttctgtaattggactgctgcagatagaagcaatttgaatagcattttccttccttcctttgttccttccttccttccttccttctttcctccctccttccttccctccctcccttcctcctccctgccttcctgccttccgggcttccttccttttcttctgacttaatcatcaacactgaaggaataatatatgtgagacactcttctaaatgttaaagataaagaagtaaataacttaaagtccttgatctcactaagcttacaatgagagaggacaagaaataatataaaaaatccaaatggatgtgtaaaagaaagtcttataagtataaatgccagtaagaagtgaagcagaataaaggaatagagggtgatggggcagagcagtgtagatatataagactggaataatcagtaaatgtcacttagctaatctttgaggagaaccctcataaagggagggaagaagtcaggccagagggtgttattaaacagagactagtcagtgctaaggtcctgagggtgaagttttattggtgtgtttgaagaacaacaaaggggccagtgaagagagcaaattgaaaagtagttggagaataatgtgaagatataataaagtccaggtgatatagaaattataagaaatgttaagaatttggatttggttccaattatcatcagaaatcattagcattttgcatagaaaaagggctcagtgtgagtcatattttagaaaaatcattcagtcttttgtagagaacaaagcaatggcagcaaaattggaagtaataagactagttagaaggctattaaagtaattttagacaagacataattgccgattttactagatgggagccatgagtacggtaataactgggatttggaatgtattttgatggtagacccaccacccttaatgatggataggatgtgtgttatgaggtaaacataatagcaaaggcaacttttaatttttgttctgaggtactgagtgaattgtggtgtcatttactaaggtgggggaacattaagagagaagcaagccttaggagaaaaatcaaagtaatgtttggaagctgttaggttatggatatgtaatagatattaaagtagtcagttggatatatgagtctgaagctcaggggtgatgaagaaattggagatataaatttgggagttataatgaagagatagtatttaatgtgatgaaacttgatggtatcactacagtaggcatctagtcagaaaaacagaaacagggtactcagcagaggatatttaatttaggcaactggttgtacaagtgttaaaggctgaaagaacaaaatgggagcatcaaggtactctataggtgatcactgcaagaagaagttgccaacagataggaatgagagaagaaaaagggggaaatagggttttggggaagaaattcctcagataatgttcaaaccaccaagaatggagtccagcctggctgctgttactacaactaaaggacacaacgaggctagttgaggggatcctgaaataatccagcactccaacatttaaaggttgggaagaggtgaatctgcaagatgattcaggataaatagtctatgaggtagaaggaaagtaggagagggtaaactcctagaagctaagtggggaaaaaaagactttcaaaaaggaggaagtatcatgtcaaatactgtttaatggtcacataaaagttggtcacataagttggaaactgaaaattaactattggatttgataaaatggaagtcgttgattgccttgacaacagtggatgcataagggttatggggataaagtctagctgaggtgaattcaagtaagagtagaaaatatggcagtgagtatatggaaataagtttttcagggaattttgtaataagttggagaaaggaagtagggcaatagtaaaaaaaaaacatgtgaaggtaaggttttttgtttttcttttaatgtcagatatgacaaattcatttgttgttgaaaaaaataattgagagggaaaaggttgattacaagagagagaaaagggtaattgccagagcaaaatccttgagtcactgggagataaaggatatagtatacatgttgagggattgagcattcatttacttcaacaagaaagaattcggggactatgggtacagacaatggagggttggctgattttgtagtaggaagatgaggaagttctcttgattatttctgttttctgagggcattacaatgtaccgcagtcttctaaaagttaagaagagggggtgaatgaggtttgggaaactgtaaaattgtaattttgaggcagagctcacttgaagttagtagttctatctgtggaaaaagttgaggttgtggaacctgtatcattctagatacagaaaattaggcataaactgtacgtaaaaatttaaaaataataaaccaattaaaacttggttgttttttactatcactgtgtttaagcattctaaacaatgtcaatgataaagcactcctccctgaaaagaatcttttattcatctaaatcctaatataaacaatcgctatgattacttttgagttttaacagtacatatttaagttcattttagcacatgaaaatgtgctgaattgctagatgtatttaatatttaataaatattgtagtttatatggaagctattttggaaaacttgtattttaaaaattggcccctgcgctctaacacaggcagacttagcttcactggttcctttagtattctaaaatggtatcattcaagcttgcttcaggcaagttcacatctatatgtattcctgtgtttagtagatttgaagtaaacaatagcccagtgattgtaaagacaacagaacttgagttatttcaattccgtctctctctgtgaccccttggagtttttagtagtgtttaaaatttacaacagtggaacagagttcaaattgcaagttgttttagttttgttgaagaattcaacttttagttcatccataaaatagattaattctcagtcataatattacggaacataattttgttatatggaggaagagaatgtggtaaaacatgacccattcctggtgtcgatatgccacgtgcaacattggttgtcatgaatcttaaactcaactagcatgtttatatgtccacccaactcaacaaaatgtttagctgtagagtcaccccacatcctactccctaccattcaggggctttgaggtagaggacaacatgccataggcagagtggaatatgagaagtcagttcataaacatatttgagacactgagaatttaaaggaagtggggaccaaaattctatataatggatttgggagaagtgagcaaatacattctaaattgctactgttaatttgcttttgcttgtacctctaggccagtcaaggttggaaaacttgggttatatttatttgtgccatatactatttgtgccgttatcctatttttctttgaggtgtacaatggagtaggtaaaatgtttaaatatatctgattaacaaaattgataaatgagattttaactcagacttacatattttctatttggtgttttatacactaaaataggtcaaaatacatggtatgtagaaactatgaaataaacttattttattgtactcagtactaattagatgctcattgctgtcatctgaatgttcatatccttccaaaattcatgttgaaacttagtcttcaatgtaatactattaagaggcatggccttgagaggtgagcttagttatttttactacaaaattaaaacaactattagtacccaggattagtttccttaatttgtaaaaactttattaaagttaggtaggaaacccaaagttatacagcagtagaaaataataaaggcaaaaatgggattctataggtgagctaacagacttcaataagaatcaactttccactttcattgcattggatgtgtagacattttctactgtacttctaatcaagggcattcatagagataagctacgagtttgccagagagatcggccagaagctactccaggcagcaacatgtaaggaagatatcctgtcagagatttagtgagactggttccacctataggttctgattgtagccagccatgttggcttacttacctttttgattctgcagtaaaaatcttatttaaaataatagtcttgcttctcctattctctagggagaccttgacagaaagttctatgcttaggttagagcgctaatgggaagacagtgactgcccctcctccctttcagctgccctcccattctccaggaacacagtcaaggcaagttgggtggtagtgctggtggccaagggagccctgtgagctggtactacaggaagcgacaagcacaggaaaattcagtgggaagacacaattctgggtcctctctcaaggatactacaccatagagggtgtgagtagctaggtcttaaggagacaaggaagtgattacaaacatatcattccccaagcatatctcagactaaaagaaaattgcagtggtggcatcattttgtttgtgggtgcagctatcatttgctaaattggagacatttgacttcggctcttaagaattgtactgttgtttatagaaacaaatcttacatttaaaacttaaaataaaataaaccagattttgatcttccttacataatccaattttcaaaaaacagcaaataacaacttttttccaaactgaaatttgaagcatatgtgttggtgagcacctgttctagaagcagcatgtatctacttgacctaattccattctgtatgtcagcctgcaatgcaataggaagtccatagagaagataaacagaaaggttagtgtgcagtctccctctgccactaggaaataaatggcagaagagtcagtcaatcctgtaagtttccactattttccattttttagctagaaggaaagggagcaatgtaatcaagcagagaccagagagcaaaaataaaaaataaaaagaataatcaaatatctcaaatatccaaagcaatcttgagcaaacacaacaaaactagaggcaacacactacctatttctgaatatactacaaagctgttgttatcaaaacatcatggtactgtcattaaaagcagacagatagacaaatgtaacagaatggagaacccaaaaatgaatatgcacatttatggtcaattgattttcgacatagatgccaagaacataaaaggaggaaaggaaagtctcttcaatcagtgatgctgggaaaactggatatccatgtatataagaataaaattagacccttttgccacaccatatcataaatcaactcaaaatggattaaagacttaaatataagacctgaaattgtactattagaagaaaacacaggagagaagtttcatgagattggtctgggcaatgattttttttttttaatatgacaccaagcacaagtaacaaaagcaaaaataaacgaacagaattacaacaaactaaaaagcttctgcacagaagaggaagcaatcaatagagtaaagtgacaacctatgaaatgggagaaaatatttgcgagccgtatatctgataaaggattaatatccaaaatatataataaatgcatacaactaaacagcaagaaaacatatatatatatatataaaacaaaaaagtcaccaaggatagggaggaaaaatgggttacaaacagaaaaaaatgaacgtaactgtatttcgaatgaataatataacaccaaagttttgggatgatgggaagaaataacctaaacaacttctatatgcagtattttgattctgtgtcttcaggtgagagtaacaactattgtactcaagttggtagatttgttcttaccatgatatggattagcggtttctaagtttgggaaagaaaatgtttagcagctggtctgtgatcaacttatctgtcattaccaggaaggaaagaaataaataaataagatctaatctcttggcaaacatgttgataagagatgtatggtttatctatggaatctatggaatgatttaacaagaagtctctggttaatgattgcttatgggaaataaatctagaatctataaattgatgtggcagtgcttcctgaaaaataatctatgtaaatatttgagtataatatggcaatgtttcataaccaaaaatgctccctgctgtgtaagttaggagactattcgtagttagtaatattatacatttttccaataatggatattgaattgatatatataatgggaaaaattcgttggattctcaatataattaaaacattgggtcataaatagattccccaccatgacctatgccaaaacttgagaaacactattttactgtcttaaatttaacaatgttgatatgtttcctgtttactttatagctgattttctaggtaatatagctttgatatataagcctctgtaattataaaattgttaaccaaaaatgtaatgatgtctaagatgtgagttgctggctcacagttaagcattctaaaggagaactaaagtcacggatctccaacctgttacacattagaattgcctgaaacattttggaagctatactgataaccaaaattttaattatctttttttgtattaaaaattattccaacacttagtggtttaaaacaatgccgatttgtatcttacaattttacaggtacagaatcaagcaagaattggctaggtgattcttctgctacacctggctaggcttggccgaagctcagggacagctcctctcatatgcctggtaccttgtggatatctggaaaactgaattcatcaaggcccctttccctcagtatgtattctcaaacctttctatagtgtctctccagcaggctaattaaagcctcttaaatggaggttcagggctccaaatgctagtgtttcaaaagtcctagaaagtagtagaagactttctgtgacatagccacagaagtcccagaagattactctgccacaattaaataagtcactaaggctggcccagattcaaggggaggacaattacactctatggcacaaaaggagtagcaaagaatttgcaacgtctttaatctactacataggcatcacctgagaccaattaagtcagaatctctaaggatggagtttcgcatcagtatcgttttaaagctctttgattctaatttgcacctaaggctgagaattcctgaactaaagtaaatggcactagtaatttccaagtcattattccatttaacttctaaaaatagtttatttcctatttttgcaaagcagccaccctgatgaaaacgaataatgtgtgcaacacttgagctacattaatttttatacacacaaaaaaatgttgctaatccaacctcaggagacaggactatttaagataatttttcaacatttgtgaaagatttgtgttgatttatgccatctttgctttccaggtgtttcttataagggatttgactcattagcagttttctaatcagttaagatgtttacaaatatattaatctcatctgtaaccaccctccttgaggaaccaatccatgttgccaaattccatagcttttcaaaatccgcactatttactttttcaattctatccccctcactactcatcgagcactttgcattccattcacaatgaactctccactatcactttgcaaggttcaaatatctctatatatgcatttacccaatattctgaatgtcctccacatccagcttctatgacctcaacctctataccaaccatctgttgatgcatgctttaaaattaagatcaacatattttaaatgtgtgatgcaaaatactacactgtcctagaagaaaccaaattagtttttgaagtcagagaatacttcctaagtaattggtatttaaggtgagttctgagagataagtggtgatttaccagactataacagaggccaaaatatcagcatcttagacaaaagtttacttctcggtcacatagcaaactaagcataagcaatccaagactgatctgttggcttcatgaaactaggaacacaggcttctttttgcttgttgctgtgctgtgttcaagaagtagcttttatctcattgtctatgatgactcttgcagcccctacatcttgtttcaagctggaggtgaggagagaagtggaggtcatactcctccccttttatgactaccacctggaaattgcacacctcacttctacttacatcctattgtctagaacctagtcacaaggccttttgtagttcccatacaaaagatactgggaaataaagtatttagctgggaggccaggtgcccaggtaaagctctagagttctatttaataaaggaagaagcagagagggacaaccaacagaatgtgaaaagtctctgacaaaagaaagaatatggtgaatcataggaactgagaaaaatccagtaagggatcagtcacaggtgtgatgacaatagagcaagcagcaacagacaacagaatctcacggaactgattccaactcttgatttctaacttgttaagttttctggtttgaaatttcaattatcttccagtcctgaagtccaggctcgaatcccagttaccttccccatgataaatgtcctgcctctaccccaatctggcagttaagcttcactttattgataaatcaccggttataacccaattttgcatctggcatccctggatatcattattcttacctggcctcctgacgccacctaatccacctgattaggaaaattttcggagaaggagttgtggcctaggagaatatattgaaaattgctatctacatattactccatttgagttacactggctatccataattcagggcaatggatttagagttgtaaatagactaattatcacccacattttaacatcccattacataagatcaagaatcagcatagagaattccataccctggctcatgcctctctactaaaaatgtgctgtaggtgctgcttgacttttagaactaaagatgggtaattctaagaaaacaataattacagaaagatcttccaggtgatcagattgaaagaatcataaataacatccaagtttggttatattttgaagaaaattatccatgattcctcaacatagaaataaccagtattttggtatattttcttctaacctatttaggttagaaggcatgctttttttacataagtaaaatcatgcctcatgtatatttttgtatacagatttttttaaagcattttctcatatcttaaaagattctgaggatatctttgaggtgcacataggaacctatctttttaatatgctttaacttattaatctgtttcttgattattggacactgatgcagtttcagtgcttttattgaaattcatactctaataatcattcatctttggatataaatctgtataaaacaatgttcctaattgtttgctggaattgttgggtttaatgaataatacatttcatttttaaaggttttatcagtttatacccaaataaaaagtatataaagtgaatttttcattatgacttcatcactattacttttgtaaatagttcctaattagatgggtaaaaaataatatcccattgtcttaatttacatattttatgttggtaatgagattaggcttttgggggtttttaatatatttaagggttatatatgtgtttgatctatgagctgtatatttgatacccatcttttaggctggaccttgcaggtggtggggttctttgagagctatttattttgtcatcttttgttgcaaatatggctgagtttctaatttccattttaattgggtttatggggcttttaatatgaagaaattgttaactactgtgtggccaagcctatgaatttttatctttgtgatttttttcatttgctttagcaaatctttttccatttggaaataagtattacttatatattatgtagaatttaaaaaatcgtttttttatttttaattaatttttacttaaaattgacacaaaataattgtacatatttatggggtatagtgggatgtttcaatgcatgcatacattgtataatgataaaatcagggtaattaccatatctataattttaaacatttatcatttattcctggtaacaacattcacaatcttttagctattttgaaataaatactacactgttatttgctgtagtcaccctactgtgtaatagaacaccagaacttattcttcctgtttagttgtgactttgtactcctttatactcaatgaccaacctctcccagtccgccttcctctctatcttccctagtctctggtaaccaccattctattctgttcttctatgaaatcaactttttagattcaacatgactgagatcatgtgatgtttgtctttctgtgcctggcttatttcacttaacatagtgtcttccaggttcaaccatgttgccacaaatgagaggatttcattctgttttatggatgaatagtatttgattttgtgtgtatatatacatctacagataaatggataatgaaatgttatgcacacacaacacacacacacacacacacacacacacatatatatatgtataaaacatttctttatctgtagattgtcatttaagttgatttcatatcttggctattgtgaatagcactgcaataaacagagtgtagatatctcttggtcatatgatttcttttcctttggacatatatccagtactgaaattgctggatcatatggtagttctatttttaattttttgaggaccttccatgctatttttcataatggctggagtaatgtacatttttaccagtaatatataagagttctcttttctccatatccttgccagtatttgttattttttgtctttttgataacaagcattctaatttgggtgatgcggtatcttgctatggttttgatttgcattccctttttagcatttaactctgatacacctgcaatttacttctggtgaatgtggaagttgatttttggcatcaattcagttttcaatttcaattttccccttggctaatgtaatttttaatgtacataagcagtaagaaaatattattgcctcaaaattatagaactgataaggtagactttgaaagcaatgacacaagctaaggcagagtgaaagaccttgaagatctctcaggaaagcttagccatcaccaataaaaagtattggttggggctgttgtttagggagttttaaagtccaggcctggagcacattatgctaagtaggataagccagacacagaaagataaatactgcaagatctcaattatttgcagcaactaagaatgtcaaattcatagaagtggagagtagaatggtagttaccagggctgggagtggaggaaatgagatgttggttaacggtcacaaagttttgttatgtgagatgagtacgttcaagagatctaatgtacagcatggttgactatagttaataataccatgtgatatacttgaagtttgctaagagagcagatctttagtattcttaccacacatacaaaaaggtaaccaagtaaggagatagatacgttaattagcttgactatagtaatcattactccatgtttacgtataccaaaacatcacattgtacacttgatacatacacaatttttatttataaaaataaaaattaaataaactattaagtccatctattccccaaggggatcacaaaacatagagctgctttatatgaaaactacatgttctattaatttgaactattttagatgtaggagtctgaactatgtcacaaagttgcttcaattttctaattcacttagtctgtataaatgcagcttgagaacagtccctggcttctctatgctagtggtttatgctagtggcatggcaagataaagatgatcatttattgctagtacttctaggcataatttcacaataacaactatgaaaggaataaaagcaaacagaaataaatatttctctccctatgccctataaaaattgtacctattgcaaaatggatgcctaaaatacattcagggaagaaaccacatgaattattcttaacccagaaagaaagctatccataaaggggaatattcccttctttttaacctgtgttactttgtgataataacctcaaaattccaattttgtctttactggattaaaagaacagcaagtcttaagacaagtttaaaagcagaacctcaaacagtattcttgtaaaaataatttattgttggaggtcaaaaggggacttatgggagtccctagcaggcagaaaagctaagctaggagatggtcttggctggagacgagcttcagtctgattccattggaagctcaagggcgtgaatttcacaacagagctgctgccaacttgaggtaagggagccagtcattggctgtgggctaggtagcagctgtgatccctttaaacagtcacctacgtatgtaggagccacaaaatgggacaacagcaccccactgccactaccacagcctcctagccacactcacttttccctgggcctggaaagtcctccctttcctaactcccatgttatctactaagtgaagtcttttccaacctcctacaaacatccccaactcccttgctctttttgtgtgtgatctcgctatactcttttgtaatatttatgacatcatattggagcaatctgtctacatgtctttcctttcctcctgagaatgcctgaaagaaagcaattatgacatttattttcatgtgcccagtgcttgggagagtgcctaatacataactggtattcaataaatcttggtaattcaaaacttctaaatataaaaccaagagttaaattataatgctgcataactgggtatccagtgataaaatttagacagcagcaaatgcagcagaattgcctttgagtgtcttgagtgctagagtgtcaatggtggtcagactccagtacttaccctatcttagttcttttctgttgttagatccataactcagttatctgtaaggattctcaatcatctccttaaagcaatggagctgccgcactatataccccaaataatctctcactgacaaactagcagtattagaaatacctgctgctgctccataccccatggcccaattccctatgctcttcatctcaaaatttcatgagaaattcaggataccaatttatataagttagacactactgcaaaataaatcatttcaagactcagtggcttaaaacaaaaattattaattctcatgaacacatttacagataagctaaaagtcagctgatctgggcctattttggctgggagtctttgcttccagctgctggtgtacctatctcaactctttattatgggtcaatttcattttcttctccacttatgttccttctcatttgctttgtaaattgtttagcccccagcaacccccgcccccaaaacctgtacgtgtgataaggtctacaaagcagtagcatgttctagaaaaaactctgctagttgtggagtcagaaaatactttcctaaggaattggtatttaagctgaggcctgagagaaactcttagcaagaacaaaaatgaggaaagggaatactaggcatgagaaatcttattttagttaggatatggtttaacctctgaaacagagaccaaaaccacagtggtttacacaggattaaagtttatttctcaatcatgtaaccatctgggtaaaacagatcaaggctgttatgacggctccatggtaccagggatttaagcttttctcatctttttgctcagtcgtcttcaacatgcagcttccgttccatgggcaaggttacacttgtccacataaagctggtaaattgtgtgtcacagctgatatcatacttacaagaaatcctttatctgattgtttcatgtttaatataatttggatatttatccaccaaatctcatgttgaattataatccccaatgctggatctggggcctggtaggacgtgtttgaatcatgggggcagatcccttatggcttggtgctatcttcgtaatagtgagttctcgtgagatctggtcatttaaaactgtgtggcacctccccccacactctctcttgcttgctcctgctttcatcatgtgacgtgcctcgtctcccttcaccttctgctgtgagtgaaagcttccttaggcctccctagatttcaagcagatcccagcaccatgcttcctataaagcctgtggaactgtgagccaattaaacctcttttgtctataaaccacccagtctcaggtatttctttacaaggcaatacaagagcagcctaagacagtgttgctcaataataaactgcaagtacaagtacagaaactttctgctccaactacacagacttaatgcagaaacctattgcatatttcctctgcttctgctatgtctgctcttatttataatatcacaatgtggaaaagagggaatattgaaaaagtgtagttctcctggaacataaacatactcctaacttctaaattctgtctatcatttgaaattcttggggactacatggctgcatataccacgtgtcatctctagcccaacttattgtagtaaatatttcctaaataaccttctttcccccaggcaatctttatgccattattctggttcactgccttcattgcagtcatcactatttgaaactatcatgtttatttattgtattcatttgctgccagaaagtaatttccataaaacacaaattttgcttaccttgtatcactgtatatcaaatgccttggattatgccaggcataaaatgcacatttgacaagtatttgttcaatggatgatatccagggtttatgcatatggggtataattgtcagagaatgagttatgaactggcaaggtgctctacaattattgttagtatagttgagttatacaaagtagattttcaaaatacagagcaattgacttagaattgtaaagaggatatgtaattaccaactacatcttgtatccaatctcttaatatcaaaaataattaaagtttcatttccacccttgcatctctctcccaaagataagtacttattccttcccagcttagaactagaactggatgactcagaggaaacaagaaataattacaaaaaataacttcagggtgatctatattagaaaatcagaaataacgtttaggttttgaaaaaaacaggaaatgttctattttcaatttttttttttttttgcttcagagtttcaaaatatttacaagcctctaaatctagaataaagcttagttaccttgactcatgtagcagcactttcaatgtggactttttcctttttaaaaatatattttcattttaattaaaaattattatgtaaactttaaaaactcatttaaattttcaaaatagttcattttgagattattaaagaaacactgaaaaagcaaatgaaatcatccacaaccaccaaaaaaaagttacctgctattaaccttaaggcaaatttacttctaagtcttttgcaaaatgtttcatagaatcctaacttaacagaatattatttactaattttataatttttctcatgtctttaaattattttaagaatgacttcagaggctatgtaatactttatcacttgagtttatcgtaatttactaattgttgaacaagaacattgttttgatgatttgtatataaataacactgcaacaattacatttgatataaatttccaccatattgctataattttctttatagaaatgaattattaggttgatgattatataaatgagtgtttatatattgataagtattttttccttagcagttcattcattgctcaattttatattgatacataatggttgtacatatttatggagtacatacaatatgtatgtaacatgtaatgatcaagtcagggtaattgagatatctattacctcaaacatttattatttctttgtgctgggaaaatctcaaaccttgtcttctagttatttggaaaaatactataaattcttgttaattatagttgccctactgtattatcaaacactagaacttactccttctaactgtatttttgtacccattaaccagcctctccttatctccccctctgctttcccttcccagcctctggtaaccatcattcgactttttgcctccagtatgtcaacttttttagctcccacatgagtgaggatgtttgatatttgtctttctgtgtctgttttacttgacataaggtcctccaggtttatccatattgctgcaaatgacatgatttcattttttaaatggctgaataatatttcattatgtgtacgtaccacattttctttcatccattaatgggcacgggcacttagtttgattccacattttggctattgtgaatagtgctgcaataaccattggagagaagacatctcttcgacttattaatttcctttcttttagatatatatccagtggtgggattgttggatcatatggtagttccttttgtaggttttgaggaacctccatactgttttccatagtggctgggctaatttacattcccacaaacaacctatgagcgtttctctttctctgcccccttgccagtatctattttctgtcttttaaaacttttaatttttaattattatgtgtatatatttaggaggtacatgtaatgatttgatacaggcatgcaaagtgtaataatcacatcagggtaactggggtatccaccacatcaagcacttctcatttctctgtgttattttctgtcttttttgtaatagccattttaactggggtgagatgatatcttattgtggttttgatttccatttccctgatgattagtgaggatgaacagtttttcataaaccagcagttatatgagcagttttcatatactggaatcaacaggtatatgaaaaaatgtgtttcttttgaaagaagacatacaaatatttattcggatcttttgtccttttaaaaatcagattatttgtttcgcttttgagatattacagttccttatatattctggttattaatctcttgttgaatctatagtttgcaaaaattttctcccattctgtaggctgtctcttcactatgttgatttaatttcccgttttttaccagcagtttatgagtatttaagagaaacctaattagcatattatttttcttaagatgtttcccaaactgttatgtgaaaatgacatttcattgttttaacttgcaatgtttgcatagatattaatgtttagtttttatatttttttcatatatttgttaacatttttttctctgagtggtacacatagtgctcattttaagttgtgtctcagaggttctttgtattgcatttgtacacctttttgtttaaaactaaaatataggtacacaagagaacctacatgaaatgaaggtagaacttaataaattatcatcgggcaaagactcttgcataactatgacccaggtgaagaaacagaaggtctttagttcttgccactcagaagtcactccatgtcctccatcccagtcacaatccccttctatcaaaaagtgaccaatatcctgtgcatgcccaggatctaactctgccatgtctaacagaaattgcatgctcccaggctaaaagataaatgattaaagttgtaccatgctgggagatgttggagcatcagcccagctagtatggagagaccacaccaagtgccttgggcatttagttgagataacaaaaaggccactgtgtggaagtcagaattatgccctggcataagagtcatgtgttaagatgaaataaaaaaagcaccctctcgccctaacaaagaaaaaataccaagcttgacaagacccggaataagtgaaaatttaactaaccaccagaaataaggtaaatacccttaaaagagaatgcataattcatactcatagcaatgtatcatgtacagtgaacattgtacaatcaggaattactagatacaccaaaaaggataaacctagtgcataagaaaaactgccagacagtaaagacataccccttaaatttatacaaataaagaaacaaaaaagaaaggcacaaatatgacccaaatattgaaattactggtaaaataaattaaagcacctattgcaaatatattctgatacctaaaggaaactatggtcatgctgaaagcagataaatattcttagcaaataaaagcaattcataaaaaagaactgaatgaaaattttagaaccaagagtacaatatctgaaattaaaatttcacaggatgggtttaaaagaagatttaacatagcatataaaaggaacagaaaatttgaagacagatcaacaaaaagcatccaatctaaagaacagatagaaaaaaaaaaaaaggaacagaccatccgtgactatttaatcaatatcaagctctctaacagaattaaattttcagaagaaaagatgcggaaaggtccatgtggagagcaaccaacagccagtacaaacttgccatctatctatgtgagtgagccatcttgaaaatcaatcctccagtcctagtcaagccacatcaacagatgtggtgtgagtagagactggcagctcctgcttgagccctgccaaaatttcagattcttgagcaaaacaaatgatagttgttgtttaaagccaaagaaagaggaggaagaggagggaatggaacaaaaaataataattttaaagaaataatggccaaaaaaatttcaaaattttataaataacataaatagaagccaacatatcagctaaccttaagcagaataagtacaaagaaaacaatgtctagctatcatagtcaaactgttgaaaatcagacattaagagaacactttgacagaggatagtcacatgtatatatgatttaaatgatcactgacttctaactagaaacaacagggaccagaagacaatgagccaacactttaaggtaaggaaagaaaaaaaagagtcaacccagaattctacgtccaaggaaaatagccttcataaaataaaaatgaaatgaagatgtaaattaaaactcagaatttctagcagaactacactactcaacatgtaaaataaaattatttatcctgaagagaaatctcccaagagagaaacttaaatttagaggaaaaaacaaatactaatggaaatagtaagtctgtgggtaaatataaggattatgtagttatttttacttctgttaatatctttaaatacatatgactgcttaaaacagtaattatgatactgtacttcaggatgtacaacatgtatagatgggatgtagattaatataatagcccaacagataggcaaacagaactttattgttgcaaagtttttacatttaacacaaaatagtaaacgttaattctaaatagatgtgacagggtatgtatattgcaatctctagagcaacctttaaaaaatgcaaagaaaccataggttaaaaagtcaacaaaataaaaggaaatcaaaaaatatttgactaagccaaaagacatcaggaaagaaggaatagaggttaaaacatatgagataaatacaaaacgaataggaaattgatagacttatatttaaataagcatatcaataattgtattaaattttcacagactacacataccaattgaaaggcagagattgccaaactgggtaaaagagcaaaatccaactatatgcagtctataagagatgctctttaaatataaagaaaccaataaagtaaaaggatgaaaaatgatagatcatgcatataagttatacaagcataaaaaactaaaatgaggatataaatagctgaagagatagacttcaagacaagaattattatcagaagtaaggaagaacctttcataatttaaaagaacctactcatcaagacaacaaaacagtcttaaacatgtaaacaactaataacaattagaaaatatgggaaacaaaaatgactgaactaaatcgggaaaatgtaaatatccacagtcgtagttgtagtttttaatattttctgacagtaactcatagaataactagacaaaaaataagaagggatatagaagatctgaacaccaccatcaaccacactgacttgttttagcccattttgtggtgatgtaacagaacaccagaattcataaagaaaagaaatttatttctcacaggtttggaggctgaaaagtgcaatatcaagctgctggcctcaggtgagggcctttctacttcatcatcccatggaagaaaatgaaaggatcacagagggagagaaagcaagagagcaagagagggccaaactcacccttacaataacaaacccattccctcaaaagtgatattaatcattataatcatgccctcatggcctaatcacctcttaaagatcccacctctcaacactattgcattggggactgagttcccaacacatgaactttgggggacaggttcaatccacagcaggaccctgccctccaaaaatacagaggtattttcaagtgcacatagaaaatttatggagatagacaacatgcttcgccataaaacagcagcttctagaagctgggaaaggcaagaaaaaggattcttccctaggactcctagtatgaacacatccctgccaaacttttagcccaatgagacccattatcgacttccaaccaccagaactataaataataaatctgagttgttttaatctactaaggtttggtactttgttttagcaatgataaaaaacacatgcttaacctctacaactaatatcaaatataaaaatagagttctcctggctgtagcagggagtagggaggcaacgttttctctccaatctctgcagtggttctctaagaaacatggcaaaagcctggaaaggttttgtgtgtatggtacatctaggctcatagtaccataatcagccttccagaaagattccccaagcattgcaacaagtaagcagaaacatatgaaataaaaatagccaacctaacaaaaaaaatgagtatccttttgtacatctgagttttaaaattgaaattaagtagatatttcctgatttcataccatcaatattttcttatcatagagtggatacacacagaaaaattactgtagataattccttacaggataaatcagtttttgaaataaaatcacaatttaaatgaataaaaaaaattccttcacaaaatatgcctaaattgactctgggatatagaccactaattttgcttgaagcaagatgcaatcatgcttccaatgataaatcattttccaattctagtaacatcttgattgttctctctagatattcacaaattctgcacatcacactagctgagaaaagcagaaatgaatatattactttaatgagtaatatatttaatatttaatgagtgccttagtccatttaggctgctataacaacatacctttgactggtaatttataatcagaatttattgcttacagttctggagactgggaagtccaagatcaaggcaccagcagatgtggtgtcctgtatggacctgttccttatagatatcaccttctttctgcatcctcacatggcagaagagggaaagtgctaataagctccctaaggccttttttataaggcactaatcccattacctaaatggcttcaatgtcataactgatcatcttttctcactttctgtctctaaaataatagacccttattattttcacaggtgtcaacaatatcattaaacatgcactctttaaaattttaaacataagattaaaatgtaatttaatgtctaatacttaaataaaacaaattatgtttttatttttaaacacctttatttgaggtacaacatacataccaaaatatttaacaattacaagtgtacaattcaatgaattttagtaatgccacagagctatgcaactatcctcgcaattttagaatattttcgtttctccaaaaggatcctcatgtctattttacttgccttggcatcgttttagaaaatcccttgaatgtaaatgtaaggatttatttctgaattcctgattatagttcattgatatgtctacctttagacaaatgccacattttaattacaatagctctggttttaattacaatagctttgtagtaagctttgaaatcagtgtgaggtctccaactttgttcttcatttcaagactgttttggctattttgtgtccctttgcaattccatgtgaattttaggatcagcttgtcaatttttgcaaaaaaaaaaaaaaaaaaaaagcagctgagatttttgactcggattgtattgaacttgtagatcaatacatcaatttgggagtatcatcatcttaatattaagtcttccaattcatgaactacaaataattgttaatttgtttaaatcttactccaaattccaattctaaaaatttctgttcccctcccccactgcccccagttgtgtccttaagagtatttcttgatagacacaagaaactagtactggttgttgctgctaggaaaacacctaggtggctttgagacaggaagggaagaggactaacgtagtttgaatttgcgtccccacccaaacctcatgttgaattataatcctcagtggaggaggggcctggtgggaggtgactgaattatggaggtggacttcccccttgctgttctcataatattgagttctcatgaaatctcacttaaaagtttgaaagtgtgtggcacatccctttcctcctcctgctctagccatgtaacatgttcctccttcctctttgccttctgccataattataagtttcctgatgcctccccatccaggcttcctataaagcctacagaaccatgagccaattaaatcacttttctttataaattactcagtttcaggtttttcttcactgcagtgtgacaatggattaacaaagaaaattggtaccaggagtaaggtgtcactataaagatacctgaaaacgtggaaacagctttggaactgggtaataggcggaggttggaacagtttggagggctccgaaaaagatagaaagatgaaggaagtttctagagactttttgaatggttgtgactgaaatgctgatagtgatatggatagtgaagtccaggctgatgtggtctccgagatgaggaacttgttgggagctagagtaaaagtcactcttgttatgctttagcaaagagactggcagcagtgtgcctctgctccagggacctgtcaaactttgaatttgagagtgatgatttagggtatctgacagaagaaatttctaagcagcaaagtgttcaagatttggcctggccgtttctaacagcatatggtcatatgcatgtgaagagagatgatctgaatctggaacttatatttaaaagggaagcagagcataaaagtttagaaaattgcagcctcttctttaggtggaagagaaaaacccattttctggagaggaattcaaaccagtggcagaaatttgcataagtaaagaggagtgcaatgttaatagccaagacaatggggaaaatgcctcaaaggcatttcagagaacttcacagcagcccctcccattcacaggcctggaggcataggaggaaagaatggtttcatgggccaggcccaggtccctgctcccctgtgcaacctcgggacactgatctctgcgtcctagacatgccagctccagctgtggctaaaagggccccagatatgtctcaggctgctgcttcagagggtgtaagccataaacattggtggcttcaatgtggtattaagcttgtgtgtgcccagagggcaagagttgaggcttgggagcctctgcctaaatttcagaagatatatggaaatgcctggatgtccaggcagaagtctgctgcaggggcagagtgctcatggagaacctctactaaggcagcatggaggggaaatgtggcattggaacccccacacagagtccccagtggagcactgcctagtggagctgtgagcagaaggtcactgttctccagaccccagaatggtagatcccctgacagcttgcattgtgcacctggaaaagccacaggcactcagtaccagttgtgaaagcagctgtaggggctgtgctctgcagagccacaggggtgtagctgtccaaggttttgggagaccacctcttgcatcagtgtggtctggatgtgagacatgaagtcaaaggaaattattttggacctttaagatttaatgactgccttgccaggttttggacttgcatggggcctgtagccctttcattttggctgatttctcccttttgggacaggagtatttagccaatgcctgtactctcattgtatcttggaagtaactaacttgttttcgattttataggttcatatggagaagagacttgccttgtctcagatgagactttggactgtgaacttttgagttaatgctggaatgagttaagacttaggggatcactgggaaaggttgattgtattttgctgtgtgagaaggacatgagatttgataggggccaggggcagaatgatatggtttgaatctgtgtaactacccaaatctcatgtcaaattgtaatcctcagtgttggaggagggggctggtgggaggttactggatcatgggggtggacttcccccttgctgttcttgtcatagtgagttctcatgagatctggttgtttaaaagtgtgaaatgtgtggcacctcccccgtgctcttcctcctgtttcagccatgtaagagatgcctccttcctcttctgccataattgtaagtttcctgaggcctccccagacatgtttccagtacagcctgtgggaccatgagccaattaaacctcttttctttataaaatgcccagtttcaggtatttcttgaatggactaatataaggacttatattttactttctacccttttgcactttttggattttacacactgcacatgtataagttatttaaaaattaaatttactaaactgtgctcccagttttttgaggtgcaataagatgcacagacatgaatgtgttagatgggtcatatttgtgtaattaattcctgttctgctcttagacttctctgaacattgcctcacgttgttagtgaaagttcccagttcttgtcaacttgggagaaagatttcaggcaagagaagatttaaagatgagagaaagctttaatgaaaggaaatagggagaaagagcttgttgtaggacaaagtaagtattctcccagacaagagtgggctgatcctgcaggaaaacatcttcgagggtcctgttctgtgagttttaacatgtagagctccctttcaagttcccacttctgtcttaagtaagtctccacctttttcctttgtctacttttcctgcttctgctttaagtctccactttttttcctgcctatgctggtgggattcttcaatatgtttgttaatacccatgcacaagttggtgatcaatatgaatcttgcttaatggcatccctgctcattactgccactccaggaaggttgtatggcagtcaaatatctatctattgcacctgaatatctcttaggaatgtcctcccttgctctcctgtgtacttgtggcaccagtgtacctcttaggaatgtccccttttgccctctttctgtccttatcagcatgtacctactgacattgtgacattttcactgcagagtgaatgattactggggcatcttaaaaggaattccagggcatttctttctgcctaggtacttcctctccttcttgcccaccccctccagcattagagattctattgctatgaaaattttgggtggtcccttgggtctgagactctccagacctttcctttctcaagtggtccccctcctgctcatgtctggctatctgcatactctaacaacatcaggctatctcatatctatttcttaccacctctccagtttctcttcttaatcctcatgcacaattttatctgtttttggctctcattcttctcgatattttagttagctattgatcagtttgctttcttctggcttaaaccaggtacttataagcaagtatagactgttctctcttcccttttccattcctggctaccttctacttcctgcctcaccctaatataatctatagtaccacaattttatctcacttttgtagggtaagataaatttttttatctacttttgtaggtattttacttttatcttacttttgtactatttcttaccctagaaaggctgtatttcagacactttcttcctctctttgaaccattaacttagatttcctaatttcttacctgtatgtcttgaatcttgtacttatttttgctaatatatatttttaagtaggtagtcataaaatatactctctgtaacatggattttatttcaaaacttgtaagtattaaaatataaaataaaataacccatgtattaaatcaatatttattaacaaaatgattgtgagttaagatacagtacctatgagaataaaacatgcaaaaatgcttattttcaattataaagataatttttaaaaacttcaatagatttagaggtacaagtggcttttagtttcatggatggatttgatagtggtgaagtctaggcttttagtgtacccatcgcctgaatagtgtacattgtatccaaatatgtaattcaactataaagataatttaaacagagtatttcaagcaacataccaaagatatttaaacaaatatttaaagaagtactgtgactttattctttttaataaaattattatttttattacaatgtaatttatatttgctgtgaacaaatcctatcattacaaagcatataaaagttagtccacttgttatctcaatctctacaggtcactttacatttttttcatacagatgtattaaaatatattagttagaagatgcttcctgctgtaattgaatatatgactaatggtgacttaatgatttaaaaccttttcttatgtcacataatcaagaagcctgaagatcagtgatcccagggttggtgggatggctgagggctgtaggacccagcccccttccccctgctacttcttacctgttgcctgttttcccaggaagtttcttgtcttgtggttataagatggctgccacagccccaagtgccacatctttgtacaagggcattgcaggtagtaggaaatgactaaatgaagaaaagacacttcctttcatcaaggagaaaaataattccacaatcttctctaccccttggtcagacctgactcctttggcaaatttgtgccaagaaggctgagaaagtgaatatgtggcatattggaatgatgatggaaatgacatgaatatagttggccaattacgatctttttcagagttctaggaaaattgtttctgcaaaataattgtgattcttttttattatgaaacaagaggagaagggatattgagtaggctgctagtagcagctgctgcacacattgtatcagtgtgtgtgtgtataaagacttaggtttgcctttaagtaattcagacccacaatagcactcatttaaacagaaagattggcctctcccctgtaaaagttcagagcagataggacaaagaatcagtttccttctagatttcccctttgccacctagagaatgggctttttctccttggttcgaaatggtgatcagcacatgtaaattccaaatggtgggacgagaaagggacaaggtcaaaaagggtcaaaagggcctgcactggctgtcgtttaagtaaggttccttgaagctgctctgaaacattctgcttctgttccattgtctgatacttagtcatgtggccatgcccagctgtgagggagcttgagaaatgctccttttatgaccaatggctacgtgtttaggtaaaaattagtgcctgtgagaataggagccctaaagaatgaaagtaaaatggattccagaggattgttagtagtctctgccatttacgggcataaaggatattcaatgttgtcattattgtaaaaagagcatgattttgaaagtatttatttgtatcttctttttatttaaaggaatatttttaggttaaggcatgtgcaagttgtggggagccacacctttcagttgtttaatttatccctacattttttccaatctagtattttgatcaggaccaaagcaaacattactgaatgacactgaattttcctattgtagacattttgaaaaacatttttgatagttgtctttttgggcatgacttgaaatcataaacatttccaaaaagatgtgaagaaaagaactgaaagatttctccagggtcttagtcaacactattcaggtcttttattctatgaaagctgtgtatgaaatcctgtcaccacagggtaaaccattaaatagacggttctttttcttttttgagcttttctttttgtattttttctgaatgtttaccagatactagatattaggattttattgaacagatttgcgtgtgaaaagaaaagccatagtaatctctttcatgtgtactttttgaaattgcttctgcacagattaaatcttatatccaagcttagaagtaaaaagcaagctagtcatataattgttcttcatctggcctggttatagcctgctgcaggaagctcattcaaatatgggcgcttcaatatttctagcacaaaataaaaatctatcttttttgttcacctaaataataccatgtcagtgtatctttattagctctgactttgtgaaatgaagtttcaaagtctactaagtattctctaattcaaataattgctctaacagaaggaaacaagataactgtttccctactcaaatatcatatagtctgttttcaatctgtctttcattgctgcattggtggaatgcctgcatttaagagagaacttctgtttgccagtcattcctcacagtggtgctggtgaccagctgtctgagaatctactattaagggttgcattctgcatgccacatgatgtcttcttcctaataccgtttagctctacaatattctttatgaagtcccttaatcactccattattccatgttgctaagcggtcaagcaactgctagctactgaaaggagaatttgcttcacatattttgtaccacatttaagtaggcttagatttttgtaatgtcacagatggtgtagcacaaataagaaggttacagggactgtggtaatatttggactctgcttacaactgggatttttggagctcttctctgtggcattgtttgattttgtttattttttattgaagttctgctactgtattagaatattagtcatttatgttttattatatacagaacattgttctgggtgctttgacagatataatacagcaataagaggatttttgcccatttatccatctaaactcttaaagtaattgtatggggatatagtagacatttcccctttttacctcaccctaaccccaatatttgaagcttcttgtaacttgggagactgcatctacctctcactagagaacctcccttcttagccttccttgtgtctgtgtaggcatgacccttgacttagctctgaaaagcaggtatatatcctcagataaaggaggaaccactcaaaatgcgttctggtgaagcaaggtggtggccacttctgaattcactttccagaagcaacaggcaacagtagtaaggggtgtagcaggagcacccagtggctggcattgcagcattggaggttttaaggtgtctgtatccacaggtggtcatcatgttgttttcataagaccagttttgtgatacaaatttgggcatttccctggtggggaagtctctatgactaattgctgggctcatctggagattctgtgagttactaaaaatatttaatagagtgagaatttttactgcttgtaactaagcatactgattgatacaagaggctagaagctattataccattaacaagtaacaaggacaggtaaaataaaaacttgggggtagacatattaacgtgatctgatggagatagataagggctcaaaagataggaaagattcacacaagatgtagatgtggagctctgcagccttaattaattcaacaaatactgtgagctgctaatggataacagaaatggtattacatgcttaagataaaacaatgagcaagaatgacacagtcctactttcatgaagcttacagtacaacggggaagaaatgaatcaagttattataacagttctgtcaatgtagaagaaatgaattaagttattataacagttccgtcaatcactctgttgggagaagtaagaggatataatgtaaacctttatcaagggcacttgtatctagaatactcaggtgagacttccttcccagagagactttaagaaacattgactatgcatggatcatgcctgtaatcccagcaaattgagaggctgaggcaggaggatcacttggacccagcagtttaagaccagcttgggtaacatagtgagatcccatctgttaaacaaaaaaaaaaaaaaaagaaacattaaattaaattaaagggaattgaaggaagacagtctgggcaaagaatgtcccgggaaaggcatcagcgtttgaaaaacactttgcagtgagaaagaaaatggcacatttgaaaactgaaacattttctatgtgcttaaaatatagaatgtggaaatggggagtggctaggatgatctggagaagagaaccaaatatattttcttctgtatttagttggtgattagtgagagtttattgagttagtgtttatgaaagataatgccaatactgcaaataatacgcaacgttatggtgatagtattattttttataaataaagattgctctgctggtccttaaatacccattattaagtcttaatatcctgtgtaatcttgaaatacaacttggtatgggtttgtgataatctgaagaagacgaatcattccaaacaactctaattgagtcaaactagtacagtgctctgtaattacaggatttttaattcatgcttttagaactgatgggagactgtaacaaaattcgggaaatgttggttttcttactttgtaatggttgagtatctctaccttgttgtgtgatagtatactgaatgggaataggaatagtagcagtgttcaaatggataaagagagatagacatatttaaggtatatttaggatatttggtatatattaggatatccattgactaaaaggataagtgaaatgaagaaagcgatgcagtcaagatgtcgatccttatatgaaagtcacagacttgtgcttcctaagtggtctttctgtctacctgtgattatttagttgatattaaatacatcacataaaatttacatttattcatcttgtcatctaattttgaaagtgcaaatacctttaaaaaacataatagtaatgtacctaaatctactcctcttctcctttgactagcaagactttaggtggaagatccaggatgtatctatttcactctagtggctgaggcaaaatttgacatttgctttagataatgatgaatttgaatgacacttaggcatatattcaaagagttgtatgtgatttattacatataattaattatataattataactataataattatgtaataattatgttaagtaaaattatgcatataattataacaaataataattttccttgatatagcagtttctatttattttcaaacacattttcattattctattttatattcaccaaaactctgtgaaaggcaaaattatccctattttacatatcagcacacactagcttataaaaatttaatagctgtaagtttatccagactgcaggtagcagaacatgaacagaagcttggattttcagctccttgttcagagacagtgaaaagagttaaacatttttttttaaacactgggtgattgttttccgaaggtccaggatgcgtactgcattaaatgaagacttgaagatttattaaaaataggagacatatgaacttctaactagataaccaatcacttaattataatttggagtgatgtggttatggtgcttttccttaataaaaatacaagctatatttattcaaccaaagtgaaatagagggttgatcaattgtttttcaaatgtcactcagtaaagagccattaaaatcatctagtcattatttcatgtcttattcattagtgtttttttttttgtctttgttttatattttggactgcattactcctttaagctggaattagtccctgtgcttgaaagtaaagacattattttctcctatttgcacattttccccaaaatcttgtgcaacctccagttaattgcactcaaaattattgatgcttaggagctcaaaaatgccattgcataaaaaaaaaaagcctttcaaaacccagcttggctttagaagctaacttgctgaaaaatgcttatagcaatgaaatatcattattcagctctgtgaggtgctagctggaaagttacaacgtcattgcttaaagggctatatttgtttatagatggacagttacaagtgactctgggggctgaagttttgtaaaattatacacttatataggtctcctgttggcccagttatgtaaatctacaaataggttttcttggcacgagggccacataactgacgataaaactctgactgttaaacgggatatataattaccaatgaccatggttggatttggtcaggttttaatcagtttgcagaatacattagtggtgcttgaaaatcttatgaaatataattccttacacaaaagccaattaatttatattttctaaagaacaaaattaaatgatagtttatcaaacatagaatttaaatattgtatattaaaaacacaaccacacacacagacgtgaacatacagtgtatgtttattataaagttttcaaatgatctctagggagccaaagccccttctgcatgttatcaagctaagaaccctaacttgatagtattctattagtaggtttgaaaatggcagtggagggctaaaggaggtggaaaaaaaattgaagtgccagacttgggcgttagtagaggtaatttgctgtattctgtcttaattgggttagaatgttgaaggctttgagagagaatttgtttagaagacaatctgattttcctgaataggaaagtttagaaacagtgtttgttaccactatgttaatagaagtgtcatattaagtactataggatttttgcatcactgagattcaaggaaaaattccataactagtgaatcagaagtctcggcttttactgaaaaatgaggaaaaagattgccatctaattggttgtctggacttatgtggacgttatctagaaaggccacgataggaaacctgaactacatggtcagacctcagaactgttttgatcccaaactaatttcctcaagtgaatagtaagaaattgctttcttataacaatttcaaaaggaatgaaatgggggaaagaagtgggttatcaaataaatggcaaatgctcttattaaaaaaaaagacccacaaacgacattagtctctccaaagagggtaagagaggtttggggaaggggataagaaagaggaaaaacattattgatcctcatttttgtctttcaatatttatttttagattactcctgaaaaaggtgaatatccatatccattgtttttttttttttttttttttttttttttttttttttttttttttttttttgtgagacggagtctcgctctgtctcccaggatggagtgcagtggcgcgatctcggctcactccatatccatttttaaatggaataaattgctgtatggtggaggatgagctattttacaaaacatcgtagaataaccaccaaataaatacattcttcagtttggagtcttttgttttttcatgaggcatttttttttttttcctaataagtttcgttgcttcactctagaggctctgataagatgcgtcatccaacccaggcttaaaaaaaatgcctcatgagataactcaaagaagttataatgccagcattcatttacaattggtagccttcgttaccatttagaacatttgttgagaagatgaagctgttatcctttatttgagagcaaattgagtgagtgtaaagtgccctctgaatattctgtaggacatcctgtttcctccctatttcctcacttcatgtcctgcaatggtgacagctgtacttacatttagtacccaggatttcgacttttgtatccagcctcttcaatgatctcttaattgctgctgtgcttgagtactctgccaaaatacaggagggcggcgttagtctgggagaggatagttcctcatggattctgcttcagcttgcccaggctcattaacactcagggttgttgcttttgcagctgctttcccagtgaggttccatttaaagcagttttgaaaatattgagagacaccagagtaacaatgaggttttcttccttttttttttttttttttcaattttactttaagttctgggatacaagtgcagaacttgtaggtttgttacataggtatacatgtaccatggtggtttgctgcacctatcaacccaccatctaggttttaagccccacgtgcattagttatttgtcctaatgctcataaaaatgttgttttctgaaaacagatgctactagtctgtgtgggatattatctcagcatcttattaaaagcaaaaagttgtataagccccattgcttttaataggcagcacttttctactaaatctgggaatattgtaagccaaaactaaaaattaacagctcagaatattctaaatatagaagataaatatttaagatactagatatggaaggtattactgatcttaactctgaatgcatttcttatttctgttctctacccaggtgctgttgtctctcacctggtttctctagttcttgtgtaagtattttagtgtgtgaatagttgtttaaatgtttctgcaagaggatgtgcactggaaggttctatttcatgatcttgacagtgtcactggagcaccctcctggatgcatttctgtatcttcaaaaggaatgccggttaaaatgttaataaagtctctgagcaaagttgcctatacataaaatcccagctacttgagagactgatgctggaggatccttggagcacaggagtttgaggtttcagtgagctatgatcatgccactgcactccaacctgggtgacaaagcaagacttcatctctaaaaataaatataaaatgaaataaaatgtcaatgaaataatgattaaataatctctctaatatgtgagtttgaatgatgagaaggaaccaagatgatatccacatgccaaggagctttagttgctgaatgtttaacaaacgtgggtgtctggaaattattattcttggtggtattagaaacttggtagatgtgtgcagcaagttaatatgtcaaaatgccaggttgcagcagagaaagaggtttaattgtggggccgctgaacaaggagacaagaagaaacctcaaattcatttctcaatggagcttgcgactaaggtttttaagagtttcagagtggatctaaatgtggagatcactgattggctgaagagtgcagggtgaagtcatggggcagggagatgaaaaaaccgtagtctcatgctgattcggttccgttgtggtggatctttgaactggttggtgtcagctgtgcccttgaaagtcaggatctgcttaagcaattcttaaacaaagatcttgggattctaatatggagatcctatctatcttaaacaaaagccttatgactaatgtcagaaattttatctataggaacaatggggatgcaaatggtctgtatctagtgctatggggactttcggtttcaaggaagtgagtcaaagtgcagcctgattaatgcttaaatataactcaatttatgtccagaattcttgttaaccctgtgaggatggcttcttcaagacctgctaccaaaatgcttattctggtctcaggctgcaaggaagcagaggatttagggaatttggcctgcatatgctcaaggaggtggctccttttacagatagacttaaaaactcttgccctgaagaaaacagcctctgttttcatgcagacgagatacccaagtgagggcctcagtgaacatctgacaaatgcttctgttagcacaattcatctggctgaccctggctgatacttccaaatttgacttaaacatatttcattgaatctaagacaccagtggttctaagacagagcattgtttactatgtaagagaaaaaatgatgacataaaggtaagattctagtgtctattattgagggttctacagagaaacagaaccaataggagatagatagatagacagatagaaggatgagaggggatttattaggataattggctcacatgattagggagacccagaattcccatgacatgccatttgcaagctggagaccctgggatgctggttgcatggctcattccaagtccaaaggccttagaactaggggagctgatggtgtcattgttaatcagagactgaagacatgagcactccagggagcagctggtataagttcttgattccaaaggctggagagcctggagtgctgatgtccaagagaaagagaagagcattccagctgcaggggaggaggggagagagagagagacagagagaaagaattgtcttttctcttccctttctattctatttgggcctccagtcgattggatgatgcttacccacatccagtcgtctgggggcccagatagaatagaagggcagatatttcccactcagtccatatactcacaccaatctcctctgcaacaccctccaagacatacccagaaataagttgacacctgaaattaatcatcacagactctaagatgcatctttgaattgtcttaagggtctgtgatgtgcacattaagatgcacagattctaagatgcagagaaaacatgcatttaaaatagaataaataatcatctcttcacctgaatccaagtctttcctagttggggacgcctaaacttcatcgaagccttaaataagccataagcttattcattgtcttgtgctttacacagggggttttatctttctctttccactttgccccagccctctgtcatatactgtagaaattgcataaaatcaggagctgttacattatgggggagccccagctttctttctctggccttgcatggtagtatgtggatatatggatacagatcatggcaatctttttttctcccttggatatttttgtctgataataaaaattgttttgttcgtaagatgtaattaatcttggcaattcttcctttagtgccgctgtaagagttctctatgagagagagtacctagttctctaggtttcctgattcagtctatgctgaggtgcagtcctccctgatgacatcttctgcttctgaacagttaatagaaaagtcccttcttccctctaaccaatatcattcataacaattatgctttgagccccttcaatgtttcaggcactattataggctctattgaacataacatatagagcattactgataggaattacaagagccaactgtatttgagcaaagacatgaagaaagtgaagcagtgggctatgtggctatctaatgggagaaagtccctgggagggagtagcaaaggaacagttccattgtgcatagtagaacatgcatagtgtgtttaagaaacaaggcagcaaggaatacgccagcttggctgaagtagaacaggaggacagtagtaggagatatgagcagagagatgttgaggagagggcagacaaatgtaaaagactttgatttttactctgaatgagatggaaaggcactgaaggaatttatacaaaagagtaacatattctgactttatttgaaatgcatatgttaagtctatgtgaagggagaactttaacatggaagagtggaaacaatgagaccagacagaaggctagtacaataataaaagagagtgatggtagcacctgcaagagttccagttgaggattaaactctgattttttttttatcttgcccaaattcttatctaaaaagtggtctgggggtcatgccctacaaatcataaattctcatcagatgtgttttatttaatcctatatatcatgacttactttccaaactgactctggcataacattacgagacaaagaagaaaatcaaaatattttacatcaaaacatgtttctttgccgtattttgaaatggccctgcagagctattctttgtgggggaaaatttgcatctgtaaagactctctattaacatagctagatctttttcttccagaccctcctaatcctaaacagattaactaagatctgaataggaaacatttgtcacctatagcctctaagggcagccactctaagacttcaaaagaactttgatctctacaatctttatcttaacctgaacattccattgtttctatctatcccaggtctttagacaaactcaaccaattgccaaccacaaaatgtttaaattcacctatagcctagaagcccccactttgagttgttctgcctttctggaccaaaccaatgtagttcttaaatgtatttgattgatgtctcatgcctctcaaaatgtataaaaccaagctgcgtcccaaccaccttgggcacatgttctcaggacttcctgagggctgtgtcaagggccatggtcactcatatttgtcttagaataaatctcttcaaatatttcagagtttgactcttttcgtcgacacagtggtggagatggtaggaagtagtcagtcagtcctggatatgttttgtatggaaatctgccaggttagattgactaaagggtagggaatggagtccaggatgactcagggtgttcggcctgagtagcctgaacattgaagctgccattgactgagatggacaatcatgtgggaaaaacggtttgaggggaagaattaggagatcagttttgggcattgtgatggttaatactgagtgtccatttgactggattgaaggatgcaaggtattgtgcctgggtgtgtctgtgagggtgttgccaaaggtgattaacatttgagtcagtgggctgagtgccgtggctcatgcctgttatcccagcactttgggaggctgaggcgggaggatcacttgaggtcaggagttcgagaccagcctgactaacatggtaaaaccccgtctctactaaaaatacaaaaattagctggccatggcagcaggcgcctgtaatcccagctactcaggaggctgaagcaggagaatcacttgaacctgggaggcagaggttacagtgagccgagatcaagccattgtactccagcctgggcgacaagagcaaaactccatctcaaaaaacaaaacaaaacaacaacaacaaaaaatttgagtcagtggactgggagaggcagacccaccttcaatgtgggtgagcacaatctaatcagctgccagcgtggctagaataaagcaggcagaaaaaggaagaagtggacttgcttagtcttctggccttcatctttctcccgtgctagatgcttcctgctctcaaacatcagactccaagttctttggcttttggactcttgcaccagtagtttgcctggggctctcgagccttcagtcgccagccacagactgaaagctgcactgttggcctccctacttttgaggttttggaacttggactggctttcttgcttctcaacttgcagatggcctattgtgggacttcaccttgtgatcgtgtgagtcaactctccttaataacaccgcttcgtatatacatctgtcatattagttctgtccctctagaaaaccctgactaataaaggcatgttaaattggcctgtttaatattcaggtggagttttctgctgttcaatactatgtgaagatcctgcagaatcactaatatatagagtgaggtttattactcttgttagtcttccatttgtcatttctccacatttttggactgctcaagagggtgaacatgatattggataccttctaccatgtacacaagatttaagagagacttctcatgatggctttgtgaactgaagtgagtcataaatactgattagttgtctaacctaattattagtagtatatataatcttgtcaatatacttttctggtattgttattctttcctatttttatcaattattctaaattatgatgattgtcagttatttaatctacttagatgtgtgtaaatctcattcatatttagatatgacagtgcatattaataatatgtgttatattacttgaattgctttattttttagaaaagatcatgattaattgaatcatatgctgtgatgtgttcctctgttactcaggcctaaagagagtcttggaacattatgttgtctcctgagagcttgcttagtgggagaatctgacttgcagataatgccaaggggacaataaaagtctagcccaggccctttaagtagaagcaaatattctgcagcagatataaaaataataaaatattaccttcataatcaggtaaaaaatctacgtaaaaatgttaagagctcattaatatttatgattgccccatataagaataagaaagcagagaatataataatgatataatttctaaagtcctaattatgaacctgtaaactttttaaggtcacctgttaatccttaattaaattgtactttgacaactgagattacttacttcattagcattcttgaatttgcatataatttgcattataaaatttgttgttttctcaagattctctttactagttctatttatactgaatgatgtaattgctctttatttaattcccttcttaatagctctaacaattctcatttggtgaagataaaatgtaaaaatttagggagcaaaatgacaattaaacataagtacattaaatgtggactattagatgggactaatagttcaggcaggtttggtctttggcaataagggactttttgttggagtaggagtggcaatttcttttcttttcttttttgagacggagtctggctctgtcgcccatgctggagtgcagtggaacgatctctgctcactgtaagctccacctcctgggttcacgccattctcctgcctcaccctcccgagtagctgggactacaggggcctgccaccacgcccggctaatgtttttgtatttttagtagagacggggtttcactgtgttagccaggatggtctcggtctcctgacctcgtgatctgcccccctcggccttccaaagtgttgggattagaggcgtgagccactgcgcccggccggcaatttctttttttaaaggaccagatagtaaatacttcatactttcaggccatgtggtttctgtggcaattactcaactctccctttgtagaacaaaagaagccatagagaatctgtaaactaatgggctacatttcaataaaactttatttacaaaaacaggcattgaagtagatttggctatgggtagtagtctacaaacctctgttggagcccagatgcttcattttgacttccaagtgtttaggattcactgagaaaaccatcctactgtcaaatttccatccatctgcctattatctatgcattatttatgctttcttcaagtgacttttattttaatatgtataacatcttagggtaaaacatttcataatacattctttctgtggaagactttggtacctgtttttgtttttgttttttttttaattcacttcacatacctatggagcatttgcaatatgccaggcatgtaatacaaactatggataagtattttgtagaaggagcagctaatagtttgttttttgaaaaagaaaaaatagtataaaaacatacatttttaaagcagtggaggaaacagtatctaaagttataattttatcttaaaattaaatggattaaaatatgctcatgaagaacatataggacactttaattatttcgacttttattttaggttcagggagtacacgtgcagttggttacatgggtaaatcatatgtcactggggtttgatgtacaaatgatctcatcaccctagtagtgagcatagtacctgagagcaattcaacaagcaaaaaccaaataaccccatttaagaaatgggcaaaagacatgaacagatacttctcaaaagaagacatataggttgccaacaaacatgtaaaaaatgctgaacagcttgcagttctctaagtaagagggaatataggagttgagagaatcaaaggaagcctgtgctttgtagcagtgcctattcaccagaatgctatggtacactgtgatattccaaactctttgtaattttgacctctaatgaaaaattttttttttcagaaaaattatagaaatgaatttaagaggaaagactgaactcaacaagctatgggtgtaaagcgagccacaacttgctttacgagtgaaatgtgaagtgtaatataaatggagccaaggaaagattttgacttaaaataaatgctcaacattattaatcatcagataaatacaaattaaaaccacaatgaaacatcatcttacactagtcagaatggatatcattaaaaagacaaaaaagtaacatattgaggaggatgtggagaaaatggaactcctagaaactgttggtgggaatgtaacttagtacaacctccatggaaaacagtatggaaatttctcaaagaactaaaaatagaactaccattgacccagcaatccactaatgggtatctatccaaaggaaagaaatcattacatcaaaaagatatctgtttatcacagcactatttgcaataatgaagatatggaaccaacctaagtgtccatcaatggaagactggatacagaaaatgtagtatatatacacaatggaataccattcagcattaaaaaagtgaaatcatgtcttttgcaacaacatggatggcactggaggccattagataaaacaagctaaacactgaaagccaaatatggcatgttctcacctataagtgggagctaaataatgtgtacacatggacatagagtgtgaaatgatagacaatggagactcagaaggatgaggtgggggagggtggtggatcatgagagattacttggctaccagctcaccatagtgaggtagagcaccaagcagccttctagggtccccacttccaaaccttggctctgggatggaatttctggactgccttgggccagaggtaagcccactgccctgaatggagagacccaggcctggcaatatttacacaagttgactgatgagccctttggccttgagtgaacattggcagtagccacacagtactcgctatgggcctgaggcaatggtggccacagggagaaactactgcttgaggaaaggagagtgaagagtgggaaggtccttgtctcttgccagctcagttatgtgaaatagagcacctagtagatttctaatgtttctgcctagaggccctgactcccagatggtgtttctggacctgttgtaggccagggagagctcactgaagggaaggacacaagtcttgttggattggtggcctgctgactgaaaagcccttgggccttgagttaacacatgggcctgggtgagaccaagtgatgagctggcttcagttctgacacagcagagtcccagaggtggtggccacaggggtgcttgtgccacccctctcctgcctccaggcagcttagcagagagagaaagacaacatttgtttgggagacagtaagggaagagaacaagaaactctgcttggtaatccagaaaattatctcagatcttaattaagaccaccaaggtggttctgcaagagttacattattactgtgcttggggtgccccctaatgcagatacagcttcagggaccaaagacttagatcagaacactcaattcacttttaatacttggaaggccttctcaaggaggatgggcgcaaacaaacccagactgtgaagactacaatcagtatctagctcttcaatgcccagacatcaacaaacatccacaagcagcaagaccatctaggaaaacatggcctcaccaaattaaataaggcaccagagaccaatcccagagtgacagagatatgtgacctttcagacagagaatccaaaatagctcttttgagcaagctcaacaaaattcaagatagcacagtgaaggaattcagactcctgtcacagatttgcaagacaaaaaaaaaaaaaaaaaaaaaaaagatgaaaagaaataaaataaatcaaagaaagaaagaaacagaatcctataagataaatttaacaaagacattgaaataatttttaaaaatcaagcagatgttctggagctgaaaaattctattgacatactaaaaatgtatcacagtcttccaaaagcagagttgatcaaacataagaaataataagtgatcttgaagacacatttatttgaaaatacgcagtcagaagagacaaaataaacaagaataaagcacacctacaagatataggaaatagcctcaaaaaggcaaatctaagagtcattggccatatagaggaggtagaaagggagagagatcagggtagaaagtttattcaagtggataataagagaacttcccaaatctagagaaatatatcaatattcaagcataagaaggctacagtacccaaagcagatttaatctaagtaagactacatcaagacatttaataatcaaactccctaagatcaaagataaagaaaggatcttaagagcagcagagaaaaaaaacaaataacatacaaaggagctccaatacagctggcagcagacttttcagtggaagccttaaaggccaggagagagtggcataacatatttaaaatgctgaaggaaaaacaatccttttatcctaatttagtagaccaggcacgttggctcatgcctgtgatcccaacactttgggaggctgaggtgtgtggatcacctcaggtcaggagtttgagaccagcctggccaacatggtgaaaccccatctctactaaaaatacaaaaaactagctgggtgtggtgatggacacctgtaatctcagctactcaggaggctgaggcaggagaattgcttgaacccaggaggcagaggttgcagtgagccaagattgcaccactgcactccagcctggctgatgaagcgagacttcttcagcaccccaacagaaaaagtatatccagcaaaaatatccttcaaacatgaaggagaaatgaagccttacccagataaacaaaagctgagggacttcatcaacaccagatctgtcctacaagacatgctaaacagagttcttcaatctgaaaggaaaaaacatgttaatgagcaatatgatatctgaaggtacaaaacccactggtaatagtatacatatgcaaagaatattataacactataactgtagtgtgtaaattactcttaaatagaaagactaaaagatgtatcaataaaaaataataaccacaataacttttcaagacacagtacaataagatataaatagaaataagaaaaagttaaaaagcagggaggataaagttaaagtgtagatttttattagttttctctttgctcgtttgttagttgatttgtttgtttacacaatcagtgttaaactgttatcagtctaacataattgatcataagatgttaattgtaacctgcatggtactctcaagtcaaaaaaaatccaaacacctataagagacacacacaaagtaaaaagcaagaaattaaaacatactaccagagaaaatcaccttcacaaaaaggaagataagaaggaaggaagaaaggaaggaaaccacaaaacaaccaggacacaacaaaatagcagcagtaagcccttacttatccataataacattgaatgtaaatggactaaactctccaatcaaaagacagtggctgaatggataaaaataataagacttaatgatctgttgcctacaagaaatacacttcaccaataaagacatgcaagaccaaaaataaaaggatgaaaaaagatattccatacaaatggaaaccaaaaccaggaatgagtagctatacttatgtcagaaaaaaatatatttcaagacaaaaactataaaaagagacaagaaataatacacaggttaattcagcaagaggatataacaattgtaaaaacatatgtacccaatgctagatcatccagatatataaaggaaatattactaaagtgagagagagagagacggagaaagaggaggagagagagttagtttattgctagctagagacttcaacaacccaccttcagtattggacagaaaatcgacaaagaaacatctgatttaatctgaactatagaccaaatggacttaagagatatttacagttcatttcatccaaccaatgtgcagaatacacattcttctcctcaatacatcaatcattctcaagaatagaccatatgttaggccaaaatcaagtcttaaaacattcataaaattgaaatcatattaagtatcttctctgaccacaatgaaaaaaaactagaaatcaatgacaagaggaactttggaagtttgaaactttggggattttgaaaacatatgaaaattaaacaatatgcttctgaatgaccagtgggccaatgaagaaattacaaaagaaattaaaaaaaattcttgaaacaaatgaaagtggaaacacaatataccaaaacctatgggatacagcaaaagcaatactaagagcaatgtttatagcaataaacacctacatcaaagtagaaaatcttcaaataaacaacctaatgatgcatcttaaagaaatagaaaagcaagagcaaactgaatccaaaagtagtagaagaaaagaaataagaatcagagcagaaataaataaatttgacacaaaaaacaacacaaaatcaatgaaatgaagagttggttatttgaaatggtaaacaaaattgacaaacttttaggcagactaagaagaaaaccagaagactcaaaaaaaaaatcatagaggaaaaaaagacacaactgatattgcaaaaattaaagggatcgttagagactactatgagcaagtgtattccaataaacttgaaaacctagaaaaaatggataaattcctacacacatacaacttaccaagcttgaaccatgaagaaaatctcaaacctgaacagaccaataataagcaatgagattgaagtcatgttaaagagtctccaggaaaggaaaagcctgggacccaatggattcactgttgaattttaccagacagttaaaggagaactaatgcctatcatatccaaattattctggaaaatagaggtggaaggaatacttccaaactcattctacaaggccaatattaccccgataccaaaaccacatagagacacattaaaaaaaagaaaactgtatgccaatatccctgatgaaactgatacaaaaatcctcaacaaaatagtagcaaacttaattcaacaatacattacaaagatcattcatcatgaccaaagtgagatttaccccagagataccaggatagttcaatttacatgtatcaatcagcaagatagatcataccaacagaatgaaggacaaaaaccattgaccacttcaaatgatgctgaaaaatcatttgataaaattcaacatcccttaatggtcaaaaccctcaagaaagtaggcattgaaggaacatacctcaaaacaataagagctatatatgaaagatcaacagctagtagcatactgaatagggaaaaaactgaaagtatttcccgtaagttctggaatgtaataaggatacccacttttacctctattatttaacatagtactgaaagttccagctggagtaatcagacttgagagagaaataaagagtattcaaattggaaaagaaaaagtcaaattatctttgtttgcaaataatatgatcttatatttggagaaacctaaagacttcacaaaaaaaactattacaactaataaacaaatgcagtaaagttgcaggataaaaaaattaacatacaaaaaaatcttgggaggctgaagtgagcagatcaagaggtcaggagatcaagaccatcctggctaacatggtgaaaccctatttttactacacacacacacacacacacacacacacacacaaaattagccaggcaaggtggaatgtaactgtagtcccagctactcaggagggtgaggcaggagaatcacttgaacctgggaggcaaaggttgcagtgagccgagatcatgccactacattccagcctgggagaccaagcaagactccgtctcaaaaaaaaaaaaaaaaaaaaaaaaaaaaaaaaaaaaaaaaaaaatcggcagcatttttatatgccaacagcaaacaacctgaaaaagaaatcaagagatagctagcaagacggccaaataggaacagctctggtccgtagctcccactgagatcaacacagaaggtgggtgatttctgcattttcaactaaggtaccccattcatctcactgggactagttagacagtgggtgtagctcacggagggcgagccgaagcagggtggggtgttgcctcacctgggaagtccaaggggatggggaactccctcccctagccaagtgaagccatgagggactgtgccgtgaggaatgatgcactcaggcccagatactatgcttttcccatggtcttcgcaacccacagaccaggagattccctccaatgcctatgccaccagagccctgggtttcaagcctaaaactgggtggccgtttgggcagacaccaaactagctgcaggattattttttttcataccccggggtgcttggaatgcagtgagacagaaccgttcactcccctggaaagggggctgaagccagggggccaagtggtttagctcagaggagcccacccccatggaacccagcaagctaagatccactggcttgaaattcttgctgccatcacagcagtgtgaagtcaacctgggatgctagagtttggtgggaggaggggcatccaccactaatgaggcttgtgtaggtagtttttccctcacagtgtaaacaaagccaccaggaagttcgaactgggtggagcccaccacagctcagcaaagccgctgtagccagactgcctctctagtttcctccactctgggtagggcatctctgaaagaaaggcagcagccccagtcagggccttatagataaaacccatctccctgggacagagcacctaggggaaggggcagcttcagcagacataaacgtccctgcctgatggctctgaagaaagcagcagctctcccagtacaacgttcgagctctgataggggacagactgcctcctcaagtgggtccctgacccccgtgtctcctgactgggagacacctccaagcaggggccgacaaacacctcatacaggagagttctggctggcatctggcaggtgcccctctgggatgaaagttccagaggaaggaacaggcagcaatctttgctgttctgcagcctccattggtgatacccaggcaaacagggtcaggaacagacctccagcaaactccagcagacctgcagcagagaggcctgactattagaaggaaaactaacaaacaggaatagcatcaacatcaacaaaaagatgtccagatacagaaacccaatctgaaggtcaccaacatcaaacaccaaaggtagataaatccatgaagatggggagaaaccaggacaaaaaggctgaaaattccaaaaacaagaatgcctcttctcctccaaaggatttcaactcctcaccagtaaggcaacaaaactggaaggagaaagagtttcacaaattgacagaagtaggcttcagaaggtgggtaataacaaactcctccaatctaagggagtgtgttctaacccaatgaaaggaagctaagaaccttgaaaaaaagttagaggaattgctaactagaataaccagtttagagaagaacataaatgacctgatggagctgaaaaacaaagcgcgagaacttcatgaagcatatgcaagtatcaacagctgaattgatcaagcagaagaaaggatataagagattaaagatcaacttaatcaaataaagtgtgaagacaagattggagaaaaaagaatggaaaggaacaaacaaagcctccgagaaatatgggactatgtgaaaagagcaaatctatatttgattggtgtacttgaaagtgacagggagaatgcaatcatgttggaaaacactcttaacgatattacccaggagaacttccccaacctagcaagagaggccaacattcaaattcaggaaacacagagaacaccacaaaggtactcctcgagaagagcaaccccaagacacataaacatcagattcatcaaggttgaaatgaaggaaaaaatgttaagtgcagccagagagaaaggtctggttacccacaaagggaagccaatcagcggatctctctgcagaaaccctacaagccagaagagagtggaggccaatattcaacattcttaaagaaaagaactttcaacccagaatttcatatccagccaagctaagcttcataagtgaaggagaaataaaatcctttacagacaagcaaatgctgagagattttctcaacaccaggccagccttgtaagagctcctgaaggaagcactaaatatagaaaggtaaaactggtaccagcaactgcaaaaacataccaaactgtaaagatcattgatgctatgaagaaactgcgtcaactaacaggcaaaataaccagctagtatcataatgacaggatcaaattcacacataacaatattaaccttaaatgtaaatggactaaatgccccaaataaaagacacagactggcaaattggacaaagagtaaagaccatcgacatgctatattcaggtgtgcccatctcatgtgcaaagacacacataggctcaaaataaagggatggaggaatatttaccaagcaaatagaaagaaaaaaaaaagcaggggttgcaatcctagtctctgataaaacagactttaaaccaacaaagatcaaaagagacaaagaaggccattacataatggtaaagggatcaatgcaacaagaagagctaactctcctaactatatatgcacccaacacaggagcacccagattcataaagcaagttcttagagacctacaaagagacttagactcccacacaataataatgggagactttaacaccccactgtcaacattagacagatcaacaagacagaaagttaacaaggatatacagaaattgaattcagctctgcaccgcgcagacctaatagacatgtacagaactctccaccccaaatcaacagaatatacattcttctcagcaccacaccgcacttattccaaaattgaccacagagttggaagtaaagcactcctcagcaaatgtaaaagaacagaaatgataacaaactgtctctcagatcacagtgcaatcaaactagaactcaggattaagaaactcattcaaaactcctcagctacatggaaactgaacaacctgctcctgaatgactactgggtacataacaaaatgaaggcagaaataaagatgttctttgaaaccaatgagaacaaaggcacgacataccagaatctctgggacacatttaaagcagtgtgtagagggaaatttatagcactaaatgcccacaagagaagtcaggaaagatctaaaatctacaccctaacatcacaattaaaagaactagagaagcaagagcaaacacattcaaaagctaacagaaggcaagaaataactaagatcagagcagaactgaaggagatagagacacaaaaaaccattcaaaaaatcaatgaatccaggagctggttttttgaaaagatcaacaaaattgatagaccactagcaagactaataaagaagaaaagagaaaagaatcaaataggcgcaataaaaaatgataaaggggatatcaccaccgatcccacagaaatacaaactaccaccagagactactataaacacctctatgcaaataaactagacaatctagaagaaatggataaattcctggacacatacaccctcccaagactaaaccaggaagaagttgaatccctgaatagaccaataacaggctctgaaattgaggaaataattaatagcttaccaaccaaaaacagtccaggaccagatggattcacagccgaattctaccagaggtacaaggaggagctggtaccattccttctgaaactattccaatcaatagaaagagagggaatcctccctaactcattttatgaggccagcatcatccggacaccaaagcctggcagagacacaacaaaaagagaattttagaccaatatccctgataagcattgatgcaaaaatcctcaatgaaatactggtaaaccaaatgcagtagcacatcaaaaagcttaaccaccatgatcaagtgggcttcatccctgggaagcaaggctggttcaacatatgcaaatcaattcacgtaatccatcatataaacagaaccaatgacaaaaaccacgtgattatctcaatagatgcagaaaaggcctttgagaaaattcaacagcccttcatgctaaaaactctcgataaattaagtattgatgggaggtatctcaaaataataatagctatttatgagaaacccacagccaatattgtactgaatgggcaaaactggaagcattccctttgaaaacgggcacaagacagggatgccctctctcaccactcctattcaacttagtgttggaagttctggccagggcactcaggcaggagaaggaaataaacggtattcaattaggaaaagatgaagtcaaattgtctctgtttgcagatgacatgattgtatatttataaaaccccatcatctcagcccaaaatgtccttaagctgataagcaacttcagcaatgtccccggacacaaaatcaatgtgcaaaaaccacaagcattcttatacaccaataaaagactaacagagagccaaatcatgagtgaactcccattcacaattgcttcaaagagaataaaatacctaggaatacaacttacaagggatgtgaaggacctcttcaaggagaactacaaaccactgctcagtgaaataaaagaggatacaaacaaatggaagaatattccatgctcatggataggaagaatcaatattgtgaaaatgcccatactgcccaaggtaatttatacattcaatgccatccccatcaagctaccaatgactttcttcacagaattggagaaaactactttaaagttcatatggaaccaaaaaagagcccacattgccaagacaatcctaagccaaaagaacaaagctggaggcatcacactacctgacttcaaactatactacaaggctacagtaaccaaaacagcatggtactggtaccaaaacagagatatagaccaatggaacacaacagagccctcagaaataataccacacatctaaaaccatctgatctttgacaaacctgagaaaaacaagaaatggggaaaggattccctatctagtaaatggtgctgggaaaactggctagccatatgtagaaagctgaaactggatcccttccttacaccttatatgaaaattaattcaagatggattaaagacttaaatcttaggcctaaaaccatgaaaaccccagaagaaaacctaggcaataccattcagggcataggcatgggcaaggatttcatgtctaaaacaacaaaagcaatggcaacaaaagccaaaattgacaaatgggatctaattaaactaaagagcttctgcacagcaaaagaaactaccatcagagtgaacaggcagcttacagaatgggagaatatttttgcaatctactcatctgaccaagggctgatatccagaatctacaaagaacacaaacaagcttacaggaaaaaaacaaacaatcccatcaacaagtgggcgaaggatatgaacaaacacttctcaaaagaagacatttatgcagccaacagacacatgaaaaaatgctcatcatcagtggccatcagagaaatgcaaatcaaaaccaaaacgagataccatctcacaccagttagaatggtgatcattaaaaagtcaggaaacaacagatactggagaggatttggagaaataggaacacttttacactgttgttgggactataaactagttcaaccattgtggaagatagtgtggcgattcctcaagaatctagaactagaaataccatttgacccagcaatcccattactgggtatatacccaaaggattataaaacatgctgctgtaaagtcacatgcacatgtatgtttattgcagcactattcacaatgccaaagacttggaaccaacccaaatgtccatcagtgatagactggattaagaaaatgtggcacatatacaccatggaatactatgcagccataaaaaataatgagttcatgtcctttgtagggacatcaatgaagctagaaaccatcattctcagcaaactatcgcaagggcaacaaaccaaacactgcatgttctcactcacaggtcggaattgaagaatgagaacacttggacacaggaaggggaacatcacacactggggcctgttgtggggtgggggaagggggagggatatcattaggagatagacctaatgtaaatgacgagttaatgggtgcagcataccaacatggcacatgtatacatatgtaagaaacctgcacattgtgcacatgtaccctagaacttaaagtataataataataataataataataataaaatatataactggaacagcaacaaaaataaaataaataaaataaaaaattaaataaattacttttttctaaaaacatgtgggtttgtctaaacaaacaaacaaaaaatcctcttcctttctcaagaaaaggaaaaacatttataaccatgttccctggaatgtaaagagcccaccttccacattcacagaaacttaacttattaaatattgattcagggcttttacattttttaacacaaaaattatgataatcaactgttaaatagacaaatattgaatagatcacttttttaacttttaatttttaaataattgtagattcacaggaaattccaaaacaaaaaacaaaaccatgtacagggaggtgccttttaccgttcgtccagtttctcccaatgataacatttttgcataactattgtacaatatcaaaaccaagaaaattacattggtacaatccacagagtttatcagatttcactagttttgtaagtacatctgtgtgtgtgtgtgcgtgtgcatgtgtgtgatctgctgtagatctgtgcaaccatcaccatgaagatacagaactgctttatcactgcaaggctcccaccaccactacctctttatggcaacacccactctactccaacctcccatccctaacacctggcaactaccaatttgtgttccatccatctctacaattttatttcaagaacacaatataaacggaatctgatagtatgtaactttttttttctttttttagacagagtcttggactgtcacccaggctggagtgcaatggcatgatcttggctcactgccacctccgactcctgggttcaagggattatccttcctcagcctcctgagtagctgggattacaggcgctctccaccacacccagctaattttttgtagttttagtagagatggggtttcactattttggccaggctggtctcgaactcctgacctcgtgatctgccagccttggcctcccaaagtgctgggattacaggcatgagccaccacgcccgtccgatagtatgtaacattttaagattggcttttctcattcggcataattaccttaagatacatccaaattgttgcttgtatcaatagttcattccttcatattgctaagtaatattgaatggtatggatggaacacagtttgtttaaccattcacccattgaaggacatttgagttgcttccagtttttgatattacgaataagctgctaagaatattcatgaacaggattttgcatgaacataagttctcatttccctatgataaatgcccaataatgcatatttactgcatatttagttttcttttaaagagactgccaagctgttttccagagtggctgtgccattttacattcccaccagcattgtataaattgatccaatttctctgccattctgatagtagtgatatgttttctatagtgatgttttcatggcaggtaggtttttaaaagcttcctctcattatctctgataggttatccattaacaatgatggaatatgcttcttagaaaattttttacatcaacagataaaattgtatgtatttaccattgtacaacatgatgttatgaagtacatataccctgtgaaatgactaaatctagctaataagcatatgcattagcttacatagaatactcttaacctaaataacagaaaatgttttgtcactactgatattctttgcactttgaatgagaaagcatgtatattcaaaatattgttctggttttttaaatgagaaaatgtatattaggcatgtttcatgtacatttaaatgctaaattagtgtaggctattagtagtaaactagtaacagtaataatagtggtaataattttagtaggaagagtggtagtagcggtacagcactgctaaaccctccatggtacagagtttctgtaggataaaaataagtagttaattctatgtacctggaaaacaaatgcatatttattttgcaggataaagttctatagtaaaccaagtttgttaacacttgttaagaccaagcttattaaccaagttgtttaacacttacataaccttattaatattttttatttgaatgtgcatttgccaatttctccctaaaatcctatccatgtttactttccatatttcaaagctttattgctagcacatacaaattcatgattattatattacttttgtattgtttcttttaggacaacagatatctggtgcatctcttttcatcactctattgtcaatattcctgtgttattttgttttaaatgagtctcttgtaagcaacattaatgtgttttttctttgtgtccaaagtgataatctcttttttatgagtgactttttagagaaatttcctacatatcaggactcatttctactctgatttggtattttctatctcatactttgtccatctttattcctgctttctgttgaattgataacattttctatacttcttcccgcaagcacacccacaggcatacatgcacatgcacacatacacatgtacattgtttttctcttcatgtttgagggctataaatttcctctactagttggaacctatagcataataatttgtaagatcatattggaagaaatggcagaccaaatatcatttgggtaaatcaaacagggattactgctctaaaggatagggaagaaagccatcaaaaatagaatttacagaaaaaagattagcaacattctctagaagagatagcagttcaaactttaagaccccaaaacttcacctgtatggataataatgtctacctaattaaaggacatatcagaaattcagtcagcataaatgtccttctcctggtccatatgctcatatgccagtcaggatctgtggatgtgggttgacaaggtacaggtggatgacaatctggagtcatgaactatgtaatatggcagggtatagaatagcacagcacactcagacacaaccacagcccggacttgtcaccttcaacctcaccaatgaaagcctcatccaagtatatttctgaattcaggaagtggaatttacacacagatatttaggtatcatggtaaaggagattctagctaatctatagaacctaactggtgcatagttaactgtaagtttttctaacaaaatctgagggcattattggagacattttgtatcctccaaagcaagcaaaatctttaacatgcttcaactaccctttgaatattactactatcccgtattccttattgttttttgctagggttttgttatctcttacaaacacattctaaaagctgagttatttttataatcttttgttttaacttttaggctcaggggtacatgtgcagatttgtcacataggtaaacttgtgtcacaggggtttgttgtcacagattattccatcacccagttactaagccttggaccaaatatattattttttatgatcctctcccgtctcctaccctccacccttaagtagaacctgctgtcggttgttcccctctttgtgtccatgtgttcctatcatttagctcccacttataagcaataacatgcagtatttggttttctgttcccgtgttagtttgctatggatgatggcctctagctccattcatgttcctgcaaataatctcattcttttttaatggctgtatcatattccatggtgtatatgtaccacattttctttatccagtctaccactgatagttatttaggttgatttcatgtctttgctactgtggatagtgctgcaatgaacattcacatgcatgtgtctttatggtagaatgctttatattcctctgggtatataccaagtgtattagtctgttttcatgcagccgataaagacatacctgagacagggcaatttagaaaagaaagaggtgtaatagacttagagttccacatggctggtcatacctcacaatcatggtggaaggcaagttcttagagacctacagagagacttagactcccacacactaattgtgggagattttatatgctccactgtcaatattagactgatcaacaagacaaaaaattaacaaggatattcaggacttgaactcagctctgggccaagcgcacctaatagacatctacagaactctccaccccaaatcaacagaatatacattcttctaagcaccacatcacacttattctaaaattggccacataattggaagtaaaacactccccagcaaatgcaaaagaacagaaacaataacatacagtctctcagaccccagtgcaatcaaattagaactcaggattaagaaactcaccaaaactttacaactatatggaaactgaacaacctactcctgaaggactactgggtaaataaggaaattaaggcagaaataaataagttctttgaaaccaatgagaacaaagacataatgtaccagaatctctggaacacatttaaagcaatgtttagagggaaatttatagcactaaatgcccacaagagaaagcagggaagatctaaaatcaacactctaacataacaaaagaactagagaagcaagagcaaacaaattcaaaagctagtggaacacaagaaataactaagatcagactggaattgaacaagatagagacttgccattcttgacagaaatagaaaaaataatcctaaaatttatatggaagcataaaagacccagaatagccaaagccatcctgagcataaagaacaaaactggaggaatcacattacctgattgcaaattgtactacagagatattgcttcaaaaaatcaatgaatccaggagatggttttttgaaaagatcaacaaaatagatagaccgctagccagactaataaaggaaagagagaagaatcaaatagatgtgataaaaagtgataaaggggatatcaccactgatcccacagaaatacaaactaccatcagagaatactaaaagcacgtctatgaaaataaactagaaagtctagaggaaatggataaattcctggacacataaaccctcccaagtctaaaccaggaagaagtcgaatccctgaatagaccagtaataagttctaaaactgatgcggtaattaatagcttaccattccaaaaaagtccagaaccagacagattcacagcctagttttaccagaggtacaaagaggacctgataccattccttctgaaactattccaaacaatagaaaaagagggaatcctccctaactcattttatgaggccagcatcatcctgataacaaaacctggcagagacacaacaaaaaaagacaatttcaggccaatatccctgatgaacattgacacaaaaatcctcaataaaatactggcaaaccgaatgtagcagcacatcaaaaagctcatccaccatgatcagatcagcttcatccctgagatgaaaggctggttcaacacacgcaaatcaataaatataatccatcacataaacagaaccaatgacaaaaatcacatgattatctcaatagatgcagagaaggccttggacaaaattcaacatccctttatgctaaaaactctcaataaactaggtattgatggaatgtatctcaaaataataagagctgtttatgacaaacccacagccaatatcatactgaatgggcaaaaactcgaagcattccctttgaaaactggcacaagacaaggatgccctctctcaccactcctattcaacacagtatgggaagttctgggagggcaatcaggcgagagaaataaataaaagatattcaaataggaagagaggaagtaaaattgtctctgtttgcagatgacatgattgtatatttagaaaaccccatcatctcagcccaaaatctccttaagctgataagcaacttcagcaaattctcaggatacaaaatcaacatgcaaaaatcacaggcattcatatacaccaataatagacagagagccaaatcatgagcgaactcccattcacaattgctacaaagggaactaaatacctagaaataaaacttacaaaggatatgaaggacctctgcaaggagaactacaaaccattgctcaaggaaataaaagaggacacaaacaaatggaaaaacattccagactcatgtaattagattaggcctatgccctgtcatctccgttttgccagattactgtaacagtcacagaagtaacactgggcagtaaaggtcatgggaaccactttaaaattcttcctatgacatttttttctgttgttccatttttttctgttctattgtgtttcagaacagattactttccttaaataaaaacctatttatgaaaagtaaatatatgtaatattttaaaaagtttctaattatcttatgtttaaaatggaataataacagtaaccagtcacaggattggaattaggaccaaataaggtaatgtatatgaaacatttataaactttgaagctgtcagtaagcattagttatacttaatttaacttttgtctagattcatagagatgaaaaagatagtcaaatggtcatatggtttagtagtttctaaagttttagaaattatagaatgtctcctaccatgctattttaatatcacaatagatccttgaagtaagggcagctatcatcaatatcacatatttttacttggtttcagtgtcttgaaatttcgtagaacaggtattgcaagatatttcaaaaactatctttttttcacacaaagaatttaataaaaattgtttttaatacagcatttcgaacatgggaaactcaaggatggcatgacagatataatatttcttacaatatgtctgaaatatatgtttgggagagagaaaatgaagtcaacattccagggctttgggacgtctatcctcttaggagggagatggctaatgtgaaggaataataacggaacaaaaggtcctagcatgttctgatgggttccacttggttcagacaaccaaaataagtgattaagtcatgtctcaaatcattgaggtttattgagccagcttgagggtgcaactgggaaaaaactccagtcacagaagcatctgtggccattttttccaaagaggttctcaggagatttagtatttatacgttttccttaaaaaggggccaggggtggcagtgagacaaatgattatatacttctgagactttagtcagtgcccagtaaatctacattctatataaggtaaggtgcatcttggggatgggtgaaggaaggattaattttatttttgttacctacctgggaagataagctagtggtcttttgaaagaactggtttttgtttagtccttaggaaagaaaacctaatgactcagctaggaggagggtataatgaggcatgtccaatctcccatcccatcatggctgtaaattcagctttcaagatttctctgggattcccttggccaagagggagtctgttcagttagttgaatctactgatccaaatgctaatctcttcaattaaccctctcacagacacacccagaaataatgttataccagctatctgggcttaacctagtcatattgacacaaaattaaccatcacatgttctttacctgatggacacttccaaggtacaatgattctatggaggcagtcttgattagtccttcataaggaacaaatttatattttctttaaacctatgactagctcagtaattgataccttgtatttaatttccacctttgtctgtctcacttttctttcttccacatttttaatgtcctagaattgaatgaccgaataaaatattagtggattagctttgcctaattctctgttttctggggaactcaggctaagattccttcatttattcagcaactatattgaataaatattattaagtgaatattgttgttggatgtctactctgtgccacataatgtttaaagcgcttgggatacatcaacgaacaaagtagacaaaaatctttgccctttctgagttactttcttggagagggagaaagagagagaatactaaaagtaatgaacaagtagattttacagtatatatgatagaaagtgataagagagcacataatcagcttcattttccagtttttcttctaccaatctccttctcttctcccaagtccatctctcaccatttcttttcttttcctttacactccaacaactttgaattacttacagtttcctctccctttgaggtcccccaacaccccatgctattttccatctccatgcctttgctttgcagctgccatagctggaatgacctccacatattccttttctctctagctattcagactcacctcaggatcatgttttcaggaaatcttacctgatttctttctctgctttccccaagctattttaggggttagtctagacttccataattcccttataaatatctttatcattatacactcatgttatttttaaagcataattatttgtgtttttatgttttctactaatctggatttcactgaggacagggactatgtcatatatactgttttactcctaacacataggatggtgttcagtaacattattttacataaatgactaaatgaaaatacatagtaatgaggttccagaattatgagctatggaagtccactattaaggtctcattggaaaggttaaaaaagcaagacatttggagacacaaaataagtaaagttaaagagaagcagcagcagatttggggttggttcagtgcagagttggcttcaatttatgtgctctgaattatactctgtggtacattaattgcacaaagtgaccacaattctttcccccgattatcctattgcaatgcttgcatctcttcacttcaaggtgtagagtctttttccttatctcttgaatctaggctggacttttgacttgcctttgttaaaataattcattgaaaatgactgttttgaacctgagcctcaagagacattgcactttcacttcccttgtaaactcttccctctgccatgagaacaaacctggttagtctgttatcctggaactaggctgagtcatcccagctgaaccaccagctgatgggagacacatgagcaagtcccatcaagctcagctaaatctattcacgtgagcagaactacccagctgacccagagactcatgaagaaatcataaatactacctgtttaaagctactagatttggtgatagtttattacacaacaataactattaattaatgatgtggaacttcaagtggaaagtttgtttcagagcactcattgtggtacaaagtgttttctgattttttagagagtgactttatggtgtttgtagaaatgatatgtattataaaaaagtttaagcaatatgagtaccacaaaaaagtataaaattacaccacctagttacatatttactttatagctaaatatgcatatttcaaaccatatattatgtgaaataatatatcagtttataaatttaaatgttattctctcatattttaagaaataacttaaaccctttatttgtatatttgatattaataattgttcttgattattagagccgctttttgagttgtctaacagttttccagagaatgtcattttgactgctaggtcatttggcatgtagcattatttgaagtctatctaatgctgtcactaaatgttttttctaaagtgataagtatatgtttccataataggagggaagttgtttcttcatttaccctgtaggtgatctcaaaaatgttgctattcactatattgattttaagtttttttaaaggcaaatatcaattgaatagtgaataatttttataaaatatgtgtgctgtacttaaaagttatggtacaaaaaatacctagcttcagaaatagaacattatcatcctcttttaacattgttctgatcttcctcctcagtcttttacccctttctttgccctcagagataactaccatactgaatttaatttttccccttgcttcttcttaaacttatttatttatttatatcatgagaacatttgttcctgagattcagcattgatattgtatatacctgtaattgttaactcattaatatacattgctgtttggtattccagtgtacatatagcgtgatctatttattcatttatgttggttatgaaagtaatgttaatttctgttacaatctaaacatcacatttgttaaatataatataattaatataatataatataatataatataatataatatctttcatttcaccgtccaaagtgaatcaatttttgtgtaggtggggtggggtggggggttcgtggaggggtatgaggaatgtttctgcttcatgtagtaattcagaaatctagattccttttataatgaagctcctctgtattcaatacatggctttgaggttacactggcatcatgcagtcagcagagagaaaaggatcatacagaaggcatgcttagttttaactgctgtgtgcactgtctttgatgagaaacagttgaaggcctcgttttgatgcaagtgaggatacctgacaatgtggtttatctgtgtgcttagaggataataaaattgtttgatgaatgcatagcattgttatttctacaatcttctagacactaaatatccatttaacttttattctcatactcaccttctttccaatagaggcaattgaaagtccaacctcagctaaaaattcacatccttattctgtcttcacaagcctatagcttaatggactttgttgcctcaagaattttatgtcttactgtgtggtttctagcagtgatcagatttcccattcttcaaggctctacatttcttgcccctctaatccctttcaaattccatcctgatttagttatttcctaaaatagttagctgccctctaacccttctactctctgtaatcaccttccactatgtacatggctcattttccaacctctgatatcagtttccttgccacccagcatccgactgctcggctaatgacatctatttaaggatctgttaagccaaagtataaattattatgttattcagaatagactacttattgccaaaaatcaatatgaaaatctcagtggcttaatgttatttctcactcaaatctcaggcttcttgaatggttggtgggtgatcttccctgctgtaattcaagggatcaccatcttacttcttggggcactgctattttcaacctctggcacatatagaatgcgaagagagtatgggaggttgcacgtgggcaatttgtcatttttatcatttccatccacaatgcctatattgtgtattataaaaagtgtaaaacaatatatataaagtgtttctgggagatggctttatgagtattttaaattttatttcatgtttgcttctttgcttgtcccaggattcctggaggaaacattatatcccttttgcagtaagttaaaaattataattgaataacttgcttcagaaatgaaagtatgaattttacaacatgagctaagcattaaatactaaactggttagaaaggtacatctggaaaaacctttgagtattcaaatatttcagacaaaacttgttaatatagtttttcacgaccacagatattgatctctgatttatccaaggctttaattgatagtttgaaaaggaaaatattagaaaatattaatagtattaatatcttttttatggctattttatgcctttataggtcagatgcttaattacttatttgctagatgcattcttgaagcctttgtttctatgtttcttagagaaaaatttcaaacttcattcaaaaatgtcttcatttcaatttaaaaaacgacttgatggccatcacatgcttatcacagggaagttaaagtagaagcttatgacatgtgtcttctccgaaattcctacaaaaaatgaacactattatgtttgggatgatgaagaaggaaagaaaccaattatgaaaaatcataatgggcaaattagcatttaggtgaaaaattacaggtgtggaagaattcccttattttaggattttaaaaaatgcgtccttattttcccctcctaatttggcttcttgtctttcaaaaattttatttttattgttaacatactagtgatttttgtacattgattttgtatcctgaaactttgttgacaaaactgtgtaactccactcagtgacatcagaagtcagtttatactttggcaggtactgggcaaatgttgttgttcttagcattggtcagagtggacactgcccctatggcttggtcctcactacagagtgcagctgaagcaggaaatggtctgatgcatttatgttttgtgtaggaatctgggaggatgcaagagacgttggaagtgtgattagaatatgtcccccaatttcttgtttcatttattctgaggaaactatttgtcctgttatctgggtgagacctgtaggggattggacccaaatctaaaactctgaatcaaagaagaagatgcagctaaaagaaaaaggaggaagtccagaattgagaaaagcctataggatggtggttatataatccttaataaataattttagagctaattcacaccttttagagctaagtctagtagaaaaatttgcatatatttatatgaatgttgagtagagatgaatgcttacttttaaaataatgtcttatatctgaataaaaataagagcgagactaagataaactgacaaacatgagactaaagaacgagaagttccataataaagcatctgactataaaattaatttagctatatgttggccaaatcgggcttcttgtatctatagttacatgtagtataaatatctcaccatgagactggaaacatatgacaggtaactcttatcctgacagcagtttcacaacaggatacccatctattaacaaaataattctacagagtatgactacagtgctgagtatttcagcacgctccatagatacctgttttacagctttagagtttttctttttttcttccccccgagacggagtctggctatgttgcctgcactcactgcaacctccacctcctggattcaattcaagcgattctcctgcctcagccttcctagtagctggggttacaggcactcgccaccactcctggctaatttttgtatttttagtagagatggggtttcaccatgttggccaggctggtctcaaactcccgatctcgagagattcaccagcttcagcctcccaaagtgctgggattacaggtttaggccaccgtgcccagcctcacagctttatagcttttcatcagcaatacaaaatgtcttcaacacacacattatgtatttctctctttgatttatattactgaagcctgtgaatatgtttttggatcaagaacctttttgaaaatctagtgaaaggcaattccttcccaggaatatgcatagattattgtagaaaacatacagactctacaccagaagttcttttacagactccaagttaggaaagtctactctcaatcaccattttttttaatgtcttgggaagaaactagaagttagcaaagtctcaatcctggtttaccttgttgcttttttgaaggtctggggaaatctagagccttcagtgttgcctaactctactgagggcattcctcttggtgccatctatagcaaacaatgtgatgatgggagagaagtactgaatatgaggctgcatgtctctctagagtaagaatagaacatcatctatttatgtattcatccattaaacaaacatataatagccattcattatgtagaaagcgcttttttaggcactgggggataaatgatatataagataaaccacaagaagaagcccagaaatgttattcatattattagtttatgtaaaaactagagattccaaatagtaaaaagatagaattatatttatttatactgaatggcatattatatgcataaatgccttgtaaattgtatactttcaatgctatttttatcttttaccttgatattaggaaactgaaaccagtgaacatcacagtgagcaaaggagtcatgagattttcatgcaggaaatagaatttaaaaactcacagatactccaaaacaaacctgatctgaagcagaaaaagaaattgtttatggaattgttatcaataagacttaacaggtactttctgaatggcagtatgaattgataattagcagacatcttgtttcaatatagagcttgaaaaagccagttataacaatatagttgaaaaatacagtttagtagcagcacacaggtgggtccatgctctcacagggtaatgatttaataaaaaataataatccaggaaaaaacaggtcaaaactcccagaaactttcacacatggcacaatgtattatgggagattttctaagaatattgttaaaacctgaccttgataaccaccaggaaaccaagagaaagaacattcaaattaactacaggaaatatacatttctatatgtattggtttcctagggttgtcataacaaattactacaaacttgttagcttaaaatgacagaaatgtgttctctcacagtgctggaggctagaaatctgaaatcaaggtgttgacagggctgtactccctcagaagactttagggaagaatcgttccttgcttcttcctggcttctggtggctcccagcagttctcgacagtccttggtttgtagctgcttcactccagtctctgcttctgacttcacatgaccttcttctgtctctgtcccctctttttctgtcttttataagtacacctgtcactgggtgtagggtccactgtaatccaggatgatttcatctctagatccttacattaaagcatctgtaaagacccttattccaaataaggtcacattttgaggtgctgtgtgaaaataccttttgtgggccagtattcaacacactcaactattccactgatttaaaacaatttttctaaactttgtactgtttcacatttggaagagaggatatttgtcttactatttcaaaactcagaaattattcctataagccaccaaattcaaggagtatgtgaaagtgaaatcacatttttctcttgtaacatttcagaatcttgtcatataataattcatgcagaaaggcaagggatgcttgcctagatcctaacagtggcaaaatgtgttttatgattactgcaatagaaccttccagttgaacactactatactgtaaagagatgatctaaattcatttatgtcattaagaacatcatgtgacaatagtgactgaatcttcaaaacaatcttcaagacttgcagtaaaaatgtgaattctgtttttgcttaagtgggctatgttgtatgatgaagacattgttctattgcaaatgacagaaatgcaaataaaccaattttataaagggaatttattgaatcaagcacgtaactaagaagtccaagagaatgggaatgtctttaaaaatgctatggatttaaagaacaatattttttcttgctttattgctccagttcatctttcctcttatatttggtttcatttctactggtgggttttcttcctataacagacaggctttctgtatgtagtgagggaaatagtagcatagcccacagaaatattcacggttgcatcatcccagttttgtgatatagatatacgcctgagaaaagaaacagtattcatgaatacaatttgacagaatggttctgattggtttgtgaccccaaattgggtcaccttccaatttgggggccaactatatagtcaagggattgaaatgatttgtcagagtaggcctgcaacatgtgctactgtggttggggtgtagtgcggggtagtctgcagtcatagaacagagtaaagctaatttagccatgttgggatcaaactcatgaaactactagctccaggttcacgctaaataacactaaacattttatatgttgaatttctgtggttactctcagagtattgataacaaacattcaaaatagatgtctaaataactatgcttcctctttttgagggaccctgaagtaaaatcattatgcttcctctagcttacgaatgacttttggagggcttccttctagcacttttaaaagcgtcgctcttaagagtggattaagtgtgacatttggaaatgtcagaggtaactttggctgtgagagcactgaccaataaatcttacctatacaaaatcctatttattgagggcttcggtgttcatgacattactaggcatcttttctttgtcctgtttcagcaaataggtttagcagggaagcaattcactccttacaaagcaattatcattagaaaatgtcactgcataaattgtaggataaaaaagcagaaacatctgattagtgactgatttaggagagaagagttcatgccaagtggaatagatatcaggaactcataccctgttcttcaagtctgttgaggtaagcttattagaaggatttctttaaatggtggaatggttggtaagatttttccccaattcaaacaataataggaagaaaaacacttataatctttgtttaaaagttgtcaatagctggtatgtttttatgcaattgatgcatttctgaacatagctataaaatgaattaattagtaaatcatatttattaactacttctagaaagcaaattctgtgctgacacctttacaaatgtagtattattaaaatcctcttaatagcactataatatacacaatataataattctaattgtacaaatgtgaaactccaggcaacttttgtaaattttctaaggtcaccttgctaaagtgaaaatgaggtatgtagccagatctttctgactcagtttgtcatatattaagcaagcttgctaaattttatacatctctatattggattcttttgtaagtcagtcatgttatcattcatgtgtaggtttgatggtcaataaaattaaattggattgaaattaatttctgatataggccacatctataaattttgcctctcaatataatgcaagaggtgtaatagtagctggacatcggctcatccctctttcttcgagccttactgttctttgacccaagactgcacatttaaaagagaggggagatgagtttttaacgctgctgtggagatgtattaaaatcccatttcagttaaggttgcagatttagcaaataaaaattagttacatttgaaatgtttatctgaaatttaaatttaattggacatcttttatctacaatgttaatttgagttcctccaacttgaatctctgtgaggtttgctcttgttcctcttgaattctcttttctgttactggtattttttttcagatcaggtcttcaatgagatattcctttttatttgaggtttcaagcttcaatatcttgagttcatcatcagccagcatctcctaccctgatttcttatttacagctttattctctggctcatactatgactttaagtttctcatgtaatgcatttactgttacattggactttgacaatcatccacaatgtggaaatctaaagcagaaaatgggaaggcagaacaggaaagagtaaggcacattggcaggaattaagtctagagcttcttacaagggtaaaagttttgttggataaaatgggatcagatattaggactagcaaataaaggtcaggcagttaagaaacctgggaacactggaaaaactgagaggtggatgatgcagaagatgagctggtcatgcacaatggcagagggattctcctggagcagaggtttggataatcagagatggatcatgatttgtcaggactttcaggaactgctttgtccagaaacagcccctcttagtcttaaagttacaacatcccctaaaaagacaaagtgctctgctagaatactgcaccaacaatttagagaagagctttccattcccacccacagacatgtatttggctaaatatggctcttgctaatgaagagcctgaaaacatatctgaagaaatatctactgaagttgcattatgatatgatatgtagaccgtaatttggtttgatacacaaccacctgcaagcccatccaagacaaaaagaagctccagagaaaacttaatgtagcacggcctcacctgtaggagatgccttaaaatgaatgcatgaccagcacaatagtgagaatacagcatttgtattctcattcttaccactatgtctttgtgtgttttacacacacacacatacacacatgctccacttttatccataaatataaacacacacacacgctccacttttatccataaatataaatcttaaatacaaatttaaatttgaattgtcctgaatctcctcatttactgctgaccaatttccgtattaatctagtttccactttggtaaatgactttgtcctcaaatttgaattctcattctggcttttctggataggcatatacatctgctttctctgattttagattcagtttcttccccaaagtttccaaatactggatattcataaatcaaattgtatagataatttaggactatcatctataacaagaaatatcataaaattagagtgttgtaagtcaaattgccagagggtcagctacaatccaccactccataggaaccctgagaataagaattccatagttgtcagtaaataagattacaataacaacaagagattattttcaaaaatcatgaaatcaccaaaattctatctgccaaccaaacacactgctggttcaataatctttgttgataggtctttaatttccttacatgagcattctgcaaaatgctttaagaataactaagtgttatacaatgaactttgggagtcagccagtagaaaattaaatagaatttagtgtgactaagtcactgtgacggaatttaatgctttaaatttttgtgaattatgaggaaatttcacagggggaacatgatggaatacaagtactcatagccctgttaactgcagctagagcaggtggaaagtgtcaagttgggatcccagtggtacagaacaaattgtgaatcatggcttcttcctgttaaaccttgaatcacctttaggataaagtccaaaattcctaacatgatctttaatgtcagtcataatgtggtcccctgtatttctttgtatcattttctctcgccacttactccgcaaccatgctgatctattgatatacttgccatttcctgaatttgaggtattcttctttaatcttggttttcatataatctatttctctgataaaacaccatccaccactctactcaacacctagttaactttccagattcagtttctttgtgctgcctctgttcttatccctggattaagaattatctcacaatatgatggttgctctcttgcttgcatatcttctatatttgtttttgagtgtcttttgaaagagagtgcctcttatgcttcattgtaaatctagggcataggaaatttcccagctgacagcagtcatttaaaatatactttttgaaataatgaggcaagcaaacataggcagactcagctgctgcagcttggaggatgtctagttgatagaaagaccacggaattccaagggtacacaaaagtaattcaaacataatggctccagtggacagcctctgatttttctttgtataatcttaaaaaaaagctcttaagcagcactttatcttatattttacacatgcgcgcgcgcgcgcgcacacacacacacacacacacacacacacacacacacgcacacacacccttcttctctctacaacctttttgtctcctgtaagtagttagggagaggagaacacctgactgtgtgaaatatgtgtgggtggaaatacaaatttctaactgtccctctgtaggtatttaggttccatttttccactctgctattaacagttgcctttcatgtctctattttccagcttaccaaatttgggtgacatattttttctggtatgtggtcctctcccattctctttgtgcttgtggatttttaaaaaataattccttcattatttgtgggaaacaatagaaaaaatgtgaatttatttcaccaagtttaaatggatcttttctgcttcaatattttactgatttttactttgacaaacatagctttgccctcatatttaagaagttttgagtggctgtcaataaattctgcaactggttgccagggatgacaatatcatgtgtggtatgcagaagctagcttgcaaaagctgatgataattaaattgttaatttttctcaagctttgtgagccagttgtatacacagccattattaaaatttatattacatagccttattattaaacgtatttaaagcaaagttaagatagccttaaatctcatcacttcttaattattttactattttctatgtttttgaggatatttacatatattacatctataaagtaaaaataccaaataatagtgtattatcgtgtatttctgcaaagtgttatcacattgttggcttataaattggccataatgagagtattaatgccacaggaatctgcaaatgctaaaaatcaagctattttttattcagaaatctagttgttagcagtatgccattgttatgtatcctccaaagttaagaagtcaaagcactcctaatctgcatccatcaccttttatttagatatttcccatagtcttgagatttctgtctcaatttcctttattttcttcttccttctatttcattccctgttttcctcagtcctacctttattctatcttcatgctcttccttttcttccctcctttcttcagaagctaactccatgtaatagatttagccactcattggccaaggtatggctgtgtttgaaatgctgttccctggtgccataaagaaatagcacttgaacataaatttaatttcctcagcaaggccatttgtatactttctgcagaaagggtatatgcaccagcagttttgccatgagagtacactgaacaaaggagacaggctcatttataacctgatgcatccaccctactgctgtgtccagtttccattggctggaataggacctcacattctgtatttgtcccgattggctagtaacttagaactttttaaaagaggcaaaggcggaggagaacaaaggaaggaggaagtaacttgtggaatgctgagaaaggtaaaaacaccttcaaataaggaagaggaccaggctatgacctaatgcttgcttgaacgagtataagcatgccagggcaaatatttaggctaacttgtgggagctaagaacataaagtacattgatttctttattacggctagcagatatttaagaatgttagcacaggtctttgaaaaaattttgcttctaagagaggttactatttattcctaattagatgaggaggaaagtctttgaagaggaatctctactttactttttacagctggaaatgggcagttttcctggaaccagagcatccccaagtgttcctctactgctgcttccaacttttagaaccaaggaagttcaccataacctttgtacactctgccttggatgtcatggttttattcttcaaggtttctcagtgtgtttgtgccagttttcatatactctggattctcacccctcctcactggctcatgttgcttgggtctgaaccttctcccattaaaactcagaaaaaaatgaatgagcatttcatatattcttagaaaaattctgcttcagttgcaggacaggatggaaataatgctacatgtcttttaaaagagctttcctctgccaagtggcacctgattaatttacaactttcatttaataaaacaactggattgttgttccacatgatttgtcccaaagctttatctgttgttgatgtaattaatttcttaccagttctttccccacttcccatttccagacaaaaatatctactacaactaacaatgactaaagtaccttccaagtttcagggtttctattcccattaatctcactgatatccttattactttgtttatgaattatttaaaagtctatatatgttacagaattgaaattcaagatgagatttgggtggggacacagccaaaccatatcagtcatctttctttactctatacatattccccccgaacacttacttaataatttataataaagcaagtacacaaataattcaaaaagtgagttaatttttttttttttgtaaaatccaaagcaagtaaacaggaaccacatttgatgtttaaaaaaaatgcatgagattaaaataactccttttcagaaacagaaatggaatctccaaaagtaaaagactgtttctatagatgaaggaactaatatctagagataataaatgccttttgaaggttgtacagcagatctaaggaatgaacccacaatttgggtttgatgtttgtttaattgtaatattaatctactttactagcaccattaatttatttgcaggatcttaaatgtcaagctaaaattaaaaatatcttttttctttttatattttgtctttaaaagtatttttaatttactgctaaaaagagagaatggcattgattcttcatctgcatagaaaacagctcactcccttctagcagatttattttgaattatataaacaccaaaaaaaaaatcctcacatacgctctgcatttttatagcttctttttaagcaaactctctcttcttggaagatcccctcccttcttcaagatatttctgctcctcccactacctcaaacgtaactgctattgttgtccttgttgcatccgcatcaccctgtgcctctattaaaagcactttacacctcataatataatttaatacatgtatgttcccctaataagatctaagttcctctaggggaggaacatatcttaggcatctttgtagaaacagaatcagccacaggatctggcacacagtaggagctcaacaaaagaatgttgaagtcatgaatgtgatagtaatagatactaaattgttctcaatcaataaatttttatttgggaaaatagagcatttggaaagaatatttcttaggatttttttcacctgcaggtaacgtaaaactgaaaaaaaaaaggtttaaatttaaattaaaacgtagaaatgaatttgttcccttggctgaaaattccaaatgtgaggcagctctcaggagtaatttgagggtgcgagcctcaagccttggcagcttccacatggtgttgagcctgtgagtgcacagaagtcaagaattgaggtttgggaacctccgcctagatttcagaggatttatggaaacacctggatgctcaggcagaagtttgctgtaggggtggggtcctcagggggagaacctctgctagggcagtgctgaagggaaatgtggggtcagagcccccacacagagtctctagtggggcactgcctagtggagctgtgagaagagggccaccatcctccagaccccagaatgatagatccactgacagcttgcacaatgcacctggaaaagctgcaggcactcaatgccagcctgtgaaagcagctggaagggaggcagtaccctgcaaagccacaggggtggagctgcccaagaccatgagaactcacatcttgcatcagcgtgacctgggtgtgagacatggagtaaaaggagatcattttggagcttgaagatttgactgcccttctggattttgggcttgcatggggtctgtagcctctttgttttggccaatttctcccatttagaatggctgtatttacccaatgcctgtacacccattgtacctaggaagtaactaacttgtttttgattttacaggctcataggcagaagggacttgccttgtgtcagacgatattttggactgtggacttttgggttaatgctgcaatgagttaagactttggggggctgttgggaaggcatgatttgtcttgaaatgtgaggacatgagatttgggaggggccaggggatagaataatatggtttggctgtgtccccacccaaatctcatcttgaatttctatgtgttgtgggaaggacttggtgggaggtaattgaatcatgggggcaagtctttcctatgctgttctgatgatagtgaataagtcttatgagatcttgctggtggaagggtttatggggtgccagtttagtcagtcacccctgtgtaggacacctctggaacaccatagggggcacctgaggagaaacatctcattattgccattgtgcccccaggccagtgagcatgacctgctctgtggctttacacagaatgctctgggcggaaacactcccttgaagcattggaatgtgaccagacatcctatcctagctcccaccagctgcagcctggtaagttaaagattatcatagtggttagacatatgctttgagcttaaaggaaattcacataaccgccagtgctatacatgtttccaatgacgcatgctcccccaccttcaccgtttcaccccgtaccatctgcttcttagatcaaaaagattgtactcaataaattttcaggaaaccagtgttctgggccttctgcagccttcactctagcagatggccccctggacctgcttttactcttaacttgtcttttctcattcctttgtcactgccggactttgggtacccatggctgggggttgggactgatctccccaacaggtctgatggtttaaaaacagaaatatccccgcacaagctctctctttgcctgccatcatccatgtaagatgtgacttgcttctccttgcctaccatcatgattgtgaggccttcccagccatgtggaactgtgagtctaattaaacctctttcttttataaattgctcagtctccagtacatctttatcagcagcgtgaaaaccgactaatacaatgacttaagtattagtaggcccttcgtctattgttgttgttaatatccttccttatataagaatgatgctcttaacttctcaaaataaggcatatactttgacatattgtagtgtttggtttaaactgagtgtttcattgacccccatttattttacatggcagtaaaagtcagtgaccagggaacggaataaaaataacttattgctttgctcagaattattgtcatgcaaagacttcttcattagggacacactcaacatcccttcttcacttcttcttattaagagacctctaatccactttgggaggccaaggtgggtggatcacgaggtcaggagatggagaccatcctggctgacatggtgaaacctcgtctctgctaaaaaatacaaaaaattagccaggcatggtggcaggtgcctgtagtcccagctactcgggaggctgaggcaggagaatggcatgaacctgggaggcagagcttgcagtgagccaagattttgccactgcattccagcctgggtgacagggcaaggctccatctcaaaaaaaaaaaaaaaagaaaaagagacctctaatcttatgaatccagttataagtcaacatttcctagggtttcttttttcagctagatatggccatatgattaaattttaactcataaaatacaagtagaagtgatatatgggattttcccaagttttcttaagcaagaggtcacatactttttcttcttcttaccctcttgcttgctatgtgtaatgtggctggagctcgaactaccattttggataaagagtaataagataagaatatcaaaggttcaatagaagaaatctagatttctgtactacctatctctagattttaatgaaataggaattaacttctattttgtttaagccattttggttttctgttaaatgaaccagaatctaagtcttaacaaacactgtgggagatcagtgccaaatcctatcaggtttttatcctgtatttcttaaatctgtccttttctccctgctttctactctcatccttctcatcatcaccgccaccaccaccattacctttagcctgacacatttactgattgcctagactactgcaatggttttctaactggtctacacaattcagtctagacctctccagtctgttttccactttgctgtctaactaatgttttcagaattcatattttgaagatcagattattacccactcttcttctagggtgaaactttgcagatgttttctaattacaattaggatggaggctacaatttttaacatgactgtgttggttagctagggttgtcataacaaactgccacacattaggggacaaaaacagtagacattaattttcttataattctggagactggacgtccaagatcaagatgtcagcagggttggtttcttttgtgcctctctccttggcttgtagatgatgatcttttctatgtctctttcctcagtttgtgtctgtatcctaatatcctcatcttataaggacagcagtcatattggattaagaccctccctaattaactcatttcaatttacttatctctttaaagattccatctccaaatatagtcatattctgaggtactagggggttagaacttcaacatacaaattacaggaaacagttcggccataacaatggcccataatgtttggttcctgattccatgagtttgtaagactttgaagttcccatgcactagaacactagaaaaacttgtttatcctataaatttcctgggcaagggagagcatcaccttcataaagtctcagtaggaagactaaatttttcctcaaaagggagaaatttgaaaagaatacttatagtgtggtctgggcagggattggttaacaagtttatcaactaggcaagttactggagcagtgtttctattgttgaaacatatgagtctagtatgagtttgtgttaaaagtgttaaagtgaccttatgtcttctgtgttgtatgctgtggttagtcctgtaatgatgtttaactgttttgagagtcacagtatagttctactatctctgttttctgtacttttctgtttattttccagtgtccctccctccttagcctaagctaagggaaaaaccattatctctggatatgtgattgaattggatctataatggtattcaatgggttgtgagtcattttgatatctaatagtgtcaaggccagatttcttggtctttttgttagaatgatcatctgttataatagtggctgcacaacagtgtttaagacacacttgcatactgcaacaccaagatgaagacaatgattactattagagtttgcaaagcaactatgaagctgtgattgtagacttagaatatcatgaaaacatgttcctagtttatttgtatttttcttatatacgcaagtagctttccctttaatttagatattgatttttcacttttgtcagtgtctgaagatttagtcccagatttggttattgtcaaggataagggtcttgggagtaccatgactaaaggtagaggtacctattaacaatttagaacctttaaatagcagacaggaaagaagatagcaaagaggttaagcctagctttgtcattcacatggatatgcgctaggaaaatcactgattctcttttatggagaaatgtctgttctcacactgctataaagatactccctgggggccagttgcagtggctcatgcctgtaatcccagcactgtgggaggccaaggtgagtggatcacctgaggtcaggtgttcgagactagcctgacctgcatggtgaaaccccgtctctactaaatacaaaaaattagccaggagtggtggtgtgtgcctgtaatcccagctacttgggtggctgaagcaggagaattgcttgaacccggggagtggaggttacagtgagctgaggctgcagcaatgcactccagcctgggtaacaagaacaaaactctgtctcaaacaaacaaacaaacaaaagatactacctgggactggataatttataaaggaaaggggtttaattgactgacagttctgcgtggatgaagaggcctcagagaacttacaatcatggcggaaggtgaaggggaagcaaggcacatcttacgtggcggcgggagagagagagagcaaggatgggggaactaccaaactcttttaaactatcagagcttgtgagaattcactcactattctgaaaacagcatgggggaaaccacccccataatccagtcacctcctataggacccttccttgatatgtggggattacaattcgaaatgagatttgggtggggacacagagcctaaccatatcattctaccactggctgctaccaaatctcatgctcttttcacatttcaaaacaaatcatgtcttctgaacagtcccccaaagtcttaactcatttcagcattaattcaaaagtgcaagtccaaagttttatctgagacaaggcaagtcacttccacctatgagcctgtaaaataaaaaacaagtcagttacttcgaagatacaatggctgtataggcattgggtgaatgttcccattccaaatgggagaaattggccaaaacaaaggggccacatgccccatgaaagtccaaatcctgtcaaggcactcattaaatctttttttgtttctttttttttttttttttgagatggagtctctctctgtcacccagactggagtgcaatggcatgatctcatctcactgcgacctccgcctcctggggcaaagcaattctcctgcctcagactcctgagtagccaggattacaggtgcctgccaccatgcccagctaatttttgcatttttagtagagacagcgtttcaccatgttgaccaggctggtctcaaactcctgacttcagatgatccacctgcctcagcctcccaaagtgctgagattacaggtgtgagccactgtgctaggtctcattaaatcttaaagctccaaaatctcctctgactctatgtttcacatccagagcacactgatgcaagggatgggctcccaaggccttgggcagctccactcttgaggctctgcagggttcagcccgtacagctggtacagctggcattgagtgtctgcagcttttccaagtgcacagtgcaagttgtaggtggatctaccattctgggatctagaggatggtagccctcttctcatagctccactaggcagtactccagtggagactctgtgtgggggccccaaccccatatttcccctctgcattgccctagtagaggttctccatgagagctcctcccctgaagcagatttctgcctgggcatctgggcatttccatacatcctctcaactctaggtggaggcttccaaagctcaacttttgtcttctgtgcacctgcagtcccaacaccacatggaagctgccaaggcttggggcttgcaccatctgaagcagcagcctgagctgtatgttggccccttttagccatggctggagctggagtggctgggatgcagggcaccaagttctgaggcttcacagagtaacggggccctgggcccacaaagccatttttccctcctaggtctctgggcctgtgatgggagtggctgctgtgaaagtctcttacatgccctggagatatttttcccattgtcttggctattagcattcagctcctcattacttatgcaaatttctgcaactgtcttgaattccttcccagaaaatgggtttttaatttctactatgtggtcaggctgcaaatttcccaaaacttcatgctgtctttctcttttaaacatgagttgtgtatggtggcctggtattcaatctgagaggtgggagtatgttagcaggacctcttcttttttcactgagagctttttaaaaataaattctgctctcctcacctttcgatgtgtctgcatgcctaatctttcctggtcacatgacaaaagcctgattttagctgaactaaggagcaaaaacttctgcatcaaaagctacctccaagtaactaaaaattggcatcatttccctaggttttatcaaagagaagaaaaattgacataatttccctagagtttataagggtttacctttctctgataaacaattttgcacctctacctcattcaacccacaagacacatatgaaaatctctgtggaggagaaagggaggatgctagaatatggacttcagtagggaggtcagtgcttaaggtggtaggttgttcccattccttttgaaaggaaagaggctatgggtacgatagacttcttttttttattcttcctgaaacaatatagtgtaacagctatttacatagcacttacattgtctcaagtattacaagtaatctagagatgagataaagtgtatgggaggatatgcataggctatatgcaaatattcagccattttatgtaagagacttgagcgcctgtggaatttggaatcctccagaggtcctggagccaatcccccatggataccgagggatgactgtacatcatactttcatttatttaaaattatatgtattaggttggtgcaaaagtgactgtggtttttgccatttttttttaaagctatggcaaaaactgcaattacttttgcaccaacctaatataaatcctacgtcacttttcatcagcaactggtaaaccaagaatcagggaccatcctaggcaaagagaactagaaagattgttcttgctcttcagaacagttgttcaaatgataccctgtggatctgattccattataatttcccagggtgcttattaaataagcagattactggatctaccacagattcactgaatcagaatttagagctgaggctagaaggctgcatccttagcaagtgcctttgatgactcctatggttcctgatgttttataacctttgttccagaaatccacactatctaacacgagacaatataacatacatgaagaggccacaaaatagtgagcaaaatcattttacagactataaatctttttattacattcatggcttagcccaaggatgaacccatagtagatgcttaatatttgcaagtaataatgagatagtttatatactagaacactgaatcatcatggtgacctaagtatttggaatttttaacatgacatcttcagttatttttgatttcaaagaaaagagccactccttactttttattttgaaatgtggcataaacctgtttgattttcacaattttaaaatgatgggaaaaaaattgaaaggttttgtgggagaagaagtacaaataggtccataaaatatgtctaagattgacttgtaaaaaataaagagaatctctaagtgccaaaagttttttctgtgcttactgacatatctttaatctcacaaaatgctctaccccgtggaagagggcagcagatataataagtaatgtattaatcatttatttgaaactctgttgatcctagtctgacaaaatgaaataaagattgatccaatttattaaggcctatgcctgctagaaacagaggcttaatgaaatatggtttatttttctcacataacaactctctaggcaggtgatggtgggtgttgttagcctctctctggtgtcatccagaatccatatccttgttatgtctgctccaccatcctcatcttgtaatttttagttttaggtttatcatttcatgggcttaaggtggctgctgcaattcctggctttatgcacatgtttaaggctggagggagctagcaaatgtgccattttctgtttttcttttttttttttttttttttgtcaacaaataaattttttcctggaaactctaaactggtatttgtttttcgacttgtggcccttaggtcagaaccctgtcacatggctacccattacggtgagtctgggaaagtgagtatccagctttctgaattctaaagtgggcagcaatggaagtagcagttgcaaaatgacttctgagttggctaaaggacaatgtctgccacaatattctctcattaccaatgacccaggacttggactctttaagaacaggagagctgagagctgaactactggaagggtagcttcactgctatgttaggcttgcttcttcacctgaaagttctttcagaatcttggttgtgtgttacctgctgtgcattctagccctgcacatgatatttgtctcctagactgactgcttcttattccttttccctttctggtaagcagtataggttagtggtggggagtgcaggttctggaagcagaaagtctgggtttaaatcctggctggcctacttattagctgtgtgatcctgagcaagttatttaacttctgtcagtctttttatcctcattcatcaagtataaatagcagtggtacctatcccacagatttgttataaaaatgcaatgacatcacctcataaaagtatatcatgaccatgctaagcatgttaagtggttggaaaatgttaataattattattaatttcttattgttttgactcatatctagatctatcaatgtatgtaatcacaatgcttggcacatagaacacacagaactcagctcacttttttgtgcataaagatatgtaattatgtaactttgtgtatgtgtatgtgtgtgttatgtttgtgtgatttgtgaaggtgttgtgcagataaaatctttttacagaaatgcccaaggcccctggatttctgcctcttagagaaagattattcaagtggactatatttgcaaaaccaattttctaagaaaccagatttttaaaaataaatttctaaaatccctatgttgtcttttattaaaattatatatttctcttggtcttttagtatactgtacatagactgtgttattttgttagattttccccagttatttctttttgggggagcagatattagtaaaagataaaatggcacccaagaatatttttcaagaacaaaatacatggcttaagaaaaagaataacctgtctgaggaatggtaggaaggacatttggaaatgaacatgcctcagtgttgaggaagatgctgaccagaaatgtgtaagcaatctggagacaaactgttgctttctttataattttactcctattcagttctggtttcatctttccattaatacatattcactttataatgtagggagcactctttcttgcctttgggatttaagtaattgaagttaatctttttgaaagagatctcagttggattgatctaagattgaaaaggtcattaagaggaaattaataaaagggaactctttaaggtgggtaacgcaggtattatagtcttagcccctggaatatgacccagtgggcagagtaagccctggcaaagcaaggcacacagccaaatgttagcttttcacatgcaaaaacaggattatgcaatagtacagactttgcaagtctattgtttacagaaggaattaagcaacatttgtttacctacttcattattataccagcaatccagcctgaaggacttagctcatagatgtcttctgaaatgtggaagaaatactttcgtttgtcataaaacctcagcaggagattggagtctggaagagggaggggagaagaggaggacctcagggaggcaagttaaacagtccagtttttgcatcttaatttccttctctgtgcttttgtctttcaaggggtggtgccgggcacaggtattttagataaataagtgggatggcaagagaaggacctttttactgcttacccatttattgggtgacaatccagtatgctgtccagaatgcaatatttttgagagtaaaagaaatcatactgggccagatcataaaacccagcattttttagacaaactgatatagtgtatatggttaacttactttgtacgaagaaggtataacaaactcactttagaggacagtggtacagtctgatagagtgagtacccagttaactctctgtgtgttatgtcagctggctttgtatcaggaagcttctggtgagtttaggtgaccccttagcagaggcaggtggaaaattccaggctaggaggctggatggagtagatggtaaacactcaagggtcagtggtctatgatgagagcacaagccaagaaccaaccatgaggattccaaggggagcctgggttatcagaagccattagagctgcagtgaccagattaaaaaggacattgccccaagagtgtctgcatgaaataagggatatccttgcttgtttgtgacccaaggatatgtaagccatacatttttccctttatatccctcaatgttagagagagaaacagaaaatatggtggctatatgggatatgaaatatttgtattaataaaaatgttaatagaaattgcatggccttttaatttatggtgtgggactaaatttaaactacaaatgtagttgagtttctattttgtggagagattatttatgaacaaaataaaggagttacaactctttataaataagtcatactataaaatgtgtgaccctccttgttgcatttaaaaaggctatatattttttgatagtgagatcttttccctctgtatttctctccaaaaatcttaataatgtcaccattttattaaatcatttgataggatcaatactttatatgaactatctcatctgagcagccccaagaaacctgtaaaacaggcattattgtcctattttataggtaaattagccaaggataagataaatcgaagggattcatcaagttcacctagataataagtggtagagcttggatttagaaccaagccaaaacactcacatggcttacctattacttttcattctaagcggccttattttatcacaaatagattgagatgaatgcattgaacccttgacttctaaactctcttctatatgattttaaatttagttaattactgaacatttcatattcttatatctgctcaactagattcaaaattcttcagtgcttccttttttaatctctgtgtttattgcattattgttgtctttagacatattcattcattcaagaagtatttattgagcacctattattgccagaaactgtctcaagtgtctgatatatatatatgtatttatatatataatatataaaaatataatatgtaatataatacataaatttatatatatataaaaatacataaaactgacaacaacctttgtccctttggaacttaccttttattgatggaggcaaaaaataaaatgagtgagttaattttaagatatagtagaaggtattaagtacaatgcacaaaaaagtaaagcagagttaagtgaaattgagaatgggaatgggttactattttaagaaacatgataagattaggtccattgagaaaatttcatctgaaaaatgcctgagggaatgtctgtgcacatgttcagaggaagagcagtttatgtggagggaagcaggcagtgcaagaggcttgaggtacatgtggccagaatagaataagtgaaataaagtcagagaaagaacaattttgggtgttgtctgaatagatcttatgggaacttgaaagtcattgcaagaaatttcacaagatttcaatgagataaataacttcctatttcttattaatatccagtatggctataagaatagacgttgctataaaagcttttattgacacatgttgacatccagacatattatgctgacatttttgtttatgaaccacagtctatcatagattattaacaaattattggtttatgtactcagatactcagacagtgatttttagttaccagaccacggtaatcacagagtttctccctgccatctttggttaactgatatgtatcaattttattttattttatttttttttttaccatcacatacctcaagatctggtaacaccatgggaagattgtatttcaagagttttcttttattttttttttcttccctcccttaacattatgctaagtaatcaggaagaaggagttaagggagcttcttttcatggactagactctagggaaaaaagattgatgatatttggtagaaggaaaagtcttatctctaaaatgccctcagtattatgtcaggctaagcattacctgtggcaaacaaaactaggatgatgagcttcatgcttggagaatgtctcttaagctatgaaatcctctgagcctccattagagacctcatcccttcttaacaagaagggtattccagacccagcaaagaagggcttcgggagctactcttgacatcccagtcctttccctgcttgtctgatccttttatttgaaattacttagtagattgaggtactagttaaagcctctgattcatgttagtctgttttgacaatctaatcctgtgttagcccagtgatagagggaatcttaaaaaaatgttacttctaagaaaggacaaaatttggcacaggttcatagactgttgtttataaattcaagggcttaggtatcttctgaataacagtattttggaaaaattgcactctaaatattttgagtggagtctgaagataaatggttcatcactaagagttaagaagattacattttagcagaggaaaaatccatacaggtcgtcccttcaaattttataattgggaactattagctcatttaagtgattttgccattgtttgaaacttctgaaattcctcttctaagatttgttttggaaactgtgtattttaaacatgtcttccaatgtggcatatctttaccctttgaaggagtatttcatttttgaaaatacttaggagctactccaaaaaaactgttatgataatagatatttgagaatagcagatatttgagaattttttaaaaaatgtgagaatatatagtaatgttacttgttgtcttgaacattttgtaaactgagtgataattcccaaagtgacatgcaaaactatatcatcaaaaattgcttcatcagaatgacttatattttcccaaaatgactgctttgaaggacaacattcatttgactacatttctcctcatcacctaccctgatcatcctatttaaaatatctagtttgatcactctatttaaaatagctatttctaatcaagatctctgttcagtgcataattctcccatgtcatttttaataattgctatttataaagaacagaactgtcttaatattgtatatttcagttttctcataataacaatggctatgactcagagcaaaaagtataattttcccagtagggacctgtgggaataaatatatatatatatatattttattacgaacctaaggaaaatctactgcattgtatttacctacaaaaatgaaaacaaaaacacaacaacaaaaaccttctaaaaatagctagtgattacaagaaataacactctgcagaccttcttctgtgtaacgcaaggtgtttgcttattgtgcttcctttatccagatctgaacactgtgatccagtttctgttgaggtgacataatttctttcctaacaaaagagtcataaatttaggagcaacttacataaagtttgagatgagttagattgccctaaaaactgaagaatactcaatttgcttcatgctgtacatgagattatgtgtaaatgtgtgtgtgtaaaaataaatactatacacacttatttttaactcaagtattacaaggtaaaatgtaaaatactggtgtgtgcaccagttggggtcctctgaaggagaagatgctgagagacaattagcagtccaagaagtttattggaggtaatgcccatgaaagacaaagggaggaggaagccaattttacacctgaaaaggaaaccggaggaaggggagcgagatggggcaggaagagcctcagtctgcgatgcagatgcgagtcagtatccgacaaaccaacagggggctccagatcaaagaggcctgctgggagtctgacagttggcagaaatgactaggtcctggtacctgcagcacactcagtcattggctggggggtgtgggggaagagcgtggcctctgctggaaagccgaggtagacactgaaggcaataacagctgggagctgtcagtaactgcatttcttgaagctgaaaaagaagttttttcttgaagacagatatgagtagcacatctccatggctgccacagtgtgtgtgtttgtattttgacactactatggtcaaagcacagttgaaacaaagttctctatcattgaaagtctaccttcttgtgaggtattctgacattacaacacatattaacagattacataagcttgcctgattttccttggaaaaactatatgtagttggcttgatttgggtacatttaaagagattgacgttactaaaatattccatactcctgaccaatggcaacaatcttaccattagaattaggtaagcctggacaaccaggacaggtgggaatgggaaccctggaatcaaatccgcaacacagagcaagcacaattataactaccacattcattttcctcttcgtatttggggtagaggacatgaagaagggaaaatgagatggagtttgcagaggaattctagaaaagtttatctttgttcagaagtaggaaaataaaaataaaacctgtgaaagaagaactggattaagatctcctttatttccctggtcattgacttacccacaaaggtatgtctaatatataaatggaatcagatattaaccctggaaaacacattggtagcatatattactaaatcttattttattagtatttttatgttaattttcataatattttatgaaaagtttagtatgttaagactctgtggtaccaagaatagaataaaggatgggttagaataatagagaggctaatagggagttttgtaggtcagaaaattcttttagcttctttttaaacacctctgctgatttttccctatggaaagaaaagtgaaaaacataggtaacacattgtgatacaaaacacagaaatatattggatttacagattctttctttccttcataaaatttagcatttgtaccttttagttctcatcaaaagtctgttgatataattttatgcatcagttttgaaacgtatagctagtatacaggtaaataaatatttcacgtggtttatgaacctacaatgtttagaacatcttctcaattaatgatcagatatttatttggcacctacaatatgactcaaaatttggaattgcattgtgtgtcatacacaggaaaagtaagtctttaacaactatgaatctctaacctatttgaagaggtgagaaaaatgcacaaaatacaaagatacaaagagggactgatacaaggcaatatatacttaagggcttaaataatagtggctttgagatgggtgagttgattgggctggttctagaaaatttgtggagaaaattggatttaagctggacaatgaaaatgagtaggttttgaatagacaaagaagcaatagcagaaatcatgtaagcaaaatcagagacatcagtgggcattagtgtggtatatagacattaagagaatgattggatttggttggatgacttacgctgagagaggagagggaaatatagttgaccctagagtcctgattatggaggtcttgggctagacagggcataagaggcaataaacaattgttgtaataataaaatgtaattagtgtaggttttactattgttagctcaagcataattgtttagcatttcttttctattctaccccttttctgaggactcaaccttttgttttggaaagcttatgaaagttatagactgttgaaaaatgttagtctacatagagtttggatgaagcgcagcaaattcctagctgtgggaagatgtttccaccaacagttctgtgggagacagacagacttttgctgctagaaggctcccaccaggcagctacaaaggcacagctagcagggctacttatcacagggatggatggacagtcggcttgcctggctccctcctgcctaaccctattgctgatctgacaatgctcagcaggctctagatgtgactcccctcccctccctggagtccccacgtcttgtctttggcatctcattcaagctccacagatatcctacaaattcctattccattgaattctcctttctcctgagtccagttgattctcacatattcttgcctgagtaggagagtcggggtttccctctagtctttttttttttttttgagacggggtctggctctgtgccccaggccagagtgcaacggcgcgatcttggctcactgcaagctccgcctcccgggttcacgccattctcctgcctcagcctcccgagtagctgggactacaggcgcccgccaccacgcccggctcattttttgtatttttagtagagatagggtttcaccatgttagccaggatggtctcgatttcctgacctcgtgatccacccacctcagcctcccaaagtgctgggattacaggcgtgagccaccgtgcctgtccccctctagtcttttaaaaatctgtttttatgacattggactctgtgctctcattctttcaagatcttactttctgattctcaggagtcttttctttcctcaataatcttggttcctgcacattgaaaacattgtttttgttttttacatgggttcaagaatctgttttataattataattttatttttaatttttgtagagatggagtctgtgttgccagggctggcctaaaactcctgggcacaagggatcctcctgccttggcctcccaaagtgctgggataacagacgtgagacactgtgcctgggcaagagtctatttttgtttcttgtttttttgagacggagtctcactctgtcgcccaggctggagtgcagtggcgctatctgggctcactgcaagctccgcctcctgggttcacgccattctcctgcctcagcctcctgagtagctgggactacaggcgcccaccaccacgcccggctaagtttttgtatttttagtagagacggggtttcaccgtgttagccaggatggtctcgatctcctaacctcttgatccgcccgcctcggcctcccaaagtgctgggattacaggcgtgagccaccgcgcccggccaggagtctattttaagtcaaataaatagcaacgagaacaataattgatcactagcagtttcttttaatttttattcctgcttcataattctgatttcatgaaggcaaagtagatacctctgactgactagggaatcacatataaggaataagaaaaagagcaagctattgttatccgtacataataataatagcttatatttattgactacttagtctgtgtcagaacctggggcaatactcatagattatttcatgtaatcagcagtacagttttaagggttgtgcaccactgctatctgcattttataggtgaagacagcagaactcagaggttaaatatcttgccatccttgcagtactagtaagtcaacggtgaaactaagattcaaacccaggaaatctaccccaaagcctgcactcttactggctgtattcttaaatattttctttatcaagggattaacataattatagaagtatttttggaagattagtctggcatctgcatgagagcctagagagaggattattagtttggaggttattttggtctttcaaaatgccaggagcttcaggcataaactaaagtggaggccctaggtgttcagcctagtgaaccagggtagtgtgagcaacatgaagaggtagagaaattaaaaattagcaatttgagaaattaatagaaaaatagacagtatactcgagaagtatttttcaaacttttttcataataaaatcacctggcacacttgctaaaaatatcctggtcccaacccaaccagcctgtcaggagattttctaagtgaatctctatcttaaataagggtcctaggtgattcttgggatcgggtaaattacagaagtcatcctagaatgtatcttttaatttttcctctaccgaaactatacattgcttaattacagtggcttttcttaactcacagacacaattttcctttttacaattagtagctgatgtgtagagtggttagcacattaggccatgactgttaaaagcttttagtctaactagtaaatcatccaggtaatttgaggttttattgccattgcattgttgtttatggcagcaaatcagttgatttgctgctaccagacacagggtgtaaagtcatatgccataattaaatgatatgtgacttctaaaccagacatcttttgaagatcccattttatcagccaagtcagccaattttaaagcagagtgggttaatcactgagaccatttcctcagctgcttctatggaaagtcaaccaaaatttcttatagttggtgggttcaagcttcataagttcagctttagaattcaattgtaaagctgagctcagattttaaacaatacatattttgggctgaaaattctcttcagtgtttataatagtctggggaaatgaaggtaataaccattttgacagtaaatggtaacatatgcaatttttttacatactgattccttcatcaattttgtatctaattactaagcacttgggaatagaggcttctaattcagaaattgtcaagtgaagtattaggcatactcaaggcagctcaccaaaggtgagaagtcctcttttttcacatatttataaacaaggaagttattgttctttgtttacttcccagatattcttagtaatatttaaagaatctcagagaggcttgcaaggatgttcaaagtccaaagtccttgccctaaaacagcacccagtgctcctcaggagtccagtattatctctaattcagctctatcccaagcgaccaatgtccaatttcacgagccttttggttgtggagttctctggctttagcagcatttcatctatcattgagaatgagatgagaatatctcaacgatggcagataggattctccctacttttcaggtctcttgtaaaacaacataaagaagccagaggagagaagaaatccagaattgtagcatagtttgcattttagttcttgaatcagggctgggttttcttcttcttgagttaaattatgtaccgatctatttatcctagaggacaaatagatagggaaaatggacccggggtgatgtcagagacaatcctgaaagttttagaatccattagtttgccaaggccctgaccagttgtcggtaatagacagtagactttcataccactgatccaattccaatcattaggggacacccagggatctgtttttgctctaaatatcccaattgaactgtattttccttatttatttaatcatttatatgtatgaacatggacacatggataaaatattttatactttgcaacataatattttatattacattattttactgctataattggtttagctttagccactggatgttctttcagaatagcttctttgtctttttcacatgtcccttcctttactttctggtaccccaagatgctctagactcatcttgtatattttcttaaaaaatgggaagtcatcagcatgtagaggtttgttgaggctatcatattatgatagtgtgtggatgtgtaaattataaaaagaagtgtgctgagaatgaaatctaatgccaagatttcattttcagcaccctctttttataattcttttaaaaaatggttacaagaaagatattcttagagcagatggaaaaaaaaactagcaggaaaacagaaataatcagaaggggatagaaacaaatgtaggatacttccaagaaacaggagatagaactaatatgaattagttatttattgattgcttcaagaaggcttcatgaaattctgggaaatacatgagtcagtgataaatagataagtttattgtaggtcaggaattgtgggctctcaaaactctgtggttcccctcagagggctgtaaaagttaaagcaatttgattggttttatattcaaggagaaatattaaagagttaactagttaaaaattaagacagaaaaacagaagataatttattttctacaaaataaacaattgtagaaatcaattctttgtataatcaaaggatagcatgtctgaaggaaatggactgggaagaagaatgtgtttgacagggtatagaagtggggatgtggagtcctgatagctggaccatgaagcatagaacctgaatctatgacttaccttctcttgggatttctcattgattactcactaattctatcactttactaactacaaggaggtctgtttctactttaaaatatgttcaaatgtaggtaaatgtcacttggaatatcccagaacacaaccatactgaggaatacagaggatactagagctcttagtaatttggctttgaagatgctgctacctttagcttcaagttcataagttcctgatttcccagtctctctccctaggattgatgccaattttattttatttttttatttttatttttttttcgagacagaatctcgctctttcgcccaggctggagtgcagtggcgtgatctcggctcactgcaagctccgcctcccgggttcacgccattctcctgcctcagccactcgagtcgctgggactacaggctcccgccaccgcgcccggctaatttttgtattttttagtagagacagggtttcaccgtgttagccaggatggtctcgatctcctgacttcgtgatccacccgcctcggcctccgaaagtgctgggattacaggcgtgagccactgcgcccggccgccaattttaatactcactgcccaagacaattcccatatccctgtgtcccaagtgtctagaataatgcctgaactatattaagcaatcaagaactatttgttgaatgaataaatgtatgaatgaattaattatatcctaagttacatttcaatattttagaaagatgccatcttatagcatcagcatacttgtctttgtttaccatattatagctcttggggttttagatgttaggtctattttcctaaatttcaccctctctccttttttcctccctagttaattgtatgtctctcctgttattgatattgccctacatttccttgtaaaatattttacaaaattgttcaggcttcctgcataattctgacttgaaatattgtgcttaaaatttttctatattgcttctcagtatcttttctaaaatagatctatgtgataattatttttggagggggtatgcttttcaccataacaaggaatatgaaaatttaaatgtgttataattttttacctccacagattgttttgcttattggtgtttaattaaaaaccaaacaacttttcctattaacttgatgctacttattaattgaaatgaggagactgactctggatattgggaaaatttatggtaagtctttactatcttttcccatggtttgtggattatttactagggaacgtttgttacagacttgggcttcacatggttttccttgagtctcacaagtagcttccttttgaatagatttagattccctaaacatttggtaaatgtctagcacatgccgaacatgtaggtagatgttaggagcttgttttaatcaatgaggaaacagatgtacagtgactcagtgactgtaatccagcaactatccaataactatggtcccacagtcagtgagagaggtagggttaaagtctatctcttgggactcaagtccagtactttttcccattatatacttggtaaaagctcatatatatatatatatatgagcatttttacttggtaaaagctcatgtgtatatatatataatatatatattatatatatataatatatataatatatatattatatatatataatatctattatatatatataatatatattatatatatataatagatatatgagtatatatatatgagtatatatatgagtatatatatgagaatatatatgagtatatatgagaatatatatatatatatgagaatgttcactttcttctggggtcctcatagcttaaacgataattcatggtttttattttgtgttccttttctcttagtctggaatagcaaattgacctcaaaagatatattttgatcaggatgaattccaaagctgaaattagttgttctctgagttcagagttttagattaaacatctctctcttgatatatatatctatggtaagttatttaaaattattcttaatatttggaataagagttaaacttaagaaaagtaagtccagtagtatttgaagtaagctttaaattggactttggttatttaaaaatgttttaatcattaaactatggaccgaaataaagtattcatgatggacataatattagactatcaaaagtcaggaaacatggccttgatgacaaacttaagagaagcagcggagggtttgctgctactgaagattttacatttaaaaaaaaaagaaaatagactgtgtagtatttgaatgaattcctaaatataagaagctatagtttttgtaaatatttgaattccagaaaataaaattccacagctatgtatgagaaagcacattttaaaaaaataagatgtttttggccagtcgtagtggctcatgcctgtaattccagcattttgtgaggctgaggtaggaggatggcttgagcccaggagatcaagactagcctgggcaacatagtgggacccccatctctacaaaagataaaaaaattagtcagtgtgatggcacgtgcccgtagtcccagctacctaggaggctgaggtgggaggattgcttgagccagggagggagatcagagcctgagagcttgaggctgcagtgagccatcatcaccctgctgcactccagcatggatgacagagtgagaacctgtctcaaaaaaacaaaaaacaaaaacccaaaacaaccaaatgtatttgctaacttgctataaatataaaatgatacttcttttttagattgtaaaaaatcaagtgaaactaactttgtgctctttgatcatcatttccgttttctctgttcttcccacctgcctccccagaccctagtaatcaccattccactctctacttctatgagtttgactaagattccacatgtaagtgacatcatatggttatatatatacatatatatatatatataaaaatatatataacgttttctttttccattcatccattgacactcaggtttattccgtatcttgaccctcgtaaataaagctgcaatgaccatgggagtgcagatatctcttcaacatactgatttcagttcctttagatatataccaagaagtgggattgctggatcatattagatgatccactgcacagcatgcaatagtaatctgcacagcatggtcactacatagttaataataacgtattatgtatttcaaattattaaaagagtaaattttaaatgttctcaccataaaaaataagtatgtgttgaatatgggatatgttaattaccgtgatttaatcattccacactgtgtacatgtatcaaaacatcacattgtaccccataaatatatatataattattttgtcagttaaaaataaaatacaagtaaaatcactttaaaataaaaaaatcaattgaaagcatttctaagcatttgaacatgtaattgttgagaaaacacacaatgatttcgctaattccagctgatcatttttccgctgagagataatatattaagggagtttagaaatacattttcagaattctatctatctacctatctctatctgtctgtatatccatccatcacattttgaaatcttttttaaagtaaaaaatgtaataaaatgtctcttgtgtagcaaatcagcaaattaaattgatataaaattctctcacatatgcttgacttaatgtaataataaatatcataacatatagcttaaaacttatctttcatccctttccctttcctctttctccacaggtgaccattattctgagtgttttaaaagcaatatttttctattgaagaaatgaaaatagcagtcattcaaaatcctattgtgctatcttttgatcatcataataagcaaacgcaaataattctcccttggtgatccaattaaatgattttaaaatatcagtgtcaaagctgttccttctaaaatttaaggcaaatctaatagattctaaacatagattacaaactcaaacgccctcaggtgccaggcaggagagattagagagccgcctgtcagaatggagacgctagatttagtttatccccaatttgtaaaagacagacgctggttgtcttttcagaatgacaagaaatcaatagacaatattatcaagtggtcagaatcttgaaagaaggcagaaatttaggtatatttatttctaatttctaaatgttgacaaagatttaaaattttaaaagtaccttgtattttaaattaaccctgttggaagtccagcgtcagctgttggactgctactttgcaattacggcaaagtgggacagctacaaccatctttctggttgagtgcactatcctctttccctttccgaattcacttatttattaaactacatttgctgctcaagtctgggcttcctggatgtaaaaagttctccgtgatctggcatcactctgccatcctgccttcaaccctgctgctcccatcagagtggcttccttgcagtcatctgacatattcaacattgttttgccttcactgctgagctcatgaagttggtctatgaatgtgtcatatagtagaaagaaactggatttggacaaaattctatgctgataaaaaggatgatgaggccaatgctgtggatgtatttatatatctgctgaatctgtcatttaggaattagtaaatagttgctgaatcctttgttttaaatatcgcgtacttgaaaacgataaataatttttcaacctttggttcttcagattgaaaaatttcagctcacagaatctttcccaagatagagaatttctaaacctgtaattatttttgtaacttgcctgtaaactctctttacattttttattctttttgtttcaagtctacaatatttctcgttgtttagaatgaagttgataatattttaatataaagcagagtttctgcattcattagtatgttctgattcgttgtttatagtgattgttttaaccatctctgaatctgagtttttgatttgcaatgattttgtgaattattgtgacatgttggcagctgtattaaaccatcgtattgaagagatattaagtaattattagtccatattcccattttaaagcgttaaaataatataaatggcatacattcttcttaatatcctggaatactgaaatgctttcaaccaaacatataagaattttagaaagctagactctgacatgagcaataaaacgcactaggttactcagaatagagattcacttagtttaaaagtagtttttattgctacataatattgtgaagcaaactattcatcagtagcctcaagcatgtactacctgcatgaaatacagggacatctgaaagactggaggaataggttggatttcttagcctcttttgtggtttccttatacttttttctgatcttcccattaataatccataacacctagcactggctatcaaatatactgaaaaagcttgttgaataaatgaatcagtgaagaaatttgtgatatcctttcaacaaattctttatttctctctcctatctgtcaattcccattgtatacataatgaatatctacacatgttactaatgaatggaatgctatgttcttcctttaaatgaacacatgctccaattccttagtctattaagatgcttgatagaatgtggcttctctgatctgaatttttgtggaaagatgtattagctagatatccaaaacatgacatgttttgaagaatgtgctcaaagtgaagaaatgtttcaaattcccaaagcacaacttgaagtattgttgtaattgtgacttgttggcagaggaaggcaggaggaacagtagtttggcacccagaaaatagaaatgcagtggaccattttcagctggaaagtcaagggaaggttggaaatcaaagtgatcaagtgggtgaacttagagcaaaattttaggagcataaggctgagaagcaaaacatctgattttgtatctcttttatcacttgctatgggaaaacttcagttttacatttttaatcaatgtggtagtactaatagtacctactacctaatagtacctaatggtatgctttttgtgaggattaaagaggcacattataaagtaaataatacagtacctggtacatactaaggataataatactgtttttattgttatagaagctataaatcagagaattgtcacattctaagatgtgtaagtcctttctggggaactgacacacacagagcaaaatcattagaagcatctttgtatataatgctgtcaaatgaatatgtttttgattatagctttcaagataacatagctattaagccttagataaattattatttacgtttttttctccctttacctactccctgcctcattttctccattcttacttccttctttcttttccttccttccttccttccctccctcccttccctccttcccccttctcctcttcccctcttccttccttcctttcttccttccttccttcattcctcccttccttccttcccaccagtatttaccacctcacaactatattctagagtatcctgggcactgggaatactataaatatatttattaacatatctctttctatagctgtatatctaagtatttatgtagttatctgtattatttaactacctagctatgtatctatctacttttctccagcttgggctgtataacaaaatatcatcgactaggtggcttaaagaacaacaacaacaaaaatttcacccagttctagaggctggaaatctaatatcagggtcccagcatggtcaggctttttttgagggccctcttcctggcttgaagttggctaccttcttgcactgtattctcacatgacggagagagtaagctctgatgtctcttccgcatcttataagaacactaatcccattattggggccctaccctcatgacctcatctacacctaattacctcctaaagaccccacttcctaatatactgggagttagggcttcaacatttcaacatgtgaatttcaggggaacacaactcagttcgcaatactatgtcaatatatttatgaaaagggggtggctaattctaattgagtcattgaaattctcataaaagaaaaatgtttaaactcagccttgagtatgttctccaggtggttagatagaacggggagtagagaaagagaaaaagggtagaagatgtggaattacaaaagggacagagatgggaactaacacagtggtatttattggcatggttagaagaaaatagcttcactaaagaatctggacattgccgtgatgatcactgtgtcttcagtgactgagtgacatgatcagggtcaccttctggcagcagcatggagaatggattagagatggcatgaagattttaggagactactctgatagttctaacgaaatacactgtgggcagaagtagtttggatgaagaagagagtaaataaaaaatgacaagattttatctcccataaacctacaagaattatatacagtcatatactgcatataatatatacataatgtataaagatgctttggtcaaagacagactgcatgtgtgacagtggtaccgtaatattatagtggagctgaaaaattcctgttgcctgatgacgttgtagccatggtaacgtcctaacacaaagcattactcatgtgtttgtgatgatgctggtgtaaacaagcctactgcactgccagttgtatgaaagtatagcatatacaattatgtacagtacataatatgtgataataataaaaaacaagtatgttaatggtttatgtatttactaaactataatttttaattgttgctttataatgcacttactcctacttatttttaaaaaagctaactttaaaacaaactcaggcaggccaggagtggtggctcatgcctgtcatcccagcactttgggaagctgaggcaagtggatcacctgaggtcaagagttcaagaccagcctggccaacatggtgaaaccccatctctaaaaaaaaataaataaataaaaacacacacacacaaagcagtctcagggatgtacttcaagagatatccagaaaaagacattgttatcatataagagaacaatgttattgcccctgaagaccatacagtgggacaagatatggagatggaagacagtgatattgatgattccggccttgagtaggcctagtcttgtgtgtgtgtgtgtgtgtgtgtgtgtgtgtgtgtatgcgtgcgtgtgtgttttgagacaaggttttgtactgtcgcccaggctggagtgcagtggcatgatctaggctcactgcaacctccctctcctgggctcaggcaatcctcccatctaagcctcctatgtacctggggctgcaggcacacacaccaccactcctggctaattttttttttttttttgagttggggtttcgccatgttgcccaggctggtcttcaactcctgggctcaagtgatctgcccacctcaacctcccaaagttctgggattacaggcatgaaccaccatgcctgcctggcctaatgtctgtgcttatgtctagttttcaacaagaaagtttaaaaattaaaaaaataaatacataaataaaatatagaatagaataagagtgcaaagaaagaataactttgtacagctatacaacgtgtttgcgttctaagtgttattacaaaagagtcaaaaagttaaaaaaattaaaatgtttataaagtacaaaagttattgcaagctaaggttattttattatggaagaaataatttttttaaaaaatgaattcggtgtagcttgcatgtacagcgtttataaagtctgtagtagtgttaccaagcaaaaggggcttgctgcctgatgcactagaggccaatagtatgacaccgagttttttagaaaagaaaagctttttattgcaggttgactaacagaggagacaggagtccagttcaaatgtgtctccctgtgctgactttaagatagtacttttattagaaaaggtttaagggatgaattctgggattggtagattggtggaaagaaagaggaggtctgaaaagtcctcaggaatgcagttatctttcatgctacgtcatgggtcacaagtgcaaattcagggggagttaggatttaacatgtggtggaaactcaggctataatgttagcaagtttgttctgcacacactgctgtcagccatattggttcccatccatttcagctagttttgttatcttacaagtgaagggagtttcagcagttcagcaagttgtttcttttcttatctgccatctttcaaacttgaaaatttctgttagctatttaactccttgggacacggtttcagtagtagacgataatgtcctaggtcttcacattccctgatcacttactcaccacagagcaatttccagtcctgcaagctgcattcatggttaagtgccctgtacaggtgtatccttttttgtctttgatattttcttactgtgccttttctatgtttagatatgttgagatacacaaatatttaccattgtgttaacaattacctgcagtactcagtatggtaatatgctgtataggattgtagcctaggatcaatagggtataccatatagcctagctgtcttgtaggttataccatctaagcttgtgtaagtatattccacgattgcacaacaacaaaataacctaatgacacttttctcaggatacatccccaatgtcaagtggcacatgattctgtggtttttcaggctgtgtttgccagtgggatgccaagagatgatttctgggggcatatgcttacctctttttggcttggaggttattcatgatctctgccttgcctcctccaaatggtgctgagtacctcctttccacactgttgttccaataagtgtcaccagtgctgctgggatctcatttctgactttagctgctcttgctccttccttggtttcatttttgtagctatttctgctggttctagtccaacaccatggtcacggtcactgcttttgctggttccactaccatcatgatcatgggcagacccaggatttttcaggattgctatctctatcatgtttgaaggctcctgccagtctgcagctgctattgtagcatgctttgctcttgttttactatgagcatgaagtgtagcttgtgatggtatggctttcaagcattaaagttaagatttcattcttaactctgccacttactaattttgtgacattttggttaagttactcaaattctttgagtcttagtttgtttatctttaacattaggataatgctacctaccatgaagtgttgttctatggattcaatgacttcgtgtaattaaaacacctcacatactggttccacaccatgcagcctaaagtaactacttattattgtcaccttaagccccatcatgagcccacctgagtcccattgccactttcgctctcttgtacttcccaaagcttattgccatcttgcttctcaaaaactcttatggataacaggttaaaaagatcatttacataactacaagtagaatatatggaacataacagttgcttgatacatgctaacttctttcccatccctgttcttgcaaactcccattgggttatttttccttagggacattttccacagtttcctttctttggtgctataatccatctatgtgcattattttgtggaagcctaaatcttagtgtacaaatttacctgaccatctaactcaaatgaccaaatagcccaggagagagagggacacaggccagaagaagcagaattggagaaattaaatgggttatatctgctgaaacttgaagcaattaaaaaaatgtccattatactatccaaagagagtaacacactcaactatggtctggacatttgtttcaagcaataaagttaatatgctgattctagccataagaaaagtgcagtaatggctgatgctttaaataaagcattaaagttttgaagcaatattatactcacagtaaaactctaacttgcgacagccagcaaaggagcttcatagggcatattcctccccatctcaggtgaacgacacttgttgagaggatatatggcttctgacacccaaataggcaagagttcagagaaaagttccatttctaatgaagcatagagtaatggttagaagtatagtcccccagaccacattctcttccagctatactgcttagtaactctgtgactttgggcaacttatttaacctcttggtgccccatgtccccatctgtaagatgggggatgataatgacaactacttcataggttgttgtgataatttaataggtaaagaaatgtaaagttctacaaaaaatgcctggcatatagttgacattgaacaaatattagctatgttattattattactttcattcgatagggaaatcaagacaaaacagagttccaagggtggacctgatagattcatagggtggaggaagaagaaatttcagggaaaatttgcagcctgaaaacaactagtgaggacttctgtctggcacaatgacatcaggttgtgactgcacttctattcctgagtcaagactggctgaggaatagggtggatctgatccagcagacaaatcctcagtgatgcccgctggagaggctggaggaggcaggagtttaaacagtgcagaattcttgctgccatcctgctggcctcccaggggaccaagagagcacttttgtacctccatcctactgtgactccgcagtgcatccaatctcatgcaaactcctttagctgtacttgaagctgttctggatgattaatctgcttgtattgattatttttagcctaagtttaaatgaagagcaaatatttctctctgatagatttacagtgctttgtttattgggaatatttttggactgaacaacaagtaaactatgctctacataaaatggtaatggtcaatatgctaaattaggtaatactaagtaaacttttttagtatagtctcaatacagagataataggtaagttcaaaaattttaaattactatgagtacatttgagattctggtgcttctgaactacaagtgatgatgtcattgaggcacagaattactttctcaggtggtttgactattaaaaaagtgtttacattagattataagctggcaaatatcagacacattgttagaatgtttaatattttcatacgtcacaggagaacctggaactgtgatatcaagcattgcaccttttggatttaattctgtagttcttcctaacatttacttgctaacctttggtgtttatttcctttttgaggaggggagttgttttgctctgctctgggtaaaacttctaaaattattttattttgtacaaaatttatgtttgtctttgaagtacagaatttctacattggtttccctatttgacatgtgaattagatcactgggattttcaatcctgaattgtgtgaagaatcatatctgaaataaatttagtggattaagctagttgataagatccaatgttgtgatttatatttctatatacatgttactatatttccaattatcttttgaatatttaaaaagggtgcctgatagactataagaaaaattttagtgttttttggaaaataattttatatttttgcactgtgtgcccactttttaacacaaatgcatgttttttcagagaaatttaaaaaataaagttgaatattttgggctgcggattttaacttccctaggaagtgccgccctcaaggcatctctaccattttgaaattacgactataatattgactataattatgactaaaatatttaaacaataataaatattttcaaatatatatgttggccatttaaaaaagtattgcattacatattttaaaatttttctcacttttaaaattcataatattattttacatttgtatattactctatttagaggcacaatgcctagcatagaatttgaactccaccactgatgtgatccatcttgggaatattacttaacctctcctgaacctcagtttcatattgtatggttaagataaaaatagtacctgcctcacaattttattgtgaggattatatgatttaatataggtaaggtgattaaaacagtatttggaacccagtaagggatacagaattatttactttgttatttttaaaacttatttggggaatataggaaaaagtgatataaatcataaacctgcagaggggattttctacacagtattattacaataatctccccttgaaaaaggatactaagagtctcactgtctatgcttagatttaacatgaatacaatatgaatcagagaaaactttttattgatcagcataagatggttagaagaatgctctaatatccaagtaataaccatgatgttgaactctgttctttaaataagacaaagtagttgaaacagttgtaattatctgatactctcacctgtaggtgtaggtaaagtaaaccagtgagagctaagctcccactctgctgcagcagagggagatgaacagactagtaggaaagggactgctcatggaggacatgggttgtggtgttagagagcaatataaaaagctgggctgtggtcagggctggaactgctgaagtacacagtgcaattgtgctttgagacctaacttgcccttgatcacatctatgagaaataggcccagaaagagtcacttatggtccaaaggtagcattagcattctaaacacatctagtcatttccattccaaggaagaatgcccagatagatagttgtgaacatctcttatcttgggatcaataatggaagaatagaggagcgatttgcttcacttctcttttttctttttaaaatgcactgtaaccaatgtgtctggcttgaaggctattaactgggttgcatcatactggtgggctagggagttaaacaatacagactagaagtcattgctacaggttttttttttttataaagcatatgctaatgtgatacacatttatctcaaacatgtatcccaaaacctactcattattttatctcccaagattatttcctttgttcttgattaatattatcactatacgcctgcttttcaaggtcataaatctctgtattccattcaatttcactcctttctaactcttcacataaaatttgttaatttagaccagtacgtgtcagacactattctgggaactagttgtattttagtgaaaagaaatcgacaataaaaacattacctgtcctcatggtgttgacaggagacaagctcacaaataaatatatgatttagtggagtgttatgatttgttatgttttgtcattatttttatatgcttttatataaaatatgttatatcatttatataataaataattgtttagaagtatcagtaaaatatcttgaataggaatgaaacgataatttaaaatgagtggtatcagcagaaaacattatagtggacccagaaggaccaaaaaaacaaaaatataattttgttattcacagaaaataccttgagcctaggaatatttaattaagcaaacatttttcagacatgcgctatgtatatttttattaactccacaaaaatttcttgagaatcttttgggcactgggacaaaatagtaaacaccctatataaaatccctacccttatggaatttacattctagtggagaagacagatgaataagaaaatgccacacacatacttcttaactattctacttcctagctttcccagtctgccccccattcaataaaacctttcttaccagtgccctgttgtggccctttccaaccacagattattgtatcaattggtctccacttcatcatctatattgtcatagttatccttctaaagcatagagttcatcattagagccctctgatattaaccttttatgacttcctgtcatcttccttatgatttcatttacattccagtcctgtgattctccaatcctatttactgctttataacctgagcaacatatcctcttagctgcaacttcagcttttagcttaagaattgctcatacttcattgagaaaatataagcaaccacataggagtgttttcatcttcttacctccgtattgtaaccctatttccataaaataatatgtatcatattcttttttcttcctttgcagcctgtcgatggcaaatatttccacttgtgcttccctttagtttcaagacctttgcacttgaagtaattgtatcataagtttcttcttttctagcgtgttattcccacctgtatacaatatgctaattcatttaaaacatctattccttgattttccatttccctaaagatattactccattttttgtaatattgttatcttaacttgctctctccattcttcacctactgcttactaatcaacctactccaatctggcttccatttctgccattcatggaaacctcagcccatcttctctcttttcttttcttctctcctgcctcatttcctttctttattttgccaaggacatcaataataaccacattgccaaatctaataaacctttctgtactcatgttaccctgctactcaggagcattcaatatgagtcagcctgcattccttgaaaaacttgactgtctagactacttcttcctttccagtctccttgttctggatgatccttcccctttacctgaaatcataattatccacaccctctccctaggtgattgcacttagtcactgtgatttaaatgctaacaattgaaaaacgaaagagctccagacgtatacacctactgcttattgtacttgtccagttgaatgcctactaggcatttcaagcttgaattttacaaaccagaacttctgttttttttccactccccacctgttcttcgaaaagtcttccccatcccaataagtggtaccaccaaacacccaattatgcaaaccccaatacctagaagttatccatgatttctttattttttcctcatccccccacagcatccattagcatgttcaaaatatattttgaatctctctgcttctttccatttatactgttactaccttgttttaagtcacattcatcttttctggacaattgtggcagcttcttaactgctatctttgcttcctctcttattcatgcccacatagcagccagagtaatctttattaaaatatgcatcagatcctgtcacccccttacttaaaactcttcaatcgttttccattttgttgaaaataaagtccagaaacttttctgccaaggccctgcaggatttagttcctggatttctctctgggattattccttactgttctgctctagctgatttcattctagccacaccatcctcctttctgttccttgaataagccaaactcttttccatttcagaacctttcatttgatactcctaacacttggaatcctctttctccggctttttgcatagcagcttatttttctttgactcttagctcaaatgtcatttccttagagaaggcttctttactttttactctaaatagcatattggtcttgtgagaatatctacaacaaacattttctagggtcaaatacagtttgacggttttatatatattacattgcctttttggaattcttatgcacagtagcacattatagcttcattaattcatacattcattcttttagttaacatttatgaacacctgctatgtgccccaaattattctaggtgcttgagatacatcaaatagtaaaacagacacaattcctaatttgtaaagtttacattctagtgagtgagacaaataataaacacttaacataattcaaaacaaattatatagtataaggaaggtcattcatgctgcagaaaaagagagttaggtaagtaggattgagagtgccatggtggttgcggtattctgagaatcatattatgaagaaaccagcatttttcaaaattattaaaccatgcaacacacattataatgttgtgaaactaattttccaaggaacacactttaggaaattatgataagcctacctttcattctcttctctcctacattcattttacagagtagaagcctgagttctagagaagccatctaattatccatgagtcacaaatccttcctagaaatttaagatatgatgtacgctttacaaagtcgattgtgaggattatgatagaaataatcagttgcatatctaggatatttggcacttgaagtaacttgtttatatgacaaaatttcttccagtaatagtcatgaaataggacaaataaaataatggttagaaaaatcagcagactttaaaatttttcttctattgaattttgtatatgtaataatgccaataaaaagaatagtaagtaaataaatattacagtacaaaatgagaaaggtaatgggttaatacttttaagttacaataatattctctttttaaaaacatgcccaaataggtggtctgttacatataacaattattagggactgaatgtgtccctacctgacttccagccctaaatttgtacgctgaaactctaactcccatgtcactatatttagagtaaggaagtaaataaggtcaaatgagggcataaggatggcgttctgatctaatagaatttgtgtctttataagaagagacatcttttttttctgtctttccccgagggcacatacagaggaaaagacatgtggggacataatgagaggacagccatctgcaagccaagaagagaatcctcaccagaaaccaacttgactggaatcttgatcttgaacttcttgcttccagaattatgagaaaataaattgttgtttaacccacacagtctattgtacttagttgtagcagtctgagaagactaatacattgataaactggtcagttacaacaatgaatatattatttatacattatataaatgattatagtttctgtattagcttagattttgcaaatttgtcaatagctttgtccaagttgattttctttatatattcctatttcatagactatattagctagatttgtcaatctatcttactcataatgactgaagaacacttttaaattcaatttaaaaggtttttgtcacataaagcaacaaatataaaactagaaaaaatataaatatgaatataaatttgaaggaaattaataaaaatcgtattgtaccatatattccagaaattttaaacactgatgaaaacttcaagtggtaccaaggaatgagagaattgaagtaattcaagtgttatatttcatcttttctatcactaggttgtcatcaattatttcaaatctgtttttttttttattgtaattaaacttctaagttcagggacacatgtgaaggtttgttatatgggtagacttgtgtcatagggttttgttgtacagattacttcatgaatccgttattaagtgcagtacccattagttattttttctgatcctctccttccttgcaccctccaccctctgataagaccaactgtctgttgttccctctatgtgtccatatgtactcatcattcagcacccacttgtgagaacatacaatatttgtttttctgttcctgaattagtttgctaaggataatggcctccagctgcatgatgctcctgcaaggggcatgatcttattctttcttgtggctgcatagtattccacggtgtatatgtaccacattttctttattcaatctgtcattgatgggaatttaggttgattccatgtctttgctattgagaatagtgctgcaatgaacatatgcatgcatgtgtctttatgacagaatgatttatattcctttaggtatatccccagtattgggattctggggtctaatgatatttccatttttaggtctttgaggaattgccacactgttttccacagtgattgaactaatttacaaccttcaaaacagtgcataggcattcctttttctctgctaccttgctagcacttatttatttatttttgactttttaataatagctattctgactggtgtgagaatcttctgcttaactcaggaatgtgtagctccacgagagtagctccccagcacccaaagagagcttgaaggattcaaaaccgttatgaacttcctcttaaaatgaacatatgtagttatgtctacatgcatcagggactgactggatgactgaggattctttgaattaacttttatgaagattacaacatttattaaagaacaagtaattcaaatgtgctaatttgtaacttaaataatatgttattgaaaatcaatagtaatctgtgcaattatttagaacttagactagtagaagcctttaaagacaggactgtttatcagtgatgttgcttagaattactggcatactttgataataaaaaagagattatttttaagttagttttatcattgcttttaaatgctccacaagcaatgcacctccttatcctattgctctgccctaggtaagtccctggaaattataatagtagttaatatttgttgagtaattcagagttaatgcatgtttaatcattgtcatgaataaatcagctgaatgagtaggaatatcccaaatgcctttccaatatgttttttggtggcttttgcccaaggttttttttttttttctcttggtttagaagacttagggctgactattcaataccattgaaaatattagatcaaagcaaaaagaacaaagccagaggcatcacattacctggcttcaaactatactacaaagctacagtaatcaaaacagcatggtactggtgcaaaaacagacatacagaaaatagaacagaatagataacccagaaataaagccacacacttacagccattttatctttgactaagttgacaaaaataagcaatggagaaagtactccctattcaataaatggtgttgggataactggctaaccatatgcagaataaagagactgaacacctaccttttaccatatacaaaaattaattcaaaatggattaaaattttaaatgtaacacctcaaactataagacttttaggagaaaacctaggaaacaccattctggacatagaccttgggaaagaatttagggcaaagtcctaaaaagtaattgcaacaaaaacaaaaattgacacatggaacctaattaaaccaaagagcttctgcacagcaaaagaaactaacaacagagtaaaaagacaacctacagaatgggtaaaatattcacaaactttgcatctgacaaaggtctaattgggaaaatctataaggaagttaagcaattgaaaaagcaaaaatcaaattacctcattaaaaagtagccgaagaacatgaacagacagttctcaaaagaagacatacaagcagccaacaagcatataaaaaatgctcaacatcagtaattatcagagaatgcaaatcaaaaccacaataagataccatctcacaccattcagaatggctattaacaaaaagtcagaaaacagcctgctggtgaggctgtggagaaaagggaatgtgtatacactgttggtggaaaagtaaattagttcagtcactgtggaaagcagtctggagatttctcaaaaaatttaaaacagaagtaacttttgtcccaacaatctcattactgggtatatatccaaaagaaaataaatctttctaccaaaaagacacacatactcacatgttcattgaagcactattcacaatatcaaaaacatggaatcaacctaggtgcccatcaatggtagattggataaagaaaatatagtacatgtacactaaggaacactacacagccataaaaggaataaagtcatgttctttgcagcaacttggatgcagttggagaccataatcctaagtgaattaatgcagggacagaaaaccaactactgcacattcttgcctataagtgggagctaaatgtggggtactcatggacataaagatggcaacaaatgagagtggggactactggaagggaggttttcccctggagggtggcaagaggtgaaaaactaactgttgagcactatgctgacttcctgggtgatgggttcaatcataccccaaacttcagcatcacataatatacccaggtaacgaacttgcacatatacccaccctgaatctaaaataaaagttgaaattataaactaacataaaatataaaataagtagatcaacaagttgagttgggattgtatgtgatggaagggaagaacacatggggtaaaggcaagtctttcaggcttatttcctatttctttgagcatgggtacttgcagctccattccactctcttcataattgtttcctccactatcgaatgacaacatcaaaatatataatattggtaaaagtaatcatattgttttcctatattctttacattagtattatggaaatacacttgtagtatactttttgtttatttacaataatcatttgggagaatttgtctgctgtgaaatagaataataaaaattgttttactcttagtacagatgctagaggaaattctttcacttttccttttcccaccttatttttatcataaaaagagaagatatttaatcctttttctatattttatgttattttagttgctaaatatatagatttggtaattcaattgtccctcgtatcatattactcgaagaaaccctgactgcaagtatgccacaatgccaatatcagcccatatttttctagcttattaactggtctgttctactcagcttcctctatcctacagggccccatctgcagttttaacagtattgatgattaattttacaaagagtagtttaaactgcaaagcagaacctggaactgagccatagagggcccatatgctcagagacatctctaaagcagagaaagaaatgttttcctgaaaatgtttctactatgttggtgaaagatagtctggaagctcctgctctaagtggttttggagggctctagtaataagttagatgactgtaaacttgcaataaaaatgacccagtttaggctctcatagtaactgcatgtcagatatcagaaaagtggagtatttctcacactcaaaaagggagaccattttgccttccatataatttgttatatttttcatctggaactcctttttttgctgaatttccactgttactgtatcactatgcatggcaatatgatatctgcaatatcttagcaatatagaagagcactggatttgaaatttttatttctcacatttatgagtcatgtggtctgagaaacagcttatttttagaaattgtattttcttcatttgtaaaatctgccttctcaggatgattgtgaagattaaataagacgacatgtgttaatgtatctggtgcaaagcatcaaatcagcgtagaatcagaaagccaatgttaggtaacaagcattccctaagtctgtattgcatctgtattcatagctgcctgacttatcattcttgaattatttgatatttaaaggtcaaatggggaaaatgtacctatatttgataaaaaagaggcatcccaagtgtagattagcttgtatagtttaaactttcttttttttttttttaagacagagtctcactctgtcacccaggctggagtgtagtggcgctgtctgcaagctctgcctccagggttcatgccattcttctgcgtcagcctcctgagtagctgggactacaggcgcccaccaccacacccggctattttttgtatttttagtagagacggggtttcaccgtgttagccaggatggactcaatcttctgacctcatgacctcgtgatctgcccgccttggcctaccaaagtgctgggattacaggcgtgagccaccgtgcccggcctaaactttcaaacacatttacttaaattagctaaaacaaggtaattatattttaggtgtttctcaaactaatatggacaaaattatttaatgttaagtttattaaacacatttagaaagaatttgtcattctatttgcctaatttgtctattatttctaattaaatacaatgtaattatttttaagaatagaaaaaagtgagatgaattgattatagagaataattaaaaatgggatataatgtgagcattagtgattatactcttaattctcccccaaataattgactcttattatactattgtttttatttatgacaatagagcataaagaaagaagatattactacaaactcccactgaattcattaatatgattatcatactgttttagtttaaaatatttgtaaataaatttggaagcaacctaagtgtccatcaacagacaaatggataaagaaaatatggcacatatactcaatggagtactattcagcgatgaaaaagaagaatatcctgtcatgtataacaacatggatagaaatggaggtcattatgataagtaaaataaaccaggcacagaaagacaaacttcacctgttgtcacttgtgggagctagaaattaaaacaattgaactcatggagatagagagtataatgatggttacggaaggctgtgaagggtagtggtggtggggagggtgcatgattaatgtgtacaaaaaatatagttatacggagtgaataagatctagtatttgatagcgcaacagggtgactacagtcaacaataatttatcatacatttaaaagtaaccagaagagtataattggtatgtttataacacaaagaaagctggaattaacttcttccaaaattttgttaatattgatattttgacctcctctcatgaatcatgaatgttcttgatggcatctagaatggtgaatcctttctaggggttttcaatttacttttcccagatataccagaagaattactatctatgtcagctatagccttataaaacgtatttcttaaataataagacttaaaaattgaagttattccttgacctataggctgaaaaatgcatgttgtattagcaggcataaacacaacatgaacctccttgtacatctctatcagagctcttgggtgactaggtgcattgacaataagcagcaatatttgaaaaggaattttactttctgagcagtaggtctcaacagtgcgcttatactattcggtaaaccattactattagtaaaccagtaaatggatatgctgtcgcccagcctttgttattctatttatagaacacagacagaaaagacttagcatgatacttaaggaccctaggattctcagaatggcaaactattgctggcttcatttaaagtcaccagctggatcagcccctaacaagagagtcaacctgtgctttgaagccaggcattcacttctctctagctatagaaatcctatataacatcttctaatataaagttgttttgtatattatacacattaatgtatacataatacattagcaatagattttacaatagtttaatgtagtcactttcataaatgatcttaggtagatcttttgaatacatttctacagcttctccatcagcacttgctgtttcattttattctgtttttttgagaccgcgtctcactctgttgtccattctggagtacaatggtgcaaccttggctcactgcaacctctggctcccgggttcaagtgattctcctgcctcagcctcctgggtagctggaattacaggcacctgccaccatgcctgggcaattttttgtatttttagtggagaggggattttgccatgttgaccaggctggtcttgaactcctgacctcaggtgatccacccgcctcagcctcccaaagtgctgggattacaggcttgagccaccgtgcctgacccactttatttttttattttatggagatgacttctttccttaaatctcatgaaccaacctctgctagtttccactttttattctgaggcttccttacctctctcagccttcacagaattgaacatggggctttgtgctggattaggtttttgctttagggaatgctgtggctgctttgatcttctatctagatgactcaaaaattttttcatatcagcaatgaggctgttttgctttcttatcatttgtgcgttcactggagtagcatttttaattttctccaaaaattttccctttgcattcaccacctggttgtttggtgcaagagacctagctatcaacctatcttggctttcaacacgcctttttcactaaatttaatcatttcttgcttttgactgaaagtgagagatatgtgactcttgcttttacttaaatacttagaggcccttgtagggttattaattagcctaatttcaatatcatttatcttagggaatagggaggctcaaagagagggagggagatagggaaatggtcagtggagcagtcagaacacacacaacatttattaagttcaccatattatctgcgcgtgatttatggtgccccgaaacaattatgatagtaacatcaaagatcactgatcacagatcaccataacaggtataataataataaaaaagctggaaatattgtaagaattaccaaaatgttttattattattattattattattattatacttgaagttttagggtacatgtgcacaatgtgcgggttagttacatatgtatacatgtgccatgctggtgtgctgcacccactaactcgtcatctagcattaggtatacctcccaatgctatctcttccccctccccccaccccacaacagtccccagagtgtgatgttccccttcctgtaccaaaatgttacacaaatacacaaagtaagcacatgctgttggataaatggtgccaataaggcttgtgtgatgctgggttgccaaaaaccttcaatttgtgaaaaacacattatctatgaagtgcagtaaagtgaagcagaataaaacaagggatgcctggattgttttgctccatccctgcttctctccttagttcattgcccccccctttttttttttaatcaagatgacttgccatcaaagaaagggaagggtatagaaaaagaccaaataatagactttttttcctgggcaaaatatcaaattaaagaggtaaacatctcagagataggattaatctttaggtaatatagcattctatttctatttaaaatctgtagaagaatttcatatttctataaaaacacaaaattccctctcttccctttttaaaatatttatcatgtagttcacatttttttctttgatagaatgtgttttctgtctcctagctattttcttagtgcaatttccagacaattctcctgcatttgcctcttggaaaagacattactaaataacttttttaggaggtatcattctcagaaagtgatattcttacaaattgcacagagtttgacagtaaaattttatttaataagcatgatacagtattattctttaacaatttatcaaagactgtaatgactctagtttcagacatttttttttctgaaatatatgagctttccctaaaaatctggtctactttcctacctcaatattctacttttgctcttggatttgctgatagggcacagaagacttcccgtggggctggaaagagcttattcttccatgtgggttatgcacaccatggggctgtcattactattactaccaggagactccttaaacactgaggatatatgacagttttcacttggttcaaaaaaaatgatgagttcatgtcctttgtagggacatggatgaaactggaaatcatcattctcagtaaactattgcaagaccaaaaaaccaaacaccgcatattctcactcataggtgggaattgaacaatgagaacacatggacacaggaaggggaatatcacactctggggactgttgtggggtggagggaggggggagggatagcattgggagatatacctaatgatagatgatgagttagtgggtgcagcgcaccagcatgtcacatgtatacatatgttactaacctgcacattgtgcacatgtaccctaaaacttaaagtataataaaaaaaaatctgccagtttctcactaagagttttctcactattaagttttaactcacagatggaattctggttccttttgtccattaactcttcagatattattgcttctaccttggcagtggagtctactgtgattgcttttatgttatatacatggctgataagggggctctgggtgcagttgtaagtaccattgtcacctttccaccctaagtatttgctctgggtgcagttctaaatcctactgtcacctttctaccctaaatatttcattaagcaaacaccttgcagctgtattaatattattacaattttcagtcttttccatttttagacaatgtctaaaaactgtggacaaaacccacagttttaaaatcttaatttatccagggaaggggggccaaaagcacttgcaggagatgaccaggaattaacacagaggaaaacattaaacaggtactgatcagttctatttctaaaatctgtgattaaaaatcagtagcatacccattgaggagaacaataagcattttcattcctaattttgataggattttgaattggactcttccttcctttgtctaacattttagaaaatgcatttcatacagtgaaattgcccccagtactagattttattattttaatctgatttctcataatggaatctgtatatatttcaaaatatgtgttgtaaccttagtcaatgtattataaacttgatatttttgagcaatatggtgatgaaaaacaaggcaatttaatggtctgatgattcagacttgaaggagttgagagtgaacattctataatacaatattcttaaactcaagaccataattaaattatcaattctagatatattttcttcttctaggtatatatctcagaaaaaatataactttgactttcataggagattttattgctctatatctatctgaaagcatgtaattctttagcattacacagctccattagagataaggaggagcatgcaaggcagcgatttgagaacaatagacataacccaataggcttggtagtacgatgtgcttcaatttggatcatgaaaagcattgtagagattattgagtttaacctccacctccaccttttaaagttctttgcaatgtttataacagacgtgcagaagcaaactagaatgatcagaagaaaaaactgataattttaactcccctttttttctttgtagttagtcaaaatattagggcatataaaactaaaaatataccttgataacgctccagttttcaaatgttatttctcttcatgattaaggatggtaatcagaatgaaccttattttccagatgcttctttaagcacactatgtgaagtttctgttgttattaggcagaaagtggcatagatatttctgtgggaatattaatactatgatcaaatcaataacatctgagttgtccccacatactggatattttaagtaaacatttatttattcaacaaatacttactgagtgtcagctatgtagcatgtgctgtctaaattctagataaataagagaaactaaatctctgtcctcatgtccatatatccttgaaggtgtggcaggaaataaataagtgtagactgtaatagatagctataaatgctgcaacagaaaataaaatagaatgagaggacagtgagtgatggaagatgctatttcagatcaattaatgagggaagttctttctgagatgcaccttttgagtagaggtgtaaaatagagaagaagtcatgtgactatttgggataaaagtattcagagaagaaggcacagcaggtccaaggtctcagagactgaaatgtgcaagggaaccagaatggcaggagaggtgtggacagggagacagtggtagaaaatgaggtgagagaagcagccaaaggtcaactgatcaaaagcttctgggtcaggatcacaagacacatacagcttaaactgccttggcctcttttgattcctattaactgtttagaaaaacacattctagttaaattcaaatctttccctactcgaagcacgaactgtgttaacctaaacttgtagaaaaatggaaacattatttttaccaatctcactgtaacttcacgaccacaagcctcaggtgaatggaatgaagaagtttgtcataggtctgtaaggatgagacacattacaaatccaggtaaagatgtagaactagataaaatgtaaggaatgtggggtgggaaatgtgggctgatggtaaaaattagggattcattaatgtacaaatagtatgtgaaggaataagcatgggtagaaagaagtccaaaaactgagccatcggggatcaacatttacagtgtggacagaaggagaggatgcagcaaagggggctaataaagagtgatgggtaaggtatgaagaaaatcagtgggcctgggtatctcagaagtcaagtgaagactttttcaaataatagagtggagtgattaaccatgccaaatactgctaagggttgagtaagaagggattaattattacgtttggcaatgtgaaggtgttcagtggggaaagtctaattgggataggttcaaatagatatggggagtaaaaaggtgaagtttgcaaatttgaacaactttttaaaggagtgctataagaggaataaaaaatagagtggtagttagaacaatatatggaatctagggaggtcttatttttaacagaaaatattatagcatgattgtatcaaaatagtaaaatccagtagagagtgagggaaaaaaactgataatgagagaaagggtataatttcaaaagtaagttctttgagtaggtgagaagaggttaaatccagtgccaaaattgagaagttggcagtaggtaggatctcaaataagttacctttacaactggaaagagagtagaatacaaatgagtacaatgggagtgggtaggtagaaaagataatagaagttcatggaagttctttttggattgcttctcttctatttatgaaatatgctgatgaaaagagtcaaactctgtgaaatatttgaagagatttattctgagccaaatatgagtgaccaatggccagtgacacagccccaggagatcctgtaaacatgtgcccaaggtggttgggttacagattgattttatacattttagggaggcataggacatcagttaatatatgtaagatgtgcattagtttggtctgggaatggggcacaacaggaaacaggggcttccagatcataagtggattcaaagattttcttattggcaatttgttgaaagagttatcatctaaagagctggaatcagtagaaaggaattttggggttaagaaaaggggttgcagagaccaaggttttatcatacagatgaagcctccaggtaataggcttcagagcccttatcaggactaaagaggtgccaggctgttagttaattctcccctggaccagggaaaagacctggaaaggaatgggtattctctacagaatataaaattttttctccataaaagacagttttgcagagccatttatattttagggtaaaatacttcaacgtctttcagagctttctatctgtcatgtaacgctatactagagtcagcctggaatttgttgtcttattgctgcaaaaagtctgttttcttcagtcttaatgtctctgttttaatgtttatgctggtcatctgtgtctgaattccaaagaaaggaggatataatgacatatatcctacccctgcttccatcatgacctgaaccagttttttaggttaattttggaatgcccttggctgaagggagcatccttcagttggttggagggcttagaattttatttttggcttacaaataagagaaaaggtggtaagtacttgagggaaaggagaaaggaaggtatgttggaggtttgagcagaaagaaggtgtgaataatcatctggcatcatgggaaaataaatgaaataagaaaatgcagcatgtttgccagagttttttgacttactttcataactttaaagtcagggtgtagaaggatttggaaatttgcataatgaagacaaaaaacaggaagaatggttcagatgaaaagaaccaaccagatatttgatagctggtatttttcagaaaagcaaaataaacagtggtctacaagtggtgatatggagtaaggagctaatctacatcacctctaagatcagaggcttatgtgttttaggagatgaaatagtctacccatgacagggctggagaagaacaagtgagaacattattttttgtttttttgtgtgtgtgatttttgttttttgttttttttttttgagagggagtcttgctctgtcacccaggctggagtgcagtggcctgatctcagctcacagcaagctccacctcccatgttcacgccattctcctgcctcagcctcccaagtagctgggactacaggcacccgccaccacacctcggtaagtttttgtatttttagtagagacggggtttcaccatgctagccaggatggtctcgacctcctgaccttgtgatccaccagcctcggcctcccaaagtgttgggattacagagagcatattttataattaacatataaatatcaggctatcacaagtgaggatacccacattagaacaaattaaaaatttgtatatgcatatcaaaatttatgcctcgttaacctagagtacaggtgtcaaatgataataaatagtgtttagttttaatttttcattctgatattttatcactgacattaagatggcagcttgatttcctataattgatattttgctatcaagagatgagacagtgttataatttacttgatcttaaggttttcttattgaatccttcctcccatctcctggagtgtagaaaacaatataatggagttttattcaggtggctaaatagaactctccagtgatcgccttttctttaccctaggaacaccaaattgaacaactcaactatctatgcaagaaagaacctttgttagaacccaaaaatctactgtttctttcatttttagtggtcagtgtaagcttcacaaatgtcagaaacatatatggcatgctcttttctatagtctttgtatcttccaaaacgtctggctgataggaattgctattatttgctaaattaatgaatcaagtttgtattattcctattacttcatgttctttctttaatgagattgtaaggttcttaaggagagggagatgcttttatatatgtgtatatatatgtaaaatacattatatatatatgtgactaaataaattaatgagttctggtgtcactttccatgtcaagtcataaaaatcatcaaacagaagcgctaagaatattccacaatttttacttgttttcctttagtctgatattactactcaccctttcctcttaggcattacgtatttgtgcatgctgatgatgttttaaaaataacaaacaaataaaatattttattggtttgttcttcccttaagtcattactgtagtctctctccctcttacattttgaaagagcaaactacatggctgtctctattttcttaacttcatccttcaatgcgtaataatccacatcaatccttactgttctgaaattgcttttgctgaaagcactaatatcttcttaattgcaaatccaaagtccattctcagtgttatttatgtttgctttctcatcagcctctgacatagtagagcactgcctgtagacttccttctttctagaccaggatgtctcctggacctcattcggctttaaaaactatcaagctgttatttcatcaaattcttctctatttcttttaatttgctcatgtaattctaggtggtttccttgactaaaataatccacttttttttttcaactaccaccttgcattctgaagagttatacctatcacctccagctccatatgtccaaatattgctattgaataactgcattagatacactacatgaaccttcaacttggcatgtcagaatgagaagttactatcaccacacagatatctatgttggctgctggaaagggtatatatctagtcccccctatctagaagccttcccctctttcacacccaacaatcaatgtactgtcaggtgatgcttattttaccttagaggtatctatacatacaggattcttgttttccacctttacttctgttctgttgtccgtagcatcttttgcaataatcttctaaatgatctctatcctggtaatttctgcccactccagctcatcctttattctatcaccagaattacaatgccaaaacccaagacagaggtgtttgcttccgtgatttatacctctgttgatctccattatataaggtatgaacagaactgattctggaacactaagccttttaagaatatgttttcaagctattattttagtcctatctcttgttattccggactgactttccactagaaccctatactgcacttgcgttaatgtctattatgtcccagacttaggctttttcgtgagtctgaaattgttcacgcttccttctccccaaagtaagcatgttcttttcctcatttattcattggttgattcaacacaaatattattggatgacactatgcaggtatttttcctcgaaccgaatttatgatatagaaggtaggggaggaagatattaaacaatcactataatgaatgcaaaatttaaatcagagataagtactttgaaagaaaataatatgacaccataagaaagtctgtaaaaagtttttgatcaatcctgggaggaggagatggtagtcagaaaggattaaaataggagaaataaatggaaattaactaggtaagaaatggaggaatgggcattcctgaaaaagggaacagagggaaaacttgtgtggatggaacacagagataaggtggggaaggtggcgggcactgaagttgaactcgtaggcatagcacaggcatagacacagagtacaagtgtctaggttaaaaatattgatattaatcctaacatcagtggatgccttcaaaggggagtaagcataggcaggggtatgcattacataatcagatttgactgtattgtagagaacagtttagagagggaggagtgaattaatgcactgagaaacagtagtgtgctgttgcattggtctagtagagagataatggtaacccgaatgatagtggtcagactggagatggtgagaagtggaagattcaaaaaatatttaggaggtaaaaatcaaggagatttcctgatggattggatatgaaaaacaagggagaaggagaaaaattccttcttccttatgtatcaaactagttcttatcttttaagaccgttcacatatcacccatgcagtttagcattttcttactatcccagcagcaataagaagggagctcatgtctttcaggttcctttggcccaatattcagatctctgcacttaaagtaacttccctgctaaaataactgtccgctcaatggataacgggtttcatgaaagcaatgatcatgtttcattctttttttttaatattccaacatctgatatcataccagtcatataatagacgttcaatgaaattgtttattgactggcagaagaaatctaaatgccatagataattaaagccagcattcattaagaattttcaataaaattttcaataaagtaacatttcaacagaaagttaagagctaatatagataacattttttttgtagatatatctgcggaaataggtttgctccattcaaggaaccattaaatctcaattcttagaaaaagtatttttgtatcatgtgtacttttgaaaattaaggaagagtcagtacactctatttaacattgaaattgtgaagaggcagaaggattcaaaaatcatattaagaaaaattttcactcacaatttttagtttttattcattatctcatatttttttccatttctcttctaagagcttttttgttaactgcacaaatgatatattagcaattattctaaaataaaagtttttagaactgcaacagtattcattccactaaaaatgatacatttaaaagtatttcaagaatgcttttggaatactattaaaatataaaaatgaaataaatgaatgaaggaacatttttaagaggcttattttttcaacaatgctgcctacttcctcacaagacagtgccctcctttcccagccattcaaattttctcatctcttcagtgaatctccatgggtgctgcatctagcactcttcatgttcctttccaaaatcagggaagtactgggatgtgtggtgttttactgaaatgaaaatttcagttacatgtcacataaggatgtttcagccaataacagaccatgtttaccacagcagatttatgagattatagtactgtatttttactgaatcttttctgtgtttagatatgttttgttacacagatactactctgtgctacaattttgccaatagtattcaggactagcctaggagcaataagttataccgtatagtctaggtgtgtagtagggtatactatctaggtttgtgtaagtacacttgatattcacccaatggtagaatcacctaacaatgcatttccagaatacgtcctcattgataagcaatacatgactgtatccagatactggctaaaacaaatcaggaatatgaatagaaatggaacatttatactcatatatgagttgaaaacttttatgttttcaactatttgaaatataaatgcatatggacaaggacaagattatatcttgggaaaaggaagttgttaagttagagataatgtttttaatttccacaaatggtttaattttatgtttttttagacaataaaacaaacaagaatacctgaaagataaataagaaaaactgaagtttaaataaattaatttttagaggaaaaaaatcacctatataaaattcacttgtataagtgagaaggcagaaagacaactgaatatttctcaataaaatgtgatgcctgtttgtcatgaactgtaagagcataaatatgaaaaatcaaaaggttgtcttagtatatgtcataatttcttaaaggaatacttagaaaaatagatattttggaatatatgcttgtggagttcaattttaatttgtaggattgtttagactcagagtacatagtatataaattctgatttccaaaatgagttgctatagtaatatgtgaaatagaatcttaaaaacagtctgtataaaagaaataaatttgagttttcttttaaaatatgtaagcattttcatcaacaatgaatgagaattctgtcgctctccatctacaccagcaattagtaccattgtcccacattaaagtcttgggggatacgttccaaggcccccagtggatgcccgtagcctcagatagtattgaaccctttttatgttctatgttttttcctatacatacatacctatgacaaagtttaatttataaattgggcacagtaagagattataacaataatactaaaataaaacaatgatatcaatatactataattgaagttatgtgactgctgtctctcaaaatatcttattgtactgtagatcttagcaaactcagtgcaaaatatttttcctttcttattaagtcaagtacttaatattttcatttcaacaaagcacatcatggcttccctttggcatatctgcattgccagtgtcactacttttgtgccttggggccatttttgagtaaaataaggttacttgaacacaagcactgtgatattgtgagagtcaatctgaaaatcaagatggcaactaagtgactaacaggcagattgtgtatacagtgtggatacagtggacaaaaggatgattaaggacacaggaaggcaggtgcgaaattttatcatgctactcagaatgggatgcaatttaaaacttatagtttatttccagaattttctatttaatattttctgatctctgaaacagtgaaaagtgaaaccgtggataaggaggaagtactgtatcgtaaatttttccaatcatagctattctatgaggtgtgtagttgtatctcattgttttagtttggatttcctacagaatagtgatagtgagcagttaaaaatctgcttatctatcatatgcatatcttctttttgaggtctctgttaaaatattttgcctctttttaaattcagttgtttccttattgttcaattttgtcttttttttgtatattttggatatgagagtcatttgtatattttggatagatgtcctttattagatatgtatttttaaaatatttcctctcagtctgttacttgttttattattctcctaagtgtcttctgcagaacagactttgtaaatttaaaagactaacatcaagtttttctttcatgcttttggtgtatataaaaactcatcaccaagcctaaggccatgtgggttttctcctatgttttcctctcaaaggtttgtagttttgcattttacatttaaatctattaccaattttgagttaatttttgtttaaagtgtagacttgtaagttttttacttgagtaacaacacagaataataacatttataaaatggggaaaaagcagtttggggattggaggtgggaatacagtttagatatggacatgttaatatttgaagcccctacttgacaaacatatggttaagtaggaagttggatacaaagagtttaattctgatatttccacataccaacactatcaggaagtccaggagtctgatttataacttcaccagcaccttgaactctgtatttccccacctccctttccttcccctacaggcttccaatccccattttatgttttcgggcgttcgttattacttacaataatcttcaaagtatgtgtagggttggaatccattatgactaagtcctattttggtgcttagtctgtgacagagaagctttggctggttgaagaaatttgaccttggtgtgtcctattcaaagtataaaataaggctgggcagtggttcacatctgtaattctagcacattgggaggctgaggtgggaggattgtttgatgccaggagttggaggctgcagtgagctaaaattgcactactgcatttgccaggtgacttggagctaaaattttttcgactccagtgagacttgctgacataaaaagagaaaatatgctttaagcacctagtgcttatgcatggcacatagtagacactcattaaatgaatggttctttctctttccccatagatgggacagtgtgcaccaaacatctgaagaccagttgcttaagtgaaaaagaatgacctgatgtatttcagatcaatattatgcatataataaaaactatgaaatgctaaaagcttagctgcaaagataaaatgcaagaagcttgctggtgaggttgtggtagcaactgaatatatgagaatagattggtacaatcactggatttctataactcagttaagagttggaagtaaagtgtaattctgtttctgtttatgtattaaagtagaaggataatatgtttaattaataaattaacaatagatattggtatacttatagaaatggattgtcacagtttctatctttgagggattaattggaacaaaaatgtactttaactatgaattacctagctccagagatatctattagtagaaaaagattgacaatgaaaagataaatttctatttactacacagcgaaataaatgttttatgttaagagctcatctcatgcatccctgtggcttcagttttcttcaatatctgccactctcagttttatttccagctggaatctattttctgagctccacaactaaatggctgtgtaccaactggacatctctttttgaattattcacaggcatcttaaattcagtctgtgtaaaactgaactggtgaaattgctctttagacctgctcctctagtgtttcccatcttagcaaattgcacaattatttccatccaattactccagctgggaacatacaagatatcactgacttttccctctcttttatttcgatcaattacttcaaattcttattatggcctccaaggctctgcataaaatatccctttctcactttaacgattacagtagactgaaccattataacaaagaaatctcccaaaaagtaagggttcaaacagtagaaatatatttcttgatcttataaaagttcagggtagatgtttcggataaacaagtgcttggctccacactgggacacaagctgatgagatctgcaatctctaatacttagtttccaaggtcattctgagcatggcccaacaatcatcctgaaagagaaagagcataaataagcatgcatggatattttttatgagtgaagcaaggaagtggaacatatttctattctcactacaatggaaagaacttagttacaaagcacacttcattgcaaggaaggctgggaaatgtaatgcatttgggcagccatatttccagcaactatggaagatgaggaaaagaactttggtgaatcattggcggtcccagcaacatttgttgttctttccttctttattctttgtgatccaggtatatcggattttagtctttgattgctctttccatccctaaggactttgtacatgtcattctcttggctcatatgcccttcatctccttcttgattcagctgacaattattattcagaattaagaatgttttacattcctgtggaaagttgttgtcttctttgtaatacttggaaaagctgcaataaattattcaatgactgtttgtcatgctagactgtaagattgaggagtaaaggaactctctgttttgttctttattatattcccaatatctggcacatagcaggatgtttagtaaatatttcttgaactcacagaaagatggatgaatggatgcctggataagtgcaaaaatagataagtttatagatgaatgggaaataagctgatataaccccactctgaaacctttagtttgttaaagaaataattatttaatgacacttgttaagcacgataaggaagtctttattataaaccatcatggtaagtacagggaccactgaaatgggattttgcagtgagggagggagattgggctcaactcttaataaaggatgggcaagtgggaatttattgccaagttgcaaggtgggggtcagtggataaaacatgactaagaggaagcatcaggggtaaagggggttctggctaaattgacctagaaagattcttgctgaaggtaggctagggtgatcaaacatcacttatgagatggtggaggatgagtaaccccagtggataccaaggatgagcagatattgggggtaggggattcttgctaaacatagttagcaaggtatttgctaaaactggattttacaaggaagtgcacagatgaacctaggagaagtttcaagagtctgaataaattttaccaatcagatactttgtatcaagttttctccatgaaggatttgtgcaaaagtagggtaggtgtttgcaaaaagaaaattcgagaagattggtacaaatttgggtagctacaaagaaaaatgataaagagagacaaatgagaaaaagaaaaagtattgttcaacaatgtggaacactcaattgcggttggaaaccacagctttgtagtgaaaactattatattttttttcttgcattcaatttcagagaaaatgcattttggaaataataatggttaataatgcacacagtacattgatccagatatgagcttagcatttaaaatgcagtttttcatgtatattttcaaaacttttttatagatgagaaaactgaaggtcagaaagtacaagtaaatggcataaggagtaaatgacattagcaatcagagaagctctgatttgtacccaagtctgtaatacttcaaaggacagagattgacaaaacaggccttgaagaagtgtgaataacaggaaattaacagtactgtgttaatgtccacacagtgctggttcctagggtcagttgattcaagaaggtgtaatgtttcatcaagatttagtgggatgagatagtagtagacatgtaaagagaggggattgtgctgtgagaattatattttcaaattttggataagaaaatgaattttggaagatgacaaggcctggaatatagacctcaaaagtgttttgttcgaggggaatgggaaagaagtttgtcagatggcagcccacatggacgctgtctttcagaatagtgacaggaattggtggaaggaaagattacaatccagataccaaagccctcactaattgtggcataagggagtagaggtgagttgacgacagtgatgaagataaagagcacagagtatagttcaatttttagggactcaagtatggaggactttttggatgagcatcaagtataatgagaatgaaactgcagtgggtaaacaagagaaagatgaacgtacctcctcacttaaaaatacagagaattaaagcttcttttgaggcttttttgagcaaaatggtattattagaggagaaaaaggttacagttagggtgaagaagtaaaggggaatagtcaagatgttgcatattacaaagaagtttctttgaaataggatgggtttctatgtagttacagtaaagaggtagaagtggaattagatagagaatgataagtctgagaaggagaagatataaattagatggaagagtttgcaatgtgggttttagatcaagggcactagaaagtcaaggaatacagaggaagatgggaagtacttgaaagaaactaactagcctcagggttccagctggggctttgatggcaagttgttttgttgctgccgcaaactcagaccaaagcattctggggaaacttaagaataggaggtggattgccaattaatatctagggctacaagagtgagaagaaatgactaaaaatacaaattaaagttcatataagtggaacaaattttaaagaggaatgggaattttgaggaaaaagtgagaaaaatgtataactctttatttataagtacatattttgcgttatgcactgggtttgtagtgaccaagacagtcttaacatgtcccttagcttgattaaactttagacagtcttcctctggcctttaaggcctgatctccctctgactccctccccctaaagaatccagatggcccagtcacaggagttcctctcctccctttataaagagtatttatttcagataccttataattgcaaattcttcttgtttgctacttgaaatgtaaatttttaaacatctcttatcagttttactacccaccaggcgtatctttctcaaggacctagagctattcctttgaaatgttatcattagggaaaatagtgaccctgtctctcagtctctgtgggagagtaagtgcttaacttcagtggtcacttggctgtaagttgtaaaactatctgctgtcatgaagataagagaaggtttgctttttctttgtgaggccaattagcagacacaggtagcctatgttaccccctttcaccccaatgcttaaaaatcctcccaccctgtatttcagtagagttgagcacagattgatttctggcctctctctcttattgcaattgacttgaataaagtcttccttacctgtttgactttggtgcagcttttgctttgacagtaacttataatgagtttatttttcatttccctaaagaaaaatgtttcatcctgacctccagggcaccatttggtgctggctgatggtggtgtggcagctggagatgtagcataatgatccaaaattgggcccttgtaaaaaaccaaagcacgtacttctaaaatagaatcaattacttatttacttatgtctgctcattataccccagatataaaccccaagggggcagcagtatatcatgaattagagcataagtttttcatcaaagatcaaaactgagttttcatctttcccttgctatttatgtaacttaggtgggttatagacctctttaagcttcagtttactcatttgcaaaatatgaatataatacactatgatattacatataacatataacttaagaacctggttattgcacaaattaaataatatgtgtaaagcacttagcacagcataacagatagttttcacagtttttctttttataagtaatattgttgttattactattatttctttaaagacagggttcatatctgtctaatagtatctactcacctgctcacaaatatttaatgattaaattatttttcaaataatacctagtacatatatacattatctaaatggaagcaaacatatgggatggaaattaacgtctgttgttgaagattgtcttagtagcagttatggtctataaaatatctaaatcacagtttcaagcatgtgttctgagacaaaaatttcaagcagaagcttcctaatgaccacatccagtccccactgagcacacctttaatatattttataatatatattatgccaacatttgctttgtgaacagggtaaagacagtcacagtcaagaattggctaaaatactgatttgtcatttatggaaaagtacaaaggtgagggtgactttcagaggaaataaggcattattagtggtgccgtctggcaaatacaagagaatttctcagagacccacttggaagaaagttcaatcatggcattggatgactcagtgaaaggtggaaggccaatactggtagttcaaatgaaaacatctactgctcttaactttgtaaatattctgtttcattcttaaaagcctagggaaataataattctatacctacttttcctgtttttctgtgaaaatagtttctataaattttaacgggcttagaaacttttctctgaatgatcaaatgtcctaagctatttcaaatcatatttaccctgcccttggacaggcaacaggttactttggaaaaattgagtctttagagaaatgacagaaaagacttttttttcttttatggggtagatcctgagacttctgagcatctataattccttatgataaatatgctattatttctatttctctagagaactcagactgatacatgttctaagtataaaccttggttgatgatctgttcatttcactagtcatgtatttctttactgctctgcttaaacaactggaagctggcttgaacagctagttttttcaaaagtaatttgttattatacatatttgcacagaaagaaaaagtttgaaaaattatcaagagagagctaagtcacttcaggagccacacttatcatgacatgtgatataattacagaaaataaaatacttgattgaagtacttgatgtgggggtagtatactatcaacaatatcaaacttaccttttcttcacttgtgataaatattaaccatctcttgctacatttctttgtattagctctgaaatgaaaagtcatttgaaaaggtattgcaaattcaagttaatgaaaaagatattgaaaatataatttatatgtgcatgagctgctgataattaaaataacaccttattaccaaacacattcttttttttcccttcttaccaaacacattcctttttttccactaacagaaatttaatctaaaaataagtgctttcttctacttttatttactaaagtacttcacagtcttccgtcatcctaatgtcatcttgcctgatgctatttcccctatattattacatttgtcttctcccaggtgtggcatcagtactgatttgctacccaacagccattccctgtcctattctaattgctcatttatatcaatatatttatatctatctatctatatatacatatatatacatatatacatatatatacacatatatacatatatatactatatatatatacacacacacattatatatatatatatatatataatgtgtgtgtgtatatatatatatatcttcttttgcagcctgttttgaagttaccagtgctcaggtgactagtttcagccaagggatataagaaaaagtctgctattgaacatctggccaagatattttttcttcctgataaaggaagagaaatagaaaccaagttttctctttatactttgagctgactccgtaatatagcaacaaaaggtgacgtgcctaaggatgaaaaccaacagctggggatagaaccataaaaaaaaaaaagaaaagaaactggactcttgatgacaatgttgaatcttcaaaccaaccttaggaccagatacatatgggttttctttttcttgaagccgaatgcactgaatcacaagcacttttgtttctcctttctgagagatctgggtattatataaaaatctctgactcaagagatccctctcttgtgtttgaaatattgctgtccactctggattctcagggcatgctctgatgagggccagccgttatcctggctctgcaccccaagcatttggcaagtgctactcaggaagtacccatgagtgatggctcaatgaaagggtgttcgaatgttgacaaccagcaggatccactggactcttccaccggatgaaataataataaataacccaaagcgagcagctcagatgggctagaacactgcctaaaattatcctaaaatcccctgaactagaaagcaaaaaaaaattagctagtgaagagagcacgggagagtcaagtgagtccatgcgtgttgggtctgaggacaaggggcaacagaacagcacacagggtggagaacactcacagccaaaagacatggggaggctctaatttcttaggaagcacgttgcttctcaagtctcagggcggccagtggatcttggtgatttgagtatcatggtgaccatggcaccacagctcagtgctgggtggaagtcgtgccctatgtgcctagtgtctcccttatgcgattgcgtccacacattggagatcctcaggtctgaggtgctccctctgacaccaaaatcactgcccagaacagcatctgttgtggtagtgagaagtgcacactcgacaaatggacaaagatttctattttttaaaaaagatttctctttgttaaaaaatatttctctggaatgaatataagaaattaacagcggtgctcatttgcttgggcaggggaggaaaacagggaacagggttgagcgcagaccactgtgcacctttttaaactgcaaaattttaaaacatcatgaatacgatgcccattcaaaagtaagtaagtttgaagtaactgaagtggaagcaacactgagtgcctgggcagggagtgctggtgtctggtgaggaaggaggagagtacagagaggtgagccctcagagtcccatgcagtctgctgtagaccaagctcagaagcagaactgacctgacccacagctcaccggggagcagaatggccatgaccaacaactgagactggggaaatactcagaataagcaaaagggaaaatgtggaggatgtgccatgccaggtccaaaactgatatacggaatgttttcaactatgaaacgaattaatgccagaatattgtgtttcctaatcactctcattctattatttggctcacaatcaaacttggtagtgctttaaacatagatttgttagtaacgatgaaaaatgagataagcagcatgtggtaataagaaagattacttgggtgtatccagacaacagaggaattcaaaataaacaacataatgagagacttcatcatttctaaggaaacaaagctttgatttttaagattctttcttttgtttaatcatttgaatagaaaaatatagtgcttgaaatttctgaaaattttaaatgttcagttagttacactgagacaatatttctctcatgcaatctgtgaatgctgcaaatcatcaagataaaaagcttataaatacttattcctaagagggctttgtatattaatcctcatctttggaaaacaaccagggaaggaccaggctaagcagaaaagcaggggccagcacaccaccaccctcctgcagggagcacacagagagagcctcctacaggctggagcttgaggtctagagggaggcggtggccagtgtgacacgcactgtccaccatgggggcagggtccatgcaagcactaaaggtggcaggcctggagcagctgagtcccacagggcacctagaggcttgggggagggtgcaggcttgctcaggtcatgaagtcaagtcctttttcaacccttgtgctctccactggggaagagacttgcagaggcatctggacctggctctacaggggcatgggtggcacggttaggctactatactagctctggccaaaaacactagaaacaaatgaaccagcacaggcagaaatgtgacagaagaccatgctggggacctggtcaccactttcaaactctcccaagtgatcaagagatcacttactaggacctcactgttaagagtaaaaagagctaattttacgagaataattagaaaaatcagaagtaaataatgcttaaacagaacctaaaactgtaacaagaccactgggtttttagattggcttttggtctcgacacaaattaagtggatgttattgcttagagaacttgcagtggcctcagttggccttctgcaagcaaattcttcttggagaaagtaggcttttccacaaatttgtcttttagcaatattctaacaaactgcactaaaattgccttgcacaaactatcacaactccacaacaatgcagccttacaatgggccagacactacacatcagtgcttcaaagatgtgtgtccttttgatccagcaattatgtctaggaatttatctgaggaagtaaccagggaagcaaaaatatgcatgttcacagatgctcatcacagtgtcactttgaggaccaaagtggaaactgaaaactgtaggataattcaagagatgatgctttaacctctctatcttacttcctcccctggattccttaagaaaagaaaaacagcaatttctcataagaaaaatatatacaaaaaccctactgatatgggaagatgcccccttcatgtgaggtgtgcatcatagtctaccacagtgtaccattatagctccttcttttgttatgagcaaaattagcatggctggccacagaggaaacatatggaagagcccacacagttggtgatgtgtttattgtcttttggtggaaggaatacaggtcatctttattttctttacattttctacattttcagaacttttgcaaatagtgtatataaaccagaaatgaaaataaacgaaataaaacaaaacaaggtatgtatgtgcaaatgtattctaaatgttatgaggtcccaattccactgatgaggattcctagggtaagaaagctcctagggagggagagctagcaagatggccaaataggaacagctgcagtctgcagctctcagtgagatcaatgcagaaggtgggtgaattctgcatttccaactgaggtacccagctcatctcattgggactggttagacagtgggtgcagcccacagaaagcaagacaaagcagggtggggcattgcctcagccaggaagcagaaggggtcagggagctccctcctctagcaaagggaagccatgaaggactgtgcagtgagtaatggtgcattccggcccagatactatgcttttcccattgtcttcacaacccgcagaccaggagattccctcaggtgcctacaccaccagggccctgggtttcaagactaaaactgggtggccgtttgggcagatgccaaattagctgcagtttgtttttttgtttttgttttttttttttttcatatcccagtggctcctggaacaccagcaagacagaaccatttactcccctggaaagggggcttaagccagggagccaagtggtctagctcagtggatcccaccctcctggagtccagcaaactcagatccactggctggaaattctcgctgccagcagagcaggctgaagtcgacctgaatgctagagcttggtggtggggagggggcagttgtccaccattactgaggcttgagtaggcagtttccctctcacagtgtaaacacagccgctgggaagttcgaacttggggagcccaacacagtttggcaaagccgctgtagccagtctgcctctctagattcctcctctatgggcaggccatgtctgaaagaaaggcagcagccccagtcaggggctaatagataaaacccccatctccctggaacagagaacccgggggaaggggcagctgtgggcacagcttcagcagacttaaacattcctgcctgctggctctgaagagagcagcagatcacccagaacaacactcgagctctgctaagaaacagactgcctcctcaactgggtccctgacccctgtgctgcctgactgggaaatatctcccagcaggggtcgacagacacctcatacaggagggctccagctggcacatggcggctgcccctctgggatgaagcttccagaggaaggaacaggcagcaatccttgctgttctgcagccagtgctggtgatacccaggaaaacagggtctggaggagacctccagcaaactccagcagacctgcagcagaggggccttactgttagaaggaaaactagcaaacagaaaggaatagcatcaacatcagcaaaaacgacatccacacaaaaaacccatccgaaggtcaccaacatcaaagaagaaatgtagataaatccacgaagatgaggacaaaaccagcacaaaaaggctgaaaattccgaaaacaagaatgcctcttccccacaactcctcagcagcaagggaacaaaactggacaaagaatgagtttgatgaactgatagaagtaggcttcggaaggtgggtaataacaaactccttcgaggtaaaggagcatgttctaacccaatggaaggaagctaaaaaactcgaaaaaagtttagaggaattgctaactaaattaaccagtttggagaagaatataaatgacctgatggagctgaaaaacacagcacgagaacttcatgaagcatacacaagtatcaatagccaaatcgatcaaggggaagaaaggatatctgaaattgcagatcaacttaatgaaataaagagtgtgaacaagattagagaacaaaagaatgaaaaggaacaaacaaagccttcaagaaatatgggactgtgtgaaaagaccaaagctaggtttgattggtgtacctgaaagtgatggggagaatggaaccaagttggaaaacactcttcaggatatcatccaggataacttccccaacatagcaagacaggccaacattcaaatttaggaaatacagagaacaccacaaagatacttctcaagaacagcaaccgccaagacacatattcgtcagattcatcaaggttgaaatgaaggaaaaaatgttaagggcagccagagagaaaggtcaggttactaacaaagggaagttcatcagactaacagcagatctatctgcagaaaccctacaagccagaagagagtggaggccaatattcaacattcttaaagaaaagaattttcaacctagaatttcatatccagccaaagtaagcttcataagcgaaggagaaataacatcctttacaaacaaacaaatgctgagagattttgtcactaccaggcctaccttacaagagctcctgaaggaagcactaaatatggaaaggaaaaactggtagcagccatgcaaaaacataccaaactgtaaagaccattgacgctatgaagaaactgcatcaactaatggccaaaatagccagctagcgtcatgatgacaggatcaaattcacacataacaatattagacttaaaggcaaatgggctaaatgccccaattaaaagacacagactggtaaattggataaagtgtcaagaccatcggtgtcctgtattcaagagacccatctcatgtgcagagacacacataggctcaaaataaagggatggaggaatatttaccaagtaaatagaacacacaaaaaaagaaggggttgcaatcctagtctctgataaaacagactttaaaccagcaaagatccaaaaagacaaagaagggcattacataatggtaaaataatcaatgcaacaagaagagttaactatcctaaatatatatgcacccaatacaggagcacccagattcataaagcaagttcttagagaccttcaaagagacttagactcccacacaataatagtaggagactttaacaccccactgtcaatattagaaagatcaacgagacagaaaattaacaagaatattcaggacttgaactcagctgtggaccaagtgcacctagtagacatctacagaactctccacaccaaatcaacagaatatacattcttctcagcaccacattacacttattttaaagttgaccacataattgaaagtgaaacactcttcagcaaatgaaaaagaatggaaagcataacaaacagtccatcatatcacagtgcaatcaaattagaactcaagattaagacactcactcaaaaatgcacaactacatggaaactgtacaatctgctcctgaatgactgctggataaataacaaaattaagacagaaataaataagttctttgaaaccaatgagaacaaagacacaatgtaccagaatttctgggacatagctaaaatggtatttagaggaaaatttatagcactaaatgcccacaagagaaagcgggaaagatctaaaatcaacaccctaacataacaattaaaaggactagagaagcaagaacaaagtcaaaagctagcagaaaacaagaaataactaagatcagaacagaactgaaggagatagagacatgaaaaccccttcagaaaaatcaatgaatccaggaactagttttttgaaaagattatcaaaatagatagaccactagccacactaacaaagaagaaaagagagaagaatcaaattgacacaataaaaaatgataaaggggatatcacctctgatctcacagaaatacaaactaccatcagagaatataataaacacctctatgcaaataaactagaaaatctagaagaaatgaataaattcctggacacatacaccgtcccaagactaacccaggaagaagttgaatccctgaatagaccaataataagttctgaaatggagtaagtaattaatagcctaccaatcaaaaaaagcccaggaccaggtggattcacagctgaattctacgtacaaagaggagctggtaccattccttctgaagctattccaaataataggaaaagagggactcctcactaactcgtttatggggccagcatcatcctgttaccaaaacctggcagagacacaacaaaaaaagaatatttcaggccaatatccctgatgaacattgatgcgaaaatccttaataaaatactggcaaaccaaatccaacagcacatcaaaaagcttatccactgtgatcaagtcagcttcatccctgggatgcaaggctggttcaacataggcaaatcaataaacgtaatccatcacataaacagaaccagtgacaaaaactatatgattatctcaatagatgcagtaaaggtctttgataaaattcaacatcccttcatgctaaaaactctcagtaaactaggtattgatggaacatatctcaagataataagagctatttatgacaaacccacagccaatatcatactgaatgggcaaaagctggaagcattccctttgaaaaccagcacaagacaaggatgccctctctcaccactcctattcaacatagtgttggcagttctggccagggcaatcaggcaagagaaagaaataaaatgtattcaaataggaagtcaaattatctctgtttgcagatgacatgattgtatatttagaaaaccccatcgtctctgcccaaaatctccttaagctgataagtgacttcagcaaagtctcaggatacaaaatcaatgtgcaaaaatcacaagcattcctatacaccaataagagacaaacagagagcaaaatcatgagtgaactcccactcacaattgctacaaagagaatgaaatacctaggaatacaacttacaagggatgagaaggacctcttcaaggagaactacaaacaactgctcaaggcaataagagaggacacaaacagaaaaaaattccatgcttatggataggaagaatcaatatcatgaaaatagccatactgcacaagtaatttatagattcgatgctatctccatcaagctatcattgactttcttcatagaattagaaaaaaacaactttaaatttcatatggaaccaaaaaagagcccatatagccaaggcaatcctaagcaaaaggaacgaagctggaggcatcacactacctgacttcaaactgtagtacaagcctgcagtagccaaaacagcatggtactggtaccaaaacagatatatagaccaatggaacagaacagagccctcagaaataatgccacacatgtataaccacctgatctttgacaaacctgacaaaaacaagcaatggagaaaggattccctatttaataaatggtgttgggaaaactggctagccatatgcagaaaacagaagctggaccctctccttacaccttatagaaaaattagctcaagatggattaaagacttaaatgttagacctaaaaccataaaaaccctagaagaaaacctaggcaacaccattcaggacataggcatgggcaaagacttcatgactaaaacaccaaaagcaatggcaacaaaagtcaaaattgacaaatgaaatctaattaaactaaagagcttctgcacagcaaaagaaactattatcagcatgaacaggcaaccaatagaatgggagaaaatttttgcaatgtatccatctgacgaagggctaatatccagaatctacaaggaacttatacaaatttacaagaataaaaaaaaaaatcccagcaaaaagtgggcaaaagatatgaacagacacttcacaaaagaagatatttatgcggccaacaatcatatgaaaaaaagctcatcatcactggtcattagagaaatgcaaatcaaaaccacaatgagataccatctcacgccagttagaatggtgatcatgaaaaagtcaggaaaaaacagatgctggataggatgtgaagatataggaacacttttacactgttggtggtaatgtaaattagttcaactattgtggaagacagtgtagtaattcctcaaggatctagaaccagaagtaccatttaactcagcaatcccattactgagtatatacccaaatggatatacatcattctattaagacacatgagcacatatgtttattgcagcactattcacaatagcaaagacttggaaccaacccaaatgcccctcagtgatagactggataaagaaaatgtggcacatatacaccatggaatactatgcagccataacaaagatgagttcatgtcctttgcagggacatggatgaagctggaaaccatcattctcagcaaactaacacaggaacagaaaaccaaataccacatgttctcactcataagtgggagttgaacaaagagaacacatggacacagggaggggaacataacacaccagggcctgtctaggggtgtggggctaggggagggatagatttaggagaaatacctaatatagataatgtgttgatgttgatgggtgcagcaaaccaccatggcacatgtatacctatgtaacaaacctgcacgttctgcacatgtatcccaaaacaaagtattataataatataataataataataataataagctcctagggtgggagtttccatagttaataagaggcttcaatgtgaataaattcacaaatacatcagacttagtacatttatcaacagacttttatttccagacgagctcccttaccttttccaggactgagtctggactacaaagacctttagttgtccattagcttcaattaggagacctgcagaaagtaacaacaacaatattaaatgcaatatataaaagacctacaaagctacagttgttaaaaactatcattatcaaagattctgtaaaataacatcacaaaaagacaaatcactgttatgaaacaactctggcaacaaccaggaggatacccagtcttaggagaaggattgaagctgtggttactcctagtgtgcaaatggtataggttacttggaaatggtgtgactatattattatagagtcagtgtgatcatttaaaatcaagatattaataaaagaaaaaattcttacaatagaatgttgaataaaatgtagcatatatttaacacagagagtattaggcaaacattaagaagaaatcttatcagaattgtcagtctcaccctgctaccacatgaaagccagtgaaaaccttttgttctcttcctattctcagtaaaatgtcagtttccaggagcaggggactgactgtcccattccaaaaggaagtcccagaggctgtctggaagtgcgtgtttagggcacacacatgacagcttgaagttcaagagtgtgcatatgtgcaacacactcaaacacccaaagtcaactgtgtaagacaatttaccttgggcagtgggactgtgaggcaggtatggagtatattaatttgagtataaaagtaaacaaaccaaatacattcaagtacactcttacatagaagaaactggggtaacaaattctgacctcatgatgtgaccccaaatggaagtcagaggtcaggaagagtgagggacatggttacaagtcatgtggtcaaaactcaaagcccaacgaggccactggggaaatttcatggtcttccaaacttcacttttctacagaagatgaagaaagtgagagcttcccatgagctcctgaaccatcagagaatcatatccaggttggcttagaaagaccaccagtgagagatctaacatgttcaaaccattgcggacaacctttgccaagccttgctgtgctgcaggcctttttccagtctgacaagaagggtgtgaaggtgccttcataatgaccatttaggccacctgttacacaaagcaaaggccagccagcatgccaggccatggaggaaagcaaggtgcttgcatgagggccctgcagttttcaggtttgggctttgagagatcaggtctaggtgcttcctgggaagtctctatcacactggcctcagcagggttataggaacacaggctctgcaatgcccaggagcctgtcatttcacacttgggccacacttggaaggcactcttaatgtcaccacacctgacgtagaactagcatggagagctgataaaagtatgctttgggccaggtgcagcggctcatgcctgtaatcccagcactttgggaggccgaggtgggcagatcacgaggtcaggagttgagaccatcctggctatcatggtgaaaccccgtgtctactaaaaatacaaaaaaattagctgggtgtggtggcgggcccctgtagtcccagctactctggagggtgaggcaggagaatggcatgaacctggcaggcggagcttgaagtgaactgagattgcaccactgcactccagcctgggcgatggagcaagactccatctcaaaaaaaaaaataaaataaaataaaaagaaaagtatgctttggtgcaaagataaccatggtgggaacctatgtgaccagtcaccagccatggcccagaggccaagaagtaaaattctgttctgggacccattagtgtgttctagatatgatgagatccaagagttattcattaccagaagaggatgcaagatccaagccagttgtgtaaggccaggagggtaaggccagggaggttaggcctgatgggtaaggccaaggaagatgagaaggccagaggggtaaggtgagatagttaaggaaaagtgagtaggaccaagtgagtaaggtcagttgggtaaggccaagacgttaggccatgtgttcaaaagcaggtgaacaagggcaggtagataaggctaggtgggtaaggcacatatgtaaagccaggtgggtgtggccataagggcaatgctgggtggaggataatgccatcagaataaggacaaaaggagaaggcaaataagttaactacaagaagctaggttcagtgaggaaagccaggagggaaaggccaggaagttagagctaggtaggtaaggtgattgaataatgccaggaggcccagttggtaaaggcaagtggttaacattaggtaggtaagaccaagtgaataagccaggtatgtaaagcctcacagataggaccaggttcctgaataaggccaggaagttaataaggccaggagattacagataggaggtgaggggcagatggataaggtcaaggggaattgcaaagggaggtaaggccagaaggctaaaaaaagtgggtaagggcagcacctaacagcaataagttagcttaagcacaccctgggaatgaccctgtggtctaagaagaatatgtgtccagagtttcgggctaaggaatctgggagtggccaacctgcagattcattccttatctatgagggatatcgaaatccctggcctattccatggaatgcaggccttacagaggactgagaccctttgttctgggttaaatgaaagttgccagaaaatgctatataaatcatgtgctttttacaaatggtaatggttctcctgttcagcccactgccattagattgtcctgcatgtaagtcctttcaataaaccctatgtctcattcactggctccaggtcttttctttggcctttgaaacatgatgccattccttttgaagtcaatatgggtctagcatgatgagtgggtaaacttgtccagcaggataggtggggaaagtctagacgttaagtccaggatgtgatatttagaagtcagggacatgagattacataggacaggggataaaatctcagaggtgaggccaggagctgggacccacggaatatggtcaggagtgtacagttaggaggcacagtgtcagaggtaagtcaggtgggaagttgaggctcgaaggctcagacagctgaatgaagctaagtggtcaataccaggtggatgagggcacatgattaaggccattaggtaaggccatttttatgtcctgccaacgtggacataatctcacataggtcaggttggtaaagctcaggaggttaattgcacatgggtagggccatgtgggtgaggccaggaggtgaagtccagggtgttaggacaaggagataaaggccagctgaataaagaggtggtttacatcaggtggtttaggccaaaatgctaggtgggtatgactatgtaggcaacccaatggctaaggatagtggctaatattgggaagttaaggccaggctgataacaccattaattatggtcataagtttaaggccaggtttttaatggcttgcaggaaaagccaggggaataaggcgagggtggtacaaccagaggtgttagggcaagatgagtatgatcaaggggttatgacaaggtggggagggttagggaggtatggccaagggggtaaggtcaggtgctgagtacaagagattaaggccaggagtttaggactatgtggtcaaggccagatgaatacagctaagtggtcaacaccagtttggtaaagccaggagactaaatctagaaggatatggctaggtgggcgatgccagaagattaatatcatgtgggtaaggccaggttggtaagaccatgagtttaaggataccaagttaaggcagtatgattaagtccatgtgggtaaggtcaggggtgagttcaggtgaataagttcagaaactgaagcccaggtggataacctggaaaataaggccaagtgggaagtacagtttggtaaaccaggtaatgaagttcagaatgtcaaggcaaggatttaaagtgaggagtttaaggctacaactttaaggccaagtgtgtatgcccatgtgggtaagacaggtacaactaagcccaagagtttatgagcagtgggtgaatgctaggtggtctaagtctactgaaaacttaatggttaacatcagatgggtcaggggagtaaagcaggtaggtaagtacaagaggttaacactgggaggttatggccaggaggttgaggccaggtgaatgaagctaggtgattaacaccagataggtaagagcatggcattaaagccaggtagtaaggtaaagacattaattgtagatagtattaaagctagtttagtaaggtaaagaagttaattgtagatatgtaagaccaggtaagtaaggtcagatgggtgaggtcaagatgttaaagctaggaggtcaaagttagatgaatcaggctaggttgttaacaccagattggtaacagcagaagttaaagccaggcaggtaaggccaattgcctgaggccaggtgggtaagagcaggaagttaagattgggtgtttgaggcctggtggttaataaaaccattaagtaaggcaggaggataggtccagcagttaaatgccagtttgctaagatcagcagggtaaggatcagtgtgtaaggccaggtaggtattcctagttgaatacagttaggtggttaacatcaagttgctaagtccaggaggttaaggccaggatggtgatatggcttggctcagtgtccccacccagatctcaccttgaattgtaataatccccacgtgctgtgggagagacactgtggaaggtaattgaatcatgggggtgggtttttcctatgctgttctcgcgatagtgaataattctcatgagatctgctgattatataaaggggagttcccctgcgtatgcgctcttgcctgctgtcatgtaagatgtggctttgctcttccttcaccttctgccatgattgtgaggccttccccagccatgtggaactgtgagtctactaaacctctttcctttataaattacccagtctcgggtatgtctttattagcagcatgagaatagactaatacatatggtaagaccaagtaggtaacctggtgggcaaacacaggttaaggctcgtacggcaagaccagtaggtaacctggcattaatatcacagtcataaccttggaggttaaggatagaatgttcagactgatggttatgactgtgatattaatgccaggtgcgtgactttgtatttaaggacaagcgggtaaggctaagaggttgcaaagagagattatggccataagattaagaccaggtgggaaggccaggtggtgaggttttgtgggtaaggcaagggggctgggatgaggcgtataaggtcaggggggcacagtcaggagtataatcctcatgtataaaccaggttggcaaggctagaaggttaatggcagatgtgtaaggccaggtgggtatagccaggggtgaaggcctgggggttacagctaggagcataatgtcagcatgatatagacaggggtatgtggcctgggaagtatgattaaagggggacttccaggggtgtatggccagggggtgtcctggacaagggtgtctaaccaggtgggtaggtacaagaggttaagcctaagagtttaaagcctggaagtccaggccagctgaataatgctaggtggtttacacctggtgggagaggccgtgaggttaagttcagaaggctaaagcttacagggtaaggccaagtgggtgaagccaggagcttaagactgagagaggccacaaggttaataagatcatgtggataaatctaggttcatacatctagattaatgccagttatgtaatgctacttgagttaggacaggtggttaaggccaagtatgtgtggccaggtggttaaggccaggaagttaagactgagtgatacggccaggtggttaatgtggccaaggggtaaggtaacggtctaccgaataaagctatgtgattcatacaaggtgggcagggccacacgggtagggccaggagattgaggccaggtgggtaaaaccagctaagtatgattcccaggtcaaggctgggtagggaggaccccgaggctatggttaggagggtactaccaggaaggtaaggtcagatagatagacatggggttaaagaccttggccaggtcctggctgagcctaagtctcagttttagcagttacacctgtgagaatataatgttcctcatacatcactttattcataggagatgataataatctctgggtcgttggtcttgggaagcactatgtgaaatacaggcaaagcatggcataccactacttcaagttagttcctctcttgtgtcatcaccatcacgatttaatagactaaatgggacaaactcatccttgcactggacaaacgcctactggaggatggccaccttctcacttgctcatttgccccatgtcaagtctatgccagctcctagggcccctgcagatcatctatgcaccccgtccttccctatgacaaatcctgtttattaacttcgtagaagggtcactcacagaagttattttgctactggcttccctatttattaatccttcttcactactacaactaagaaatgaagagatgtgtaaaatgcacagggtcaaggactgaaggtgggaggtggtggcatttgctgcctttggtagggaaatggatttctgttgatgagtgcagccagctgggactgtttcactcctggcagcagtagagcatatataagacaccacaagaaggagatctgtttactgcccactgaggagtcctgccttgagggcaagtcaggctccatcataaagggaaaacacctggggatgcggcactctcaaacacagcctactgcagcaatggtggtgataccaacagttgtgcttgtgtttataaatcacattatgcttctgctcacagagatcaatttctaatctacaccaacacaggcactgcaagagcaatgcaaattccctcctgcctggtcggaatctctggcagcagtgcagaggctgcagccttgccttatccctaaaactcatgcttgctctatccagctacagcctcaactgtgatggccacacctgctgcagccttttcttattctcaatgcctgtgttagcactgtccagctgtagggccaggttgcctcagatgcagctctgcctctacatccagtagtctgccccagctatgacatgaaccctgtatcccacagcaatccactcctaggaaaaccaaagtcccggagaacaacccccacaaccccctcccccaccacaaatcactgtaggaggggagacatacagatgtactgactcatggcagtagtacatgactcatggcagtagtacatgactcatggcagtagtacatgactcattttggggtaccagtcttgttccccggtacagccccttcttctgaaaagtgcttcttcttatttcagccgtgttgctctagagcagctgttctcttgcggcagagagttagctggccaaaagtggaccagcaagacccttactagaagggtaaagtaagaccatgacattgaggccaggtaggtaagtcagtttagtaaggcaaggaagtaattaacaattgtattaaatagataaggcctatctgagatcggatgaaggggctaggctttctccacaagcctcaaatttatgacataaaactggagtaactggaaggtacacagaccaagaaataaaggcagccagttctgataacaagagaagagaatgacgcaaacctataacgtgccagactattgacagaagttttaacatatatggttccagctccatctgcaaacaatcattttgttacagaaaaatgcttaaaataaattcctttacttgtgctcactaaaattgtttgtctcttgtgctccaaaaagaagctaagaaagaaaagtttctggcgtttttaaaacctactgccttgatctgccaattccattgaccatatgtccagcagtcaggctggttacctgataagcacttgtacctcacgcgccctcatccttcctttagctttctccagagagaactagagagtgaatgggtaacagaagagagggtaaaatcaacatccagagcaggctctctgagccacagcactactgacatttgggcttagataactctttgttggggatctttccttcactgcagagtgcttagcagcatccttggcctccacccactagaggccagtagcactctccagtcctccagtccaaccaacatcaacattacaaaatcaccctcagttgagaaacactgacttaaatgcatgatatctggggctatgctgactctaaaacagatctcttcaaagatgatagttaaataaatatacagttggctatattttcaactctaattttcagttaggagcattacacctagaagacagaaaatctgacataaaggagccaagcagtgggttcctgtggctgcttttaaacacctatcatggcagtactagtttaccctgtagtgagttttacaagcacagaaaataactgttacataacacattgtgggtcaaaatctcaaaagaaatgcaagttctttactataaaggaaattggaaaacaaaaataccacttataattttgttcatcaataatgtgaagaacaataatacaaaattttctataaacctatactggagcttggtgactttcttactgagatataaccttgaatggtagacttctgttatacctgaactgacacacacacatacttgacagctgaagatgtggctgacagggttgccagtctccaggagggcaatttgatggtctgaatgtttttgtgcccccctcaaatttacaggttgaaatcctgctccccaatatgatggtatcaggaagtggggcctcaggaggtatttaggtcctgagggtggagctctcataaatgagtttagtgccagataaaaggaaccccagatatctttttgccccttctgccacataaggacacagtaagaaggtgctgtctatgattcggaaaggaggcccttaccagatgctgactctaccagtgctttgatcttgaacttccagcctccagaaatgggagaactgaatttctgttgtctatgagccacagagtttgtgatgtttttgttatagcagcccaaatgggctaaggcagggtcccaccttttgatattcatgcctatgtcatcttcttctcacggaatttgcttctataacctataggagattggaaatgacagaatgtaattctgaagctagacgatttcctgttctcttggatcacttgctttggtgaaagctggtggccatcttgtgaggacactcaagcagccctctggagagaccctcttggtgatgagccaaagcctcctacccacagctgtgtgggtgagacgtcttgcaagcagtctgtctagtccctgacaagccttcccatggctgtagataaggacaacatctcaacttcaacaatgtgacagaccttggaacagaagtgcccaacaaagccacttccaaattcctgatccacagaaactgtgagggataattttttatttccatttgaagtcactaaatttgggggttatttgacagtaatagatacctaacacagtggtgaaagagttttctctagaacataaaaaaaaatgtgtttcttttcgtcaactgggtaagtcattgaatatatttttggagggatcttgaaccctccataaacttagttccatatgaaaaggttattgggatagtcacctaaaagaactagattccaccctccataccccaaacagtgcagcttaaaccttctcatcactgtgcttgatttcctgaaagtctgctccctttctggaaactgatgctgaagaaaaattgaataacctaataaagaccttgtttgttgacaatggtgaagtacagcaagaaccaactaagcagggaattactttagtcttccctgaaaaagaaaatcacaatgttgctggttcaattctattgtggtcaacgacaacaccacaatgaagttgcaaagtcaaaatgcaggtgatattcaagtgcagaagaaagaaaacatgaagttaaagggccaaataaaaggatgaaagagaagagatttaaaaatgataatgacacataaacttgaaaatgatgccacagaacaagaatgctacacaaatctcacttgtagatgtttaccaggcacactgaaagagtccacaatgaccaaccggagacaaagccacaaatataaatataaggaatctgcatatattattgacctcactgcctgacatggtttggctgtgtcctcattcaaatctcaatttgaattgtatctcccagaatgcccacgtgttgtgggagggacccaggaggaggtaatcgaatcgtgggggctggtcttttcatgctattctcgtgatagtgaataagtctcacaagatctgatgggtttattagcgatttccacttttgcttcctcctcatttttctcttgccaccaccatataagaagtgccttttacctcccaccatgatttggaggcctccccagccatgtggaactgtaagtccaattaaacctctttttcttcccagtctcaggtatgtctttatcagcagcatgaaaacagtaaagtggagtgttgctgaaaagatacctgaaaatgtggaagtgactttggaactgggtaacaggcagaggttggaacagtttggagggctcagaagaagacaggaaaatgtgggaaagtttggaactttctagagatttgttgaatggccttgcccaaaatgctgatagccatatggacaataagatccaggctgaggtggtctcaggtggagatgaggaacttgttgggaactggagcaaaggtgactcctgttatgttttagtaaagagactggtggcattttacccctgccctagagatttgtggaactttgaacttgagaaagatgacttagggtatctggtgggagaaagatgacttagggtatctggtggaagaaatttctaagcagcaaagcattcaagaggtgactcgagtactgttaaaagcattcagttttaaaagggaaacagagcgtaagagttcagaaaatttgcagcctgacaatgcaatagaaaggaaaaaccaattttctggggagaaattcaagctggctacagaaatttgcataagtagcaaggagcctaatgttaatgcccaagaccatgaggaaaatgtctccagggcatgtcagaggtcttcacagcagcccctcccatcacaggcccagaggcccaggaaaaaaagtggtttcctgggccaagccccggtccctgtgctgtgtgcagcctagggacttgtgccctgtgtcccagctgctccagccatggctgaaaggggtcaatgtagagcttgggctctggcttcagagggtggaagcccgaaaccttggcagctttaacctggtgttgagtctgcgggtgcacagaagtcaagaattgaggtttgggaacctctgcctagatttcagagtatgtatggaaatgcctggatgcccaggcaaaagtttgctgcaggggcagggctctcatggagaacctccgctagggcagtgaagaagggaaatgtggggtcagagcccccatatagagttcctactggggcactgccaagtggagctatgagaagagggccaccgtcctccagactccagaatggtagatccaccaacagcttgcaccgcgtgcctgggaaagccacagacactcaacaccagcctgtgaaagcagctgggagggaggctgtatcctgcaaagctgcagggacggagctgcccaagaccataggagctcacctcttgcatcagcgtgacctggatgtgagacctggagtcaaaggagatcattttggagctttaaaatttgactgccctgctgcatttcatacttgcgtggtacctgtaacccctttgttttggccagtttctcccatttggaacagctatatttacccaacacctgtactgccattgtatctaggaagtaactagcttgcttttgatttcacaggctcataagcagaagggacttaccttatctcaaataaaactttggactgtggacttttgggttaatgctgaaatgagttaagactttgggggactgttgggaaggcatgattagttttgaaatatgaggacatgatatttggaggggccagggatggaatgatatggtttggctatgtcccctttcaaatctcatattgaattacatctcccacaattctcacatgttgtcggagggactcagggggagataattgaatcatgtgggctggtctttcccgtgctattctcctgatagtgaataagtctcacggtatctgatgggtttatcagggttttctacttttgcttcctccttatttttctctttctgctgccatctgagaagtgcctttcacctcctgccatgattctgaggcctccccagccatgtggaactgtaagtccaattaagcctctttttcttcccagtcttgggtatgtctttatcagcagtgtgaaaacggactaatacactgccttaggaacccacataatatagtcaatgtccattttgactgaacaagagtttacacacggtacacttcaactccacagccagcatcatgattactagttaaagatcagaagcactcctgtcttatccatgtttcctgatagtgcctgtaccagttagaaaaggtaaaaaattatcattatttgccttcatgaaaatcattagaaaaactattataacaatagctttcctttatattagcaataaactagtagaaaatataaaaattaagcctctttcacaatagccataaaaacttagaatacccaggagcaatcaatataaaacgtatgcagaaccaagaagaaagctacctaacttccctgaggaatacagataatgactggaataaatatataacatgttatagggccaaaatattaatattacaaatcaaactgcatgataaatgcaatttaaatcaatatcgcaagttttgagcatgatcttaaagagttgcaaaacagatttttgaagagggctggagaggagtccaactctacaaacagccccaatcaatgggagcctggtccaaatggcttgattgtctggaacccaatccagtctggaatccatagccctcctggaaacagcccttagattctcctcctgagatttccctgtctacttcaccagggcttgtggctcctgggtacccctctgtcagactccaaaatggacaaggaccataactgaatgacacctttctttcacctggccttgagatgagttctgcacccagccaggtccagcaagacacatctgggggatgagcttgttctggacgctggcctgtggaactgtagcctggagttgccaatagtcctcttggcactttaagggagaacatgcctagaaatgaatccaatccctagaggtaaggtaacctccaggatggcttcaaccatcctgattttcagagcttgtagccttgtctgatcccctcctcttatgtggctgacctgctgacttgcttctaacctccagaatcaaaggtgagattaagtctcgagagactgtgactttctctttctctttttctatttccctctctctccctttcttcttcctccgctgctgctgcttctgctccttctccttctcctcctccccccacctctctaacttgctttgagaaagccagccatcattatgtgagctgccccgtggagtggtctatgtgacaagaaactgagagccacctgaaccaggcaagtgagctcaaagtgggtcctgcctagtggcactcagggcaaccacaaactggctgagatcatttctgtagcccctcaggctctgggctcaggacctaagctcttatctgacagaaactgaggtgataaatgttgtttcaagttactaagttgtgggagtagagagatattaggtgaccccccccaacctctgtccttctcacagcccccactttagggaagacttcacagtgctattacaaagaataggatatggctggattataaaaaaatgaatttatgccaggagatttgaggtagagctaaggttcattgataaatatattctaaatggataaaggaatgaagtagaaaagataaagctaacagtgctatatctgagaatggtagggtaaggagcttcaggtcaagcctgctgctgaaaacaatgacaaaatattaataaattaagaaatttgtatacatttaaatctgtgtaataaaatcagagcactccttaggcagggagaagtaaagggccaggatccacacccaggagggaatggaaacccagggaaatgagtcaggaccacttttccagctctggagcacccctattccagtccagcaagagagggactgatgaactgaaactcatagagcttggaaaccaaacctagagctgcccaccggccccccaagaagcgaggcttcaggcaaatatctaactctggggctggaggccccaacagccacaccttgagaagagaaacctagacactggaaggaaacttggctttcaccgagaacaaagcccagactcagattccatgacctcaggattcaggagtagtctccatccatcaccaccattcacagactagccactgagaaaagcaaaatattctcctctgaaggagggcatcattcataggctcagattttctctatagcttttgaataaaaaaagtctaacaatgaaaaaatgccaaagcagacaagaagacaagtcatgaccaaaagaccagatcacagaattaggataatgaaatcactggaagtaaactttaaaataactatgattaatacattgaagaaattaaaactcaagagttagaatttcagcacagaacaaaaaactataaaaacggaattctagaacggaaaaatacaataactgtacatcagacacaactagacacaggtcaaacaatgccctatgatgctggaaaaagcagagccaccaccatacatgagccaacaatgctaaacagcctggtatcatttgacatgtcaaagaaacgaaactttacacgaatgattccttatccatttatttccatcctccaaactaagatttgggcttgtagctccctttccatttgttaaagaagttaaatccatgtgatgaaattgtcccaagtagatcttactgccagtctgaaagaactctgctaatgctgaagtctacagactaggatttcaaagctatttggagttgcaaaaccccatgagattgtttaattttgtgacttccctcctattcaagccttctgtctgttgagagtgggggcacatccgaattatcacaaaatgaggatgaaactacccctggtaatctacagccacatcaacttttgtgctacttatttggacaatattaaacatttttattttatgttgcatactatttcaaacaagatatctacattaaaaaagattttcaaaggaagctctaaaataataacttctaagaatgaataactggattaataaatatctggattaatctaaaagtacaccagaccaaagataggtatgtctttataactgagcctcaaactcaaccatgaagacaaagttagaggttgatttcaccataactatctccctttcatccttctctgcaaaatacagtttaggttctatcgatagagatgtcattagaatctctgtcattagaatattttaattcaaaccgtaatttttctgagaggcaaaagaaatagcatagtctaaaaataagacccacacaaagtactctagtcattaattaacaagcgaagtaaactgttatgcaatagctgaaaagatctgatgggctattccttatgctgttatcatttacctgagaagttccaagaatatacaaactactgttttgaacttaggcctcaaagaatcttggtaatcacagtaaataatgatgaacaaacacatactaattaatgaaatgaagaaaaaaaatttaacctatccaaaaattcactttatttaatgttaaaattcaagatatgttctcttaagtttatattcaaatgagcttatatttccaactcttgctgaatgacagaagcacacataatgttcacattttgctgtaaatgatggacaaagctttaatgtccttcattgataaaggatgggtacaaatcaacagaaaaatagagaaacatctgaaaagaaaaatgagcacaggatatgttcatctattcacaaataaatataatgttttaaaagaaaaatactaaattaaaaatgcaaactaaaaaatgcaatttaaaatcttacccatcaaattgagcaagttttgtgagtttttaaatgtaagaagtgggctgcattccaggctataacaagctgtaggggaggcactactgtcactgaggaagggtagaccaggtatcttgatggacagtccccttggcaagaaaattcttgtccaagatgccaatagcaggagttaattgtattaaatttctggaagtaacccaaaaagctgttgctaggggttactttgtggtgtgatcagacatgaggtttctattacttggcctgtatgagcttctgtgttgattgacacttgttctctgctttctgtccacacagtatatgaatggaagtgttccatttgaattttttttaccttgattatttaccaatttaattcagataaatgaattttaaaggtaaaaaccaagctctgattgcaggggtcagggactgaatctctcccatatgtgctttcccagctagggctgcaccaaaagggctctgtaggctgcttcaagttctttctcctcctctgtctcctcttccatcccttccatccatctccccactcaatctgtgacaagaagcacattcctagtatcctgctagagttttaaatgtattctgacatgactacagctaaagagagagaagcatttttgaaatgaaatgttagctattaatcaccaaggaattaagatattatcacacatttcatacatggctggaaaacatgttgttgtttaaataaaagagttacaatgtcatatgaaatcaacctaggtgcccaccaatgttgggttggatacaaaagtgtggtacatatacaccgtgaaatactacacagccataaaaaagtataatgtcttttgcaccaacatggatgcagttgggaggctgttatcctaagcaaatgaacacaggaacagaaaaccaagtaaccatgttctcacctataagtagcaggtaaactcatggacatgaagatggcaacaatagaaactagggactctagcagggagggagaggggcaagaattgaaaaattgactattaggtactgcgctcagtgcttgattgacaggatcaatcgtaccttaaacctcagcatcacactatatacccaggtaataaaccagctcatgtaccccctgaatctaaactaaaagttgaaataaaaaagaattacgtgttttgtctagatatcttttaaaaatacacaaatatctaatttatttgtgttttagaaacaaataaaaccatcggatttatagttgatgccagggctcacacacactccagcagacgtcaaggcatcctgaaagtcacccaattatcccatagcaatggtatttatgggtttttgaataaacatggaaattgaaacttccagtcttaaaacttgaaatttacttttgtctcatctgagttccaccttcaggaaactctctgtcaggcaagggaccgaaactcactagatcattgtatacagacaatgagatatcagacccttcattccttctgattgcttctcagatagaagataagaagtcccagaatttgtagttggcaagctggagaccaaggagaactgatggtataagttctagctcaggtctgaaggctagtgacccaggagagctggtggtgtaatttccagtctgagtgtaagtcctaaggaaaagaagactgatgtcccagcttgaagatagtcaagcacacaaaatgaattctcattccagcatttttgttctattcagaccttcaatgaagtggatgaagcccactcatattggggagaacaatctgctttgctcagtctactgattcgagcattaatctcatccagaaacaccctcacaggcatatccagaataatgcttaaccaagtatctgggcatcatggccaaatcaagttaacgcacatccacattgctgctaaggacatggttttattccttttatggctgcttagtattccctggtgtatatgtgtcacattttctttatccggtccaccatttgtgggtatttaggttgattttatgtctttgctattgtgaatagtgctgcaatgaacatgtatgggcatgtgctttatggtagaaggatttatattcctttgggtatatacccagtaatgtgattgctgggctgattggtagacctgttttaagttctctgagaaatctccaaactgctttccacagtggctgaactaatttacattcccaccagcagtgtataaacataacctttctccataacctcaccagcatcttgttattttttgactaaataagtagacattctgactagtatgagatagtatctcattgtggttctgatttgtatttctctaatgattagtgatgttgaacatttttttcatatgcttgttggctgtgtgtatgtcttcttttaagaagtgtctgttcatgtcctttgcccactttttaacggagttgctttttgcttgttaatttatttaaatttcttataggttctggatattagacatttgtcagatgcatagtttgcaaatttttttttctcattctgtagggtgtctgttttgcctgttgatggtttcttttgctgtgcataagctctttagtttgattcagtcccatgtgtgaatttctggttttgttgcgattgcttttggtgcttttgtcatgaaatctttgccagagcctgtatccagaatagtatttcctaagttatcttcagagtttttatacttttagattttatatttaagtctgtaatccatctgcagttgatttatgtatatggtgtaaggaaggggtctagtttgaatcttttgcatatggccagccagttatctcagcaccatttgttgactagggaattctttccttattgcttgttttcatccacttcgttgaagatcagatggttgtaggtgagcgggattatttctaggctttctattttgttccgttgtctgcttttgtaccagtatcatgatgttatggttactgtagccttatagtatagttcaaagttgggtagtaggatgcctctgactttgctatttttgcttacgattgttttggctattcttcctcttttttggttccatatgaattttagaatagcttttttagttctgtaaagaatgtcactggtattttggtagaaatagcattgaatctgtaaattgctttggccagtatggccatttttaccatattgattctttcaatccatgactatggagtgttttgccatttattgtgtctccattaatttctttcagaagtattttgttattcttattgtagggatctttcacctctctgagtagctgtattcctaggtattttatcctttttagttattgtgagtgggattgcattcttgatttggctctcagcttggatgttattggagcatagaaatgctactgatttgtgtacattgattttgtatcttgaaaatttactgaaagtatcagttataggaaccttgggcagagactatgaggttttctaggtatatcatctgcaaagagagacagtttgacttcttctcttcctatttggatgccatttctttctttgtctttcttaattgctctggctaggatttccagtaatatgtttaaaaggagtggtgagagtgggcatccttgtcttattccagttttcaaggggaatgttttttgcccattcagtatgttgttgactgtggttttgtaatagatggctcttaatattttgaggtatgtttcttcaatgcctagttcattgagggtttttaacatgaagggatgttgaattttattgaaagccttttctgcctctttaagatgatcatgtggtttttgtttctagttatgtttatgtaatggatcatatttattgatttgtgtttgttgagccaatcttgcatcccaggaataaagcctacatgatcatggtggattagcttttcgatgtgatgctggattcaatttgctagtattttgttgagaatttttatgtctatgttcatcagcgatattggtctgaattttttgttgttgttgtgtctctgccagattttggtatcaggatgatgctgacctcttagaatgagttagagaggagttcctcctctgcatttttctggaataatttcagtaggattggtacctgttcttttttacacatctagtagagtttatatgtaaatcactctggtccagggcttaatctgattggtaagtatttttattagtgtttcaattttggaacttgttattggtctgctcaggcattcaatttctttctggtttaatcttgagaggttgtaggtttccaggaatttatgcatttcttctagattttctagtttgtatgaatagagatgttcataatagtatctcaggattttttgtatttgtttgaggttagaggtaaagtcacctttgtcattcctgattgtgtttatttggatcttctttttttcttcattagtctagctagtgctctatcaatcttattaattgcttctagaaacaaacttctggtttcattgatgttttgtgtggatttttacttatcaaattcattcagctcagttctgatttttgttatttcttttatccctgtaatcttaaagttgttttcctcgtcattttctagttcctttaggtgggatgtttggttgttaatttgacatctttgtgacgtttttagcgctatggttttcctcttaacactgctttaacagtgtcccagaaattttggtatattgtatttttgtttttatttgtttcaaataatttgttgatttctcccttaatttcttcaggagcaggttgtttaatttccatgtaattgtgtggtattgagagatcttggtatttatttctacttttattgtactgtggtctggttggtataattttttttaatttgttgaaaattgctttatggccaagcctgtggttgatcacagattatgtgctatatgcagataaaaagattgtatatcctgttgtttttgggtagagtgttctgtagatggctgttacacattttgttaggtgtcaaatttgagtcccaaatctttgttagttttgtgcctcagtgatctaagactgtcagtgggctgttgaagtctcccactattattatgtgtcatttaagtctctttgtaggtttcaaataacttattttatgaatctggtgctcctgtgttgggtgcatttatatttagggtagttaagtcttcttgttcaattggatactttatcattatgtaatgcccttctttgtccttatttattattgttgatttaaagtctgtttggtctgaaattaggatagagacttctgctgtcctttgttttctgtttgctttttagattattctgtgtgcctttactttcagcctatgggtgccatcacgtgtgaaatgggtctcttgaagacagcatacatcactcctgtttctttattcagattttcactctgtgccttttaagtggggcatttagcccctttaccttcaaggttaatacggatatgtgcaaatttcatactgtcatcatattgttaattggtttctaggtagacttgatggtctagttgctttatagtgtcagtagactatgtacttaaataggtttttttcatggcaggtaacagccttttgtttccatgtttagtattcccttatagaccttttataaggaagatctggtagtaataaattcccttagtatttgcttggatgaaaagcattttatttctcctccacttatgaagcttactttggctggatatgaaattcttacttggaatttcttttctttaaggatgctgaatataggcccccaatctcttctggcttgtagagtttctgctgaaagttctgctgttagcctgatggagttcctttttatgtgatctgccccttctcttcagctgcctttaatattttttctttcatgttgaccttggagaatctgatgctatgtgttttgggcatattcatctcatatggtatctcactagtgatctctgaatttcctgaattggcatgttcacctctcgtgagcttgaggaaatttttatggaaaatatctacaaatatgttttccagttgcttgctctcttttcctctctgggatgccagtgagttgtaggtttggtctctttacataatttcatacttttcagctgttttgctcactttacaaaattctctttattctttttttttttttttttttttttttgagatggagtctcactctgtcactcaggctggagtgcagtggcatgatcttggttcactgtaaccttcacctcctgggttcaagtgattttcctgcctcagcctcccaagtagctaggactacaggcatgcaccaatatgcctggctattttttttttctgtattttatgtagagacggggtttcactatgtttgccaggctggtctcgaacttctgacctctggtgatctgcccacctcagccttccaaagtgctgggattacaagcatgagtcaccatgcccagtcttctttattcttttctgactgagttgattcaaagaactggtcttcaagcactgaaaatctctcagcttggtctattctggtgttaatacttctgattatattatgaaattcttgtagtgagtttttcatctctagaaggtcagtttggttctcaaaatggctatttcatctttcagctcttgtatcattttgttggattcttttagattccttgtattgggtttcaactttctcctgaatcttgataatctttgttgctacctggattcttaattgtacatttgtcatttcaaccatttcagaccaacttaaagaaccattggtggggagctaatgcagtcattcggaggtaagaagacttcctgacgtttagagttgctagagtgcttgtgctggttctttctcatctgtgtggcctgatgttccttccttaaatctttaaagttgctgtcctttggatggcactttttgctttcatattctttgatgaccttgaagggtttgttcatgttatgagttgggttttattgattggtttcatttctggattatttcagggggctgaggttcagaagggcagaggtgttcctggttggctggcaacaaaactctgatgacgagtactggcaaaactgtttcaccagggaggtggtgggctgcagtggttcccgtatgtgtgcttgcaccagtggtggtgggcagtgatgggtcctgcatgtgcacatgagccatcaaagcagtggaaggaggctatgggtgagtgcagactggaaggggaaggctgtgcatgggtgcatgcccaaagggacctatgtgcagaagctctctgactgttaggtgggttttgctggcaaaaggcctgtggcattagctgctggtaagccctgcagatgggcagctgaggctgcactgtaagaggtggcagacaggctgggaccctgggataggccagcaggcatgggggacacccagatcatactatccctgtcccatgggcaagatagccctattctgtcccagtctggcagataacaaaggctaaagccacctagatgagtacagagagctttgggggatcggcaccctttactgtgccccactgcagccattcacataccaaaatcttttggattcatgaaggctgaaattctgtcattgccaactctctgggacattccccctgccatgtcaaatgttcattatggtcgtggggtctcctgcaactaggattctggggatctgtggtgagagtgggccactctatgcctatttcactcacccctctcccaagatccccttggggccaggaatgagtcctggtgctaggcaaccatgtgcatggtgtcccagctttctaccttttcaggccaggtttgaatcctccctttgtccactctcagtgccttgttttcaaaaatctgtttggactatccgagcctacttgatgatctggcctcttggtgggagaagttcttcctggctgcatctagttggtcatcttagctccaataaatacttctgattattttctgtgggcgaatacctgaaggttttgggaagatcgggaagatgtactgaagatgtcaatttcaggaaaagtaacatcatgctaatggaattttgtcaagtggcctttgttatccagataaaaaaaaatttggatgatgggatagaaatataatgccaggatatacaataatatattgtttctgaataccttatggaaaaatgcctaattttaggatttctttgtattatttaattttattttaatcattttttaaatacaggtttctcaaaaataagtagtgctgagtaatttcatttgacttaaagtctaaatgatcaaggaatattcactattgtttttaaatttttctatatggatgctatcatgaagtctgtaacaatgaaagaatccaatttatgaaataatcttatttccaaatattctctatacaagataaattaatgtttctaaacaatgtgtttggtcattttgataagacttggtcaacttggcaacttttactacatcagtaactgaaatggtatctctgagcattagtgttttcattttttgaatctctttattgactggtacttccagaaagtgatggataaatatttttgcagaaaaatcctgccattttcttgagaggtcactttgattaagcaagatattaaaaaattcaagaaatttataatctcttcttagccttttggctaagattatgtgaataaatctgtatattattttattttgtaaaagaaagaaatactctttattcaaatgtcaatgtgttgtaagcatcaatagaatataataaaaccaatgtaaagaaagacttttaaatatttttccctttagaggccaggtatggtggctcaagcctgtaaccctagcactttggagaataaactttacagttagcctagaacatttataaagaacatggacattgttgtcaaacaaacctggattctaatttgctgcttttatttacctcttgcctttacttgggcagggtattctaaactatcacatattcagacatgccattattcaataatgaagggctactgttgtagcaccttctttcccattaatctttatgccttttccctcctccctcaatttttttttgatgagggatttatttctacatgacatttggtgaatatatgtatgtatgtgtatatctttacaaccacacatatatgtatgtacacttacacataaacatacatgcacacacaaacaatatgcccagaatatgtaacaatgcctgacgcatagtatgtaatcaataaatatttgttcaatcaatacattgtaaatttaattcactcataaattatactctgtttcatgcctttgcactacaatatatttgataaagaatattataaattattggccacaattccagtctcagaggttatgggtagcatcaacacccacatattgggaccctagagaaaagatggccaaagcagcatcctacccacaaaaattatctaacaagtccactagctaagtataccttcactattctttttttctctatgcttctgcttgattatatggtgttcgttttttaataattattacagaatgcttattatagatcattaggagaagtataagaataaaagtaaaaacacactcaaaactccatcactagacacctgcttttataatttagtgtggactgtatttccttctattttttgttttctttaagacggagtctcgctccatcacccaggctgaagagcagtggtgtgatctcggctcactgcaacctctgcctcctgggttcaagcaattctcctgcctcagccacccaagcagctgggattgcaggcacgtgccaccactccagctcatttttagtagatacggggttttaccatattggccaggctagtcttgaactcctgacttgaggtgatccacccactcggcctcccaaaattctgggattacacgtgtgagccaccatgcccagcctctttctaatatttttaaatatacatttcctgcctccctccctctcctcccttcttttcccttcccctgcccctccccctttcctcccttcccctcccctcccctccccccaacctccttccctcctctcctgccttctctggtttctctttattccttcccataattgatatcatgttatatacttttatattgtgtatatgcacttttacctttaaaataaatttccagaaaagttttctcttcatttccatcaaaagattcccatttatccaatctctatcttacagcaatatcatttaaaaatggttgttaattcttgttaatgtgatagatgaaaatagaatattaatattgttactcaaaaacatatttaagcatttcaaaaatctgtgaaattatttagtttttatttttctgtttttaccgcttttaagtttttacagctttctgctgtagattccttattctttctatgcacacccatgacttctacaaataattatattctttttaatctttataactatttgtgtcctatttcactggctaggaccttcagaataatgtcgaattgaaggtgacagagcatatattattgtcttactcctaccatagatagaaagggctatcaacatcgagcaggattctagctataggttttttataggtcaccttatcatgttgaagaagcttctttctatttctgcttgctgagagttgttattttgaatgattgttgaactttataaaaacaattaatgctcctgttaaaattatcatatagctctttttctgtattctagtaatataataaaatctattatttgatatatggttgctaacaatcttcattccccggtaaactgcacttagtcattatgtattatcccttatatatattgttggatttgatttgctaaaattcttttcaagattttagatctgtgtttatgagagatacttatctgcagttctctgcttttataatgtctttgtctgattttgatagcaaggtcatgctgaccacacaaaataaaatggaaacttcctcttctatttactgaaagagttttttgtgtgaaattagtagtatttcttcctaaaatttttgatagaatttgaagtgaagccatctggacctgaagttttctttgatggaaggttttaagtgataatatcaatatttaagattgatataagagtattcattcttttttttcttcttgaattagttttggttcatctatgtcttccaagaaatatgtatattttatctaggttgtaaagtttatttgcattaagttggtaaaattatttccttattatactttttgtgtgtgaagagtctgcaattatgtcccctctttcatttctaatattattaatttgtatcttcttttttttattcatgattattctgggtagagatatatcagttttatcaatatcttaaatgaaccaattttagctttattgatgtttcactactgttcatttgtatttcattgatttttattcttgtcactgtttattttagtgaatatggatttattttgcctttcttgacaaatttcttggtgctcagattattggtttcatttctttgcttttttttttagtattagcatttagtgctgttaatttccctctaggaactgctttagttgcatttttaaaattttggtatgttagattttattacatttagttaaaaataatttttatttcccttgtgatttcttctttgatttgtgaattgcttaaatatgtgttgtttaatttgcagtatttggtggtttcctattccaatgtagtgaaatctttttaatttattaattcctgttttatgttctatcctagtaatgtaccatgtacatttgaaagaaatgtgaactctactatttttaggcataattttttgtaattttcaccaggacagttgataatactgttcaatttttctacatatttgctaatttgtatatctagttgttctaataattgttgagaaagaggcgtcagcatgttcagctatgaccatggagttatctctctctccctataattatgtcaatttttggtctgtctttagatgcatacacattagtgatttttattcctcataaattgacattttattataattaaatattcctctctctgcttatacattagtcttatattttatgtgatataaatacagccacttcagcccttttatgtttattgtttgcatgtcgtattcttttccatccatttacttttagcatatctgtgtctttaaagaatactttttttttacagcatgtaattgtgttttaaaaaaattcattccaacaattttactcttttttagttattagttttcgtttgattagtctatagtatttaatgtaattatatatatgactggattttgtctatgtcttcataattgttttttctactttcctcttctgatttttttttctgttggttctacactcttgacttttttggattatttaagcatgttaaattttttaaaattgttttggttattttaggttgtacttcttcattttaattaattatttttaaaaaaagtttgctctagggattataataaacattgttaacatttgtagcccagtcagtgttaaacttgtacagatccatgtaaaatacaggaatcttacaaatgtatagatcgtttcctaactgattatgtatattatagttgttatatgtactacatgtccaaaatttatatggtaatatgattattcaatagtcatttggtcgttatttcttaaaatattttttctgtctcattcttcctcatcctccttctgacattgccattacctgtatgttaggccatttgatatctaacagatccccgaggctctgtttccttctttcaagattctttagtctgtattttagtgttggataatttctattgagctgtcttcaagtttacctacttttttattgtgcgctctgtaggctgttcaaaccacagccacagaaatttttaatgtcagatctagcattttttagaactacctttttctgttctagagtttacatttgttcttttttattggctctagtctgctgaaatttcccattttccattcatgaaaccatattgcatttcctgagggtaattacaatagccatttaaaaatccttgcctgttagttttagtactgacttcatcttatgtttggatttagctgattttctttctcttaagaagttgcttattttcttgattctttatatattagatcatattggattaaattctagacaatataaatattaaattatggaaattctgtattcttttatttttgtacagtgggcagtgttttgttggttttagcaagtaattatcttgactgaggttgtattacaaacttttttttggggatggcatctccagtctaatgttagacactttgtctttgacttagtcgttttgagtttattcaggacacccatggctcagaagtcagcaaggatgtaactgatagaatttgtgtcaccccattctaaattttcttttcttaattcttccattctcttctgaaactatggtttccccatctaaagaggctggatttttttctagcattgcttttgacaccagtgtgcacttaaaaaaataaaaaaggataaaagttatgaaaacggggaaagtatattgtacagctctcctcctcctctctttaagcctaaattgtcaccagaatctgtttgcttttgttcactctctagttctttcagggagttgctttttgaattcttattttctgtgatacagtcatctaatatgatcttattctgttgtaaccgaaatggaaacaaatggtattattttaaaactatattgtctatttgtgttttcttttttcctgatatatacatgtagagagagagagacacagaaagtagaatggtggttgttagagtgtggggcagttatatatatgtattataaacatgcatatatatatgcattataaacatgcatatatatatgcattataaacatgcatatatatatgcattataaacatgcatatatatgcattataaacatgcatatatatatgcattataaacatgcatatatatgcattataaacatatatatgcatattggtctttgtaaatcctcattgatttctatatatataatttcattatacatataattttcatttatatatatttactgaatatgtatattgaaattatacatataaatgcatgttgacctctataaatcctcttaatgatttcagaagttttcttgtagtttcttttggagtttccattttacactatctctaatacaatgttgactagagtcggtgatagtgagcattcttgatttattctcagtgtcagcacaaaaatatgcaataactgaccatttaatatttcttttgaaatactttttatcagataaggaggtttctttctatttattgcttgtaaagtgttttatataaatagctattgaatttttatcatattcctttccacatttattgaggtgactgaaaaatcatataattttccttttttctgtaaatataatgaattacattgatttttttaaaaaaaatcacatttgcattcttagataaagactaatgattgcaatatactatcctttttataaattgctgccttcaaattactaacattttatttaggaggtttgtatgtatgttcatgagttggataggtatttaatttttttcttttcatattatcatccagtgttagaatcaaatttatttttgttctcataaaaataggtgttgagaaatactttccttttgctattctctggaagtttgtataagattcattttatgtagctcttaataatttagagtaatttatcggttaaatctcctaggcctcaagtttttcttacagaatagtttaaataatgaatccagttaaaaatcggtggctcacgcctgtaatcccagcactttgggaggccaaggcgggcggatcatgaagtcaggagatcgagaccatcctggctaacacggtgaaaccccgtctctactaaaaaaatacacaaaattagccgggcgtggtggtgggcgcctgtagtcccagctactcgggaggctgaggcaggagaatggcgtgaaccagggaggcggaacttgaagcgagccgagatcacgccgctgcacaccagcctgggcaacagagtgagactccgtctcaaaaaaacacaaaaaacaaacaaacaaacaaaaaaccatataggagtataatatttaaatacttcttttttggggggaggacagtttttcccccattttaatcatttgtaaacgtacagttcagtggcattaagtacattcacattgtcatgcaaccatcaacatcacacatccacagaacgcttttcattttgcaaaactgaaactttgtatctattaaacaataactctccttttctgctgtcccacactctaacagccaccagtctactttctgtctctatcaattcgactactgtaagcgtaccttgcgtaaacttacgtggaatcaaactgtatttgtcctttagggactggcttatttcacttagcattatgacttcagattcattcatgttacatatctgaattttcttcctttttaaaggtgaataatattttgttgtgtatatatatatatgttttgttcctcctcttacctgtcaatgaacatataggttggaattctttcaaatttggcaactacaaataatgctgctttgagtataggtgcacaaatatctgttcaagtccctgctttcaattcttttggtatatactcagaagtagaattacttaatcacacggtaattgtaattttagttctttttaggagttgccatacttttttccgtagtggctgcaccattttacattcccatcaacagtgtataagagttacaatttctccacatcctcaacaacacttaattttctttcttttcttctttctttctctttctttcttttctttctttctctctctctttctttctttctctatctccttccttccttccctccttccttccttccctccttcctatttctctctctctttcttttttctccttccttccttccctccttccttcctctttctttctttctccttccttccttccttccttccttccctcccttccttcctgttggtcttgctttgcttgtttttttctctctctctttttctttctttttaaatagacatgataatggatgtgaggcggtatcttactgtggttttgactgtgcatttaagtggtaccttattttacatttccttaatgactagtgatgtgaagcatccttttatgtcctcattggcatttgcatatcttctctggagaaatgtctattcaagtcgtttgcccactttaaagtcagggtttgttgttgctgagctataggaattctttaatattttgaatattacttccttatcagatatgtgatttgtaaatattttctctcattttgcgggttgccttcttattctgttgataatgtcatttgatgcacaagtttttaattttgatgcagttcaatttgtctactttttctgttgttgcctgtgtcttcggtgttttagccaataaatcattgccaattccaatcttatgaagtttttcctttatgttttcttctaagagttttgcagttttagcccttatgtgtagacctctgatttgttttaatttttgtatatggtatgagggctcaatttcattcttttgcatggatatccagttttcctaacttcatttgttgaaaagatagtttcttccctgttaagtagtctttacacacttgtgaaaaatcatttgtccctttaagtcagaatttatttatgggctattctattctattggtctgtttatccttatgccagtaccatattttgacaagttgtggttctaagaattttctatattctgtaaactgtcaaaattaatgggataatatctgattatttttaaatgtctaatggatctgtgattattccccatttttactttttatgattgataatttgagtttttgctgtttttcagcaatctttttaggaacttatcaattcattaacttttgaaaaatcatcttttggttttattaaagttcacttttgtatgtttgctttctatttctgtgatttatatttttaattgctctcatgtcttctcaattcactgttacaaaatattcttctattttctatggaaagttattttataaggtaactacaattttcaaatttcattacttgtaattttggtccttgaatttctaaaataactatataattcttagagaaacaggtatgttcctgaaaaagaagtgtataataatttacttgagttgtgcaaattataaagcagtaaagtatgtattaatgactaacactaattacaccaggtctattttctacatatttttcatgcttcaaatttcttcgtcagcactcagtgcagaaccatcctttgtttagtgattgcacattcagagctgtggcatgaaggctaactgtgttgaaaatataagaaagcaaacacaaaaaagacctattaaccataatcgaaggcacatttatgccatacaatagattaggtagttaattaggttaaatgttgaatttcaaaggtgagaaatgtgtgctgctgcttactatcttttccaaaaaggtggctagaccattacacagaaggagtaatttcttctgagacagtggaattctatttacactctattaaaatataaattttacatcagtccaaagcttgtatccagaaattaaattactagccattgtgctctgggaggtaattacttgaaaatctgattaattctgaattaatttttaatgcaggtagaatattaaatgattataaagagcaaaaaaattatcaagacagccgtaaactgtcttagtttagactcaagacactctttactttctacaaagtatttcagagagaaaaaatagataaccctggcatttatttcattatttgattttatcagcgactccaggcattcaactcagctaagataaaattctaatctaaagatgtgtttagattcttttctccttgaaagtctgcttaataggaactaaagaagactttaggtaagtgaatgtcctataatttgtcaccttcttaaaaaatccatctattatggaaaatataatgtatgatttcaaactcaggattacaaaaaaggtaaaatcattgatagaaaattccaaaactatttaattttttatgtataatttcaagtttaaggaacttcagaaatgtttatcatgtcagggtatatcagtccatttgcattgttaagaaggaatacctaagactgggtaatttataaagaaaagaggtttattttggctcaagtttctgcaggccatattggaaatgtggtgccagcatttgcttctggtgagggcctcaggaagcttacagtcatggcagctggtatgggggacaaggcatatcacatggcaaaaaaaaaaaaaaaaaaacaagagaaagcggggaggtgccacactctttaaacaaccagctcttgtcaactgccagaatgagaacttaccatggagatgacatcaagccattcatgaaggagctgcacccatggtccaaatatctcttatgaggtctcacctttgatattgggaattacatttcaatatgaggttcagagaggacacacatccaaattatattatgtgcaccattgccttttattattttttaatttagcaaattcagattcatacttttttttgatgctcataatttgatggtcataattttccttcaaaatgctcaatccttatgttttgttatggcttttagttgtcaactttctaaaattaaccctattctttcaggtgggtttactctggtatccaaataatccatatactttttcattgcatgagcatgcagatgaattgataggcagatccatatactactgttaatgacaatcttttgtcttggttgtccaaagttgccaaatttctatttgagcaatagttttgctcttagcaaagaatgttactcttgggaaaaaaagagtgaggttaaaatttttcctactgtttcatttaatataatttttatgtaacatttatctttccttgcacctttattggccattgaccttttcttttggctgatctcttcctgagttgttcaagatcctaccttagttctccacatatacttgtctttatcaaggaaaactgaggtcctgaatttttctgcttttctaaccattaaaatattaacttaaactgtgttccatcattttagattccttttgaagatactgataatctgtattaacagctctatgaaatttatacttctccaaaggggacaaatttttagtccaagtcttagatgttttttagttcatttttttttttttttttttagttcattctaggatcattatttcacctcttactgaggtgactaatagcacttgatttgaatactacaatatttagatttatgtattgggtcaaaaagtgagaaatatgagtcatccattttaaattaatattgtgtgttcatgtatgtatagacatacataatacatacatatgcatgaatatatgtacatatatgacaatatgcattgtctgaatttatattttccagttatattctagttagaacatagaaaatgtactaatttcagtaatattttaataaaatcatagtaaattcatacttttatgggattttgtgtgtgtcatataaaattttttcacttatttgatgtaatgtgttatgcagcaattctgtagaaccagtctggttgtgagagggctggtgaggaaactttagtggaaaaaaaaagttctttggaaatcaaacatttgtcttgcatggattgctgcaccatttggacaacattattctagtttcttgtttatatataacctgagattttgttcactacagttaagaaactgaggtgcagacacaaagaaattggctgattggttggtaagctattaattattgcctcaatttcagagcctcttattggtctactcggagattcaacttcttcctgggttagtcttgggagggtgtatgtgtcgaggaatttatccatttcttctagattttctagtttatttgcgtagaggtatttatagtattctctgatggtagtttgtatttctgtgggatcagtggtgatatcccctttatcattttttattgcatctatttgattcttctctcttttcttctttattagtcttgctagcagtctgtcaattttgttgctcttttcaaaaaaccagctcctggattcattgattttttgaaggttttttttgtgtgtctctatttccttcagttctgctctgatcttagttatttcttgccttctgctagcttttgaatgtgtttgcttttgcttctctagttcttttaactgtgatgttagggtgtcaattttagatctttcctgcttccccttgggggcatttagtgccataaatttccctctacacactgctttgaatgtgtcccagagattctggtatgttgtgtctttgttctcgttggtttcaaagaacatctttatttctgccttcatttcgttatgtacccagtaggcattcaggagcaggttattcagtttccaggtagttgagcggttttgattgagtttcttaatcctgagttctagtttgattgcactgtggtctgagagacagtttgttataatttctgttcttttacatttgctgaggagtgctttacttccaactatgtggtcaattttggaaaaggtgtggtgtggcgctgagaagaatgtatattctgttgatttggggtggagagttctgtagatggctattaggtccacttggtgcagagctgagttcaattcctggatatccttgttaactttctgtcttgttgatctgtctaatgttgacagtggggtgttaaagtctcccattattattgtgtgggagcttaccaaccaaaaaaagtccaggaccagatggatttacagccaaattctaccagaggtacaatgaggagctggtaccattccttctgaaactattccaattaatagaaaaagagggaatcctccctaactcattttatgaggccagcatcatcctgataccaaagcctggcagagacacagcaaaaaaagagaattttagaccaatatccctgatgaccatcgatgcaaaaatcctcaataaaatgctggcaaaccgaatccagcagcatatcaagaagcttatccaccatgatcaagtgggcttcatccttgcaatgcaaggctggttcaacatacgcaaatcaataaatgtaatccagcatataaacagaaccaacgacaaaaaccacctgattatctcaatagatgcagaaaaggcctttgacaaaattcaacaacgcttcatgctaaaaactcaataaattaggtattgatgggacatatctcaaaataataagagctatctatgacaaacccacagccagtatcatactgaatgggcaaaaactggaagcattccttttgaaaactggcacaagacagggatgccttctctcaccactcctattccacatagtgttggaagttctggacagggcaatcaggaaggagaaggaaataaagggtattcaattaggaaaagaggaagtcaaattgtctctgtttgcagatgacatgattgtatatctagaaaaccccatcgtctcagcccaaaatctccttaagctgataggcaacttcagcaaagtctcaggatacaaaaccaatgtgcaaaaatcacaagcattcttatacaccaataatagacaaacagagagccaaatcatgagtgaactcccattcacaattgcttcaaagagaataaaatacctaggaatccaacttataagggatgtgaaggaactcttcaaggagaactataaaccactgctcaaggaaataaaagaggatacaaacaaatggaagaacattccatgctcatggataggaagaatcaatattgtgaaaatggccatactgcccaaggtagtttacagattcaatgccatccccatcaagctaccaattactttcttcacagaattgggaaaaaactactttaaagttcatatggaaccaaaaaagagcctgcatcaccaagtcagtcccaagccaaaagaacaaagctgaaggcatcacgctacctgacttcaaactatactacaaggctacagtaaccaaaacagcatggtactggtaccaaaacagagatatagatgaatgaaacagaatagagccctcagaaataatgtcacatatctacaactatctgaactttgacaaacctgacaaaaacaagaaatggggaaaggattccctatttaattaatagtgctgggaaaactggctagccatatgtagaaagctgaaactggatcccttccttacactttatacaaaaattaattcaagatggagtaaagacttaaatgttagacctaaaaccatcaaaaccctagaagaaaactaggcattactattcaggacataggcatgggcaaggagttcatgtctaagacaccaaaagcaatggtaacaaaagccaaaattgacaaatggtatctaattaaactaaagagcttctgcacagcaagaaactaccatcagagtgaacaggcaacctacagaatgggagaaaatttttgctatctactcatctgacaaagggctaatattcagaatctacaatgaacccaaacaaatttacaagaaaaaaataaccccatcaaaaagttggcgaaggatatgaacagacacttctcaaaagaagacatttatgcagccaaaagacacatgaaaaaatgctcatcatcactggccatcagagaaatgcaaatcaaaaccacaatgagatacaatctcacaccagttagaatggtgatcattaaaaagtcaggaaacaacaggtgctggagaggatgtggagaaataggaacacttttacactgttggtgggactgtaaactagttcgaccattgtggaagtcagtgtggcgattcctcagggatctagaactagaaataccatttgacccagccgtcccattactgggtatatacccaaaggattataaaacatgctgcaataaagacacatgcacacatatgtttattgtggcactattcacaatagcaaagacttggaaccaacccaaatgtccatcaacgatagactggattaagaaaatgtggcacatatacaccatggaatactaagcagccataaaaaatgatgcgttcatgtcctttgtagggacatggatgaactggaaaccattattctcagcaaactatcgcaaggacaaaaaaccaaacaccgcatgttctcactcataggtgggaactgaacaatgagaacacatggacgcaggaaggggaacatcacacactggggcctgttgtggggtggggggaggcgggagggatagcattaggagatatacctaacgttaaatgatgagttactgggtgcagcacaccaacatggcacatgtatacatatgtaacatacctgcatggtgtgcacatgtaccctaaatcttaaagtataataataaaaaaaaagaaattggctgattggcctttgattattatagtcatttattcattcatttaattttttttaaactaagagttacaatctaatgggaaaaataatctagcagcatacctaattgaaaatcctgccatgaatttgtactgtagcaagagcatgaaacctggtttttattttgaggtacttaaaatattagagtaaatgaaaacattttagcaactacttataattcctcaaaatatcagcatttgtaaacttttgcatctagcttacttaaattctttatgcaaattagcatccaattataattatcaatattacagtaattgaatatagtgatggtgtgcatagcagaactaacattgtaatcctttatgtagtttcttgagtctgttgaacagtacacatataaaatgtctttaacctacctggtgtcgagcatactgtgctgcccacagcagttcacagtaaccacaacccctgacttaaaaatatggagaaaacgctcttgacagacctctgttgttgtactttgtcaatgtagtttgtgatagtcttggctaatgtgttacaccttgatttacttcctatcctattaaattattcatatcatgccatatatgaacatgccaatctttaataaaatgagctgaaaattagcatttagagaaaaacaagttcaagaacaaatactccctggaaacatagtcttgagacagtcaacatgaaatccattattttccttttcattgaaggtaaaaatgtgggttgtgggttgttcatctgataatgcccctcacaaacatatgagatccacggatttctataccactaggtttcctgggaggtctacattagccccaaggcagctggccagcgtgagttgtacctgcattgtgagaagatcatctttattatgtgtttacagttgcctgactcagtatctgttcctaagcagacagtggactgcccacttgtaggctcacctaactaaagttgtctcttacatatctggctatggaaaatttaaatgatgatgtcccttacatggccctaaagcatgtaagatacctaaagtgtatatgatgtgtagaagatgcctaaagcacatgcctaacatgcttgggtgaaaatccaagctgttacaacttacttagaaaagaggtttactcatttttgtgatcaattaagtcaatcacaataggaatattaaatacgtattatatgctgaacatgacagtcattgctagtatgaatttagccagtattgacttctctgataatctcaaaacaaggttaaaatatgtataaacaatgatttgttctcttagatgaaaaatatttacaataagcagaaaaaagcaccattcttgaactatgattttgttaatttgtaacctattatatgtagtgtttttcttttttaatagaagcactttggccccgttgcttgcaagtagtgcatattgttgctaatacttttgttgttaacttacaattttgaaattaattaatttaaccacagggtgatatgagataagatgatcataaatgttctaattatgacaaattattgaaattttatttgtggtatttttatgattgttatgaatatttataactgagaagatgatatgttttatattcgaagggtatatatttttgtgtgtatatgaatttatttaaatcagtctcattatttaaactaatctatgtcttgttaattggccatttcacaggtcatagatagatagagatttgggaacaatttgtactctgattgttgctatcagtttcttttttttttcctgaaagactttgcttatgtatgtgatgccctttcatttgatgcacaaagttaatactagtatcaacttttacacccacattatggactagaattttgaattaacccaacaattgactgagtctacactgatactttttaaacattaaaattaaattaaaattacgatgttaacattacaaactcatttttatcatttcttgcacaactcactctggaagaaactaacattaacctcacactcaccccttattctattctcagtgccctccttggaccctatgactccttcccaaggtcagaactgattaaacactagtgctactaagagttttagctgagagatagactgatttgttatttgctaggtactttgaacagaaaggtattgcaacgctggagcttaagtgactatgtttgaattttgagtgggtgaagcaagaaaatatggtgttcagagagaatgaagtttggagtagacatgcagagagaagcagggaccaaagaccatacaatccagagagcgtagagggcagtgtttgcctggtgctaaaaatattttggttgttggttccagtctttttagatactcagctgttctttctcctcagtttatttcctatcaattcccttgagcgtcttaagcagcttctattctttcaactaaataactataaggatactcatcctcgctttatttggttagcatttgctaaatgtatctactcctattgtttaacttttaacacttatctctcaagatttttctggattctaaacaaacttgtttagataattcattaggagtttctgagtaggatgtgagtttcaatagtcatacaagataatgaataacaaatttggttaaagtaaaagaaagtaaaagacagaaattgtaatagatgttgcccatacctgatacagatttaaaaaactagatgaaggcatcatgaaccattaactaacaattgtgaagtattgagcaaataacctaccgtttttgaatctctctctctcactttttaatttgtaatagaggaattgtattagctgtctaaactatttcacagggaacttgtgaggatcaaatgaaataatatatatgaatgtgcttttcaagaaccctattactgttttgtaatgcaaaagggtgtaaacctacagatacttcagattcaaaaagaactaagtacttatagatctttagtctatacagatttcagatttgttggctgtgtcaccacttcagtatatctggataattctgagtaaggttcttccaggcagaagttagggtatggggtaaactttctaaaacactcagcaacctaagcacttggtgtaatttcatgcagtaaatatggaatgggaaattttaaagtggagcagattctttgaatcatggattgctctagaatctctaaagtcactttaaaataccgaggtttggcgatataagcatttggctgctctaaacatggttgctaggcaaatagctatcctgtggggatcccctgggaagtgaattgaccttaaaccatgagattggtgtactttttcagtggctcttgcattgtcaacgtacagaggagttgtgaaaagttgccattccttttctgtagcatcacactgaatattttacatgttgcataaactttagtggtgagcaaagtacctctttatttggacagagaaaattttatatttgcgtataattacatataaaaattatatccaagaaggccaggcgcggtggctcacgcctgtaatcccagcactttgggaggccgaggcgggcagatcacgaggtcaggagatcgagaccatcctggctaacatggtgaaaccctgtgtctgctaaaaatacaaaaaaactagccaggcttggtggtgggcacctgtagtcccagctactctggaggctgaggccagagaatggcgtgaattcagaaggcagagcttgcagtgagccgagattgcaccactgcactccagcctcggcgacagagtgagactccgtctcaaaaaaaaaaaaaaaaaaaaaaaaaaaaaaaaaaaaaaaaaattatatccaggaaattgtcaaaggacatgagatatatttttgtaaggtaaaaaagcataataatgaaaaatgtgagttttgtagttactctacttaggttcaaattctggctttttgttcaattaactgactgcatggtttgcttgcattgtttggccttactgaatctcatttccctcctctgtaaaatgatgtagtaataataccattatcatagtatatttgtaaaacttagagagaaaaatgcagatgaagcaaatattgcagtatttggacccaggtgctcagtaaatattagctaatgctataatttaataacaaatactttaaaataagacaaaatttttgtttgaaatgaaaagcagtgaaactgctggtgttgctataacatcattcactaacatcactgttttgtaatgaaaggtgcaaagtattaatccaggcatccaaatttattacaaatataaccttaaagctatgtgaaaaacttcaatataaacatttttcaacactatcagtctcttccaattttgtgaaatgttgacactgacacaaagattttgatggttatgtgattctttgccatgacaaacaacgtttttgtctgtttataatgcgctttaattagaagtataaaatcagagttaagaggatttttgaagaaattagtagcttcctaagcccaactgtatgaataagcttctaacggaaaccaaggacaggattattttcaggcttttagtcttaataaaaatgtgcagagaatttcaattctaatttatataagtaagtcagataaatcaatttatttacctggattttggcccgtcactttctatttgaaaatgaaaagaattaattttcatattctatgcatatttattaatcagtattttttacacttattgttactaccttgccatttattattaccaattaaataagtccaatcattttttaaactttttattttgaataattttatatgtatagaagacttagaaagatagcatagagtgttctcatatacccttcagccagtttttgttaatgttaacattttatgttaccatggtacgtttatcaaaatcaagaaattaatatagatacaatactattaactgaactacagacttcatttataatttcactggttttcattcatgtcttttgtttgttctaggagctaatccaaggtggcaccagttatgtcttcttggtttcctccagtctgacagtttatcagctttccttctttattatgaccttgacacttttgaagagtattgaccaggtattttgtataatgttcctcagtttaggttggtctgatttttttttttttcatgaccagactgagattgattatacattttggggaagaataacacagcagcgaagtgctctcctcatatcaaatcagtaatacatttgttcaacaacttcttactggtgatgttgatcttgatcacttggttaaagttaatatttttcctgtcatataatctatttcctagaattaagtaactagactcagcccatattcaaggggtttgggaatgattaagcttcaccttctggaaggaggagtataaaaagtttgcgagtgtaggctaatatcaccataataattaataaatatttcagagaagtaccaatacaatagttaaacagtacttttggagagatatgtaaatactcatttttcctaaaagtttcttccactaatcttagcatctgtcagaggattttgcttgcagcaattattgtgatgttctaatggttccttcatttctccacatttattatttgaaattggtttgtaaagaagagttctccatttccccagttgtttgcttatttatttatttatgtaattatttatatatatcagcatgggttcatgaatgattatttcaatctttggaatataatttaatactgtcattattttgttgctcaaagtgtttcatctttggcaattgggagctcttttaggttggctcctgtatcttttctggaatgacagttcctccaagctcatcctgaattttccctgccctcatccctatcattaaccatttctctgagggtacccggttcacttcattaaagcatagtatttgggaaagactatctgggcacagagcatgctcactgctatgggagtgtcactgactctaaagcctctatcctgtctgataggccgatttagtcaggaaatatttgtatgtaaaaaatccaaaaaaactttgcctgtgcctatatagatatatctatatttgtttgtctatttattaaaatgtttgagtatatactggtatatccagctcaaattcagcaccacagagtttattctagccttctgtattatttattgtaatttctttttctgacagtaggaactctgactcccattatctacaattcatttaactaatgagtcattgatttatttatatgcataccccagtatacatctaaaatggtttctgaataactaaactatactcttgtgagaatcaaatttgccattgggtacagtatttgtgtctaattttattttattttattttttatctttattacacttttattctcaaagaatatttcaccggatatagatttctggcttgattggtgttggttgcggtggttgtttttctttatttttttttattatactttaagttttagggtacatgtgcacaatgtgcaggtttgttatatatgtatacatgtgccatgttggtgtgcagcacccattaacttgtcatttaacattaggtatatctcctaatgctatccctcccttctccccccactccacaacaggccccggtgtgtgatgttccccttccggtgtccatgtgttttcattgttcaattcccacctatgagtgagaacatgtggtgtttggtttttcgtccttgcattagtttgctgagaatgatggtttccagcttcatccatgtccctgcaaaggacatgaactcatctatttatggctgcattgtattccatgtgtatatgtgccacatttacttaatccactctatcattgttggacatttaggttggttccaagtctttgctattgtgaatagtgccacaataaacatatgtgtgcatgtgtctttattgcagcatgatttgtaatcctttgggtatatacccagtaatgggattgctgggtcaaatggtatttctagttctagatccctgaggaatcgccacactgacttccacaatggttgaactagtttacagtcccaccaacagtgtaaaattgttcctatttctccacatcctctccagcacctgtagtttcctgactttttaaagattgccattctaactggtgtgagatgatatctcattgtggttttgatttgcatttctctgatggccagtgatgatgagcattttttcatgtgttttttggctgcataaatgtcttcttttgtgaagtgtctgttcatatccttcgcccacgttttgatggggttgttggtttttttcttgtaaatttgtttgggttcattgtagattctggatattagccccttgtcagatgagtagatagcaaaaattttctcccattctgtaggttgcctcttcactctgatggtagtttcttttgctgtgcagaagctctttagtttaatgagatcccatttgtcaattttggctttggttgccattgcttttggtgttttagacatgaagtccttgcccatgcctatgtcctgaatggcattgcctaggttttcttctagggtttttatggttttaggtctaacatttaagtcttcgatccatcttgaattaatttttgtataaggtgtaaggaagggatccagtttcagctttctacatatggctagccagttttcccagcaccattgattaaatagggaatcctttctacatttcttgtttttgtcaggtttgtcaaagatcagatagttgtagatatgcaacattatttctgagggctctgttctgttccattggtctatatctctgttttggtaccagtaccatgctgttttgtttactgtaggcttatagtatagtttgaagtcaggtagcatgatgcctccagctttgttcttttggcttaggattgacttggcaatgcgggctcttttttggttccatatgaactttaaagtagttttttcccaattctgtgaagaaagtcattggtagcttgatggggatggcattgaatctgtaaattaccttgggcagtatggccattttcacaatattgattcttcctatccatgagcatggaatgttcttccatttgtttgtatcctcttttatttccttgagcagtggtttgtagttctccttgaagatttccttcacatcccttataagttggattcctaggtattttattctctttgaagcaattgtgaatgggagttcactcatgatttggctctctgtttgtctattattggtgtataagaatgcttgtgatttttgcacattggttttgtatcctgagactttgctgaagttgcctatcagcttaaggagattttgggctgagacgatggggttttctagatatataatcatgtcatctgcaaacagagacaatttgacttcctcttttcctaattgaataccctttatttccttctcctgcctgattgccctgtccagaacttccaacactatgttgaataggagtgttgagagagggcatccctgtcttgtgccagttttctaattaaaaaaaaaaactttagccttaaaatacccagttaatacactgtttcccaaagttacatagatcagactattttccctcaccctcttcagtgagattttacacaatacatttgtaatacagttagattcattttttcatagtctgctttcaaaactagaaacaaatgggtttggatccccaaaatctagttaattgttaaaagttggcatatagtaacatttactctgtgtggtatacagttctttgggtcttgacagatgcataaagaaatgtatccatcaccacagtaacatgcagaacaattctatcaccctaaaacttcccgcatacagtgtttttatagtaggaatcttcccacaagccatgacaatcactaatttgtttcacgttcctatagtttttgtgcctttcccaaaatgttacatatatgggattgtataatacataaggtttggttatggtttcttctatttgaaagatgtatttaaaatttatccatgttgttgcatgaattcatagttcattctgttttattgctgagtagtgaattccattgcatggatgtatcacagggtttttacttagtcacttattaaaggacatcttggttatttccagtttgggacaattatgaaaaaactgctacaaatatttatgtagaggtttttgtgtcaatataaattttcaattcatttgggtaactgtttagtaatgaaattgtaagttgtatgataacggtttgtgtacctctctaagaaactgtcaaatggttttccagtgtggtcaaaccagtttgcattcctatcaggaatgaatgagaatccttgttgctccatatctttgtcagcacttaatatattggcctttaaatggttctaaatttcttttattttaaactgttgatagtctcaaaatgacactgaagcataactggtgtaatattatttgaaaatattctgttgcatgatactacataatacgtagcaaggtaaattattagtatgtttaaagttaagggaaaggtaactttcatattgttgtgtatcatttacagttttgcccagtttttaaatttttttggcgtgcattcctctcttttgaagtcaatgaatgattcataagaaaaaatataagatcctatttgcaatttttttgcttttgttgcaattgctttcagtgtttttgtcatgaaatctttgcctgtgcctatgtcctgaatagtattgtctagattttcttctagggtttttatagttttgggttttacatttaagtctttaatccatcttgagttaatttttgtatatgatgtaaggaaggggtccagtttcaattttctgcatatgggtagccagttctcccagcaccatttattaaatagggaatccattcctcattgcttgtttttgtcaggtttgtgaaagatcagatggttctaggtgtgtggtcttacttttgagttctctattctgttccactgatctatgtgtctgtttttgtaccagtaccatgctgttttggttactgtagacgtgtagtatagtttgaaggtgggtagtatgatgtctccagctttgttccttttgcttaggattgtcttggatatactggcccttttttttgtttcatataaattttaaaatagttttttctaattttgtgaagactgttaatggtattttaatgggaatagcattgaattactttgggcagtgtggccattttcacaatatttattcttcgtatctatgagcatggaatattttttcatttgtttgtgtcgtttctgatttccttgagcagtagtttgtagttctccttgaagaggtccttcacatcccttgttagctgtattcctagatattttattctttttgtggcaattgtgaatgggagttcattcatgatttggctctctgtgtgcctgttggtgtacagcaatgttagtgatttttgcacattgatttttttttttatgctgagattttgctgaagttgcttatcagcttaagaagattttgggcttagatgatgggattttctagatataggatcaggtcacctgcaaacaaagataatttgtcttcctgtcttcctacttgaatacacttttttctttctcttgcctgattgccctggccagaacttccaatactatgtggaataggagtggtgagagaggacatcatggtcttgggcttgtattcaagaggaaagcttacagcttttgcccattcagtatgatattgaatatgggtttgtcataaatagctcctattattttgaggtatgttccttcaatacatggtttattgagagtttttaacatgaagggatgttgaattttattgatggtcttttctggatctattgagattatcatgcagtgtttgtctttagttctgtttatgtgacgaattacatgtattgacttgcatatgtcgaaccaaccttgcattgtggggatgaattgaacttgatcgtggtggataagctttttgatgtgcttctggatttggtttgccagtatttttcacattcattttcatcagggatattggcctgaagggtttttttgctgttgttgtatcaaagtgaacagaaaacctacagaaagggagaaaatttttgcaatctatccatctgacaaaggtctaatatccagtgtctacaaggaacttaaagaaatttacaagaaaaaagcaaacaaccacattaaaaagtgggcaaaggacatgaacagacacttctcaaaagaagacattcatgcagccaacaaacacatgaagtaaagctcaacatcactgatcattagagaaatgccaatcaaaaccacaatgagatacaatctcataccaatcagaatagcaattattaaaaagtaaagaaacaacagacactggtgaggttgtggagaaacaggaacacttatacactgttgctgggaatgtaaattagttcaaccattgtggaagagtgtggcaattcctcaaagatctagaaatatggttataagatagaaataccttaatatacaggtgatataagataaaatatggttgtaagatagaaataccatttgacccagcaatcccattacagggtataaatcatcctattataaagatacagtacatgcatatgtatgttcaatgcagcactattcacaatagcaaagagatggaatcaacccatattgcccatcaatgatagactggataaagaaaatgtggtacatactcaccatagaatactatatagccataaaaagaaatgagattatgtcctttgtggggacatggatgaagctggaagccgtcatcctcagcaaactaacgcaggaacagaaaaccaaacactacatgttttcacttataagtgggagctgaatgatgagaacatatgggacacatggcagggaacaacacatactgggacctgttggggggtggtggtggagggagagagaccatcaggaagaataggtaatggatgctgggcttaatacctaggtgatgggttgatccttgcagcaaatcactatggcacatgttgacctgtgtagtgtaacaaacctgcacatcctgcacatgtaccccggagcttaaaataaaattgatggaaaaaaaataaatatgcatttttaattttggaattacatacgttaaaatgctaagataataacagctccacataaaatatagaaaactttcaccaaatttacaaacatttttgaaaaacaagattactacttgtttttgtgtagtcataaagaaatcattgggattttaaaatattgatttattgtatgacaataagtttatacagattatagcaaatataagaaaaggtacttagtaaaaacacaatagaagtactgagaaaaaattgagttaatctctgaacatatgcccccttttataacctaaacctaaacctcagaaactcctggaacattacagaatatacagtcatactttccattagctatcagagtgatgatatcatcacacatcatgtaacctctggaaaactgtaccagacactcattagagaataagagtgaaaaagacaaacagcattttagtttattttaaaaatagtcgtgtacgcactgacagagtgttgatgacccctaatactgtgagaactgctctattaggctatgaacaggcactgacaaactggattgaaaaagaagtatagggaagcataatgaaaagttcagatacttgagagttttagtaatggaactttaccaaagcgaggtatttacttgagagagcatcttagtcttttagtaaataattgagtggcaaggtcaaaaccaccttatatacatttagtaattttttgctgatatagtacatgaacatcttgataaatatttaatattaaaatatggttataagatagaatcttgtaatcaatgacccagaaagccatttaatccatcatctaataaagagcatatcaatagtgaaagggcactactaattataatgctgagtcaatcagtgtaacacaggtttgtcccaggggataaaagttcaccttatcttgcaaatacatattctgagagcttagtagatttctaaatttgtgaatacttctgtggcttgtgcatttctcacataagtcagtaaagttcagattcctgagagttactaaaggtttgaatgataaatagcaacagttgatgagatatgaatgctgaaattttggctagttcattcagtaactaagtaactcatttctgtacatcatcttcaacataattaaatctattttatacacaatgaagttgaaaaagcatcatctagtcctaaattatgtatgattacaatgagtatgttctcctgactctatattggtttcacaccaacgatcactgacatgaaaaacagccacacaccctttataaaaacaaaaggctaattgagaatgaatctttagctcatcacttgttattcatgttagtttcttgcttgtatatacatgtgttgtattcaacacaaatattgtggatagctttgtactatgtacaaattttaagactatatctgtgtaagaatgtatttggtgacagagatggccaagttaaaaaagaaaatttgatagtaaaaaaaaaccttgatactttttatctcttttttttactagtggctaagagggcaggaatcctcatcatacacacaaaaggcaggtaaattaagaaacacaaagcaatggtctcaaacctgccactgccttgttatggaacttctgagctatctcattcacctttccttcaggtgacaaagaatggattatgggaatattgaactactccacaaaatctattgaaaggaataatcaatataaattattacaaagtagtttctcttttataccctccctgggtctccattatccaatttccaggttgtctggcatcttccctttgtcttctttgtcatgctgcttatctttttaggaatttctcactgaaatcatattttaaatggagaaagagagaattggttactctcttattgcttttattcttcagtcctcttaatacccaacatttatttaaaaatatttaactgtttaaaaaagacaatagcccttttttcttatcttcctgaaatactgcattttctagcaatgcttctccaaagctccactcacaaacctgcaacaaccttccataacacaagtttacctacataacaaatccgcacatgtaccccaaacttaaaataaaaatcataaaaaaggcaaaacaaaacaaaacgaaaacaataacgcactttgtttaattaagctttatatcagggagcggtgagctcaaaaggcacgttaaatcatgacctgtcatatctgaattattttgagtgtcacatttaaagcctttaaaaaaaggctctagctttttctgtgcgtgattgtaaaaaagtaatcatctgtgatagatgactatttgcatcaatatgtgctccttaaatctttcctgtaaagttccattaagttagcttaatctctacagcttgattgaatctttggagcttcagtcttcttatgtagtgttattccattcatttttgttattgcttttcctctaaccttctaaaggtgtgatctttgggagacattatctttacaatgaggaaaggtaccttgatggttagcatgtgaactctggatctagactgcctatattcaaattaaaccttgtcaggttctaacctgagctggggtctgagaggaattgggggatgggtggcaggtagccgaaagaactcttgagggattgtagaaagttgggacatgggccgggcgcagttgctcacgcctgtaatcccagcactttgggaggccgagacgggtggatcatgaggtcaggagattgagaccatcctggctaacacggtgaaaccccgtctctactaaaaatacaaaaattagccgggcatggtggtgcgcgcctgtagtcccagctacgcgggaggctgaggcaggagaatggcgtgaacccgggaggcggagcttgcagtgagtcgagatcgcaccactgcactccagcctgggcgacagagcaaaactccgtctcaaaaaaaaaaaaaaaaaaagaaagttgggacatggctttattctctctctcctacagagtcagcagtgcagttatattattcacaggcaatagtagctcaaagccaggtaagagctcaaacaggttacattaaatggttacataatgcacagggttgtgcacctgtgctccaaacctgctgtgtcatattgtaccagatgtctacctcagcccactcctgactgaagcacagccattttcttacactccaccccctatgctgagggagttctcgtagtggggaaacatgcccgcagggcagaaccctggacccagaggccacagcagcaatacaggaagcaacacccatgactaatattcccgctatgctgcccattattattaggatccagcatgggccagagcccagagacccaccatatctgtagggattcatgagtaaggctctcaactgctttgatttccttgaaaagctgctgttatgttttgttgattgtcagggatgaaggtacaacactgtggtcccaaaagagcaaaggtgccaccttgggcagcagttaatatgtctagggccatacgggtctgcagtaccaccttcctggtttgatcaacctcatctgttaatagaacgaaggcaactcaggtgttattcaaggcttgagcattgtgctctgcaagggctgtaacttacatttctacagttatgacacctgctccagggatggttaatgctaaggggtagagccaccagggggcttgctggatttgcaaaaaccaggaacattgtcccttccagttatgtgagtgtctaggcaatgtggggataacagtggcaggcacataagggcactaggtaatgcatggggttgtgctcctgggctccaaacctgctgtgtcatactgtactggatgtctaccttggcctactcctgactgaagaacagccattttccttatagacctctttcacagggaaattatgagtattaaataagttaattcatgtaaaatgcttaaaattatgactgatatgaaataaagatttaatactgttagtagtggcagagatctaagttatcccaagttaccagtaggaaatctgtatacgtctgcaagcaactttagcccttgtctactcaaaagaaagaatttgactgagggacatgaagcagaaaacaagactgaggcaagtttcagagcatgagtggaagtttatttaaaaaggccttagaacaggaaagaaaggaaggtgcagttggaagagacccaagcaggcacatgaaggtttaagagagaaggtcaaatgtcccgttcaaccatgattcttggccttttataggttcacctctttcccgagattcttcccgtatgtgcagagccctctctacagttgggaagtgagcatgcgcagtgtgtttaggaagagtacatatgcccacctgaagctttcttccttttttccagttgtgggtacgtggaagataatattttgccgtttttatctcttaatgtgcatgcccagtaagtttcttctttctggggtctgcctttaataacactttaatgttaataggtgtggaccatcagaagattgtctctccccggttgctgaattatcattttctgagaggcagtgtgacaatttttaaaacatcacttgacatttctagtgggtggagggagagccctctcctgccctactcatgcctatctatctacctataacaataaaatgtattgagggcctaccatagtttagggtctgatagacactaggtgtatagctataaagatactatatgcttaagaactgagtttagaaggagaggtacacattgaaacaaatatagctgtctcttggtatccatgggcaattggtttcagcacccctcattgataccaaaatctgtgatgttcaagtgctttatataaaatggcacagtacttgcatataacctatatacatctttccatatacttaaatcatctttaattacttataatgcccaatataatgtaaatactatgtaaatagttgttatactgtattgtttagggaacagtgacaagaaaaagtctacgtgttcaatacagactcaaacattaattttttccccaaatattttcattttactgtgggttgaatccatgtttgtggaacccacagataaggagggctgactgtaagtgaaatagaacataatatgcattgtaataatattacacaggttatagaggtggcataaatctggaggttctgcaaagtcttcccagaggtgaagtattcaggctgatctggaactctggctggataatggagaagagcaatctgggcactgttaccactgggcaggtgagttctgtaatgctgttcctggagtcatttctccaggcctacccaggcactagttctcaaggtgtttcaataatttggaaaacccaatttattagattagtttttgcttaaattatctagagtagttttatatctttgcaatgaaaccctctattatctttctttcccacaagacttacaaaaattagaacccttgcttgacaactgtttgcttctaatcttagaaaactgtccactcctaatatacatgtaagatagataccatgcttatatttcttaaatgccacctatttttctgggtcatatttttaaaaatgtactttaaatattcactactatctatttgtacatttcaagtaattcaaccttacgaactccaacttgcttaaatgcaaaatatacacattaatatctatgatatatagttgctgtaaataaacaaaatactttttataaaaatgttttgaaaactgtaatatactacgtaaagttagacattaaaagttactctacgatcaaatcatagggatttgtttttcaataaatgaagcccataagtgagtgttctgaggtcagataattagcatttagaaacagatgcaaatgcaagtgtattaacctgtggtggggctaataaatgcctagtgacctaaatagggattaaatttacgtctctactatagtttcatttttctctgtatgctaatttgagaatgcatattaagaaaagcatcatggtgcagtgttttttttaatgatgtgaacttaggttaaatgccatcttaactctgccaagtgaagtgatgaggaaattatacagccatttaaagtcattaaaatattttgcatttgttttttggtcacttttaacattttattttgaattgctaaagtaattgccttgaattaggatgacttttttgcttttgtttctgatatgtcatttggctattttgtgatgtgaattttaaaaacatttttatggcctgagtgatatcttaaacctatttgggtagttcctttaagatcctaattgtttttggcattttgtgatggagtaatcaggactgtatttaagtcccttgctattgaatattgcaaataattttagggctgtaagtaccttaaagaactttcttagtaaatctaataagcagtaaatacaactaataattgagttcagtcttagattcagaaacatcagtgagatcaatatctttttatctcatttccaaaatttttattttttctcttcctttctctaatctaggtaaagacatatgcatcattattatctgtgttcactgtaatagaaaattacatgcaccaagaatcaacttttgatgaaactactattgtttcagctccctgtcaaaactctcgtgtttaatcccaaactaactcaaaatacttaactggttaaatgatgagttctattgaggaaaagagtcaaactacataaaatatttgaagagatttgttttaagccaaatatgaaagaccatggcctgtgacacagccttcaggagaccctcagaacatgtacccaaggtagtcagagcacagtttggttttatacattttagggagacatgagacatcaatcaagtacatttaagatataccttggttctgtcaaaaaaggtgaaacaatttgaagtattgcagggtgggagttgtgccgcaaatttaaggagacaacttcaggctaaacctgatttaacgtgacaaagaccagatatttccttttaatagaaacaatttccttaaaacatcaataaaacagagataaacaatcaccattttatctgctagtaaatgttagctgcacaaaaatacacttccaaatagctctaaaagtagcttaaggtaacaatttatttagtttttattgctgctgagcagttctattctaggctggtcttggctggtctcaggcttactcatgcatctgtgatcagcttgtgtgttgtgtgttggctagggctggctggtcatggatggcctcagtcccgtgtctggttattgcctgagatgaaagagaagcaattgggccacacatgtctccacgtgagttctaaatgcagaaatatggcatacaccattcttcttctaagcattagaaacaaaccaagttcttggcaagcctctgcttgtattgtgcttattaatgttacattgggtgaagcaagtcacatgaataatcaagattcaaaggctggataaacggactctctcctttgatgggaagggaagaattgatagtcatgttgcaatctatcttaacattattcaaaactctttttgaaaaatataattgctcttcaaatttctatcaagtggcatgcccaaactccatgatcaaagtatcagtaatcaagtagatgctgttagtggtaggaagtgttttcccatcaggttaagttaggagacttgtagagaggctgctgttaaaataagcacattaacacacacatcctgagtcataaaacttctttgtagaattttggtcataagttgagtttttgaaagttagtgtaagctagcccacccaacccactgaaaaagaaatcatgaatttgcctcttgaattgcattttcttctaggagagaggtatgcctaaatcacatgttatagtggaatatagagctctttctctaatatataatataattaaattatagagctctttctcgtatatatttactcagtctttctgtaacaattcttgagatattacattataggtttaagttgaaaattaataccattccaaattgttctagtgcatgtttgaacaaagtggtgataaaagcttcaacagttggtcgttttctctgcttgctttcttccaactgcctctgttactaccacaaaggcaagttttttatacatatgttatctgtgatctggtactagtcacagttgtaaaatgaatcatttttccctctcaaacttggcaatatctttttaaaaaataaataaaatgactttttgggctgggcatggtggcttatgcctgtaatcccagcacaccgggaggccgaggtaggtggattgcctgaggtcaagagttcgtgaccagcctggctaacatggtgaaatcccatttctactaaaaatacaaaaaatagctgggcgcggtggtgcatgcctgtagtcccagctactcgggaggctgaggcaggagaatcacttgaacctaagaggcggaggttgaagtgagccgagatcacaccactgccctccactccagcctgggttgcagaacaagactctgtctccaaaaagaaaaaaaaaaaaaaaaaaaggactttttgctgtaagatgaagttgttgcccatgtcaatatttctctgtagctaaaaactttcctagttgcccagaattaaaaaaatcccatttcttgggatgataatcatctgttcaccattcatctattaattaattaatcaataataagctgtgattatttcctctaagctaagtgcagtgaaggatagcaaaatgaaatggtatattcactggactcaagctgcttataatcctgttgtacataaaaggcataaatataaaaggtaagtgaaaaaccaaaaatagacaatatatagcaggcgactgcgctttacccatcaccttctttgttttactctgtctctctccagaatgacatggcggccatgccctcttcatgatctcttgttgtgatctatcactgggacagaaggaaggtaatcaatactttctttataaataacatatcattgaattctcacaacacctttgtgaggtagatgtgtattacaacatttacctcacaagtaaggaaaaataaacctggagtaattaagtaaacttctgtagaatacatgaatttagatacagatcttttaggatctcaagcctacaacttttacagattatcaagtcttcctaaaattttccatcaaaatactccagaggacaataccttactttttttttgagagattatggaagtatagcccaaagcagtcaaccatgagcccttttttattctaaatttacatctgagttttgttgtcagcattaccgcttcccctgttcacagggaatttctgcacttgttagtgagaaatgtccgttcagaaagaaaactaacttagccagagacccttccaatagtgtattgcatacttaaaaattgctaaaagagtagattttatatctactcaccacaaataaatgataagaatgtgaggcaattcatatgttaattagctcactatagctattaaagtatacatatttcaaaatatcatgtacaccattacgatataccaacattccttgacttacgatggcttgacctatatttttccactttacgatgatgtgaaagcaataaacattaagtagaaaccatattttgatttttgaataaaaatcctttctaataactttattagaaagtaggctatgtattagatgattttgcctaactgtagactaatgtaagtgtcccacgaatgtttaacctaggctaggttaagctatgatgtttggtaagctaggtttactaagtgcatgtttgacttacattattttcaacttacagtaggtttcttgggatgtatccccattataaatcaggaagcatatgtgtatacagtttttatttgtcgattaaaaacacaaataattttttaaaaaacacataaaacacgaatgaaaaaccccaaaaaccttgtacttcaagtcaggaaggtcagactctgattctgtttccatcataaatacctgtatgacagtgaaaacaacaagaaaaacaacagcaaaaaagaaatactatgcatgaccacaatagcacaaaagcaggagtggggtaaatgtccatttgtgtgtgtgtgcgtgtgtattttcactcgagtccgtgtgaagagaccagcaaacaggctttgtgtgagcaacatggctgtctatttcacctgggtgcaggcgggctgagtccaaaaagagagtcagcgaagggacatggggtggggccattttataggatttgggaaggtaatggaaaattacagtcaaagggggttgttctctggtgggcaggggcgggggtcacaaggtgctcagtcggggagcttctgagccaggagaaggaaattcacagggttaatcactcagctaaggtggggcaggaacaaatcacaatggtggaatgtcatctgttaaggcagggcagggcctttttacttcttttgtgattcttcagttacttcaggccatctgggcatatacatgcaagtcacaggggatgcgatggcttggcttgggctcagaggcccgacattcctgccttcttttattaataagaaaaataaaacaaaatagtgttgaagtgttggggcggcgaaaatttttgcaggtggtatggagagagaatgggcgatgtttctcaggggtgctttgagtgggattaggggcggtgtgggaacctagagtgggagagattaagctgaagaaagatcttgcggtaaggggtgatactgtggggttgttagaagaaacatttgtcgtatagaatgattggtgatggcctggatacggttttgtatgaattgaaaaactaaatggaataagagaaggagaaaaacaggtataaaaggtctaagaattgggaggacctaggacatctgattagagagtgcccaaggaggttcagcctagccttgccagcaaagattatttatttacttcaagagtttagagtggcagtttggggatagcaccaggagatatcagctgtgatggcttggagaaacagtgtaaaccggcagtgtaaacaagagcagggcatgtatgagtagttgagaatggtgaataggagtatgactagacagaagatagtagggatgacaagtttttttggggcacagtctaagttggtctggtgttgaatgagactggggcctaataaaaaggagcatctatacaggagcttaaatgggctgtatcctgtaacattctgaggacaggcctgaattctgagaagcgaaagtggtaaaagtattgtccagtcctttttaagttggtggctgagcttggtgaggtgtgtttttaaaagacctttagtccattctacttttcttgaagacggaggaccgtaaaggatgtaaaggtttcactgaatactaagggcctgaaaaactgcttggctgatttgactaataaaggctggtctgttatcagactgtatagaggtgggaaggctaaactgaggaattatgtctgacagaagggaagaaatgactgcggtggccttctcagaccctgtaggaaaggcctttacttattcagtgaaagtgtctattcagcctaagaggtattttagtttcctggctccggaatgttgagtaaagctaatttgccagtcctgggtgggggcaaatcctcaagcttgatgtgtagggaagggagggggcctgaataatccctgaggagtagtagaatagcagatggaacactgagaagttatttccttgaggatagatttccaggatggaaaggaaatgagaggttctgagaggcgggctagtggcttgtactacagcatagcctgcctttgcttgtgtgtggcgattaggcctggtggaactgccatcaataaatcaagcgtgatcagggtggggaacaggaaagaaggaaatatggggaaatggtgaatatcaggtggatcagagagatacagtcatgggggtcaggtgtggtatcaggaataatgtgagaggccttattgaagtccgggccaggaacaatggtaattgtaggacttaaagagtgagtacagctgaaggagccagggagcagaaagtatatgcatcaggtatgaggaagaaaatagattttgggagttatgagaaatgtagagagtgagttgagcatagtttgtgatttttagggcctctaacggtattaaagcagcggcagccgctgcacgcagacatgagggctaggctaaaacagtaaggtcaagttgtttggacagaaaggctacagggtgcggtcctggctcttgtgtaagaattctgactgcaccaactatgcctaggaaggaagggagttgttgttttgtagaaggtgctggggtttgagagatcagtctgacaagaatggcagggagagcatgtgtgtttttatgagaattatgccaagataggtaacagatgaggaagaaatttgggcttgattgaaataatgggggctgtctgtgaaggtttgcggcagtacagcctaggtaatttgctgagcttgatgggtgtcagggtcagtccaagtgaaagcgaagagaggctgggattaagggtgcaaaggaatagtaaagaaagcatgtttgagatctagaacagaataatgggttgtagaggcagggattgaggataggagagtatatggttttggcaccacggggtggataggcaaaacaatttggttgataaggcatagatcctgaactaagttgtaaggcttgtctggttttaggacaggtaaaatgggtgaattgtaaggagagtttataggctttaaaaggctgtgctgtagcaggccagtgataacaggctttaatctttttaaagcgtgctgtgggatgggatattggcgttgagtggggtaagggtgattaggttttaatgagatggtaaggggtgcatgatcggtcaccaaggagggagtagaggtatcttatacttgtgggttaagttggggagatacaagaggaggatgcaaaggaggctttggattgggaagaagggcggcaatgagatatagctgtagtccaggaatagtcagggaagcagataatttagttaaagtgtctcagcctaataagggaactgggcaggtggggataactaaaaaggagtgcttaaaagagtattgtctaagttggcaccagagttggggagttttaagaggtttagaagcctggccgtcaatacccacaacagttatggaggcaacggaaataggcccttaaaaagaaggtaatgtggagtgggtagcctccatattgattaagaaggggacgggcttaccttccactgtgagagttacctgaagctcggcgtccatgatggtctagggggcttccgaggcaatcgggcagtgtcagtcttcagccgctaagccgagaagatctgggaaggagtcagtcagagagccttgggccagagttccaggggctctgggagtggctgccaggtgagttgaacagtccgatttgcagtggggtcccacacagatgggacgtggcttaggaggaatcctgggctgccggcagtccttggcctggtggtcagatttctggcacttgtagcaagctcctgggggaggaggttctggaggaatgcctgactgctgcagttcaggggtttggaagttcttgtgtgctggagatgtggctgggctttgtctcacagtggaggcaaggaattgcaacttttttttattattgtacaccttgaaggtgaggttaattaagtcctgttgtggggtttgaggaccagattccaatttttggggttttatttaatgttaggagcagattgggtaataaaatgtatattgagaataagatggccttttgaccttttagggtctagggctgtgaagcgtctcagggttgctgccaaacgagccatgaactgggctgggtttttatatttgatgaaaaagagcctaaacacttctgatttggcataaagaaaaaggagcattaaccttgactatgcctttggctccagccacttttttaagagtaaattgctgggcaggtgggggagggctagtcacagaatgaaactgtaagcaggaccaggtgtgaggaggggaggtgataaaaagattgcagggtggaggagcggaggctgaggaagaattgggacgtagcttggcctggcaaggaggggagaggtcagatgggtctgtagaaaaggaagattagaaagactcagcgatgcttggggttgggactgaggggacaggcaggagggaaagaaggaagatttgggagaagttgcactgggcacagagactaggaagggactattgtgtaaaagaatgcctggatgtcaggcacctcagaccatttgcccattttacgaaaagaattatttagatcttgtaggatggaaaaattggaagtgccattttctggctatttggaactactgtcaagtttgtattggggtcaagtggcattgcagaagaaaataagatgcttagattttaggtcaggtgagagttgaagaggttttaaattcttaagaatataggctaaaggagaagaaggaggaatggtaggtggaaggttgcccatagtgaaggaggcaaacccagagaaaagagagcatagagacacggagggaaggggttcgggggttcttatcctccagaaaagtgggaaggggggttggggcacggaaataagggattggggcacagagataagaggttggggtgtggaaataagggattggggcacagagataagaggtcagggtgtggaaataagggattgggggttcttgcctcctagaaaagcaggacttgtcactaagggtgaaggagaaggggttgaggggtacttgcccctcccccagaaaagcagagaaggggtagagacacagagagaaggggttggggtacttgccccttccccagaaaagcaggacttgccactaagggtgaaggaccaaggcaggcgtccctgcgtggtctgacacctttgaaacatgggtgaataatcagagaggcgtccctgcagtgatttaacaccaagggaaggctgccttcccagtccgtgactggcgccggagttttgggtccacggataaaacgtgtctcctttgtctctaccagaaaatgaaaggaattgaaattaagagaagggagagattgaagtgtggcaccaagattgaaaggagaaagaggttgagggacagtgagggaagctggagaaaagagtaaaaagaggccgcttaccggatttgaaattggtgagatgtttcttgggctggttggtctgaggacctgaggttgtaggtggatctttctcacagagcaaagtgtaggaggacgggggattgatctcccaagggaggtcccccgatcctagtcacggcaccaaatttcactcgagtcagtgtgaagagaccagcaaacaggctttgtgtgagcaacatggctgtctatttcacctgggtgcaggcgggctgagtccgaaaagagagtcagcgaagggagataggggtggggccgttttataggatttgggaaggtaatggaaaattacagtcaaagggggttgttctctggtgggcaggggcgggggtcacaaggtgctcagtcggggagcttctgagccaggagaaggaaattcacagggttaatcactcagctaaggtggggcaggaacaaatcacaatggtggaatgtcatcagttaaggcggggcagggcgttttcacttcttttgtgattcttcagttacttcaggccatctgggcatatacatgcaagtcacaggggatgcgatggcttggcttgggttcagaggcctgacatgtatgtgtgtgtgtgtatgtgtgctttaaaatataaggctttattaagggtttaaactgtcaatttgagacaggattgaaattttaccatgaaggtcttaggatggcttgtgcaagcccacagagcaaataaaaaccacatacatcataaaaatcatctgaatgggacgccagaaaagtcacagttcagagtgttagtgatttgtaactcctgggtgcagagtagtgtacctaagggccctaatccctgtcctttgcaggtgttcaagtcagggagttcaggttccttgcaatcagatttttgcctcagtggttgtatctgcttcagcagtcatctgtgattgtcaagttgaaattttgctcttcctcagccatcagaagtgcctggtttcatcaccaaattcagctttggggtaaatgaaattaagataagatctctttgttctctagaaatactacattaataagtcaaggatgaatattgtaatttttaggctaaccattaaaagaactgatgataaccatatatattacaagctaatggacaattaacttagtgggtgaaatgtaattgcaagggtcctgtacagtatgttcaatgatgattataaccctctcttctggaatgggagcaaaacaataattcactatcattatagttgactcttgaacaatgtggaggttggggcaccaaccccttgcacagctaaaaattgatatatgacttttgactccctaaaaacataatcgctaatagcctactgttgaccagagctttattggtaacataaacaagcaattaacacgtattttgtatattgtacatactgtagatctgttgagcattttgctagaattcttagtaaaaaatagcaaaaaaaaaatgtttattctaaaaggttttttagatggagcttttaggattttctgtatgtaagattatgtcatctgcaaacagggcaatttaaattcttcctttccaatttggtcaccttttgtttctttttcttgtctaattgctctaggcaggtccttcagcattgtgctgaatagaaatggtgagagtgggaacccttgttttgttcttgatcttagaggaaaagctttcagcttttcttcattgagtatgatattagcccagggcttgtcaaaaatggcatttattattttgtggcccattccctctgtacctaatttattgagagttttttttaatcataaaataatgttgaagtttgtcaaataatttttttctgcatttattgagatgatcatatgttttttgtctttcattctgtcaattggtttaccacatttatttgtgatgctgaaccatccttccataccacttaatcatggtgtatgatcatttaagtatgctgctgaatttgctttgataatattttgttgagagtctttcacatttatgttcattagggattttggcctgtaatttcttttattgcggcatcttaatctggttttgatattcaggatacaaaattaatataaaaaatcagttgcatagctatacactaacaaagaactatttgaaaaagaagttaagaaaatgatcttatttacaaacacaagaaaaagaataaaatacttaaaagtaaatttggtgaaggagctgaaaggtctgtacactaaaagctataagatattgatagaagaaattgaagaagacacaaataaatggaaatatatttaatcttcatgaataagaatagttaatattattaaaatgtccatattacccaaggtgatctacaaatcagtgcaattctcatcaatattccaatggcatttttcatagaaatagaaatacaatccttaaatccacatggaaccacaaaagattccaaatagccaaagcaatcttgtaaaagaagagtaaagctggaggcattacactcccaaatttcaaactatattactaagctatagtaatcaaaacagtatcgttctggcttaaaagcagatgcataaactaatggaacagaaagggcagctcagaaataaccccatgcatatatggtctactaatctttaacaagggtgccaaaagtccacaacaaagaaaggaaactctcttaaataaaggacacagaaaaatctgaattatcaacatgcaaaataataaaattgaacctttatcttatagcatatataaaaatcaaaatagataaaagatctaaatataagacctgaaaccaaaaaacttctagaatatgggaaaaaagccttctggcattggtcttattaatgattcttttaatataatacccaaaataaagttatcaaaagcaaaagtaaactagtgagactacatcaaaataacaagcttctgcatgacaaagaaaacaataaaataaaaaggcaacttacagaatgggagaaaatatttgcaaaccatgtatcttataagggattaatctccaaaatgtataaggaactcacacaactcaagaaaacaaccttataaaaaatcagcataggataaatgaacagacatttttccaaagtatacaaatggccaacaggtatacaaaaagatgctcaacataattaatcatcaaaaaaattaaaatgagaaatacaattagatatcattttacacctgttggatggctaatataaaaatgtcaggagataacaagtgttggcaaaggtgtggagaaaagggaagcttcatatatttgagtgggagtgcaaattagtacagctattatggaaagcagtatggaggttccttaaaaaattaaaaatagaactactgtatgatttagaaatcccgcttctgtgtttatatttaaaataaattaaatcagtatctggaagatatatctacaccctcatgtttattacagccctatctacaatagttaatatatggaaacaaccatagtgttaatcattgaatgtatggataaagaaaatgtggtatataccatgggatattattcagccataaaaaggaagaaaattctgctatttgtgacaatatagatgaacctgcaagacactgtgttaagtgaaattagccaggcacagaaaggcaaattttgaatgatttcacttatacttggaatctgtgaaagtctgacttgtagaaagagagagtggcatggtagttgtctgggcctggcaagtggggaaaaaggggagaagtttattaaaggtacaagcttttcattataagataattaagttttagggatctcttgtacaacatgagtactgatggatgcattaatttgattgggacaatcaatgcataatgtatatgtgtatgaaatcatcatgttgtacaacttcaatatacacaatctttatttgccaattagatattttaagataaataaataagacatggagaaagaaaaaaagcaagagaaaaatgaaatgttaaagaattggaaaggaagaaatgaaattgtcacaatttgcagatgactgatgctgtttgtagaataccctaaagaatctatggacatattttcagaacatatgagtgaagaagcaagtcatccagattcaagatgaacatacacacatcaattgtgtttctatataccagaagagataggataaaattaaaaattcatataaaatcaatatagcatctgaaatggagtattatgaataatttaattacttctacacagaaaacttatcagtcattattggggagaatagaaaacctaagtaaatggacatatatatagtggttgtgaattaaaaactcaatattgtttttaatgtcaactttgctcaaatttattcttacattcaatgcaatctcattcaaagttgatcagattttcttgttgagaatgcaaagctaattcaaaactttgtagaactcagaatagccaagacagtctttacgaggtaaaagaaaagagttggaagagtttcactaacacattagtactttactatacagttacagtaatcaagacattgtgataatgaaacacaaacaaacagaccaatgtaataaaatagcatccagaaaaacacctgcacatcttcatactgccacctgatttaaaacaaaatgccacttcaatacagtgggagaaaagctggtcttttaaataaattatgttcgagcaattaaatatgtgcaaaaaatgaattttgatacctatctcacattatacacagagattattttgtacagaatgtagatctacatgtcaaaagtaaaacaatgactattctaaaagaaatccaagaagaatatcttcatgggttttgggtaggcaattgtttatttggaggacactgtactaaccataaaggaaaagattggtaaattgtagtacattaaaattgagaactattgttcatcaaaagatatcactcaaatgtcagaaaattcaggtgacagagtggaagactatacttaaatgtatataactgataaagcattcatacttaaaaaatatatatataaatattctacatatcaattagaagaaaaaagtaatccaatttaaaaaaaatgagcaaaaatgttaagtgctcacaaaagaatagctccaaatggccaataaatatttaaaaggtgctcaactttgatcatcaaatgccataggtgtagtaagtgttttaaaaagtgagtaaccttgtacaataagtgttttaaaaggtgatccaccttaagcggcaatacttgttttaaaaggtgagcaactttaaaaggtgcttagctttggtcatcagtaaaatacaaatttaaacaacaatgtaattttttacacacctgataagatggctaacatagaaaattacagcaatacaaaggtaattgaagatgtggagccattggaatttcatatggtgttagtggaagtgtaaattattgcaaccacttttgaaaactggcaatacctactaaagctgaacatgcatatttcctacaactctatgacctatgcatctaaaacctagtataagactatttcatagcatcactgttggtaatagtccacattaaaaacacctcaattcccatcaaccatagataaaagtatggcatacacatacaatggagtactatatagcattaaactaacataaaaatttcaaatctcacacagaaaaggaagttcaaagcagttacttttaaatgttaaagtcttgagtccaatgttgaattttatttttggtgaaaagttggatttgacatactcttataacctaaaatcatcaagcactttctattgtcatatatgttatacattggggatagtgtaaaggggaataattttggagaaaaatgctcaatacctatttctgataaatgttttgtttaagtgttatacacaagtccatggagaaaatcatgtttcataataaaattatcttcttcttgttaacaaaagtttattagatacatgttactgaatgtaaatgggctaaatgccacaattaaaaggcacagagtagcaagctggataaaaaaccaatacccaattgtatgctgtcttccaaagacccatctcacatgcaatgacacctataggcttaaaataaagagatgaaggaaaatctccaaacaaatggagaacagaaaaaaacaggggtcacaatcctaatttcagaaaaaacaggctttaagccaacggagatcaaaaaggatacaaaagggcattacgtaatggtaaagggttcaattcaactggaagatctaactatcctaaatatatgtgcacccaacataggaacatccagattcataaagcaatttcttagagaccttcaaagagacttagactcccacacaatactagtgggagacttcaacaccccactgactagacagatcatcaaggcagaaaattaagaaagacattcaggaccttaactcagcactggatcaaatggacctgatagacacctataaaactctccactccaaaacaacagaatatacattcttcattcatcaatatacattcatcaccacatggcacatactctaaaactgaccacacaaccagacatagaacaatcctcagcaaataaaaaagaactaatataccaaccattcttttggaccacagtgcaataatattagaaatcaagactaagaaaattgctcaaaacgatacaattacatggaaattaaaaacctgctcctgaatgacttttggataaataatgaaattaaggcagaaattaagaagttccctgaaactaatgagaacaaagataaaacataccagaatctctgggacacagctaagacagtggtaagagggaaatttgtagcactaaatgcccacacctgaaagttagaaagatctcaatttaacaacctaacatcacaaataaaagaactagagaaccaacagcaaaccaatcccaaagttagcaggagaaaagaaataaccaaaatcagagctgaactgaaggagattaagatgtgaaaaaccattcaaaagatcaataaattcaggagttggtgtttgaataagataataaaataggccactagctagactaataaaaaagaaaagagttaaaatccaaataaacacaattagaaatgacaaagggtatattatcactgaccacacagaaatataactgtcagagactactattttccaaaaatgtaaaatgtatagcatttgtataacagctcaaaagtgtaaggcaagttaaattctgtttcagctgtttaaaattgcatattaagttgctttactgtgattccaagcaccttgacatgagaaatggtactatgactttcgtatatttctacacacttgtagtgagccttaagcctagtttgagagatatgctttaaaatagccaataagattacaacttagtcaaataagttgtgaagactttatctcttacatgcttcttatttatagattttttgtgctattatttaacaaatagattatgaactagatgctgaaaaggaagttatgcaatttctgttcaatctgttttttaaaaaaactgtctagcaattaaatgatctgagtgaattggagtttatgattctaattttacttttctgtgttgtctcctgatttttttgagaagccaactgaacggtttgatagtagtttatattattgtgtaggtagtatattctaggagatgtttagaaatttaaaactcattatatctagtttaattcctaatatctccacgaaatagctaatgggatttgaataatggcctgtataaatcatacatttatgctttaattattgcattactttaattcattcatttgttcttttagccattatatattattttcccattatgtgtctagcatggctgtagatactgagattgcagtggtgaataagccaatcaaggcattgactctccccagtttccagcctggtagagggcaaaaatatcaagtaaatgagtaagtaagtaaacagataacagatggcaataaatgtatgaagaagattaaaaggtgatatgatatagataaggacatatagctaagaggagctcttgttttaactgagatctgaatgatagtaattaactagccataacaagataagaagaagccccttttcaggcagaaaacacagctagtgtaaaaagccaaagacgaaaatcagtttatcctgttccagggaaacgagaagttgaatgtgcttgaaatgagtgggtaatgtgaagcataaggcaagataagttaaggaggcaggcagaattaaatgatttaagactttataagctagggaaagaattcatatcttaagcgtaatggaaaactactagagtttttaaaaatgtcttttatgtaaacagtgaattgttcacggtaaaagtaaaggctgagagttcagctagggtgtccctgtagcgattctgatgagagataacattaggtaaacatagaaggtaatgcagatggagagaagcagatagtttgggattatgtttttgaggcagagttgaaaaggctttcagactgattagatgtgggtaagagagaaaaataagaaagagaatttatctgcttaaacagcttattgaatgatagcaccatgtattaagatgcagatcagaggaaaaattagttttggggtgttatgaccacttcctattcatcccattggtgaaggaggaatctcgtgcccaaaattataggagatgttcaagcacacaacccctgacactggacagatgagatcatccagccacaacacactgcatgctgtgaagggccacacaggtgttgcactcaggagctgagtgaactgggctgtgggaggcaggctttgttagtaatgggagggtgagatgtcccctggttcctgcagaaggattggattgctttgcttgagtaattgtatgggttggccgggagattaaacctgttaggttgaggacagggtagaatgcaacagctgacggaagaactagctgggcagagaacatttcctactgagtaggggcatatctggtgacagcaagagaactcacagataggcctttcgggccctgtaaagttaaaaatgtcaaggcagcacttgaaagtttaggtcttaccctacgtcggggaaattaaggtccctttggccatgttacatttgagatgactgtaaagactgcatcgaagtggagacatcatgttgtatatgtaagtctgaaactgtgagacatcagaattggaggtaaagatttaggcgataaggacatttaacatcatgggactgagtagaagaatgtgtagatagagaagagaaaaggttgagctttagatgcgtttcaacattgagagttggagcagaggaaagggagcatcaaggagacttggaagagtagctattgaggtaggaagaaaaccaggaaggcgaagtgttatgagctgagagaagcattccaagaaggaagtgattatttctgacaaatgctgctgagttgtcatagaaggtaagtaatcatcagacctgcaacgtgataaccttgacaagagagtctctgtagagttgtgggaaattggatgttcttggtaggtacttatttatagttagttgaaactagtggtgtctgctggtctgtagcctctagttactgtttcctgttaatcgcactatgtaaaaaataatctatggaatcaaaggcaaattgataagctcagaattccatagaaaattggcctcatctccctttcacaagtcaatgtaagattttgtgagctgttttctatccaatagtgcaattgcttatggtcataggcaggagtataacaagcaccccatggccctgcctttctgtcatggcacactccatgattggttatactggggccctgctaacctactttattttcacaaacaagacaagctcccatctcagagcactggcacatacttttctctctgtctggaaacataatctcttttcttctggatgatctcaactttaggatcaccttaggtttcttcttaaatgtccctttcttaggaaagtcttcctggtctcataaattggcttatgtttccctgcaatgcactcttatcctgatttttccctttacaactcttgaacgcatctgcattccatgttcatataattatctgagtactatctcctttactcgactataaattctatgaagtcatcttctcaatatattttattcttcacggtatttctggtgcttggcacaagccctggtgtaaagggagtgaacaataaattataaaaataaaataataataaataccagagggtttttctttgagggaggtggcagacagtttattaattcttttttttcttcttttttattttatttttgttacagatgaaaacatttacttcagactgtttactactgttcgattctatttttcctttgattttctcttctcagtcataagtggaaatggaagggattcattcaaaggtagggataaggacaaaatccatttcaattaaaaaattaccttatgtataggataagattattgaaatggaaactattctgtttattagtattgcttaacttatttgcttctgtgctcaacttcactgtttaaaaaacctcatcgaacatcaaactgtaatatctacataaaaatagttttatttcaggaaagctacactagtttatatatagtttcatagtaaaattttatctacttttgttgttatttttgcactgcatatactttaaaatattaatgactaacaaacatgggaagatattttgttaatggaataatgcttcagagttctttttgtcattccgtggtcagtaattacttaccagcagtagacaatgttctgagacaggggattgtctacactccatacataatcttcatttcaactttgcccctcactctgaacttggtgtcactcagttcttgatctttatatctcccctccctgtacctcaagccctttatctctccactcatacttgacccttattgtttcccacatttccctctctgaactgaagtggtaagtctcagacatgaactgagcacattgctttaaaaattgtggtaataaaacaaagctgaatatttcatcaaaagccttcctgaaataaaaatgactgcattagtattgctgggccaaaatgttatgtactagcttgtgtatatagtagaaattaaaaaaaaatttttttcattgctaataatgattcaggaaacacactgcacaccaagtttgatctgacgtgttacagttaggaaaggctttgatcatttgtaatcagattagtgtccagtcaaatgactttgatggctggctgagagaatctgagaagaatgcgaggaagacatgagaatgtctttatttgtgtgaatctaaattgatattataaaaggtaactggctctgccttgcagaagaaatttttcagttggcattgtcaaatctcaagatagttttattggtgcctgatgatataccattagctttcttaacttcgaaagttatttagcagttagtggaaaaaaaattgtgtattacttaggcttccttgttcctgcatactctgttctctgtgcttgccttttttctcctcttcagataatttgtatttattctttaggattcagctcaagcatctctttgtgaaaattattccctgtttatctcttctttcctaccaattctttgacataggcagaggtcctctccccaacctgctctcatggcactctctctctctatatatattctttgataatttattatattgtagtgaaattatttgttcacaaatgtaactggaggttaacttgcattttgatggttcaacaagatagattcatcaaggatagatgcaatattaatcaagtctgtcaggcatagattagaatttttatccaaggaacaatatataaaaaataaataaatgaaaatgactatataataatacttattctttcataagttctcaaatttgtctttccatgtaggaagacaatatactagtcagtattctgatattttctccagtttctgggaactttgttaatattgcttaactatcttaatttggaatcaatactgggacaccctaaggcttagaataagaaccagaactggggttaattgatcatggtaaccaggcttcatacaatgtctaagcattcatctgatcagcctcttctctgaaaacactatgtgctttaaaacacatagaggtgggccaggtagtggctcacgcttgtaatcccagcactttgggaggccgaggcaggtggatcatgaggtcaggagattgagactatcctggctaacacggtgaaaccccgtctctactaaaaatacaaaaaattagctggacacggtggcgggcgcgttgtagtcccagctactcaggatgctgaggaaggagaatggcgtgaatccggaaggcagagcttgcagtgagccaagatcacgccactgcactccagcctgggtgacagagcaaggctccatctcaaaaacaaaacaaaacaacaacaaaaaaacacttataggtggtagttcatctacttcaaaactactacacgaaatgcataatgtctactctttaaagattaaaacatcagaacgcaaaacacttgtttgtttcctagggttattatgatagtcatagatggataaacatagcatttacttcaagttcatgtggctgcatctcagaaactattagttaaagccatgggtaggttctagagtcaaactacctggatgcaaagcttagtttcatgagtagcaaactgtagtttgggcaggatgcttaaaatttctgttctaatttcttcatttataagattgggataatactctagttcattaagttgtgtttaataagccatgtatgactttcaaaatactgactaaatgcttaagttggtaatatgaggtgtgaggctgattaaagataataaattatatttggcaaaataaatgttaacttttaacaactcttactaaactgaacatagttgttttgccttcttacacatattttctgttaaagacagataaaatagagctacagttctttcatgagagggccttcgcagtgaaacaaacatattagctcagcagtggaagactcctgggtactcttcagggatgagtcatgtggtgattgaaaatgtgcttgggctggaccagcagtttgctggcctagacctggcctattcagataatcagagtgggggaagtacagccagcaaagggcactatatcccttttcgttgaggaacagagcagctactaaggattctaccataaagacagtttagggtggcgttctagcaaagataaggatgcctacagcagttttgaatctcctaatgattcaagcactaagtctagcttcttcagagatcatggaagtggatcaaggggagggtttgataatcatggatggagtgattatgatggcactggcagccattgtgacagaagtggctttggcaaattagcatgtggtgaaaacagtcactggtgtgacaaataagatgaagatgattggtcaaaaccactcccaccaagtgaatgctggaacaggaactcttttctggaggcaacactgggattaattttgagaaatacgatgacattctagttgaggcaacagacagcaattgtcctccacatattgaaagtttcagtgatgttgagatgggagaaactatcatgggaaacatggaggttattatactagcctgactccagtgcaaaagcatgctgttactattagaaaagagaaaagagacttgatggcttgtgcccaaacagggtctggaaaactgcagcatttctcttgcccatgttgagtcagatgtattcagatggtccaaaggaggctttgagggccatgaaggaaaattaaaggtgagggcgcagcaaacagtacccaatcttcttggtattagccccaagaagagaattggcaatacagatcaatgagaaagcaagaaaattttcgtactgatctagagttcctccttgtgtgatttatggtggtgctgttattgttcagcagatttgagtcttagaaggtggatggcacttgctactagccactccaggatatctagtggatatgatggaaagaggaaagattggattaaacttttatgaatacttggtgttagaagaagctgatcagatgttggatatggggtttgagcctcagatacatagaaaagttgaacaagataccatgcctccaaagggtgtccaccaaactatgatgtttagtgctacttggcctaaggacatacagatgctcgctcatgatttcttcaatgaatatattaataccttattggctgtatggaggagttggctctacctctgagaacatcacaaagaaagttgtttgggtggaagaatcagacaaagttgtttctgcttgacctcctaatacatccacttgatcccaggcaagtacgcactaaccttaggtttatggagaccaaaaagggtttttattctctagaggatatcttataccatgaaggatagtcatgtaccagtatctatggacaccattctcagagggatagggaagaagctcttcaccagttaccctcaggaaaaagcccaatgctagtggctatagcagtagcagtaagaggactggacctttcaaatgtggaacatgttatcaattttgatttgccaagtgatattgaagaatatgtatatggcattggccatacaagatgtgtagaaaaccttggcctggccacctcgttctttaatgaggggaacataaatatcactaaggatttgttgcatcttcttgttgaagctaaacaagaagtgccatcttggttagaaaatatggcttatgaacaccactaccagggtagtaattgtggacgttctaagagtggcagatttagtggaggatttggtgccagaggctactgacaaaatagtggtgccagccgttccagtttcagcagcagccatgcaagcagcagacacagtggtgaaggtggccacggcagcagcagaagatttggtggaggtggctatggaggcttttgcaacactaatagatatggaggaaattataactcccagagagttgactggtgggtaactgagcctgctttgcagtaggtcatcctgccaaacaagctaatatggaaaccatatgtaacttagctggatgataccttgtgtagcttgaagaacttgcagtatattaccagctgtgattctccactaattttttcttttttaagggagctcaaggttccacaagaagaaaaaaagaacaattaacaaccttgtttggaaggtggtttgaagacttcattgccattgtttggattaattcccctcctgcctacctccaacccaaactgcatttataattttgtgactgaggatcatttgtttgttaatgttaactttagataactttttattttgatgtcctgttggctcaatacatcaattgttttgaaaaaattactgaacttgggctaaagtcaaaccttgggacacaggtgtgatacaacttaataggaaccatcgattcatccataaatattttaaggataaacctatttggtagcctccattagggctttttgatacttgaaaactgggggaaaacaaacaacaaatcttgtaaagtatattaatggaattagtttctactgctgcaaactgtattaagttaaagttctgattttctcactctgtcctggataggtatttgtaacctcacagcctttaaacaagccattccagtcacgatgaggtgatgtatgaatacatgcatacattcaaacactgtcttcaaagttaactcaagtaaatacagcaactcctctttcagtgtttaggcagattattaactatgagctagccaaatgtgggcatactattacagggaatgcttaaagatccggtaacttgaaataggtttttaggagaactcatctgcttagactttttaaatgcctgccataaatgaaattgaaatggtagatggggaccacagcaaagaccaaccctcgttagggccctggatgatttttggtctaataacacatgctagtgttgatgttttctggttaagagggtatgaacaggaagaattatgcagcaggctttactttaaatgctgattcacatgattgttcaagctgagttgagatgctaaactggcttactatagactttgtaaaaatggctccagaagagtaactaactgaaatctttaagctcacacaggttggaaatatgtacataattgcacaaggtgtcaatttactctacagcgcagttttagttgcataggtttccattgtatttatagtcaatttaagttaaatctggccaaagatgagcattgttcaccactaaaatgcctctgccactttgaattctgatctaattttgtggccagaatgtggtgattaaagcgctcagtctttttacagtggcataggaaaatggcaaaaatttcctaaagtgcagtagattttcaagtgtattgtgccttgttctagaacttttattaagtaggtacacttgacagtattgaggtcatttgtcatggtgctatttaattagtctaggtttaggcccttgtacttattgtccataatttgtacaaagtacttcttttattgcacattaagatatatatgcatatacgtcttctcttgtcttgtgtgcatgtccttaaacttccaatcttattttgtctcttggagattgttgaacacagcttgtctgggaaggggatgggactagatttctaaaatttatttgggaccattgggaagaaaactatttgcacacgacagatttctagatactttttgctgctagttttatgtaatatttattgaacattttgacaaatatttatttgtaagcctaaaagtgattctttgaaagtttaaagaaacttgactaaaagacagtacaaacacaatggcacttgaatgttgaatgtcaccatattcgtgaaattatatatttcagggtagtgtgagcttttaatgttaagtcatattaaactcttaagtcaaattaagcagacctggcattggcagtatagctataattttctgatattagtaaaaacaaaattgacaacttgaaattaaatcatgccaaggtattgatacacttgtcttaagatattaatgaaacacttcaccacactgatacgaagtgtccagattttcagatgtttgttgtgtgagttttgttgaattttatgtattttttttcagtgaatgtctggcacattgcaatcctcaaacgtgattatctttagttggcaatttagttggcataatcagtgacttgtacattcagtgatagcgtttgagcaagttttatcagcaggcagtattttcagttaataaataagatttcaaaatcatgtaaggttttaaacttgctgaatgtaaagattgcacctcaagtcactgtacctttagtaattgcttagtataatagttcagatgctagcaatgcatgtgctgtgaatattctgattttattaaaataaagttgaactacaaaaaatagataagatgcataaattgaacaatctctaagactacatggaaaggaaactcttgttcttggtataatattatggaccactgtgaatgttctatggactttgtattctatatatactcatattctctgaggatgatcataatggtagattgaaatatcacaatgatctcaaccccattcttagcaatgcaatttcatgtgatcatttaaaagtattagcaatgcacttatatagtgcttagatatttttagttgctttcactcttatctataaggggttgtccttaataatcatagtttacaagattatcatgtgaggtaggttgctatcatacaaggtagatgaactacattgtgtattgaaccatgaattccatggattttgacaggcataaaagataaatggctgatttgtgtttgtggaagttcattcaattcctgagaaaaatcaggaggtgaaatctaagaaatattaagccatcgagaggaggcagctatctttttgaaattaagatgggatgacaggtctttcagcctgagaacagctagcatgtgtactttagttgtcatgctcaaggtcaaaagaaatttcaaagtagttaaagaggttgcttgattgcctgcccgccgttcgttcgttctttctctttctttctttctttctctttctttctttctttctttctttctttctttctttctttctttctttctttctttcttttctttctttttctttctttctttctttctttccttccttcctttctttctttctccttcccttccttccctccttccttccttccttccttccttccttccttcctttctttctttctttctttctttttctttctttctatcttctttttggagtttcactcttgttgcccaggctggagtgcagtggtgtcatctcggctcaccacaacctctgcctcctgggttcaagtgattctcctgcttcagcctcccaggtagctgggattacaggtatgcgccaccacacctggctaattttgtacttttactagagatgggatttcttcatgttggtcaagctggtctcgaactcccagcctcaggtgatccacccgcctcggcctccaaaagtgctgggattacaggggtgagccactgcgcccggtctgattttatttcactatgaatttggagctctaagcctaaaagaaggtttctcataattcatggaaaaaggaggaaactttctctaaaatatttcttgtgtgcatatttacaaaacctaaacatagattttttttggaaatatttaaatatgctattttaaagagtttcatttttccatgtttatataaggcatgttaaaatagttgtacacctaagataatacagcagctttcagcatttaagtataagtgattgaatgttgatttatgaacattacagaccagaagattaataaaaatttttgcatagtgaaaaataattaggatttgacctcatttttatgcttatatccatataaggaatattttcacttattttatgtttaaatatccattatcagtaagggaagctaatgatatacatttttacatctacatatatctttgtgatgcacagccatttaaattcagatattgaaatacaccactgccaggagaggaaatgcacacaatacttaacctctagaactttgtcattgctatagaccagtgcctgctgtgtctttccattgttcccttttctgaatttgagtttgtaattatgtttatgttatgtatgttaccctttctccaccactgtatattagatgtacagcaggacagatgccttggcattttagatcgtagattatagaactacgagtagccccattaaggtcagatggagaagaccacacaccagctggatatctcaactttgaataggatgaagtaactggaagctatttgggaatgtcaaaaatgggatgtgacagggtatgttctgtgttgggcactaatggtgctcctagatatttggtagccaggtaggtaatctgtagcataaggctagattttcaccggttatgctgcctcccccacagtgctaagttgttgctgggaagtagctgcctagtcagggtctgtatttctctggatcccttgcaattaggtggtatcatatatccagtattgccagtggaaggcagttaggaattagatgtatcttttctaagacttctcttttctcatgccttgatgcaagaaaacacattgagagttggattttggcagtaccaaaaccacaagagggaaagagttcaattcattgactcatatcttggagaagaaccacatcctccaaaagcaaaaatcttattttggagcttagtgtgaaaaataaaccacttaaggtgttatacattttcagtatcatatatttaaatgattattactataactattgaaaaatatatgtttggcatttaaaagtcaatttcttaaaagtaactttcattttttggtggctttgaattggcagtgtagtttttgtctttaaatgaatggtgcatttgattttaaaattatttttcattttttattgaggtacttaaactgtcaactttagcgttttcctcacagatctgtgttttctgtactatcaccttgatctttaaattgaaattatttgttcttcatgttctttttaaagcttttaatgagcttgcagacaactatctctttgctgttcctactattaatattgcagatgcaaccctgggatagtgtaaaggtagggtaaaggcagagcactcacttgacaaggggtagcatgggatggataggatgggatggattagatgcaacacaaagcaatgaggtaaggtgagatggaataactgtgtagtagtaactcaaaagtatcacaaatttttggaccacattagcctggatgactattcttaagtaaagaaacaatgttgggaggctgaggcaggcgaatcacgagatcaggagatcgagaccatcctggctaacacggtgaaaccctgtctctactaaaaatacaaaaaaattagccaggcacggtggcgggcacctgtagtcccagctattcaggagtctgaggcagaagaatggcatgaacctgggaggcggagcttgcagtgagtggagattgcgccactgcactccagcctgggcgacagagaaaactccatctcattaaaaaaaacaaaaacaaaaacaaaaaaacaatgttattctggcttggctttggattaaaaggctttggctagggaatttacactctttgttttctctctttattgtgtaggcagagagagtttaattttagcccaattcttttattctttaataatgagccatattagtcaagatttgcattctagcacccattctttcaatatgtaaacaacttttaagtatgcaaaattttctttgagacgcctgggttctgccactaggacccaacattttgagttagtttttcttgcctaaagcccacatacttgcctaaagtccagcatcctcactgaaccaccactgggctgttccaccttgtttctccttccctatttcaggttctcagttacttcttgggtgctcagaatttgctgttaccatgattgcatatgctgaaatcaatgaattcagtcatgcatactgccaactctctccgctcattacgcttgcatatatgagaattcatggtgctctgctaaataaagggttatgtttgggggtcactgccttttaagagcacaaaactgaagctttaaatgttttagtgctttccacagcttagtgtttaaacacgtgctcagagatgaattcattaaaatgcactcatcctctcaggccacttaggattgcccacatgcatccattctcaggctatttgaaaacaggaggaagaggaaactcaacaatggatatttctagtacagaaaggatttatgattcagaacgtataacaatattctggtgactttgcattcatgcactactatccttttctataatctttccagtacattttagaataaactgtgggcttgctacaaactgagaagaacaaatcaatgaaaataaaagatataggtaatcaaaagaggtcttcaattttcctcctgaaaactcagacaaggtggaggctcaattcagttaggggaagattgggctgttcataattgcctatgtgacttgtcagttcctttttaattcgtacaaaacctttgtgagtgtgacattatatctagacgatagttatgttaatttccctaattgtgatattatctgcctatcaatagccacctattctaaactttaaaacatgtagcaatttttcatgcttgaaactcaaagtgacaataacgttggaaaaaaataaagacatttcctgtgaattcagttaaaatagaatgctcactttttccacagaataatgctttttaaaatttttattgcttatgcagtacatgcttattaaggaaaatatggttaacacaggaaaataaaaggaaaattgtaaactgtaattttactaaagacgtctacataacatttaggtacagtttcttttctcaaggcatctataaaagatatttgccattcttgttgaattctcagcatgtgtgtttgaggaatttccagcttatgaagcagatcttgcctctcattttagaagcagaaaacccaaggcttattttcagttggtcccatagctaagtgcaagcacattaacttcggctatcccaatttgatatgcacactctgggctttggattgagaattcttgaggcaaagcagcagagacacaggagaatgtattcccattggggtggagaggcagtagcatcaatatccaatttccagagggagaagaagcaacaatttcagtgttagcatcatttacatggttttggtgataaaacatttttgagtgacagtgactatgccctgcagttctggtggcagtgtagctactttaatggttctgaggtgtgatttatgtattgacagtgactaccaggccccacacttgttcttctagctctcaaagtttacaagtttcctaacatagtatcatgcctataatcttagaactctgggaggctgaggcaggaggatcacttgaggctaggagtttgagactagcctgggaaacataacaagaccctgtctctacaaaaaaattaaaaaaatgtatccaggtgtggtggcgtatgcttgtagtcccagctatttgggaggctgaggtgggaggatcactcaagcccaggaatttgaggctgcagtgagctatgatcacatcactacactcaagcctaggcaagagagtaaaccctcttgtaaacaaacacacaaacacaagtaaataaataaaaatttatttttactaagattatctgagttagtttatactgctcacaactaaaaacactgaatcagtggattattttttattatgtggttggaatcctatttatcatgtttcttagtctggggtgaattctacctagggaccggaattttctgaaggaaatttttatgtatggtttcagagttatgttcataattaaaggaaatattaataaaaaattccagttccatttgcaaagacagaaactgattcattattttgtaagttactttttaaggtttcttcaactattttgcttgctgatttgataattttcttccttagagttcctttaaaagacataggtcattgacttctgcttaataaaactcctatttttttaaaaaaaataggtttattgatatataatgtacacgtttaaatgttcaatccagtagtttttagtatatttacagagttgtgcagccaacccaataatctaattttaaaacattctcatcattccaaaaagaaattgtgtgcctcttcacagtcattatccttttacactccttcctctctcctttagcactaggcaaccaggcaactgcaaagctaatttctttctctttagatttacctactctttttatttcatagaattggaattacacagtatatcgtcttttgtggctggcttcttccacttagcataatggttttgagattagtctatgtcataatacatatcagtatttaatttcttattatggattgccaaataaaatttcattttattgcaattccatgttttatttatccattcatgagttgataggtagttaggttgctttcacttttttgctattataaataatgttgctatgaatgtctgtgtataagttgtgtgtgaatttatgctttcatttctcttggttagatacctaggagtagaacatctggggtcctatggtaactctgtgtttaacatattgagaaactgatgaagtgtttgccatggtggctgcaccattttacactcaattcaatttaatgtatccacattcaatgcattcggtttctccacattcttgccacagtatgttattgcctgtctttttgattatagctatcctagtaggcatgaagtggtatttcattgtggttttgatttccaattccctaattgagcaaataattatggaggctgaaaagtctcataatctgctatccacaagctggggaaccagataagacagtggtgtacagtagtcccctcttatttgtgatttcactttccatggtttctatatgtgtatgttataactaggtggttcatagtattgcgtatgttctctattttcttattaactatctctgtagatgttctgtccatcattgaaaggggagggtgttggagtcttcaagtattatattactgtagagctattgttctctttatttctgtcaatatatgttttatacattttggagctctgttgttaggtgcttttacatttacaattattatatcttcttgatgggttgagccttttagagttgtgtaatatccttcttggtcccttgaaatagtttttcacttgaggtctaatttgtctgttggtatagctaactcagttcttgtttagttactgtattacatgaaatatattttatcctatttgtagctctagatctaaagggagtttcttgtagaaagtgtgtagttggatcactgttttttttcattatgccagtttttgccttttggttggatagttttaatctgcttacatttaaagcagttactgagaagaaagggttatttcaatcattttgcaattgttttctgtaagcgttaggccatttttgtttctaatttcctcttttattgactccttttgtattcaatgtattttttgtagttaaaccattttgtgtcccctttcatttccttttttgtattattttttaaagatattttatttgcagttgcatggaaatactttaacatcttaagtttatgacaatctagttttaattgatatcaatttaacttcaatagcatagaaaattctctgctccaggacagttctgtccccacttgtatgttgttatcatcaattatatatttatacatcatgttcttaacaacagatcataattatttttatgcatttgtcttttaaattgtgttgtaaattaaaagtgaaattatgaatcaaaaatgcaactacaatacagtaacactggattttatatttgcccaggtagtcaccagagagctttatttcttcaatgacactgagttacggcctagtgtgcttcaatatcaaccttaaaaacatcctttagcattttgtatagggcaggcctactgataaaggactctcttggtttttgtttatttgagaacatcttaatttcttcctcattttttgaaggatagttatgatggattagaatatttttttccagcaccttaaataatatcatcccattgccttctggccttcataatttctgataagaaatcaattctttttttattttattttattttattattatactttaagttttagggtacatgtgcacaatgtgcaggtttgttacatatgtatacatgtgccatgttggtgtactgcacccattaactcgtcatttagcattaggtatatctcctaatgctatccctcccccctcccccgaccccacaacagtccccggagtgtgatgttccccttcctgtgtccaagtgttctcattgttcaattcccacctatgagtgagaacatgcagtgtttggttttttgtccttgcgatagtttgctgagaagtgtaagctctattagggtctggactcattaatagttattgaatgaattaatgagtttttaaaaataataaaataagctgaaaataaattttttattttcatattctcataaaatcatcattctcagaaatcaattcttttaaaatttattttcagattattatttttaaaaactcattcattcattcaataactattaatgagtccagaccctaatagagcttacactttaattggggaaatatacaataaatataatgaattattaaattatgtagtattctggaaggtgataaatgctatgaaacaataaacatcaggatggaggatagggaaaaattgtgcatgttgctgagggggagaagatatgcaattttaaataaggtaatcaggattggccttattggggaaagatttggtgaaatgaagaagtttgtcatgccactatcttggtggccagcattctatagagaaggaatagtcagtgtgggtcctgaggttgtagcatgtttagcaaagttacagaacaataaggaagctaatgtagatggatccgtgaatgctgatgagcacaggaaagaataggtgaaaggaggaaagttagaaaaggctacatcataaaagtgcttctaggccattgtaaaaattttggcttttcctttgagttaaatgggaaggcagtagagggttttgagtagaggggcaagatggtgtgatgcagttttaaaataatcattctggttactttattaagaatcaactgtataaaggaaacagtgtggacactattgtaataatgtttttgaacatttattttttttgtttggctctgccctacttatgctttagctcatttaattctcatatcagcactttgaagaaattgttatttttcccttcttcactgatgagttaagtgaagctcagagcagagaatcccttgcttgaagtcctctggtaaactgttggtgaagattggatgtaacccaagtctgttggttggacgatcccggttgtcacaactcaaaaattctatgcttcattactcagctacatgcacttttggccctcccttccaattcaccagctctctaagcagaattttttttatattttgagaattttgtccccataaattttttttctgaatcaataacaggaaaattagacatttctatgaggaaaaaatcaacaaggaagcacaatgtagtttttgaggaatggctgggtgagtgtgtttagaaaagagagaaccctccatgacatatattttactagccaataggaaagtagtaagacttcttttacttttaatattagttttaatgtttttaaagaaaaaatagaaattaaatctgtcacattatcacatatgcaaagggtgtaaatacattaaacatattcaatataattaccacaacttgaaaatactttattcactacaaactttatatacatttacttcttatataaacagatttttcatatatatatatatatgtatgaaaacacaaaactaatgaccttgtacagcccttctgaactttattctctattcctgcttggccctaagggaaattattccaaccttattgttctacatggtccatgtcattctggatttccttagcttttgacatattatcaatgataagtaggaaattgttactgttagaagtgtgagaaatgtttgtaagtctcctgcttttctatttgatgaaatagtttaccaggtactaatcataaatttttagaggaaattttgcatttgcaaaaactaaattcaaatgttgagctggccagcatttatttttcacatttattttgtatttcataggcttgataccaagcttcttggtattctttatgtgctttgtaagggcggggttcactctgaaattgctcagttcactgtttctaagacattggcaggatttggaaaaggacatgaattcagctgctgggtcagaaatgtcaccatcatgaagttagaagatggaataatgcaacagtgtgctgtacttggtaaaaaataaaaaagtgtgagagtgaattctgtaacaattatgtccgctttaatattttcccatacaggtaatttcaatatcttgtactttgtccagatgcaaaatagtaagcaatgtttatttttgatttaatgtattttgtttaaaagagaatacttacaatgatgtaagcctttttgattctttcatatttgtttaaaaatattttgaatttttctgatactgatctaagtaaaaaaacctgggctgttttaaccatctgcctagtagtctgagccagtgtttgccttcaaacaatggaaagattcatactgaactttagaaacagagggtagagtaaattttgaaggcagattctttccaagcttagcaaatatgaaaacactgggatgactttatttaaaaatgaatctcactgaatttgattttgtgcattattctgtaattcttattgtcaaaatgcagacaaaagagtgaaaaatcttctcttttatatttcactcttgttttattattgtcgtttaaatttttgaacttaaaaaattctgcctataggtctcagtttaagggccatgagtagtgagtgaatgatgccagtttttttctggaaagcattgaaaaaatactgtctgggtatttctgtcacactagaagggaggtgctcggtaagcaacacaacaatatgtatgttcacagaagccaaagcaaaccaacaatccaactgacgaggccagtatttttccttagaaataaatgtcttagaaaattctactgaatttctctaatatgtgagggccaggagttatatttttcaaatgtatgatactttggtagtggctgatgacattaaatttgagggctaaacttcatattcatattttacagctgaatatggttccatatgtctaaaacattaattaatgctagtaccatatcattcataaatttaagaaaataataactttttacatattaggctttttcttgacactttaacattgtatgataaatatatgttttaagaatgaacattcaaaaacattatattcaaacaattagatactatatattaaatttgcttatttaaaacatgcacacaagcttcacagactttattgagcatatggcaatgctgtaatgaccacttatcatttcagtatttgattttaattctttgaagttgttgcattcattaaatgattgaatgtgtaggcacatttgtatgtgtgtgtgtgtgtgtgtgtgtctctttgtttattggtatcatcagaagaaattcagctggaacacatatgtttagcttgtttagactccgaactttttgtaacaattggatatttctggttttggcttcaaaatagggaagagatttgagaaatagaccatgatttgccattgaatatttgcttttattctgttcttcaaaaatattttgttttaatatcggtggaggcacaacagtaaagtgtttgttagagagtattattttagacaaatatctttaaaaatcaaactgaagagtttaaaggagaagtttgtactacacattcacattctcaaaaagtttctgctttcttgagcaggattaacagtatccctaattcaaggaaagatgatctgtaagcactgaggcctggatgttactttttacacttaaaagtatttcttgttatgttatgagtctcagaaatgtgctagtatatatcttcttgtagtaaatgtgatgctttcttaggactattatctcatttctttctggtaagacttctgaataatctaagcaaatgaaagaaaaggtctttctgtggaaggatgtgtgttaaactcaccctcttgctcagctgttattagtttacatgtatccaaactattgtgcagattcgttttctaagaggtaattcacttgtctacaccttgcctagtttactcatatgtaacatatattggtatttttcaaccatatagtcttttgtcacacttgtgactttttttccctaaggagttgcctttgaagatattttctcctagtccttattctattttcagtgaggggagaggaagagaacataaatagtattcttcctctatttattggaatgtacctttactgttttataatctagctatttaaaaaatctgtgaaaaataaaaaatgataggaattttcttcatatttttagggtcttaactgactactttttagcttggtattcaaaaataagtaatggtcaaaaagtatataattttttaaaatttcactttctcagaaaaaaaatcaagagaatgaaatatacatttgcctaatgatttaactagatttccttttcagttaaatgccatggaagaaatctttaaatctttaaatctttacattctacaaaatgagttttcttgagcaaagattttcagttcctacttcttgaggttaattttccattactctagtgggaaaatgaatcatttaactttttttcccattttatatctctaggcaaaaaagcctattttatacagattttatacagattttgtttcccttcacttacaatattatgttttaaagattctttaatctcttggaaaaactatatatcattttaatgtcacaaatgtatattgcaatttgtaaatgagatagactggcgagtttacaagtattttcctgacatatttttgttcattgcatataataatttagagttttcaaagaataaatttaaagcccattttattttgggtggaggctaacatgttattagtgtctttgtcacatttatacactacctttctcaatttgaccatagctgcctaaaaattgctttctgtttctagagggtatataggacaggactggtaaataggagaatggggtcctagactggcaccatgatggtctcacactaatcttttacctcaggaaatggaattaagaatattcatccacagaggtatagggtgagcttatgaaacttgaagtggcggaggcagatttggaattcctgcgagagcagccattgaaacttgggtctcttggcgttgctcttttcttccgactggacctggtggtgtctgcatcgttggggtcaaacacgactgtcatggactccattctggtcacggtgtacatactgctttgccggtttggatgaaacctggtggtcttgagctctagctcatcatagctggaaactttgatgaaaggacaccagcgaaatgctctcttgaagccagctcgaaatctgaggaaaagcaggccacagaaagaaaaagttattttttcaagcagatatgtctttcagctgccacagaaaattctacctaaggcagttataacaactcagtttttgagtttggtttttagccagactcttagaatttatgtcacagtactgttgttagtcgtttagttcttgtttgaattgaatcttaatttcccattaatgagaagcattgattcccagcaatgaaaagcatctcattcccatcagtgagaagtcatcaatagcgaatgcatagcatcaggtaatcaatatgttaaagaaacagtacatttttctaaaataattgtatacatttacataaatataattgaattaggctggccagttaaggcacttaaaaatgatatatttcaaaatagtttctttcagaaatgattacacatttataaattaaagtctcgtttaatgttagaattgctaatcttgatgatttttatctaattatatatgaaagtgcaaaatccttaactttgtaaaccattaaatgaagttaattaaaagtggatgtaatgcttgtggggtgtcaggaattgagatatggcttatgcaattagtgaaaaaaaaagcaagagttaattaagtatttaacaaacttaaggcacagtgtggtagaaccccaactgagaagagagcttaggatttaattcatgcagttacttacataaagtcccaattctacttgtgaaaaaaacacattggtttattacaggacttacgagccctatgaaatttaaccctatcccttcatgtgctgaccagtacaaccaaggtgtttttatctggaaagcagattttatcttttttttctagtcttacatttgactacaaatattctcacttttcattttttaactttataaacatctttcccttgaccactgtgatttcttcacaagccatctccatagaggctgcatgctctcttactcaccccacctcacaatgcaggaaggaggattggagttcccattgtttttacaaaaccttctacttcaaagtttatttatttacaacatatcctttttaataaagtccgctcacatatgccatcatctctccatcttatagaaattattcaagaatttctaggaagtaacttcatttcattgaggatttgagcatattttcaattctcctttaatcatgagggcacttctttttctttggcaggtaaaattctgagattttggaggaagaagttggcccatagaagaatcatccagttagaaccccaagatcattatttggggcatctaattattaatgtgggatgctttataaagtgtgtatgggggtcttgaaagataaagcctgtgcctctctcagtgaattcttaaattttcccttccttctgcattttgaatttgaaccaagaaaatggaacaacattgtatgtttccagtgaaggtgggtgtgacaagcaacttgcatttcgtagttttgtttttaccttttattcagacagcagtagatgatgggattgtacatggttgagctcattgccagccaaaagctagccaggtagacctgctggatgtatttccatctatttagttgttgatagattgcagtgagaatgaagtaaatatgatagggcagccagcagatagcaaatgtcatgacaacaataatcatcattttgacaacctataaagaaaaaaagtcatttttgacaaatataatactcataatagttccaatagcttattgcaaatcatgcttttctgccaatacagttaaatacacatcatgcctagggaatagtcaatatattaaaaaatggtgaagcaatatacggacagttgcctaaggtaagtctcaagaaattatgctatgtcactattcatttctacctatctaagtgaatgggtagtgctaactcaaacacggacaaatatattttgattggcctgaagaaaatcagtgtttacaaaaacccagagagcctggaacagagagagataggaactaggatgtggctgtgtagcctgcattgtacgatagtggagatattatctccaggaaatcaactgttaagtcactatggaggtttactaggctgctagggctgggtttgttcaagtcagtactcttctatagcctgactatagcttaagactatttagatttctttaatagcctgctcactacgtaaccttatgaatattaatttggtttctcttataatctgatattggggaagatttccccaaatagtgattatgtgtaaatattcacgttagtgtgaggaaaatactaacttgagatttgcaaatagattattggtttatgcaactgttttatgcattagcttttatgactttggtaagcataagccatttcctttgattgtatacttgtgaatgataatatcctggacagctctaatcaaagtagaatgtcagctgttatttctcttccactaggcctaaaattcctgaagacagaatgtcttaattatctttttactcccagcatctatcacagtccttgatatatagctggagataaatatatataggatgaatgaataataaatagcaatgtacaatgaacaatgttcatatctcttttgggaatttggaaatagtaaaaagtttaaaataagatactttaagctaaacaattttgaagcttacctgcagtcagattaaaacaaatcagggaaagctctgatgtaaagggcctatgaggcacctcagaactaggaagatacagtatttatgaaatggacttgtcatttgactgcaaattagggattcagatgaaggttggcaaggtttagtcaggagagacatgattttagaaataggcaaagcatgaaatggatcaatgtggaaggtaactcttccctaagggccaaatcactgtaccatccaggtggccagcattgagcagatggaaattggccatcagagttgaaaatccaggtcaacagctcacaaaatgtcatcactggccacatcacataatatcttttgattttcccagtgttctttaaattacattgctttcttctgaagaactgcttttgtatttctgcattttatttctcagatttcctattcataattcatatatttgtgaaaaacaaatgatttaatttacatttatgcaatattttacgtatttaacaattaattaattgtctttcaattgcgcattaggaaattgaggcaaaaacccaaagatctgaccactgtgattcatgtaactaagatctttcttgtctttttaccctctatttacagataaaaacatctgttgaatatcttgagtctagaaaataacattgaaaatatagtggttgaggaccaattcctcatcctgaagtttacaatgtaatgaaaaaaaggaaatgtataattttaataaaaatgcatgcattgaaatgtggtgagtatgaacatgtgcagataaaatttaaaataatatttatgagaatgtactagtttattgtaataaagaatgactcaatacatgcctactaactgtaggctcagaggatattagactaaatgaaattagtctactgatgttttcattgttgaatttgtgagcattctactattccttgaacagggtagttaagctccagccatagattattttccctggctcctccctctacctagaacactcttctaaccatgattcccagggcttaagtacctcacctccttcaagccgttgcacaattgtcattttttctttgagtgctattctgaccaattaatttaaaatcacagtctgcccttccagccctcccagaacctcttagcttgctctttctcttcagtttgttatgttttttctttattttgtgtctcctgatgctggactacaaaagagcaaggattttctgtttgttttgttcatttgtatatttcgggcacctagactggacttcatacataaagggtactcagaaattttttaaatgaacaggtgaaagtgactataaaacaaaagaaactgaaagacgcagacagttaagtaatgtctaagattttagtcagttattactagtatcatttggttttcatttaagatggacatgtgtatgtaaaataagcatggaatttactgctatttctgctttcaaggcaaacaaatttaaaaagagaatgagtccaaaaataacctttttttttttttgagacagagtctcactcttgtcacccaggctggagtgcagtggtgcgatcttggctcactgcaacctctgcctcccgggttcaagtaattcttctgcctcagcctcccaagtagctgggattacaggagcgtgccaccacgcctggctaatttttgtatttttagtagagacagggtgttaccatagtggccaggcttgtctcaaactcctgaccttgtagatccacccacctcggcctcccaaaattctgggattacaggtgtgagacactgcacccggcctaatataattattttcatggggcacatgaaagcattagatttcattctaagcaaatgttaagagcaagtaaaatatctttgagaatgttaacatatattgtatttgaatcttttatacagactgactacaaactccctatgcacaaaattgttttccgacaattgctgaaaacctactaaggctatcagtccttttagataaatttcaattttcatagtgcaaaaagttcagaaaaacatgcaaaaattaaaatgcatgtggaaaatggaacagagacttcagatagcttttaactcacatacagagggcctttagaacttcttgcgaaagatttataaacatattttaaaaattttaagaaaagcttaaaatactctacagaaatgtttataagtgaaacagctgctataatatattttctgtacttatttctatataatactgttaccttggcactctgcttacaaaatcttgtagtgttatttcagatgatgaactctctggactctagttttgatgtgaatgcaaacgtaggctcttgggtgggagaaattgtcttgctttgtgaaatgctgaaatcacaaaactgaaatcaccctcctgataaaatgccaaagaaaagagctctttgaagcatgaagcttgagcaatgatagatgtgcaggtgctatgagcagttaccactgtattgcatggctgaacaatggtactagtgcaggcaggctatgaactgttaaacagaaaaaagaatcaggtggtaaactttaagaaattcttgagatttttaggcaagatgacaatctgggacagagaaggttcaaatctctcatcgtgtcttaataatgttattaagtgggtagccacccattacccttggaaacttacaagcaggataaaggaggaaagtggggacatgtaatgtagcccttacaaagttacattgcctatttttagcagttaagaatctaactacgtaggcaggatggaactgcatgtcctcatatattagtgagaatgaactttggataccattccttcatgtatcaaaggggaaagatcttagatttttgtataccgtacagattagaactgaaatgcctacagttgttcttattcattacattaaattagtgtaggatggatgattttgaggtttgggttgtaaaagcaaaaattagtttaggaaattaactaaaatgctgacaactatttagaaaactctaggggtcatattcttttttttttaattttggcaatattatcttctaattattttatttttattattatactttaagttttagggtacatgtgcacaatgtgcaggttagttacatatgtatacatgtgccatgctggtgtgctgcacccactaactcatcatctagcattaggtatatctcccaatgctatccctcccccctccccccaccccacaacagtccccagagtgtgatgttccccttcctgtgtccatatgttctcattgttcaatacccacctatgagtgagaatatgtggtgtttggttttttgttcttgtgatagtttactgagaatgatgatttccaatttcatccatgtccctacaaaggacatgaactcatccttttttatggctgcatagtattccatggtgtatatgtgtcacgttttcttaatccagtctatcattgttggacatttggggtggttccaagtctttgctattgtgaatagtgccgcaataaacatacgtgtgcatgtgtctttatagcagcataatttataatcctttgggtatatacccagtaatgggatggctgggtcaaatggtatttctagttctacatccctgaggaatcgccacactgacttccacaatggttgaactagtttacagtcccaccaacagtgtaaaagtgttcctatttctccacatcctctccagcacctgttgtttcctgactttttaaagattgccattctaactggtgtgagacgatatctcattgtggttttggtttgcatttgtctgttggtacaggattgattctttctaaatgcttggaataaaaatggtcagctaggtgtgacaaaaaacaaaacaaaacaaaactgcttgttttgattagaatcctttttttaaaattttattattattatactttaagttttagggtacatgtgcacaatgtgcaggtttgttacatatggatacatgtcccatgttggtctgctgcacccattaactcgtcatttacattaggtatatctcctaatgctatccctcccccgtccccctaccccacaagagtccccagtgtgtgatgttccccttcctgtgtccatgtgttctcattgttcaattcccacctgtgagtgagaacatgcagtttggttttttgtccttgcgatagtttgctgagaatgatggtttccagcttcatccatgtccctacaaaggacacgaactcatcattttttatggctgcatagtattccatggtgtatatgtgccacattttcttaatccagtctatcattgttggacatttgggttggttccaagtctttgctattgtgaatagtgccgcaataaacacatgtgtgcatgcgtctttatagcagcataatttataatcctttgggtatatacccagtaatgggaaggctgggtcaaatggtatttctagttctagttccctgaggaattgccacactgacttccacaatggttgaactagtttacagtcccaccaacagtgtaaaagtgttcctatttctccacatcctctccagcacctgttgtttcctgactttttaaagattgccattctaactggtgtgagatgatatctcattgtggttttggtttgcatttctctgttggtacaagattgattctttctaaatgcttggaataaaaatggtcagcttggtgtgacaaaaaacaaaacacaacaaaactgcttgttttgattagaatccttttttttaaattttattattattatactttaagttttagggtacaagtgcacaacgtgcaggtttgttacatatgtatacatgtgccatgttggtctgctgcacccattaactcgtcatttacattaggtacatctcctaatgctatccctcccccgtccccccaccccacaagagtccccagtgtgtgatgttccccttcctgtgtccatgtgttctcattgttcaattcccacctgtgagtgagaacatgcagtttggttttttgtccttgtaatagtttgctgagaatgatggtttccagtttcatccatgtccctacaaaggacatgaactcatcataatttatggctgcatagtattccatggtgtatatgtgccacattttcttaattcagtctattgtttttggacatttaagttggttccaagtctttgctattgtgaatagtgccgctataaacatacgtgtgcatgtgtctttataacagcatgatttataatcctttggggatatacccagtaatgggatggctaggtcaaatggtatttctagttctagatccctgaggaatcgccacaccgacttccacagtggttgaactagtttacagtcccaccaacagtgtaaaagtgttcctatttctccacatcctctccagcacctgttgtttcctgactttttaatgatcaccattctaactggtgtgagatggtatctcattgtggttttgatttgcatttctctgatggccagtgatggtgagcattttttcatgtgtttttcggctgcataaatgtcttcttttgagaagtgtctgttcatatccttcgcccactttttgatgaggttgtttgtttttttcttgtaaatttgtttgagttcattttagattctggatattagccctttgtcagataagtaggttgcaaaaactttctcccattctgtaggttgcctgttcactctgatggtagtttcttttgctgtgcagaagctctttagattacttagatcccatttgtcaattttggcttttgttgccattgcttttggtgtgttagacatgaagtccttgcccatgcctatgtactgaatggtattgcctatgttttcttctagggtttttatggttttaggtctaacatgtaagtctttaatccatcttgaattgatttttatataaggtgtaaggaagggatccagtttcagctttctacatatggctagccagttttcccagcaccattgattaaatagggaatcctttccccatttcttgtttttgtcaggtttgtcaaagatcagatatttgtagatatgcggcattatttctgagggctctgttctgttccattggtctatatatctgtttgtgcaccagtaccatgctgttttggttactgtagccttgtagtatagtttgaagtcaggtagcatgatgcctccagctttgttcttttggcttaggactgacttggtgatgcaggctcttttttggttccatatgaactttaaagtagtttttcccagttctgtgaagaaagtcattggtagcttgatggggatggcattgaatctgtaaattaccttgggcagtatggccattttcacaatattgattcttcctacccatgaacatggaatgttcttccatttgtttgtatcctcttttatttcactgagcagtggtttgtagttctccttgaagagctccttcatatcccttgtaagttggattcctaggtattttattttctttgaagcaattgtgaatgggagttcactcatgatttggctctctgtttgtctgttattggtgtataagaatgcttgtggtttttgtacattgattttgtatcctgagactttgctgaagttgcttatcagcttgaggagattttgggctgagacaatggggttttctagatacacaatcatgtcatctgcaaacagagacaatttgacttcctcttttcctaattgaataccctttattcccttctcctgtctgattgccctggccagaacttccaacactatgttgaataggagtggtgagagagggcatccttgtcttgtgccagttttcaaaaggaatgcttccagtttttgcccattcagtatgatattggctgtgggtttgtcatagatagctcttattattttgagatacgtcccatcaatacctaatttattgagattttttagcatgaagtgctgttgaattttgtcaaaggccttttctgcatctattgagatagtcatgtgctttttgtcattggttctgtttatatgctggattagatttgttgatttgcgtatgtcgaaccagccttgcatcccagggatgaagcccccttgatcatggtggataaactttttgatgtgctgctggattcggtttgccagtattttattgaggatttttgcatcaatgttcatcaaggatattggtctaaaattctcttttttggttgtgtctctgctgggctttggtatcaggatgatgctggcctcataaaatgagttagggaggattccctctttttctattgattggaatagtttcagaaggaatggtatcagctcctctttgtaactctggtagaattcggctgtgaatccatctggtcctggactttttttggttggtaagctattgattattacctcaatttcacagcctgttattggtctattcagagattcaacttcttcctggtttagtcttgggagggtgtatgtgtcaaggaatttatccatttcttctagattttctagtttatttgcatagaggtatttatagtatcctctgatggtagtttgtattcctgtgggatcagtgttgatatcccctttatcattttttattgggtctatttgattcttctctcttttcttctttattagtcttgctagcagtctatcaatcaattttgttgctctcttcaaaaaaccagctcctggattcattaatcttttgaagggttttttgtgtctctatttccttcagttctgctctgatcttagttatttcttgccttctgctagcttttgaatgtgtttgatcttgcttttctagttcttttaattgtgatgttagggtgtcaattttagatctttcttgctttctcttgtgggcatttagtgctataaatttccctctgcacactgctttgaatgtgtcccagagattctggtatattgtgtctttgttctcattggtttcaaagaacatctttatttctgccttcatttcattatttacccagtagtcattcaggagccggttgttcattttccatgtagttgagcagttttgagtgagtttcttaatcctgagttctagtttgattgcactgtggtctgagagacagtttgttataatttctgttcttttacatttgctgaggagtgctttacttccaactatgtggtcagttttggagtaggtgtggtgtggtgctgaaaagaatgcatattttgttgatttggggtggagatttctgtaggtgtctatcaggtcagctttgtgcagagctgagttcaattcttgggtatctttgttaactttctctcgttgatctgtctaatgttgacagtgggatgttaaagtctcccattattattgtgtggagtctaagtctctttgttggtcgctaaggacttgctttatgaatctgggtgctcctgtattgggtgtatatatatttaggatagttagctcttcttgttgaattgatccctttaccattatgtaatggcctttttttgttttccatttgcttggtagattttcctccatccctttattttgagcctatgtgtgtctctgcatgtgagatgggtttcctgaatacagcacactgatgggtcttgacgctatccaatttgccagtctgagtcttttaattggagaatttagcccatttacatttaaagttaatattattttgtgtgaatttgatcctgtcattatgatgttagctggttattttgctcgatatttgatgcagtttcttcctagccttgatggtctttgcaatttggcatgtttttgcaatggctggtactggttgttcctttccatgtttagtgcttccttcaggagctcttttagggcaggcctggtggtgacaaaatctctcagcattagcttgtctgtagaggatattatttctccttcacttatgaagcttagtttggctggatatgaaattctgggatgaaaattcttttctttaaaaatgttgaatattggtctccactctcttctggcttgtagagtttctgctgagagatcaggtgttagtctgatgggcttccctttgtgggtaacctgacctttctctctggctgcgcttaacattttttccttcatttccactttggtgaatctgacaattatgtgtcttttagttgctattcttgaggagtatctttgtggtgttctctgtatatcctgagtttgaatgttggcctgctttgctagattggggaagttctcctagatagtatcctgcagagtgttttccaacttggttccaatctccccgtcactttcaggtacaccaatcagacgtagatttggtcttttcacatagtcccatatttcttggaggctttgttcatttctttttattcttttttctctaaacttctcttctcccttcatttcattcatttcatcttccatcactgataccctttcttccagttgatcgcatcggctactgaggcttctgcattcgtcacgtagctctcgtgccttggttttcagctccatcatgtcctttaaggacttctctgcattggttattctagttatccatttgtctaattttttttcaaagctttgaacttctttgccattggtttgaatttctcctgtagcttggagtagtttgattgtctgaagccttcttctctcaactcctctaagtcattctccatccagctgtgttccgttgctggtgaggagctgtgttcctttggaggaggagaggtgctctgctttttagagtttccagtttttctgctcttttttttttttcccatctttgtggttttatccacctttgatctttgatgatggtgacgtacagatgggtttttgatgtggatgtcctttctgtttgttagttttccttctaacagacaggaccctcagctgcaggtctgttggagtttgcctagaggtccactgcagaccctgtttgcctgggtatcagcagcagtggctgcagaacagcggatattggtgaaccgcagatgctgctgtctgatcgttcctgtggaagttttgtctcagaggagtaccaggccatgtgaggtgttagtccagccctactggagggtgcctcccatttaggctactcgggggtcagggagccacttaaggaggcagtctgcccattctcagatctcaagctgcatgctgggagcaccactactctcttcaaagctgtcagagagggacatttaagtctgcagaggttactgctgtctttttgtttgtctgtgccctacaccaagaggtggagcctacagaggcaggcaggcctccttgagctgtggtgggctctgcccagttcgagcttcctgtctgctttgtttacctaatcatacaactaactcagcaatggcaggtgcccctcccccagcctcgctgccaccttgcagtttgatctcggactgctgtgctagcaatgagcaagactccatgggcgtaggaccctcctagccatgtgcgggatataatctcctggtgtgccattttttaagcccattggaaaagcgaaatattagggtgggagtgacccgattttccaggtgctgcctgtcactgctttctttgactaggaaagggaattcccttaccccttgcacttcccgggtgaggttatgcctcgccctgctttggctcgtgcacggtgcgctgcacccactgtcttgcacctactgtctggcactccccagtgagatgaacccggtacctcagttggaaatgtagaaatcacccgtcttctgcgttgctcacgctgggcgaacttatccttttttatggcggcatagtattccatggtgtatatgtgccatattttctttatccagtctatcattgatgggcatttgggttggttccaagactttgctattgtgaacagtgctgcaataaacatacgtgtgcatgtgtctttatagtagaatgatttataatcctttgggtatatacccagtaatgggattgctgggtcaaatggaatttctggttctagatctttgaggaattgccacactgtcttctacaaaggttgaactaatttatattcccaccaacagtgtgaaagcattcctatttctccacatcctctccagcaactgttgtttcctgactttttaatgatcaccgaactacaaaccactgctcaaggaaataagagaagacacaaacggaaaaacattccatgctcatggataggaagaatcagtatcttgaaaatggccatactgcccaaagtaatttatagattcaatgctatccccatcaactaccattgactttcttcacagaattagaaaaaactattttaaatttcatatgggaccaaaaaggagcccatatctccaagacaatcctaagctaaaagaacaaagccggaggcatcaggctgcttgacttcaaattatactgcaaggctatagtaaccaaaacaccatggtactggtaccaaaacagatatacaaaccaatgcaacagaacagaggcctcagaaataacaccacacatctacaaccatctgatctttgacaaacctgacaaaaacaatcaatggggaaaggattccctatttaataaatggtgctgggaaaactggctagccatatgcagaaaactgaaactggatcccttccttacaccttatacaaaaattaattcaagatggattaaagaattaaacataagaccgaaaaccataaaaaccctagaagaaaacctaggcaacaccattcaggatgtagacatgagaaaagacttcatgattaaaacaccaaaagcaatggcaacaaaagccaaaattgacaaatgggatctaaattaaactaaagagcttctgcacagcaaaagaaactaccatgagtgaacaggcaacttatagaatgggagaatttttttgcaatgtatccatctgacaaagggctaatatccagaatctacaaagaatttaaacaaatttacaagaaaaaaaacaccaccatcaaaaagtgggcaaaggatatgaagagacacttctcaaaacaagacagttatgtggccaacaaacatatgaaagaaagctcatcatcactggtcattagagagataataattcttttttttttctttttattattatactttaagttttagggtacatgtgcacattgtgcaggttagttacatatgtatacatgtgccatgctggtgcactgcacccactaactcgtcatctagcattaggtatatctcccaatgctatccctcccccctccccccaccccacaacagtccccagagtgtgatgttccccttcctgtgtccatgtgatctcattgttcaattcccacctatgagtgagaatatgtggtgtttggcttttttttgcgatagtttactgagaatgatgatttccaatttcatccatgtccctacaaaggacatgaactcatcattttttatggctgcatagtattccatggtgtatatgtgccacagtttcttaatccagtctatcattgttggacatttgggttggttccaagtctttgctattgtgaataatgcggcaataaacatacgtgtgcatgtgtctttatagcagcatgatttatagtcctttgggtatatacccagtaatgggatggctgggtcaaatggtatttctagttctagatccctgaggaattgccacactgacttccacaatggttgaactagtttacagtcccaccaacagtgtaaaactgttcctatttctccacatcctctccagcacctgttgtttcctgactttttaatgattgccattctaactggtgtgagatagtatctcattgtggttttgatttgcatttctctgatggccagtgatgatgaacattttttcatgtgttttttggctgcataaatgtcttcttttgagaagtgtctgttcatgtccttcacccacttttcgatggggttgtttttttcttgtaaatttgtttgagttcattgtagattctggatattagccctttgtcagatgagtaggttgtgaaaattttctcccattttgtaggttgcctgttcactctgatggtagtttcttttgctgtgcagaagctctttagtttaattagatcccatttgtcaattttgtctttggttgccatggcttttggtgttttagacatgaagtccttgcccatgcctatgtactgaatggtaatgcctaggttttcttctagggtttttatggttttaggtcgtacgtttaagtctttaatccatcttgaattaatttttgtataaggtgtaaggaagggatccagtttcagctttctacatatggctagccagttttcccagcaccattgattaaatagggaatcctttccccatttcttgtttttgtcaggtttgtcaaagatcagatagttgtagatatgtggcattatttctgagggctctgttctgttccattggtctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcagtggtagttggatggggatggcattgaatctgtaaattaccttgggcagtatggccattttcacaatattgattcttcctatccatgagcatggactgttcttccatttgtttgtatcctcttttatttcactgagcagtggtttgtagttctccttgaagagctccttcatatcccttgtaagttggattcctaggtattttattttctttgaagcaattgtgaatgggagttcactcatgatttggctctctgtctgttgttggtgtataagaatgcttgtgatttttgtacattgattttgtatcctgagactttgctgaagttgcttatcagcttaaggagattttgggctgagacagtggggttttctagatatacaatcatgtcatctgcaaacagggacaatttgacttcctcttttcctaattgaataccctttatttccttctccggcctaattgccctgtccagaacttccaacactatgttgaataggagtgttgagagagggcatccctgtcttgtgccagttttcaaagggaatgcttccagtttttgcccattcagtatgatattggctgtgggtttgtcatagatagctcttattattttgaaatacatcccatcaatacctaatttattgagagtttttagcatgaagggttgttgaattttggcttcatccctgggatgcaaggctggttcaatatacgcaaatcaataaatgtaatccagcatataaacagagccaaggacaaaaaccacatgattatctcaagagataataattcttaattagacttagcaaatcatacttatcttttgtaacagatatgcggtattgttaagcatgtttttgtttcttttagtccatatcattgcctatgcattattcattttgtgcccctagaaattagcatagtttttgagttttgaattttgaaggtatcttttgacttttgaaggtatctgattttcagactcagtttatgaacatttgaattgcaggaagcattatgtatttatttttatcttaccagtgtttagtgttattatgctcataataagaattcaaaaatattatttaaaataaataaaacaaaaatacttttaaatattttatatttaaattaaaataatctttattgctcttagtttttgtctctagcaggctggatgtttggaaagaatagctatttgagccatgtgataatataggcttaagaaagaaatacagttgtttttgtgtacttaatctattgtatacttagattgaacatatagagaatattgacttcaaatatacattttagatgatatttaatgccatgggaatgaatgaaattactcagagaatagagagtgagaagtggtctagattaagccccaaataagtcagacattttgaagtcagtcagatagagacaaagggctggaaaggatatcaggaacaagcagtgtttggcaagaaaactgctataacgtggtcagaaacatcactacagggttttcctctcctttaggagggattgccagtcctgtagaatgttgctcaaagttttagtaagataagaaatgatcgtttccatggagactagtggttgaactgaaccagagtacctgtggtggaattgtgcagtcaaaatctaaatggaaaggtttaaagtgtgaatgaaatattattggatacatacctaaaagaaaataaatcattctatcaaaatgacacacgcactcatatgttcgttaccacgctattcacaatagcaaaggcatgggattaacctaggtgctcatcgataatagattggataaagaaaatgtggttcatatacaccatgggaaactacatagccataaaagtataaaatcatgtcctttgcagcaacatggatgcagctggaggccataatcctcaatgaattaaaaccgaaatagaaaacgagataccacttgttctcacttataagtggaagctaaacattaagcacgcatggacataaaagtaggaacaatagatactgtagactactagaggcaggagaaaggggagcataggtggaaaaactacctattgggtcctgtgctcactacctgggtgatagaatccagaccccaaatctcagcatcacactatatacccatgaaacaaatttgcacatgtaccccgtgaatctgaaataaaaaaagaattatggatgttttcattggttataatggagggacatagattggaagctgggtggaggatcaaaagataattttctaaaattaaacatactgaaaggtgtttgaatgctattggaataagcctataggtcgccaagtacaaccgaaggcttatgctttctaacagagtatgagcaaatggattctgcaaactttggggaggtggacatttcttcattgtaataaaaaggtatgattgtagagagtatatcaaatggatttgtaagtaagttacatggtcagaaatctaatttcatctattgtctcctagtttcttaataactagtgctcagtgtgcctacaaacaaggtagcacatagaacattctgaataaatatttgtaaaatcaataaattaatagagcctgaggcaatgtcattagctaaatagatgaggaattaatttgattagaaaacagtgtattcttccctaaatcatacatatttcatataaaattgaaagtgctcagaaattgggctgcctctagggtggccaaaaatatgaagtgtgtaatagggaactacacagtgtaatgaatatcatagcacaggcttcattatgctgtggaattattagtgataagctactaatagaaaaagatagatatttgttggccttattcactgcattctatttcaacagtggccacaaaattatttccatacacaaatgtttttgtaggatgtaatattgtgttagtgtgatttatttacaccctaaagcaaatataattcaaaatatatgttatagaagctcttgctgtcttccctcaatatcagcaatgcaaaaagaaagaaactgctttttattataagaaataactcaaaaaggagcaacataaaagtacatttggtcttttatttttatgttttattttgtttataattaacagataatggttgtacattatttgtggggtagtgtgtttcaatacatatataatgaaatgatcaaatcagggtaaacagaatacttatctcaaacatttgtcatttctttgtagtgagaacattcaaaatcctttcttttagctattttgaagtgtacaatacattattgttgactatagacaacctactgtgtaatagaacatggtaacttattcttcctatcgaactgtaaatttgtacctggtgaccaacctctccccatcccctctcctgccactctcctcagcctctggtaaccactattctactagtgattagtgagaagtaaccactcacttcttctataaggtaaactttgttagattctacatatgactgaaatcttgtggtgtttgttcctctgtggttggcttaacataatgtcctctaggttcatggaaactgttacaaatcataaaaaataattttttatgactaactagcattgtattgcgtatataaccatattttctttaaccatgcatctcttggtggacacttaggttgattccacttcttggctattgtgattagtgctgcaataaatataggagtgcaggtatctcttcaacatgctaatttcattgcttttgagtatgtaccttgtaatggaattgctggactatgtggtagttctgtttttaattttttgaggaacttccatgttattatccataaaggctgtactagtttacagtttgtccctccaatagtgtataagagttctttttcctgtgcacctttgccagcatttgttattttttgtctttttcataatagccattctaactgggatgagattatatctcattgtgattctaatttgtgtttctctaataattagtgatgttgagcattgtttttcatatacctgttagtcctttgtatgtcttcttttgggaaatgtctactcagatcctttatccatttttaaattttattattactattatttttgctattgagttgtttgagttccttatatagtctggatattaactacttgtcagaggcatagtttgcaaatattttctccaattctgtagattgtcccttcactctgttgattatttcctttgctgtacaaaagctttttagtttgtcatcatcttatttgcctatttttgcttttatttctcttgcttttgaggtcttattcaaaatatccttgtccagatcaatgtcataaagcatttccccataaatttgtctagtagtttcatagttttgggtcttacatttatatctttaatccattttgagttgatttttgtaagtgttgaaaaacagaggtctagttccatccatctgcatatgcataaccagttttcctagccccatttaggggcttgtcctttccccaatgtgtgttcttggtgcatttgttaaaaatcagtcgggtgtaaagtgtggatttatttctgggttctctaatctgttccatcggtatatgtgtctgtttttaggctagtatcatgctgctttcactatttttgtttttagtatattttaaggtcgggtagtgtaatgcctccagctttgtcctttttgttcaagcttgctttagctattcagggtcttttataatttcatgaaaattttaggattgtttttcctatttctgtgaacactttcattggtattctgatagggattgaattgaatttgtaaattgttttgggtagtatggatattttagcaatattaattcttccagtccaagaagatgggatatttttccacttattagtgtcctctttagttgcttttgttaatgtttcatagtttttattgtagagatcttccatctcctcggttaagtttagtcctagttactttatttttttgtagctattgtaagtgggattgatttcttaatttcttttttagagagtttgctgttggtgataattaataactaattaacaccttaaagagcaaaagtaaggtacacacagttgcctcctaaggcagagggggagtaaaatttgttggagaccttttatgtgcaaggctctgtgccacatgcattacctcttttgaactaatgcaatctgtacatattggaggtgccagctaattatgtttcaattatagttaaactgtctagtagacaagcatttccttttttttaacacagacatggcatcaagaagtagaggagaatgattctggagcaaaaggccaataaaaaagtttacttttttgcccctctaaaagctacattcttcttgtgaacatccacacctcagtaagtgtcatcatcatctatctgactgccagagacagacacttataagtcatggttgtttctttggttttcctcattttcactgccccattcaatcacttggcaaatcctattgaccaagacatcaaaataagtcttatatcttttaatatcttgtcatctctactactataacctctgagaaagcattgttgtctctctcctaaacaaatgcgataaccatctaattggcctctgcttccaaatagcagatacagtaactttttaaaaaatgtaaaatagattaccctctacttaaaataattttcttattgtatctgaaataaaactgaacattcaaagcttctgttatattttgctgccgtgttctccagtctcacccattacatactcccattggttctttatgccccaacatcctgacttctttctgatccttaaaaacatcaataattttcctacttcaggcattgcttatgttgtctttcttgcctggagtgctcttctcctaattctttgtgtgctttatttgttcttattgataagaactcagctagaatatcactccaacagtcatttcctaccaccctagttgaaaacaactccgattgcaattattctctttcatggcttatttccttcagcttttccagtgtaatttgttactctcttgtttatttaggggttatctttgccctgcttaaatgcaaatcccatgaagttcttttttttttttcttgtggttattttttgagacagcctcgctctgtcacccaggctggagtgcagtggcttgctcttggctcactgcaacctccgcctggttcaagtgattcttgtgccttagccttctgagtacctgggactacaggtgtgcaccaccacaccagctaatttttgtgttttttagtagagattgggatctcgccatgttggccaggttggtctcaaactcctgacctcaggtgatctgcccaccttggcctcccaaagtgctgggattacaggcgtgagccacagagcctggcctgggaagctgtgttttgcatttctctctctctccagtgcttagaagaatacccagagcacatgataaccctcttttaaataaatgaataaatgaatatataaatagatgaatggta

SEQ ID NO: 99 - DNA, 28880 bp, Homo sapiens
aatgtgccatggttaagaaatgaggtaatattttacaggagagaacacatctacatcccagcatttctgaagtttgaggcacatcccatggggaaagcagaggctgggtgctcctgatgaagctaggcctaggaacaaagcaaggatggctcaggggcagctgtatttccgacttggatctgaacttgaggagcttcttcagagtgtcgggctggggctctgttgggctctgttgggcaccttcatttccctttccaggtttgtgtcagaccaggtgacatgggacatagacagtcagttcctgctgggcccagccttcctggtcagccctgtcctggagcgcgtgagtatggaggcctccgatgaggggaggatcccagctgtgaggcttggggaaaaggacgaggagaagaggcctgagctggtgggggtcctgagacatggtttcttattctacctgtgtctcttcctctctttctgagctgaagtccatcacttaggtgttcttggcactcagctccttcatctttaaaatgagcctaacaattctggttcgtaggatgatcaagaagaaaacacctcatggaatagtcaatgacacaatcatttcttcgttaactaaaataattaatagaaggtcagatgggggcagtattgtaaaaaatttataacagtcctctagcactattacaacttttcagaaggatgacttggcaatgtgtgtacttgtattgctgctggctaacccttcccttcctctacaggagctcctcccagcagtaaaagccatttctttacttctgttgttgattaggcttctgattaaaatatcaattaattgtacctccctcaaatatatatatatatatatatatatatataaatatatatatatatatatatatttttttttttttttttttgagacagagtctcactctgttgcccaggctggagtgcagtggcatgatcttggctcattcaacctctgcctcctgggttctagtgattctcttgccttagcctcttgagtagctgagactacaggcatgtgccaccattcccggctaatttttttttctttttttgtatgtttagtagagatggggtttcactgtattagccaggatggtctcaatatcctgacctcatgatctgcctgacttggactcccaaagagctgggattacaggcatgagccatcgcgcccggccccaaaatctcattatacccacaaaattttcttctgccccagacacaacctcccttgtttgtctctttaagagtcaaaggggtaagtctatgtctataagcaaacagtgatttattttttcccgaagtcctggatatcaaagtgctttatgaaagccacttgttttgggtagacaaatctctggtttaaaaaagaaaacaggaagaaggttgccccagttgttaacctcttgggacatgaggcagctgggtccaaagccatcacaattatttcacctctttcctaagcagtttggttactctgtcctggaaaatggtggcactgcctcaccttgtttgtgtttcattttagaatgccagaaatgtcactgcatatttccctagagcccgttggtacgattactacacggtaagtttttctgaatgtttatataacacgggaatgtggtagagagtacaaaggctttaggtccgatagaccttaggtcaaatgctggctctgtaacccacctgctgtgtggtcttagagaagccactttaacccttgtaatctcagttttctcacctccaagtggggtaagaccactttcctcatagaaccattgtgaaataacacataaagcatctcactcagggtctgtttttttgtgggtgttctctttgtgttagtttttaatatttctttatatcactgctatttacaatgttgtgtaaaggcagatgctagccaacatctgagattgtgttgcaaactatagtttttgtttttattgttgatatctttgcctgctgtaagtttgtaagcatagaggccgttttgtctcttttgattaaatacctccttccatagcatagatgctcaaagaggggcgctgcacataattacataaggcacacaagtgattaggcaatgtgcaaaacacacacagaggtatgggacccaacccttgtgtgtctaagtagtgcaagtgcatttagaaatgaggaagcaatgaagagctccttgccgcatagtttcattgctagtatgattcccaaagactcagctgggaagccagggtcttcccgggcagctctggggtggtgggctcttgctgggaccctgacaaatcagaccctgattcttggggaagaatcaaaggaggtatttccttcgtttctaactaggcctcttcttctgactttctgaggagaacatagttgagggctggaaatacaacaaaggggtacaagcagggatacaggaagcagagcatgtgctggcccctttcatccaaggagatttcagtgagattaagtgaaaagtggagaaggatgtgcaattttgttccttctcttctcagtccattggagcccaagtcctctccacagccccagactcctcttcctgctgctagtctggatctgcccttagggtggtaacatgttaaggctctgctatgtgtgtcccagccaggcgtttcccaggaagaggtggccagctttctttacgtgagactggcctttgtcctgagtgtgcatgttgagtctcccattcactaccagaagatatctttgatggaagagggaaagacaaaagaagtcatggagcaagctgtttagaaaaagatgaaattgggccaggtgtggtggctcacacctgtaatcccaggactttgggaggccgagatggacagatcacaaggtcaggagatcgagaccatcctagctaacacggtgaaaccccatctctatgaaaaataaaaacaattagccgggtgtaggggcatgcacctgtagtcccagctactcgggaggctgaggcatgacaattgtttgaacctgggaggcggaggttgcagtgagctgagattgtgccactgcactccagcctgggtgacggaaccagactttgtctcaagaaaaaaaaaaaaaagaaagagatgaaatttttaatgtttaattaaaatgaagatgaatctcataattaggattaatgaagaagtgtcaccttaattaatcttcccaagtttgggtaactattactcattctagagcacaagctggcaaactatggcccacagccaaatctggttgttagctgatttgcaaataaagttttagtggaacacagccatgcatatttgtttgcttgttgtcaacaataactgcttcttacctgtaaagtagcagctctgaaatgagaggattttgcctaccaggggacatttggcaatgcctggagatatttttggttgtcacaacaggctgggggtgaggaggctatgcggctgacatctgaggattctgctaaatatcaaaaggcacaggatagccccatcgccagagaattgtctggccccaaatctcaatagtgctgagactgaaaagccctgctctagttgagaacatgtaggatggaaggatggtcccttaggttctgatacaggtgagagtgtagcagttcttcctgttacacatcaggcaaatgtagtttgtatggtggaagcaaaggtaagagaccctaacaagatattatagcagccttgcgaggttttatgcagcactgtgcgaatgcagaatgggtaatagcaggtatgttgcaaagggtgatgaacaggcataagttcagaggggaggatgagatgtctggcaggatgcattgttcagggaggggcctgtcctctccttcatcatcttttaccttcttctgcccccagggtgtggatattaatgcaagaggagagtggaagaccttgccagcccctcttgaccacattaatcttcatgtccgtgggggctacatcctgccctggcaagagcctgcactgaacacccacttaaggtgaatgacaggactcaggttttcctttacatttcagttagctcaacaatttgtgatgaagtctaccaaaatgtaagcatcactttcaaacccacatgcaattctactcaacacttgttttttctttgttttgttgtttgtgtgttaatctttttcagactctatactttttgtctaattattaacaactcttttaagtctaagggagtgagatgaaaggtctaagaatgtcattttttaaatctcacatctgacatggaagtcaaaataagagcaaccacaattcacaagagcttttcagaagctgttgttttagaactgtatccagtagattttgaaagactgtaattcatgtccttccttaaaccctttgaatttcttttcaaacacgctaacagccaggtggtcagcctccttggtttgccaggactgatgcattttagcaccagaactctcctctcttgagatgcttctcaattctgggtaaaccaggtcagttgatgcctctatctgccttggccacactgctcacccatgtttctttactcttgaatcacttattctcattttaggagggtcaggatccactttccaccctcctagaatctcaacttcctctttcttttctcccgctaagagatttctttcttgtgattcaaaagtggattcaaaaaaaccctcaaaagtctatgtcactgaattttgctttatacgtaattgattccaaaattatagattccatctgtactaaagaggtgtgcatttatatcttcatgcctttgagagtattaacctatttgtctttaatagactaggagttctttggaagccagaaacctgtcttttcttttgaacctctcttactgctttaatttttcaaattctagacttttttatgatactaatgggaaatatccctaaatccaataccagttggcttccattttctaactgttcaccttcaagctgttctgtacagtgataccaaattgatttttccaaaatgaaaatctcaactggttgctcccaggcttgaagtccaaagtctttcattaatagggtattcaaaaccaatcacaacctggttccacgttaccttaacaactcttatctcctgccatacctccatgtacatacagaccaggtatgccaaaaaactggcgatttcccaaacatacccatgtattttactgcatgtgggcttttgaatttatcctttccaacatctgtgcctggtgtattcttaatgatccaaatgaaactttacgtttcagcagcaagaagtctttccctaatcttccagcagaggaagcactgccacttccaagtttctggtcatttgtaatatatatttatttgctccttagatgattttgtctttcttctttagcagtgttagcatttcaatagtagttgcatactctgtgcatgaaaattgtagtatctgaagtgtttaggaccatctaaatctattgttagttctttgttgctgactttcctttatgttgacttattaccttgtgtgcttggtgattttttgtttcatactgtgataatcttaagcatctaaatgtgggtctccttcctccagagatgatttgccttctcctctatttgcaagccaggaattccttccatctgacatcacgttaacttccatcaaggatcccggcttcatgtgggaatcagaggttcacattctgtaccttggattactaggcttaatagcccaattttaaccttgctgtgggaatttgccacatggagattctaggttttgcttactaagcaccctttgagttctagctcagtgttttgctatcctgttattgttttggtctcttgagtatattccttactgtcttgcaaatccaagaacattttagcaggaatatatgttataatttatctaggatcaggtaatattttactgggtaagtctccagaagaatatacagtctaccatatttgtagaactgtgtttctggactcctagaatatcttaaatttgtgttgttttcactgtctgcgttcattttttagtgaatgtgcctaatttttcctataatattgaaggtcgttcaggtcaggggttgtgatttattaatttttgtatctcattgacttcctagaaatgactgctactcaatacatgaatatttaaagaaagcagatgattttgttgataatggaaactaactctcttgcatagtgaaaggctgaactgtggaagaatacagtggagaatgtgagtccagtgagagacagaggaggaataggaagagcaggaaactgagaggttgcctagagagtgacagagtgaggagagattccaaataaaaattgctctctatcctcttcttcctctatgtccatctactctaccatgtctttaagtaatgtgttgtgtttcctattctaaattctaaagtagatcattagaatgatttatttttctttcaaaacaaactaataataaataatcagatacattaccatttagtagatggaccttagtgtatgttgttgctttctgagtataaatggtccttaggcaggcgaaaatgtatcttcctcacagcactggacacttctcctgagggcatcattgctaaagtgatctgactgaaccagttattgcctaagatttctttctcttctcatactctgtattccgaacagtggttgcagaagcagcttttatttgagctattgcagtgcctctggtgcttaaattcttgcctccaacgtagatgttattgttaatgtttggggtgtttctatctcctgtgacactgttgatattatagaaaaatgcatctgtcgattttgtgtttgtacctcaagaaacagaaccatctgctgctagtatcttttccagtttgaaatttgatggaaatattctcagcccagttggcaaaattgtctgactcctgtctttgtctcttgaatcttgttccccacagtcgaaagaaccctcttggtcttattattgccctagatgaaaacaaagaagcaaaaggagaacttttctgggatgatgggcaaacaaagggtgagcgctgttacaataatgttgctgtttcccaacctgcgcctgtgacttatggtccttcactcctgctggtcattcagctgtgggagaaatctcagcaggcacagtagcaagagtcacttaagtattttgtttctggttgcaccattcagggatagtggtggacgaactactgacgaaagaaaaatgcatttgtatctctgacagttctcccattcgccagtgatacctataatggctcttattttattgtcaatgggtgcttagatgagaaggtttcaagactgttccctaattctatgttaatgtcttcctccgaaaattcttatgagcaaatgttgacgatataaaaatcatgcacctgccagtgaggcagtgagaatatactgttctagtgtgtactcagctagccatacgttttagcatatttgtgggtccagtatactaacaattcttgttcttcaagtttaggaaatagattcctttgaagcatatgccttggaagcccttggaagggaatctttgcaatgttctggtagaaaagagaaggaaaaacaatggcttggccttggagactcttgtccctctaatccaatatgtagattaaaaattaattatttatttggtagtcaaatattttgttggcaaataaagattgaatatatttaaggtggacgatgtgaggatttaatatatgtaggcatagtataatgattaccacagctattttaatgaacacatccatcactaccaatgctgcagactggatccccagaacttattcatctaagaactgaaagtttgtacccttgaccatcatctccccattttccacttctgcaggctctaagaacaactgttgtaggctctgcttctaagagatgaacttttttagattccacatatgagtgagaccacgcagtattggactttctgtctctggcttatttcacttagtataatgtcctcctaagtcattcatgctgttgcgaatggcagaatattcttctttctatgtctgaaaaatattctactgtatatatgtaccagaacatctttatctattcatccactgatagacacttaggttgttttcatatcttggctactgtgaagaaagaaattaaaaattgaaatgtaagggctaaaattgtaaagctcctagaagaaaacatagcaaaaaacctccttgacgtagtcttggcaatgactttttggatatgataccaaaagcaaaggcaaaatgccaaaaagtaaacaggcgtgactacatcaaactaaaaggctcctgcacagcaaaagaaacaatcaacaacatgaaaaggcaaactacagaatggataaaaatgtttgcaaaccatatatctcagaagagattaatatcaaaaaataaggaacatatgcaactcagtagcaaaagatcaaatgacccaattaaaaagtgggtgaaggacctgaacagatgtttttccaaggaagacatacaagtggctaactggtatgtgaaaagatgctcagcatcagtaaatgacacaggtatgcaagtcaaaaatcacagcgagatgtcacctcacacctgttagcatggaaatcataaaaaagaaaggagagaagtgctggtgagggtgtggagaaaatagaattttttagactgttggtgggactgtaaattgttacaaccattatggaaaatagaatggaggttcctcaaaaaattaaaaacagaacttccatacaatcccatgaattcccacttctgggtgtatatccagaggacatgaaaccagtatctttaagagatatactcactcctcccatattcattacagcattacttgcaacagccaagatatggaaacattctaagtatacattgatgaatgaatacaatggaatattattcatccataaggtaaaggaaatactgccatttgtgacatcaggatgtaactgaaaagagtgggagtgtgaaatctgttcttctgtggtgggcaagccggagtctgacttgtctttctgtcactttcagatactgtggccaagaaagtatatcttttatgtgagttttctgtcactcaagtgagtagcatatttttatgaatcttaggtgtgggctttggactgaccattagcacatctgtgcttgtgtatatgtgtgattatatttgtaactttatatgcattattggctataggtgagcacatttctatttatgatttcatcgatgttttcaaaaggaggcattaatatagcaagtagtgtttctaaatatagtttttaattatctgtgtgtttttatgattgtatcaaattagaggattatcaaactaatgttgtacttcttgagcagacactagtagagaaagcagagaggcattcatggcagtggggggtatccagtctggaatagaatatatgagtgacttgagaatctgtgtattacaggcatacctttatgcataattggagttaattgttttgcagaaccacttggaggtgactatttcacaatcaacctacaaggaccccaataatttagcattcaatgagattaaaattcttgggatggaggaacctagcaatgttacggtgaaacacaatggtgtcccaagtcagacttctcctacagtcacttatgattctaacctgaaggtaaaaacccattttgttgagatggtacattgagaattctccatagcaccatgatgtttcttcttgccaagtttgcatgggtccctgaagtaccagggcacctttgatgcatgttttggggaattgagagggcacctttgatgccttttttggggaaaaaaatgaggtggccagagctagaatgagttgggtatttttcttcttattcccttctctgcctatcagtgttcccatctctctagctggtttcacttgcttttcccaaaaatagaataattatgatgagacccaggaacagcaaagttggaaagtggggaatagcctgacattattagactgtgaattttgtatgactagcacaaataagaattggtatttgaaaaaggccagcttggataggaaacttgtggtcaggctttggaggtcttagttaccaacttgaattaattctcaagcagtctcatattgatccttgaatgaaggctgtgctactgtgtgtgagcattgttgggagtgggagtgggggctggggactagtagaacagggaagtacaagatggtttagatttagaggagactgggagaaggatgataatctttagaatgtgattttattactccagacgtgtgagaactttaacttgggaagtgctgtctagagaagcatcaaagataagaaaaatatatggaaaatattaaatatttgaattaataggattcaaggaaggtttcaaatttgcagcctttatgcttagaaaaataaagatgctgggatgttagaagtggaaagaaagatgattttatttccacctctcaattttgctgttgccaaaattgaaattcaaagaaatgaattagaattcccaatttgccctgatgtgattattattcattgtatgcctgaatcaaaatatttcatatactccataaatatgtatacctactatatactcattaaaattaaaaattaaaaaaagaaatcatttgtccaatatactacataaatgcgagcatgataaccaggtcatatgattcttattgctgtgttctttctaccactccacgccaatgggggatgctggtttggggactggagagcaagaggatcagctcactttgagatgacaccatgtgtcatgctaaagaggaagtgcagaagacacccttccagacaagacacagagggctaagaggagttagggtagaaaagaataaggggtgatcgcgacaggttttatttgacctaattgttttcattatgctatgtacaagattctgctagaggggagtcatatgccctgttactgctaaatagattcccccactgtacagttctcttcttataagctaaagtgatatgttgcttggatggttgaaagtctggactgatgtctatttgtttttccaaaataaataaataaataaagtcttagattttgcaaggcctttctcccaaagatgaatttccttgtgatttctgcattcctacaggtcgccattatcacagacatcaatcttttcctgggagaagcatacacagtggagtggagcataaagataagggatgaagaaaaaatagactgttaccctgatgagaatggtgattctgcagaaaactgcactgcccgtggctgtatctgggaggtaaccatgctgatggggttcatgtgcatgaaaatctccacacctaatctatagtttcttaagcatagcagtggcacttatataactacttaaaatccatagaaaggacttcctaagggacatgatctggatgtgacaagtaggtggggacatgtggaaaactttttaaaataaatattttgcttggagaccaggaaattaaatttatgttattgccaagtgataagtgataggctggttttattgtcatataaaatgacttttctaaccctgtttaggttagagaactttaagaccacatgctgtgctgatctatgactttggccttacttttcaggcatccaattcttctggagtccctttttgctattttgtcaacgacctatactctgtcagtgatgttcagtataactcccatggggccacagctgacatctccttaaagtcttctgttcatgccaatgccttcccttccacacccgtgaacccccttcgcctggatgtcacttaccataagaatgaaatgctacagttcaaggtaaacacggtacatatatcaggcagtgataagacccttttcagttccattatctttttctggttcaggtcacacaaccctaaaataagttaatcatgctacattagactatgtcattatccagagaacattgagaaatcattgagggaacaatgagacctgccctaattttcatttggaaaagattactgtggctactgttaggaaaatggttgggagagcaagagtgggtacggagagacaagttgggaggctgccagttaggcaggtcaagtgagggcttaggtttggactaaatactggaatgaaggtggagaacagtgcacctagttgagattcaggaagttgggttacagggtctggtgcttgattgaaagcaggcgacaatggagagggaagcatcaagaatgatgaccgcgttggtatcttgcatcttaatatggatggtgctgacatcaaccagaatgggaatactgaaaaggtttgtgcttgatcaatgtaagatgatatgttcagtttgggatactgaatttgagatacgtataaaatagccaccaacctgcagcgatttcatttctttccagaatttaattgcatttaaagactagggatggactagctgttacgtctgcttctctattaaactaatcttctcaaggataggaatgtgccctttcctctttgtgcttctgaagtctaatacagagcctggcagatagttagtgctgtaatgtaattgacagagtaagtgaaagtgatcaggacattgtcacattgcctgaaaatttctttacaatctgacatcaacccgaattctgagtttttgtacatcgtctaatgcagggatgatgctgttgtatgtttgtaccctcatcatagcactagcatgttgtaggcacctaatgggtttgaagtgaatgaacttccttggagttctagccttaaccattgactactctacctcttgaccatacagtagctctttccaaaatatttgcctctttctggcccactttaattctctctgccttcgtggttgttattcttcaccagaatgacttgatctcttttctgtgtttggttaatgactaccaagtttctaatactctagattgtatttctcctgggagaccatctcagtctcccagaaacaatgttaggcatttccttctctagagtctcacagcacttctacatagctctcccttagcacacatcacccaggtgttgtgagctgctctcttacacttctcatttgcttgtgaatttcataaaaccataacactgccttattgagctcacatccctagtgtcttgtgcagtgtcaggcagggatgtagtaggtactcatgaatcagtttagataccaccttcagcaaggacattctgattattttaatcaaatagatttcactttggggagacacgttatttttcaattcagaaaagttttaaggtatttatatattctcatatacccacagaaaataacaagtaacatattcataaataccacgctgattccagaatgattttctacgttagcaccaatgtcacaatgcttatattgatgcagtagaggccttagtaatgagaaatgacagacaaacatattaaatctgacattgttatttgatgtgttaattaaatctcagacatcataaacttaaagaagacagaaacatagcatctgaacttttgtccaaaaatcaaaaaggttctgctaagggtataggtttcaagagtagtattcttgcctaaaatcgttttcctctggcctagatttatgatcccaacaacaatcggtatgaagttccagtccctctgaacatacccagcgtgccatccagcacccctgagggtcaactctatgatgtcctcattaagaagaatccatttgggattgaaattcgccggaagagtacaggcactataatgtgagtggcttctagtgtgactcagagttgatggctacctgcgccttcgctgccaggtccattgtccttggatgtatcctggttcaaaacatcacattgtccacttccagatccatggatgagttgtttccttcagacctattcttacaggaaatctttagcattctggaaataattactgaggcagttgagcgtgcctgaggattcatccaacaaatgtttatggggtgccttctctagattaggtgctgctccttatagacaactgaggtttctcttctcatgacaacaaataataagtaaataacagagataatttaagttatagtataaaaaggagattgtgatagtgataattgctgtgtagccaaaagagcagggtaattgagggttatggtgtggttactgcttctgatattggggtcagagtagatctcgccaagaaggtgatattttaataggacctggatgagaaggagccacccacatgagacagggcgaagggaaagagcatttcagacagagggaataggaagtgggtaggccaggagatgaagcgaagctggcatgctaaagaaaagaagtctagtgtggttggagcaatggaggaagtaagcaggtgagtgctgggagaggaagctgcaacgccggttgagggggcagcttcagccttgaaggcttcataagatgtttgcatgagaagccatggaagaagcacaaatgggagtgacatgaggtgagatcctcgtaggaatatcgctttgagtgctacgtagaaaatgcgctgaggggtgcaagggtggaaggcagtgctggtgtggagtgttcccagctgtgatggtgaggggagcttgtatttgtattgtagaggaccactgaaaggaggcagtgagagtgggaaacagatgaatgaagaactcctgggcttttagtggggatatctatgatattttaatcaaattgagtttcagttttgtttgggagatgaacagcttctgggtaggaatcaagtgttctgttgtccttgaaaagtcagctgctggaagcagagagaaaagcccattttctgtttcaaatctgcctttttgtgtttcagttgggactctcagctccttggcttcaccttcaatgacatgtttatccgcatctccacccgccttccctccaagtacctctatggctttggggagactgagcacacgtcctacaggagagacttggagtggcacacttgggggatgttctcccgagaccagcccccaggggtaaggacagagcatttgagatctgtgtctctgcttctctccacccacactgctcaggctttgggcttcatcttcccaaactccacttggtcgtcacattctgcttttaggcgagtgggccaattctcaggctcctttgtttcatgtgtttaattgatttcatggagaaaactagacccatcttagcaagcatatttttgttgagtttctttctcaggcataatgtcttttaaactcctactgcttctccccatgactctccagtacaagaagaattcctatggtgtccacccctactacatggggctagaggaggatggcagtgcccatggagtgctcctgctgaacagcaatgccatgggtaaggccatccagcgcctcccttattttggggggataccagtcatgcctgagtcagtttagaatgtgtttagcctaactgttccttgaagtcaaaatcttcattttacgggcactgctgtttattttttctttgtgtttagcctttctgttcatttcagtctaatatcatgtgataagaagatttaacccaactcttattttggtaaaaatcacataagaagggatagtaaaaccacatgggtcccaaatgtcttggaggtcagctcgtgagagccagttataaaatttgaattagggtaaaactatgggtcagagaagttagtctggggattgtgagggtgtatggtatgttgaaaagttacctatcgggtactacgtttgctatctggatgacaggattcataccccaaacttcagcatcgtgcaatattcccatgtaacaaatgtgaacatgtacctccttatccaaaataaaagttgaaatgtaaacataattttaagagtagaacgacaaaatatagtaaaatacaccaaaggaagcaaacccaggaatgggacatttagacttccactgaacttcttcagttctatgtgattatgatagaaaatactggctcttactactctacgatagggagggtgcaggaaatagagaatgtgtggatttcaggggtgattcatgacgtggaaagtttccagcttgattagcatttttcttcattttcagatgtgacgttccagcccctgcctgccttgacataccgtaccacagggggagttctggacttttatgtgttcttggggccaactccagagcttgtcacccagcagtacactgaggtagggagaaatccaattgtttatcaagtacttatatagcacattctgggtgccagagcccacattcattagtataactctcagatgataactggaattattggtattacttggaaagagattatagaataaggaaaaataaatacattctaatcaccattaaatttatagcctctgtaagcattgcagaatagcagaagttacagtggtactagtggtggtgatggtagtgatagtagtatggtggtggtggtatttgtggttatatggtggtggtgatggtgatgatggtggtaggggatgatggtggtgatagtgatgtgggaatggtgataatgatggtggtagtagtagtggtgttggtgatggtgatgatagtggtgggggtggtgttgatgggagtgttggtgatggtggtgatagtggtggtgatggtgacgatgatggggtggtgatggttggtgtttgatagtgatggtggtggtggctatggtggtggtagtggtggtgacagtggggtggtgtgaagaatatggtggtggtagtggtggtgatggtgaaaatagtgatgatggtggtgaccatggttgttgtggcagcagcagcaaacacttatgtactacctactgcacatcactgatttattacttgctgcatgttagagcactttgcacatagtaactcattcagtcttcacaaaaggactgtgagggagatgctattattatacccttatttacagatgaagaaactgaagcactaagagattacttaatttttgcctaaggtctcacagctagcaggactggagcctgtatctaagccaggcattttgcctctgattctgggtttcttaaccagttacctacagtgtctctaggaatggagtgaaatcagcttttccataatttttaagaaggagctcaagtctagcagaaagctttctccaagtatcctagtggctctatatcctgtcagttttgatgtggaattcaattagttagttgtctagcttggggcacagaaaaatattcttattacttgatgtaaaacttcaatctggtgtctctgttctgaggactaatattttctgtctattttctagttgattggccggcctgtgatggtaccttactggtctttggggttccagctgtgtcgctatggctaccagaacgactctgagatctccagcttgtatgatgagatggtggctgcccagatcccttatgtacgttctcagtcatggctctggagtttgaaaactaacccaggtgcctctgtgtctggcttcatttgtctaatgtttgtgagattctataaagacataatgttctttttcagacaatatcacagttagcctcaccccagcacagtaatagaggtaagggcccttgtttccatcttctagagatgatagctcaagacttactgtgatttcccagagggggagataagctggctccagggctctttctactatctcatgcttccttccatttctttcacatgacttcaaaacatgtagtcaaaatgtccttggttccataagaataaataatatccacagttcttttacttaattcctgaaaaaaactaaccccaaaccatcagaccattgtatatgtggatacgacctcagttcccgcagccctggtgctgtagcacagtgtcccatgagctctgagctaatcactgatggaatacacggatcctggaatgggttccagaggatgtacacatggaaataaagcttatccttcactggaggatgggaggggacccagtcatcaggcaactgatccaatgtaccatcgcatatctaattgtattctacatttctcttgttttacagtagctccattagtggaacatagcgtttccattagtggatagtgaaatgcaatatttcattctccagaagaatgtagtgtctgatttccctcaagattgggtattccaaagcaactgtacattgttgctttgttttgacttgttttgcagtagatttaccatccacattgtattagccctgggtagttaatattattttttctaagcatgaaccactgataccaggggcagcctcttgagggaggtcatcacagtcactcctgatagtggcagtttacaaagcactgtccattccagtgttcgtatttatcctcagaatagccatcttagagaggcattctcatcctattttatgctgactttgatttttttctatcttatcactgaacgtttgagaaattaagtgaatttcccagcacctgtacctaacaaatggcagagctcggacttgaaagcatcaacaagaagctatctggaattccaccatgggtggtggaggcttgttctcctataaagcttgggcgtgtacagcagcagcctctcagctccccatgtcctcccgcaggacgtgcagtactcagacatcgactacatggagcggcagctggacttcaccctcagccccaagtttgccgggtttccagctctgatcaatcgcatgaaggctgatgggatgcgggtcatcctcattctggttagtcctgatgtgaatgtgtgcggtctgtttgggagcaggtatgggttttgttggagaaagtgttatactttatttccatgttgcaagtagataaattgaagtgtagtaagaaatgtgtatttccctggactcacagaaactctacagttcaggtagaagccaacaagttcgccctggaggagttctccttcattctgtttctcttcattctgtggctttgatttttcccaactgacttatgctttgatttcaggatccagccatttctggcaatgagacacagccctatcctgccttcactcggggcgtggaggatgacgtcttcatcaagtacccaaatgatggagacattgtctggggaaaggtataatcctaagcgatgatccagtagtccctagcctgagggtgggtcactgttagagggtcacacgcctgtgtatgttatttttggccttttctatttgggctctgaggtcagaagctctccttttctcaatcaatatttgttgatacagttaataacttttaagtaatataatgtgttacggaattcacttctcttttacatcaatcctacatgataatcaaagtattgctcctaggaacatggtttatataataatttctttggaaatactatgtaagggaaattgtctagtgcatcgctactgaacatgtttctctccataggtctggcctgattttcctgatgttgttgtgaatgggtctctagactgggacagtcaagtggaggtaaagggtctttgtaaatttgggtggagtcagggtttctaggaaggggcagccgttcctgggaatgtggacatgcctgtactgtggacatgggcttggcaagggagaaacacttagggcatgtgtgttggatgtcagtctgtgtgcccattactttataggtagtcatactttactggccactgggatgtagacatgtattattatccttgggatttaagaccagagagctcagatgacttgtccacggttttaggtgacagagtgttgatttcaattccaaggctgtcagattacaaaggcccaagaaattcccactgggcgatacctcctagcagtgccatcttttctctgaactggtatacttaactgttgttgccttggttatcccttttaaacagtcttctaacctcaaagactgtttaggtctttttttggtgtatcttttttttttccatgaacacgtttctccctttccacacttataattcctcctctgagcccaatccttccttgggtttctcaactttgcttttacctctcagtttccagccttactgtaaaacttgctctcttctggggatggtttgttgcttgtaatggatccaagtagcccatgcttctgtacctgaatttttttccagattcactaagcgtttcttgcttgaatgatacatggctccttacaggtctaggaaggctacggccccatcctctggccaagatgtgtgtctcctgaactgaggcagcctgtgtgctttactatcaattgttgtgacagtacccacaggcaggattcttagtgcgggtccaagggcttcctggagaccaagtaccttgccctacctctggagctgttcttcaataatgcctattctttctgggcaggaattgtagcagggcatgtgtagcctatgtgacccccacagaaaagctggggagacaaggaaaaggcctcttttctagaacatctgccaggaattgaagggacaaagaagctgacttgtgcagtcagcaatgcggtatatgttgtagtgtctagatactctctcaggatcaagtattaatcagacaaatatccatgttgtgggcacaaatcccagcagctgtaattctgttagcagccactcagaagtccaggggcaaagacctcttttgggagttctttctacgtaatgtaagattgtatcccatggacagaggtgcaggagaaacattgatcaccaggaatgtgactggtgatcaccaggaatattggagttaggccaaatattcatgccttatccagataagctggttttcagggcaagtggtgagtcctagagggaaaggcagatattagacagaaccacacaatctggagccagggactgaggcctggcacagctctgatagggtagggagaacagatggtactgcaaacacgtgatgcatacttctctgttgtcagtctctggcctcctggatcccagagccagttggcagcagtagcactattgatttaaaatgagacacacttggcaccaggctgcttggctattggactgcatgtctttatttactgtcagtagatgcagtaaaacaaaacaaacaaaacagaagctggggctggttttgaagattggcaagaacgagtcagactcagttcaaggctgttttccttatgtctactactgaacaagtatctatctatctatctatgtatatccatgtacccatctatgtatgtatgtatgtatgtatgtacgtatctatctatctacctatctcagtctatcatatctatgtatctaccgatcaatgtattaattcatccacccactctatctatccatccatcctctatctatctatctatcatctacctcatctatctatatctatctatctatctatccactctatctactcaggttatatctatctttctatctgtctgtctatctatctatctatctatctatctatctatctatctatccatccagccaccctattcatttatgtctgtctgtctgtctgtctgtctgtctatctatctatctatctatctatctatctatctatctatctatctatctatcattctatcctatctatgtaccatctatctatctatctatctatctatctatctatctatctatctatctaatctatctccacctctattcatccactcaccctatctatccaaatccctcttctgtctatcatttatctacctatttatatatcatctatctctatgtatgtatgtatgtatgtatgtatgtatgtatctatctatctatctatctatctatctatctatctatactgttcaagggagaagacctagcttcctgtcctctcgtcacctctcacagagaatcacttgaagcttagtggtccaagcagcccacatggacacaggaacctgcccagccagagaagttctgggtcatgggcttcctgacttttatcaagtagtcagtatcagaaccccacagttcatcagccagtaggggcaacactgccatcctgaggcaatttggaaatctgagggcagtgttggttatcacagggacaccagaggcattcagtgggcagtgggcagggatgcccatagctctgatttcagggaattctccacaaaatatctctcacctcaaacgccagttatacccctgatgagaaacacttcattagggagtcacagaatctgttagctcataagaaattcttggtagataggataattataactattggttggtacaaaggtaattgtagtttttgccattgaaagttattaaaagtaggccgggcatggtggctcatgcctgcaatcccagcactttgggaggctgatcacgaggtcaggagttcaagatcaacctgaccaccatggtgaaaccccatctttactaaaaatacaaaagttagccaggcgtggtggcacgcgcctgtaatcccacttaggaggctgaggtaggagaatcgcttgaacccgggaggcagaggttgcagtgagccaggattgagccactgcactccagcctgggtgacacagcgagactccgtctcagaagaaaaaaaaaggaaggaaagttattaaaagtaatgacaaaaacttcaattacctttgcaccaacctaatatttatattattaataaagacccactcgatgaagctggtgaggatgaagccactgatgtccaggtctggctttactgaatataaaacaaacagccaacagccccatgaaaagcagatttctgagtccaaagctccagcaatttaattcaataagtctgatgggatctaggaattgcattttgtagcatgcaatgtgccacaaaaagagtgctaggtgatcctgaggcccagtgtgtgggtggttatatcactgtttgaagactggagaaagtgaaggcagaagccacaaaggcaagacttgaatatgcacaggtgtaaggtagagccagcacgttggagaacggcagaacatttttatgaagttggaaggggtcatccgagcagtacttagggaagttcctacatcatggctggccaagttcaccacgtgtaccccatatgggatacaattctgactcagctgtggctgataatctctttattctaattctccatcccccacccatcccgtcgtttctaacccttcctgatctggagctctctgtttctggtgaaagattctctttgtcaggtttcctagcttctacctccatttcctaacaaaaggcatccctggcatgcccacttctgtcaagattctccgtgatgtgacccactgtcttctcacatccttgacagccagacccatgtaggctggtctgtttctgttttctcatgttccttttcttgccctttatgtagacatatgggttcctacctgccttttgtctattgtgtgtaagaactggagttccccagaccaagtcctcattctgttgcctccccgaacctcctcaccagcattctttagctctttaactcttacaatggtgtgattgtcataaaggaggctatttactgagacatacaaaggaccataatgttccgtaacaagcaacatttatttgctgcttcgaagtggtgtgaacccaccattaaacagtgagtatatattttgtgtcaagttctaagctaagcattgtgcaaaatataaatgtcactcagatgaatataaaacaagcttcttgctctcaaaagtctacaatgtagttaagaagttgtatctggctgggcatggtgtctcatgcctgttatcctatcactttgggaggctgaggtgtgtggatcactttaggtcaggaatttgagaccagcctgaacaacatgaggaaactacgtctctactagaaatacaaaaattagccaggtgtagtggtgtgtgcctgtaatcccagctactcaggaggctgaggcaaaagaatcgcgagaacctggaaggcagaggtttcagtgagccgaggtagcaccactgcactctagcctgggtgggtgacagagcaagactctgtctcaaaaaaaaaaaaaaagaagttgtacctttaacccatcttgcaggttaaaacaaaaacacacctgttattatctgaagaaagatgaaaataaggggaagttgaaatgtcctctttaagtcctctcaatttatcttccacacagctgtagttgtcatgtgattctgaaattgtagaaaacactgaggtgtactggtcttatatcctgaaatgtaatcttattccttcctcccctctcgcagtgggaatgacataggagggagtccctgggtgtttcttcctaacctattaccatgcatctcatgtctgcagtctctccctggctttgtctttgaggagtgcataggaaatggcaggactgacattgagggttgggcatcgaatgcatgaggtcactagttcgggtcattgattgtcatcatccatgtatatatgaagagaacagtttttggatgttttccaaatgccgggaaggtgtgcaaattgcactaatttctcctctcattctacatttctctaataagttaataacattatttaggccctgttcaggccgtctgtcaccatgcagttgaagtatttgtgcgagttgcattctcagtaagtgcctgtttgctgtcttctatatttgtgtgggacaaagaaattatatttcttttttatagctatatcgagcttatgtggccttcccagactttttccgtaattcaactgccaagtggtggaagagggaaatagaagaactatacaacaatccacagaatccagagaggagcttgaagtttgatggcatgtggattgtaagtgtgtgtgtgtctctgtgtaccagtgacacttgtctatctttgtgtgcctacgtgtatgtaccactgaccttcagtcaagaggatagtcattgtccaaggaagactttggacatatcagacacttcctcctctcaggagaggaacagccctgatagccctcacaccttctaccagacctgacattactactataaaacctctgaggcaattgactaggaatttcttggaactttcactgcctcacgcccaccttgagagagatttttttttaaccctctagccagttgttctgtaggggtgaattcatctttctagccagttctcaccaggatttgatgaagctcccagggctggcatctatagggattactggatgttgaacaatgtattcactgcttccttggctcagaattggcaggacgtaattatcttaaaaagtgaggtatgtctgtgtttggcatttctaggatatgaatgaaccatcaagcttcgtgaatggggcagtttctccaggctgcagggatgcctctctgaaccaccctccctacatgccgtgtaagaatccttggccttcttgattggcagagccatgattgaaagaaggattacactggaggagcccgaggccaggggtggccgcacagctcagggcacatcctcatggctgctgtggtttactggggaccagagacaaaagctctgcacgcgctttacccagctgggcatgtgcaagtgactagactcattgcacaaattttttgaatttgtctagaaaacacttacgagtggtcatgccaccaaagggttctcacagctaggcttgttagttttttaggcttatgtgaattccatcacaggaattttttggtgtcatcaatgggtggaaattattggcttgcctttattgtggagctgatggactttggagttacacttgggttcatatcttggttccagaaattgttctctctaggagttttgtgacttttcacagattatgcgatatgtccaaatctcagtctgctaaactgtaaaagacaggtaatgagatcttcttcatagaattatggaaataattggcaagtcaaaagcctaaataagagcctgtcatatagtgtttgacagctgtacattcttcctgacacctctgctttcttcagtgaacttgatgttggaaacactggagccgccgttgcagctcagagctgggggcgctgtgctcatgtctctgggaagacggagagtgacacaggcaggactgaagttagtcttaagatccagggcccagtcccttgaagagaagtcagggagaaacagaatcagggctggatttcacctcaccagttcttcctcctcagatttggagtccagggacaggggcctgagcagcaagaccctgtgcatggagagtcagcagatcctcccagacggctccccggtgcagcactacaatgtgcacaacctgtacgggtggtcccagaccagacccacatacgagtgagtctctgtctcccttctccagctgtcacaacctgtagggattgccagtgactgacatagctaccctacttttcttttcattcccattctaagggttaagaagattctcatgacaactgtgtaatgattcttattagataaacacttagtgacatggagccaggccctgtgattaaaaggaggaggacagatttaaataaggcatggtcccaccagtgaaaagcttaatgatcctagtgggaaagactcacatggagacatcataatgatcacagagggcagccggtggtacaacagcttcagttacaggaggtgaagggaacacagaggactgggcatctctcccctttatttcaaagtgaatcatctttggagttcttttttgtttttcaccattcttggtggaggctaattggtattccactgaattagcacagtcctgctttgtaagctcaattaatagtgtgaattcttctaaggacgatcttataatcttcactgtgttcctcctcaaatatagaaaactaagttttggggaaaccaatagcaagatttagtaattccttactatttttggggcactccagtgagtttgctacagtgaagttctttgtaaagcactgtgagaacacgtgactcgttatctccatcatctgggatcagtggagcccccattacagctcagagtcccgtgttccctccaatcacgcagcaaacattgactaggctcaagggctctgggagcagatgctctatggcctttgcttcctggcggtgccctcagttcacctccttttcccctccaaccagagccgtgcaggaggtgacaggacagcgaggggtcgtcatcacccgctccacatttccctcttctggccgctgggcaggacattggctgggagacaacacagccgcgtgggatcagctgaagaagtctatcattggtgcgtgggtccttcccagggcctgtgccggtagggcagggagttgggatccttggggaagaggtgaggaggcaggtcgtgagagcgagcctggtgtgacacagctgtgcttctcgttgcaggcatgatggagttcagcctcttcggcatatcctatgtgagtgtccttgggatcctcctaagcaccaagaaggtggggacatctttcagaaatcatcagcaggctccttttatttcctcttgtttcagacgggagcagatatctgtgggttctttcaagatgctgaatatgagatgtgtgttcgctggatgcagctgggggccttttaccccttctcaagaaaccacaacaccattgggaccagggtaggacagtggcccctacctccagtgtttcacttgaaacacagcctccatttctgacctaaagttaatgcagtctgtatttcctgtgatatctttaaaattttttttttttttcttttgagacaaagactcattctattgcctaagctggatcttgcagtgtcccaatcatggctgactgcagccttgacctctggggctcaagcgactcacctacctcagcctcttgaatagctgggactacaggcacataccaacgtgcccagctaatttttgtgttttgtagagatgggatcttgccatatttcccaagcttgtctcgaactcgtggcctcagtccccgaaagtgctgggattacaggcgtgagccactgcacccttataaattgttaagcccatgggtctcagtgagccatattcctcagtgttctttaggttattattatgttttgttcttcttgtttgggcagaattgtaaaaaatataccaaaaagaatgtcttacagtgaaatttcatcagctgtcctaggagagcatcagtgaacttttccagtctattaagaatattctctgggcctcatgtgtagttttcttttgtttagctgtgagtgatcttcaattggagtatgctttcagtgaccttcttaaatcccctagaaattccagggcaagctcccaacactgttctctttctcctttagagacaagaccctgtgtcctgggatgttgcttttgtgaatatttccagaactgtcctgcagaccagatacaccctgttgccatatctgtataccttgatgcataaggcccacacggagggcgtcactgttgtgcggcctctgctccatgagtgagtgtccagcagggatcccaatgcctaatggatgacttattgcattctatatggtgacagttgaattcttccaaattaaagacatgattgccttttgacatgagctcttcaggtgcagaccatactttattactctctttagcacagtgctatacatgccttaggtcattaataaaaggttattgattgaatgagcaaaactgaaatgatgcagtatagcatagaataatttctttctaatttggc

SEQ ID NO: 100 - DNA, 17857 bp, Homo sapiens
ctctcatgattacttcatgctagatgtgaattcaaagaacgatgagaataaactggttgagctcgtattaagaaaatccttggacagagaggacgctcctgcgcaccacttattcctgacagccacagatgggggcaaacctgagctcacaggcactgttcagctgctggtcacagtgctggatgtgaatgataatgctcccactttcgaacagtctgaatacgaagtaagaatattcgaaaacgcagacaacggaacaacagttatcaaactgaatgcttctgatccggatgaaggagccaatggggcaatttcatattcttttaatagccttgttgaaactatggttattgaccactttagcatagatcgaaatacgggagaaatagtgattcggggtaatttggattttgaacaagaaaacttatacaaaatcctcattgacgccacggacaaaggccatcctcccatggcgggtcattgcaccgttttagtgagaattttggataaaaatgataacgtccctgagatagcactgacttccttatccttgcctgtacgtgaagacgctcaatttggtactgtcatcgccctaattagcgtgaacgacctcgattcaggtgccaacgggcaggtgacctgctccctgatgccccatgtccccttcaagctggtgtccaccttcaagaattactactcgttggtgctggacagcgccctggaccgcgagagagtgtcggcctatgagttggtggtaaccgcgcgggacgggggctcgccttcgctgtgggccaccgccagcttgtctgtggaggtggccgacgtgaacgacaatgctccggcgttcgcgcagcccgagtacacggtgttcgtgaaggagaacaacccgccgggctgccacatcttcacggtgtctgcgcgagacgcggacgcgcaggagaacgcgctggtgtcctactcgcttgtggagcggcgggtgggcgagcgctcgctgtcgagctacatttcggtgcacacggagagcggcaaggtgtacgcgctgcagccgctggaccacgaggagctagagctgctgcagttccaggtgagcgcgcgcgacgcgggcgtgccgcctctgggcagcaacgtgacgctgcaggtgttcgtgctggacgagaatgacaacgcgccggcactgctggagcctcgggtgggtggcactggtggcgcagcgagcaagctggtgccgcggtctgtgggcgcgggccacgtggtagcgaaggtgcgcgcagtggacgccgactcgggctacaacgcgtggctttcgtatgagctgcagccagctgcaagcagccctcgcatcccgttccgcgtggggctgtacacgggcgagatcagcaccactcgtgtcctggacgaagcggactctccgcgccaccgtctgctggtcctggtgaaggatcatggtgaacctgcgctgaccgccacggccacggttctggtgtcgctggtggagagcggccaggctccaaaagcgtcatcgaggcagtcggctggcgttttgggtccggaagcggcgctggtggatgtcaacgtgtacctgatcatcgccatctgcgcggtatccagcctgctggtgctcacgctgctgctgtacactgcgctgcggtgctcagcactgcccactgagggcgggtgccgggcgggcaagcccactctggtgtgctccagtgcggtggggagctggtcatactcgcaacaacagccgcagagggtgtgctctggtgaggggccaccgaagacggacctcatggccttcagcccctgccttcctcctgatctgggatcagttgatgtaggcgaagagcaagatttaaatgttgatcatggcctcaaagtaagtccatttaaatttagaactcataaattctatttgtggaaattgtagttactttaaaagtgtttcagatttagtttttcaccgtattttatagtgaaaatttaaacattgtttagtttttagaaaccttttataattaattgaattttctcagtggcataatacagtattaatcattctccacaagttgggtctatcttgaaactcaagttatggttggatgatatccattttttactgaatatttattttggcctgccttacagccgtcttctctgaacaatactctaaggacgttcagggcattttgatctttggtgaaagtattcccccaaagcgtttattcttttgtccttaggcactgaactcttaatcttactccatatgctgtactttgaaatgcatgttttaaatatgttgtctttatatttacttttattcactttaagatctcggtttattcatcttatctgactttttagtgtctggtagtcacaaatatctttggtgtttcactattgccgttttaagcagtgtagtgataaaatacagaatgatagtgtttttcaaaatttgatagttttcatattcttcctaattttattataaactagttaaaaagtaaaatcaagagggaagagatttgtaatccttcttttaattcattatttagaccattttaccatttggagacatgttttttattctacatgatttttacagttgtattgtcgccaacttaacattttttgagcctctatgtttaggaaatgattactttattcttgcaagtatcttctaaactctaatcattcaaccctttgttcatgagttggaatattttcaataatattccacattaaagtgatatttaatatatgacttagaaaaatgttttcatcagaaaaactatacatgataatttcattcttgcaaaccaaacatataatttataaatccttattatacagaatatttgggattatcatggcccattagttcgtgtaaaaatatttagtattatgggataaatctttgaaaaatccaagatactttattttggtatctttcaacattttctttcttttatttcttcttgtctttttacacgtttgcttcttgtgactgttggacctgcctggatattaaatacccattagacttcgtgcatattgctttggagagaatggtagaaattgatggaagggaatgaacgatttctgggactctgaattcttacagtttgttattagtattgttttaaatcttttaatcacttatgaacaaataatgtaatcatttatgggcatattttagcccccttgtccaactgaaggtaacctcaaagcagcattgttttgtagtttattttacagttctcttaatgcctgtccatgtttagcattttatttgactatttgaacacattgtgtaaaagcgaattgttttcattttagtcctttaaaaaatatgattgttttcatttaagtccttttaaaaaatatgattatctttattatcctgtttgaataatatgtgttttcctttgtgaaagtaatatttcctatcctgtctatgtctacctggttctcaggtattactttaattactgaattctcctaaacatttaattgacttttacaaaatatcataaataggaggattctttccaccacctagcattgtatttggcaatttatcatttaagtcattttagttctgtttttcttcaactctctgatatttgaatttggggttgtgctttcacagtgagaaagtctaaacctatttcttgtacattaatacttttcactattctaattatggtgatgcttttagctattaagaatttctgggattgaaatgtgtcagaagttagttattaagtattgtggattctgaagctctctaaatcaagtcctccctttaccaatttttgtatgtgtagccattggtaaaggatttgttattcagttccttggcattatatgtatgcatgataaatgtgaattctactttatagatttatttgtatcaagtaagttaatagttataaattattaataataaactctggcaagtgataggtacataataaaatttagttattaccattcttaagagaaaagaagttagtgattgcagaaaggcaacctaaaatgtcagaaagtcgttatggccttccatattaatcttatttttgtgtaaaactatcttctgtaaagtcattttttagattaacctaggatgtttcaatattttgaatgttgtgtggtggaatgaaaaaaatctaaaagttattacgagtttaggaaagtcaagttaacaccacctatgtgggaaaacagttttttggaaaggttaaagtccttccaaggaatgtgtagactatcttactttgatagttgtatgtttcccatatttaaaagttgcctgagatcctgcagaggcctgagtaggcgtttgagttctttgtatgtatgagatctttccattaatagtatttttcttaaaaagaagtatacaataatgttttgatgatgatttaaagtcaatttatgttgtagttctatgaattaagtaaaccatttatgtagagtgttgtaaatagccttttaaagtgctttctcttttttcttttcttttctttctttctttttttttttttttttttgagacggagtctcgctctatctcccaggctggaatgcagtggcgcaatctcggctcactgcaacctctgcctcccgggttcaaatgattctccttcctcagcctcccaagtagctgggattacaggtgcatgccaccatgccctgctaattttttgtatttttagtagagtcggggtttcaccatgttagccaggatggtctcgatctcctgacctcctgatccgcccacttcggcctcctaaagtgctgggattacaggcatgagccaccgcgcccagcctaaaatgctttcttagcaagtagagaagattgtaataaccagtcttcattaaacattaaataggacccttacagatctctaacagcatatcatcatgtcaggaattattactgagccccagcccctggctttaaaatttgaggtcaaataaagaatatgagtcacacaatgcaaggcaagataatgtaacaggtacaagaggtaaatcagaatgacgttgaagttgaaagacaatcatttcctatttgaatttttgaagaaatacttgaaggggcatggtgtgtttcagtggttttaaaataagtaagttccccccgggagaatattgagaatgatagacatttcttggaaagagaaaacataaggaaagttgaagacacagaaagcatcaatatgacaagtagaaaagtccactttggttaaaacacacagtctgcagagaatgaaagcaggaaaaccaatgtaagaagatctcttgatttctgagtaataaactaaagggccatgagtgattaaggaatttggccactctttagaattaattgggagctatttaactaccttgagcaaaataaatcacgacttttgaaagaaggttgaacgggaagacaaactcagaagctcctgcagtaatcaaggacagaagcaattgttaaatgcacctcttaggctgttatcagtagaaatacgaaataaaagataaatatgcaaaaacattaatggcacaataaacactcacggttttgcctttagacttgagatacactaaaatctagatttaattaatcgacttggacgttggaataagatagtaaaactcacaacaaaactttgtagaacttagtcaggaaaagaatctcaagcatagctttaaaaacagaaattgccccgagtactaaggatgagcaataatgaaattaaaacatattgtaataacattacacaaactatattggagactacaaagaagagattattcatagattataaagcttggaaagaatcaaaacaacacatttctggaaacagattgtataaatgctacaaaagagaaaaatatattttctccccacgcaacacaagaccttaaagtcaattctcgcttttcttgcaatattttataccttttcaattcatagaattactcaagaaaactacctcagttggttgctactttttgttgattccttttaccagacatgactaagtttctttttcatcagtagatttctgggctcctatattcactagagattgcaactcctggatttctcttacactagaatcctatttcgagccatatgggagattctgaattccagaacaaaagaattttgtaatttaaaattcgtgattgctcaatggaatcattttaattgttacttcatttctgtcgttatttaaaacttaagtggagagttttctcagggataagaaaaccacaatcaaggtcatacaaaacttttagaggcagtcagtctgctaagaaggctccagcaagagaaacgggatcttctgtttcaacaatcattacttaagaaaaaattaagaaaatgaaataagttttgcagaataactgtgaaatttttattcatgaaatatgtacttacactttgggccacgtgatgtcactctttgccgcgatgttctctctgaatccagacaaatacagcccttttcccatgggaaagaggctcaattctttttcactctctctgtgctgaacgatggcgaacacagcagaatgggactgacgaaatcagatgatttcttctaatttggaggcaattttcactaattagaagaagactgagtatttgaaatgttatactcaagtcgaggagatccagagggtcagcctctactgctctcgcttctgatcctcgcaatgtgggtggtggggagcggccagctccactactccgtcccggaggaagccgaacacggcaccttcgtgggccgcatcgcgcaggacctggggctggagctggcggagctggtgccgcgcctgttccagttggattccaaaggccgcggggaccttctggaggtaaatctgcagaatggcattttgtttgtgaattctcggatcgaccgcgaggagctgtgcgggcggagcgcggagtgcagcatccacctggaggtgatcgtagacaggccgctgcaggttttccatgtggacgtggaggtgaaggacattaacgacaaccctccagtgttcccagcgacacaaaagaatctgttcatcgcggaatccaggccgcttgactctcggtttccactagagggcgcgtccgatgcagatatcggggagaacgccctgctcacttacagactgagccccaatgagtatttcttcctggacgtgccaaccagcaaccagcaggtaaaacctcttggacttgtattacggaaacttttagacagagaagaaactccggagcttcatttattgctcacggccaccgatggaggcaaacccgagctgactggcaccgttcaattactcatcacggtactggacaacaatgacaatgccccagtgttcgacagaaccctgtatacggtgaaattaccagaaaacgtttctatcggaacgctggtgattcaccccaatgcctcagatttagacgaaggcttgaatggggatattatttactccttctccagtgatgtttctccagatataaaatccaagttccacatggaccccttaagtggggcaatcacagtgataggacatatggattttgaagaaagtagagcacacaagatcccagtcgaggctgtcgataaaggcttcccacccctggctggtcattgtacacttcttgtggaagttgtggatgtaaatgacaatgctccacagttgactatcaaaacgctctcggttcctgtaaaagaggacgcacaactggggacagttattgccctgattagtgtgatcgacctagacgcagatgccaacgggcaggttacctgctccctgacgccccacgtccccttcaagctggtgtccacctacaagaattactactcgttggtgctggacagagctctggaccgcgagagtgtgtccgcctacgagctggtggttaccgcgcgggacgggggctcgccttcactgtgggccacggccagggtgtctgtggaggtggccgacgtgaacgacaacgcaccagcgttcgcgcagtccgagtacacggtgttcgtgaaggagaacaacccgccgggctgccacatcttcacggtgtctgcgcgggacgctgacgcgcaggagaacgccctggtgtcctactcgctggtggagcggcggttgggcgagcgctcgctgtcgagctacgtgtcagtgcacgcggagagcggcaaggtgtacgcgctgcagccgttggaccacgaggagctggagctgctacagttccaggtgagcgcgcgcgacgcgggcgtgccgcctctgggcagcaacgtgacgctgcaggtgttcgtgctggacgagaacgacaatgcgccggcgctgctgacacctcggatgaggggcactgacggcgcagtgagcgagatggtgctgcggtcggtgggcgccggcgtagtggtggggaaggtgcgcgcagtggacgccgactcgggctacaacgcgtggctttcatacgagctgcagccagaaacggccagcgcgagcatcccgttccgcgtggggctgtacacgggcgagatcagcacaacgcgtgccctggacgaaacggacgcaccgcgccagcgcctactggtgctggtgaaagaccacggggagccagcgctgacggccacggccactgtgctggtgtcgctggtggagagcggccaggcgccaaagtcatcgtcgcgggcgtcagtgggtgccacgggccccgaggtgacgctggtggatgtcaacgtgtacctgatcatcgccatctgcgcggtgtctagcctgttggttctcacgctgctgctgtacactgtgctgcggtgctcggcgatgcccaccgagggcgagtgcgcgcctggcaagccgacgctggtgtgttctagcgcggtggggagttggtcgtactcgcagcagaggaggcagagggtgtgctctggcgagggtaagcagaagaccgacctcatggccttcagcccgggcctttctccttgtgctggatctacagagcgaacgggagaaccctctgcttcctcagattcaactgggaaggtgggtttttctagcattttatttatttatataattttttttcttgaaagatattatcgattactcccaggggccgttcaaatagttttattcatttttctagaaatccagcagattttttttctgataaagtaaaccccttaacattggagccgactttgtcttgacttctagtgagaattataaactgtatattaaatagatattttttgggtgctgaatcaattttatttaaatttgtgattaaagtgacattgaatttctgatgctatgctgccataacacttgaaaaccaatttagttgttagtcattcattaaacattaacatcactatcatttatttattgctaaatgatgcatagtattttagtctacttgtattgtttataagaaacccaagcaaaaatatatagcaattgttaccttgttaagtttgtagttctctacatttctctggatggagactgtgaacatctgattgttcagcaaccttcagtatctattattttaataagaaagaaacttcccctaaactttagaaaacagttgctccactttaggaatcaaattatgtcaataaatgttataaacacagccttcatttcaacttatataaaatatgttttaaaatgcctgacaatgtagataattcaagaaatgttgactgaaattttgtctacacttagaacattttttgaaattcagtttacagaaattggagaaaatgctttttaaacaagtgtttcctttcttcaagaagatattctccttttaattgaaattttctccattcagtgataaaatgatcagccatgtgaagattcgaaacttcgagttcttttgaaattcagagtctgtaacttaaaacattacccttatgaatttagatgagaattcacttgttctgtcagtaatccataagacagaaatctgtttttttaaaaatatctttttctcctctcagctcatacataacacaaggcagaaatctggatatgagatttgcctctttaatgtcactacatgttatgtttcctgaattgtagtatgtgactttcaaaatggtggttttccacactctacctttagtgcaagctatttgtttgttttctaatttatagttttaaaaacttcgcttattgagtttttgttatgtggtttatatttttctttctctttcagctattttatttaatattgtgtcagatattttacaaggtatgacctaattaaaaactcagtagagaaagatcagaatggccttgagaatagagccacaaaaataactatgaaaatgccagtaacgtttatttaaaacaaaatattttaatttttaaattttcccttaaaacacacttttggaatatgctacaatattacatgttttttgtctttttatttttctgagacggagtcgttttctgccacccaggctggagtacagtggcatgatcttggctcactgcaacgtctgcctcctgggttcaagcaattctcctgcctcagcctcctgagtagctgggattataggcacatgccaccgcgcccagctaatttttgtatttttagtagagatggggtttcatcatgttggccaggttggtctcgaactcctgaccttgtgatgctcccacctcggcctcccaaagtgctgggattaaagctgtgagccactgtgccaaggcttttttattttttttttttgtcattttctttcaaaacttgagtggtctctgagctcctgtcattaaacctatctatatctgtctatcagcacaactcaccttgaatatagtcttatactttcaagtatctttgtctttgcacgtttttcaagtttcatgtgccatttaaacttggacccaggtatctgattatttgatgtgaatagagggatgctacagatgtcatttgtctcccgccctaagtcctccagtctccttagagctagtacttactaagcatttactatgtcatcaataatcataaaacgtatttttttttttgagtcagagtctcgctctgttgcccaggctggagtgcagtggtgccatcttggctcactccaagctccccctcccgtgttcacgccattctcctgcctcagcctcccgagtagctgggactacaggcgcctgccaccatgcccgcctaatttttttgtatttttagtagagatggggtttcaccgtgttagtcaggatggtctcgatctcctgacctcatgatcctcccgcctcagcctcccaaaatgctgggattacaggcgtgagccaccgcgcctggcctaaaatgtgttctttattattgacggctgtattgatgggattggtaatttagtccttcatattaatctctattctctctcagagtacaagctctcatcatatgcaaattctcagaagggctgtgaacaccttagtaataaatttatcttttgaggtcattagcaaacatgaactcacagggatccagagatggtaaaattcaaaacagcctgtcaagttcaaaacagagaggtgaaagcagaagagacactttcctattttgcctaataggtctccttatatgcatctgtagttaacattcctcaattcaagttagaatcatgaaacaataatgaagctcctcctatgtctcttttcaagttgtaattactatataggaaaaactaagttgtcacccaatatcttagacactttgagagcaaagggggtgctgtaaataagtatacaagatcacagacctaaattgagcctgttccagacaaattggggcctatggtcaacctatccttagacctgctaacgcattagcattagcagcacctaagtcctcattgaatgttctggttcaaggctccacctcagaaattctgaaatgggtagtaagagcaaattttcattttaaagcacacctgagatgattctcatacaaccgaaattttagatccatagccctatttgatacttgacagtgcaagtttctgtaatttaaaaagatgtggtggcctgacacctgcaatcccaacattttgggaggccaaggtgggagggtcccttccttgagcccagcagtttgagaccaatgtagtgagactcatctctgccaaaaaaaaaaaattagccgggcatggtggcacacatctctagtcccaattactcaggaggctgaggcgagagaatcgcttgagcctgggacattgaggctgcagtgaactgtgatggcacaactgcatttcagcccgggagacagcaagattctgtctcaaaaaaaaaaaaaaaaagagtagtttaactactccctactttttattcaatattggacatctacattgggatatttatgttatcacttggtataaaatgtacattagtagaaattgagtttagtttttattattttgtgcgtggagatgattgatcaatggcaaacttattttacgctccagatagctaaaacaaacgttgatattttgatacataactcattacattttaattcagggtttataaaaaagtaatctctaaaatcagaatttgaatgaattttgatgcaagaggcattccagaggagtagagaagtatagaaacagaatttagtaggacacataaactgatggattaagtgacacccatttctgtcagttttcttattcataaatattgttgctctgtcattcagattttaataaaaaaagtttaaagtaattgacacatttaaaaatattctttagaaaagtcaaaacatcattaaataaaataaattaacccttgcataagaccaatatgtctgttgttaagttttcctttcttggaaagacagaaaactcaagtttttttcagcagcacagatatattacattttcattcctgaatatttgatttcaagaactttgagagagaaaaaaatatttttactgcaagtggtgatgaaaaacttcactgacattgataaaattactagatatatttcagaactgtgtcttttgggcatttgaaaagcgtaaatataacagggttgaaagcatttgcctctgaaagcagaaataataaatttcttaattactttattcagaattataattaagattctttttgcccgtgtaagatattataaaatgaaacttcttgtataaaggatttttctgtaatagtacttttctgttttcttaaatacagaaaccaccactctcagcctgtgcagtagcaataattaaggcattctataggtaataattttgcctgatgagccaaatttggtattgagcctcatgaaaacaaatgtggccaaattgaggcctgagaatagtttccatttatgaagcactcattctccttaaggtactattgcaagcacttactatattataattcactcaaccaccgtattactattaggccaaagttataaaattggaacatgagggagggagaggttaaacgattttcccaagtcatgtggctagtgagtaggataataggaatctaaatggagaaatgtctgatgttgaagctaatgatctctaaattctagtgatgactagatcttcggagttataaacacctcacagatagttgatgcttgacattagtgtctaaataaaccttattaaatctcaaaataatgagaaagagaagtaagttaagtgtcagaacttaaatggaactaaagttgtcatttaataaaatattagtatactcagtagtatgcaaatattaagggcattttgaaattcggctattgataatcatgtggttagggaagaaatcactactctgagagtctacatttaagaaaacattgcacgtgggatcaacatttattgttattaactataaagagacgtaatgtgaggctttgaaagtccatagacataaaaatacgtaaaaaaagaattaacatatgaatgaaagaaaagttgtgaactcatggaatcgtacttacacctaaagccaccggatgtcgctgtcgtccacaaaatagctttttagaacaaaggcatcagccagtttctcaaggactaggaagtagcgtcattctgagatctcagccatttcgataaaaaatagatataagaaataggacagaaaatgtcagatcgtatgtgcgttctagaccgctgattcgtcgatttgtaaaacaagagaaggataagatggtttccagatgtagctgcctgggggtccagtgtctgctgctctcgcttcttctcctcgcagcctgggaggtggggagcggccagctccactactcagtctacgaggaggccagacacggcaccttcgtgggccgcatcgcgcaggacctggggctggagctggcggagctggtgcagcgcctgttccgggtggcgtccaaaagacacggggaccttctggaggtaaatctgcagaatggcattttgtttgtgaattctcggattgaccgcgaggagctgtgcgggcggagcgtggagtgcagcatccacctggaggtgatcgtggacaggccgctgcaggttttccatgtggacgtggaagtgaaggacattaacgacaacccgcccaggttctccgtaacagaacaaaagctctcaatacctgaatccagactgcttgactctcgatttccactagaaggcgcatctgatgcggatgttggagagaacgcattgcttacttacaaactcagtccaaatgagtattttgttcttgatattataaacaaaaaagacaaagacaaattcccagtgcttgttctgcggaagctgctggatcgtgaagaaaatcctcagctaaagttgttgttgacagcaactgatggaggcaaacctgaatttaccggatctgtttctctgctgatcctggtgttagatgccaatgataacgcccctatctttgacagaccggtttatgaagttaagatgtatgaaaatcaagtgaaccaaacattagtaatacggctcaacgcttctgattcggatgaaggaataaacaaggaaatgatgtattcatttagctctttggtcccacccacgataagaaggaaattttggataaacgaaaggacgggagaaataaaagtaaatgatgctattgactttgaggacagtaacacttatgaaattcatgtagatgttacagataagggaaacccacctatggttggtcactgcacggtcctagtggaactactggatgaaaatgataattcacctgaggtgattgtcacttctctgtctctcccagtgaaagaagatgctcaagtgggcaccgtcattgccctaatcagcgtttctgaccatgattcaggagccaacggacaggtcacctgctctctgacgcctcacgttccgttcaagctggtgtccacctacaagaattactactcattggtgctggacagcgctctggaccgcgagagggtgtcggcctatgagctggtggtgaccgcgcgggacgggggctcgcctccgctgtgggccacggccagcgtgtctgtggaggtggccgacgtgaacgacaacgcgcctgcgttcgcgcagtccgagtacacggtgttcgtgaaggagaacaacccgccaggctgccacatcttcacggtgtctgcgtgggacgcggacgcgcaggagaacgccctggtgtcctactctctggtggagcggcggttgggcgagcgctcgctgtcgagctacgtgtcggtgcacgcggagagcggcaaggtgtacgcgctgcagccgctggaccacgaggagctggagctgctacagttccaggtgagcgcgcgcgatgggggcgtgccgcctctgggcagcaacttgacgctgcaggtgttcgtgctggacgagaacgacaacgctcccgcgctgctggcgtctcccgctggcagcgcgggcggtgcagtcagtgagctggtgctgcggtcggtggttgcgggtcacgtggtggctaaggtgcgcgcagtggacgctgactctggatacaacgcgtggctgtcgtatgaattgcagtcggcggcggttggtgcacgcatcccgtttcgcgtggggctgtacacgggcgagatcagtacgacgcgcgctctggatgagactgactcgccacgccagcgcctactggtgctggtgaaggaccatggcgagccgtcgctgacggccacggccactgtgcttgtgtcgcttgtggagggcagccaggcacccaaggcctcgtcgcgggcttcagtgggcgtggcgcccgaggtggccctggtggatgtcaacgtgtacctgatcatcgccatctgcgcggtgtccagcttgctggtgctcacgctgctgctgtacactgcactgaggtgctcggcggcgcccaccgagggcgcatgtgggccggtgaagcccacgctggtgtgctctagcgcggtggggagctggtcttactcgcagcagaggcggcagagggtgtgttctggggagggcctgcccaaggcggacctcatggccttcagccccagccttccaccatgcccaatggtagatgtggacggggaagatcagtctattggaggggaccactctaggaaggtgggttattacgttttcattttccttttgtgctttatgaataatattttctcttaccgcattttctcaaatatgtatcagaatatttcatttttgtctacattccatttatgcttgaatatttctagtgatacctttgtaatataatttattccaggagttttaaaatttttttatcctacccagtgtgtcagcctttgattggtacttaaatttttttaaataacaatttattctgaatacactaatattttccaatacaaatatgtgatataggttgcagttctgacgatttactttcataatcacttttcgttacaaatatttgtgagattagtacttcatgttatttcatttccaatctaaattttgatttgattgtatttgcattaccaaaaaattccactgatctatatctcttcagtgaaaatgtgttttcctccatgtgtagaatatgtgtagcgtaccacagcttatactgccatagtagatttcaatgttcagtgattacagctttttctcaatagtgcagtaagtaggtgggcagttcattggtaaaaatttcttaatcttagcaattaagttaaatgctttgaactttaaaaacgttttccatttttattttagttgtagtggtacctgtgtcagtgtgtattattcacttagcagaagaaaatgtatgtttcttttatttacataattttatccagtagctcttcattatctgctcctttatcagcattaggcattgcttatgatattcaggtattagctctttcactttaaggaaggagtcatgcttatgtttaataatgaagagaatttgaacactttttacttttgagactgaaaatactttagtatgaattaatattaaaagtttgaggagaaaataaaattaatgttttctactgatctgatatattgtatagtttaatagcttctctagtcatcttaaacagggttgggttagatgatatagactcagaaatgaaagctaacttagttgcagagtgacaaaactacactatcaattgtgttttcctgaaattggttgttacctgatacccatgatttcatttttaaaaaaaatttattaattctagtgttaccaaacaccaatgccatgaatttgtcatcttgcctatggctcttagcaattacttttttctttcctttctctttgagtatggagattgaatttgttactcagtacgtgcttcacaaatagcttcaaataaaattaaaattattgttcaa

SEQ ID NO: 101 - DNA, 16026 bp, Homo sapiens
gatgtaggcgaagagcaagatttaaatgttgatcatggcctcaaagtaagtccatttaaatttagaactcataaattctatttgtggaaattgtagttactttaaaagtgtttcagatttagtttttcaccgtattttatagtgaaaatttaaacattgtttagtttttagaaaccttttataattaattgaattttctcagtggcataatacagtattaatcattctccacaagttgggtctatcttgaaactcaagttatggttggatgatatccattttttactgaatatttattttggcctgccttacagccgtcttctctgaacaatactctaaggacgttcagggcattttgatctttggtgaaagtattcccccaaagcgtttattcttttgtccttaggcactgaactcttaatcttactccatatgctgtactttgaaatgcatgttttaaatatgttgtctttatatttacttttattcactttaagatctcggtttattcatcttatctgactttttagtgtctggtagtcacaaatatctttggtgtttcactattgccgttttaagcagtgtagtgataaaatacagaatgatagtgtttttcaaaatttgatagttttcatattcttcctaattttattataaactagttaaaaagtaaaatcaagagggaagagatttgtaatccttcttttaattcattatttagaccattttaccatttggagacatgttttttattctacatgatttttacagttgtattgtcgccaacttaacattttttgagcctctatgtttaggaaatgattactttattcttgcaagtatcttctaaactctaatcattcaaccctttgttcatgagttggaatattttcaataatattccacattaaagtgatatttaatatatgacttagaaaaatgttttcatcagaaaaactatacatgataatttcattcttgcaaaccaaacatataatttataaatccttattatacagaatatttgggattatcatggcccattagttcgtgtaaaaatatttagtattatgggataaatctttgaaaaatccaagatactttattttggtatctttcaacattttctttcttttatttcttcttgtctttttacacgtttgcttcttgtgactgttggacctgcctggatattaaatacccattagacttcgtgcatattgctttggagagaatggtagaaattgatggaagggaatgaacgatttctgggactctgaattcttacagtttgttattagtattgttttaaatcttttaatcacttatgaacaaataatgtaatcatttatgggcatattttagcccccttgtccaactgaaggtaacctcaaagcagcattgttttgtagtttattttacagttctcttaatgcctgtccatgtttagcattttatttgactatttgaacacattgtgtaaaagcgaattgttttcattttagtcctttaaaaaatatgattgttttcatttaagtccttttaaaaaatatgattatctttattatcctgtttgaataatatgtgttttcctttgtgaaagtaatatttcctatcctgtctatgtctacctggttctcaggtattactttaattactgaattctcctaaacatttaattgacttttacaaaatatcataaataggaggattctttccaccacctagcattgtatttggcaatttatcatttaagtcattttagttctgtttttcttcaactctctgatatttgaatttggggttgtgctttcacagtgagaaagtctaaacctatttcttgtacattaatacttttcactattctaattatggtgatgcttttagctattaagaatttctgggattgaaatgtgtcagaagttagttattaagtattgtggattctgaagctctctaaatcaagtcctccctttaccaatttttgtatgtgtagccattggtaaaggatttgttattcagttccttggcattatatgtatgcatgataaatgtgaattctactttatagatttatttgtatcaagtaagttaatagttataaattattaataataaactctggcaagtgataggtacataataaaatttagttattaccattcttaagagaaaagaagttagtgattgcagaaaggcaacctaaaatgtcagaaagtcgttatggccttccatattaatcttatttttgtgtaaaactatcttctgtaaagtcattttttagattaacctaggatgtttcaatattttgaatgttgtgtggtggaatgaaaaaaatctaaaagttattacgagtttaggaaagtcaagttaacaccacctatgtgggaaaacagttttttggaaaggttaaagtccttccaaggaatgtgtagactatcttactttgatagttgtatgtttcccatatttaaaagttgcctgagatcctgcagaggcctgagtaggcgtttgagttctttgtatgtatgagatctttccattaatagtatttttcttaaaaagaagtatacaataatgttttgatgatgatttaaagtcaatttatgttgtagttctatgaattaagtaaaccatttatgtagagtgttgtaaatagccttttaaagtgctttctcttttttcttttcttttctttctttctttttttttttttttttttgagacggagtctcgctctatctcccaggctggaatgcagtggcgcaatctcggctcactgcaacctctgcctcccgggttcaaatgattctccttcctcagcctcccaagtagctgggattacaggtgcatgccaccatgccctgctaattttttgtatttttagtagagtcggggtttcaccatgttagccaggatggtctcgatctcctgacctcctgatccgcccacttcggcctcctaaagtgctgggattacaggcatgagccaccgcgcccagcctaaaatgctttcttagcaagtagagaagattgtaataaccagtcttcattaaacattaaataggacccttacagatctctaacagcatatcatcatgtcaggaattattactgagccccagcccctggctttaaaatttgaggtcaaataaagaatatgagtcacacaatgcaaggcaagataatgtaacaggtacaagaggtaaatcagaatgacgttgaagttgaaagacaatcatttcctatttgaatttttgaagaaatacttgaaggggcatggtgtgtttcagtggttttaaaataagtaagttccccccgggagaatattgagaatgatagacatttcttggaaagagaaaacataaggaaagttgaagacacagaaagcatcaatatgacaagtagaaaagtccactttggttaaaacacacagtctgcagagaatgaaagcaggaaaaccaatgtaagaagatctcttgatttctgagtaataaactaaagggccatgagtgattaaggaatttggccactctttagaattaattgggagctatttaactaccttgagcaaaataaatcacgacttttgaaagaaggttgaacgggaagacaaactcagaagctcctgcagtaatcaaggacagaagcaattgttaaatgcacctcttaggctgttatcagtagaaatacgaaataaaagataaatatgcaaaaacattaatggcacaataaacactcacggttttgcctttagacttgagatacactaaaatctagatttaattaatcgacttggacgttggaataagatagtaaaactcacaacaaaactttgtagaacttagtcaggaaaagaatctcaagcatagctttaaaaacagaaattgccccgagtactaaggatgagcaataatgaaattaaaacatattgtaataacattacacaaactatattggagactacaaagaagagattattcatagattataaagcttggaaagaatcaaaacaacacatttctggaaacagattgtataaatgctacaaaagagaaaaatatattttctccccacgcaacacaagaccttaaagtcaattctcgcttttcttgcaatattttataccttttcaattcatagaattactcaagaaaactacctcagttggttgctactttttgttgattccttttaccagacatgactaagtttctttttcatcagtagatttctgggctcctatattcactagagattgcaactcctggatttctcttacactagaatcctatttcgagccatatgggagattctgaattccagaacaaaagaattttgtaatttaaaattcgtgattgctcaatggaatcattttaattgttacttcatttctgtcgttatttaaaacttaagtggagagttttctcagggataagaaaaccacaatcaaggtcatacaaaacttttagaggcagtcagtctgctaagaaggctccagcaagagaaacgggatcttctgtttcaacaatcattacttaagaaaaaattaagaaaatgaaataagttttgcagaataactgtgaaatttttattcatgaaatatgtacttacactttgggccacgtgatgtcactctttgccgcgatgttctctctgaatccagacaaatacagcccttttcccatgggaaagaggctcaattctttttcactctctctgtgctgaacgatggcgaacacagcagaatgggactgacgaaatcagatgatttcttctaatttggaggcaattttcactaattagaagaagactgagtatttgaaatgttatactcaagtcgaggagatccagagggtcagcctctactgctctcgcttctgatcctcgcaatgtgggtggtggggagcggccagctccactactccgtcccggaggaagccgaacacggcaccttcgtgggccgcatcgcgcaggacctggggctggagctggcggagctggtgccgcgcctgttccagttggattccaaaggccgcggggaccttctggaggtaaatctgcagaatggcattttgtttgtgaattctcggatcgaccgcgaggagctgtgcgggcggagcgcggagtgcagcatccacctggaggtgatcgtagacaggccgctgcaggttttccatgtggacgtggaggtgaaggacattaacgacaaccctccagtgttcccagcgacacaaaagaatctgttcatcgcggaatccaggccgcttgactctcggtttccactagagggcgcgtccgatgcagatatcggggagaacgccctgctcacttacagactgagccccaatgagtatttcttcctggacgtgccaaccagcaaccagcaggtaaaacctcttggacttgtattacggaaacttttagacagagaagaaactccggagcttcatttattgctcacggccaccgatggaggcaaacccgagctgactggcaccgttcaattactcatcacggtactggacaacaatgacaatgccccagtgttcgacagaaccctgtatacggtgaaattaccagaaaacgtttctatcggaacgctggtgattcaccccaatgcctcagatttagacgaaggcttgaatggggatattatttactccttctccagtgatgtttctccagatataaaatccaagttccacatggaccccttaagtggggcaatcacagtgataggacatatggattttgaagaaagtagagcacacaagatcccagtcgaggctgtcgataaaggcttcccacccctggctggtcattgtacacttcttgtggaagttgtggatgtaaatgacaatgctccacagttgactatcaaaacgctctcggttcctgtaaaagaggacgcacaactggggacagttattgccctgattagtgtgatcgacctagacgcagatgccaacgggcaggttacctgctccctgacgccccacgtccccttcaagctggtgtccacctacaagaattactactcgttggtgctggacagagctctggaccgcgagagtgtgtccgcctacgagctggtggttaccgcgcgggacgggggctcgccttcactgtgggccacggccagggtgtctgtggaggtggccgacgtgaacgacaacgcaccagcgttcgcgcagtccgagtacacggtgttcgtgaaggagaacaacccgccgggctgccacatcttcacggtgtctgcgcgggacgctgacgcgcaggagaacgccctggtgtcctactcgctggtggagcggcggttgggcgagcgctcgctgtcgagctacgtgtcagtgcacgcggagagcggcaaggtgtacgcgctgcagccgttggaccacgaggagctggagctgctacagttccaggtgagcgcgcgcgacgcgggcgtgccgcctctgggcagcaacgtgacgctgcaggtgttcgtgctggacgagaacgacaatgcgccggcgctgctgacacctcggatgaggggcactgacggcgcagtgagcgagatggtgctgcggtcggtgggcgccggcgtagtggtggggaaggtgcgcgcagtggacgccgactcgggctacaacgcgtggctttcatacgagctgcagccagaaacggccagcgcgagcatcccgttccgcgtggggctgtacacgggcgagatcagcacaacgcgtgccctggacgaaacggacgcaccgcgccagcgcctactggtgctggtgaaagaccacggggagccagcgctgacggccacggccactgtgctggtgtcgctggtggagagcggccaggcgccaaagtcatcgtcgcgggcgtcagtgggtgccacgggccccgaggtgacgctggtggatgtcaacgtgtacctgatcatcgccatctgcgcggtgtctagcctgttggttctcacgctgctgctgtacactgtgctgcggtgctcggcgatgcccaccgagggcgagtgcgcgcctggcaagccgacgctggtgtgttctagcgcggtggggagttggtcgtactcgcagcagaggaggcagagggtgtgctctggcgagggtaagcagaagaccgacctcatggccttcagcccgggcctttctccttgtgctggatctacagagcgaacgggagaaccctctgcttcctcagattcaactgggaaggtgggtttttctagcattttatttatttatataattttttttcttgaaagatattatcgattactcccaggggccgttcaaatagttttattcatttttctagaaatccagcagattttttttctgataaagtaaaccccttaacattggagccgactttgtcttgacttctagtgagaattataaactgtatattaaatagatattttttgggtgctgaatcaattttatttaaatttgtgattaaagtgacattgaatttctgatgctatgctgccataacacttgaaaaccaatttagttgttagtcattcattaaacattaacatcactatcatttatttattgctaaatgatgcatagtattttagtctacttgtattgtttataagaaacccaagcaaaaatatatagcaattgttaccttgttaagtttgtagttctctacatttctctggatggagactgtgaacatctgattgttcagcaaccttcagtatctattattttaataagaaagaaacttcccctaaactttagaaaacagttgctccactttaggaatcaaattatgtcaataaatgttataaacacagccttcatttcaacttatataaaatatgttttaaaatgcctgacaatgtagataattcaagaaatgttgactgaaattttgtctacacttagaacattttttgaaattcagtttacagaaattggagaaaatgctttttaaacaagtgtttcctttcttcaagaagatattctccttttaattgaaattttctccattcagtgataaaatgatcagccatgtgaagattcgaaacttcgagttcttttgaaattcagagtctgtaacttaaaacattacccttatgaatttagatgagaattcacttgttctgtcagtaatccataagacagaaatctgtttttttaaaaatatctttttctcctctcagctcatacataacacaaggcagaaatctggatatgagatttgcctctttaatgtcactacatgttatgtttcctgaattgtagtatgtgactttcaaaatggtggttttccacactctacctttagtgcaagctatttgtttgttttctaatttatagttttaaaaacttcgcttattgagtttttgttatgtggtttatatttttctttctctttcagctattttatttaatattgtgtcagatattttacaaggtatgacctaattaaaaactcagtagagaaagatcagaatggccttgagaatagagccacaaaaataactatgaaaatgccagtaacgtttatttaaaacaaaatattttaatttttaaattttcccttaaaacacacttttggaatatgctacaatattacatgttttttgtctttttatttttctgagacggagtcgttttctgccacccaggctggagtacagtggcatgatcttggctcactgcaacgtctgcctcctgggttcaagcaattctcctgcctcagcctcctgagtagctgggattataggcacatgccaccgcgcccagctaatttttgtatttttagtagagatggggtttcatcatgttggccaggttggtctcgaactcctgaccttgtgatgctcccacctcggcctcccaaagtgctgggattaaagctgtgagccactgtgccaaggcttttttattttttttttttgtcattttctttcaaaacttgagtggtctctgagctcctgtcattaaacctatctatatctgtctatcagcacaactcaccttgaatatagtcttatactttcaagtatctttgtctttgcacgtttttcaagtttcatgtgccatttaaacttggacccaggtatctgattatttgatgtgaatagagggatgctacagatgtcatttgtctcccgccctaagtcctccagtctccttagagctagtacttactaagcatttactatgtcatcaataatcataaaacgtatttttttttttgagtcagagtctcgctctgttgcccaggctggagtgcagtggtgccatcttggctcactccaagctccccctcccgtgttcacgccattctcctgcctcagcctcccgagtagctgggactacaggcgcctgccaccatgcccgcctaatttttttgtatttttagtagagatggggtttcaccgtgttagtcaggatggtctcgatctcctgacctcatgatcctcccgcctcagcctcccaaaatgctgggattacaggcgtgagccaccgcgcctggcctaaaatgtgttctttattattgacggctgtattgatgggattggtaatttagtccttcatattaatctctattctctctcagagtacaagctctcatcatatgcaaattctcagaagggctgtgaacaccttagtaataaatttatcttttgaggtcattagcaaacatgaactcacagggatccagagatggtaaaattcaaaacagcctgtcaagttcaaaacagagaggtgaaagcagaagagacactttcctattttgcctaataggtctccttatatgcatctgtagttaacattcctcaattcaagttagaatcatgaaacaataatgaagctcctcctatgtctcttttcaagttgtaattactatataggaaaaactaagttgtcacccaatatcttagacactttgagagcaaagggggtgctgtaaataagtatacaagatcacagacctaaattgagcctgttccagacaaattggggcctatggtcaacctatccttagacctgctaacgcattagcattagcagcacctaagtcctcattgaatgttctggttcaaggctccacctcagaaattctgaaatgggtagtaagagcaaattttcattttaaagcacacctgagatgattctcatacaaccgaaattttagatccatagccctatttgatacttgacagtgcaagtttctgtaatttaaaaagatgtggtggcctgacacctgcaatcccaacattttgggaggccaaggtgggagggtcccttccttgagcccagcagtttgagaccaatgtagtgagactcatctctgccaaaaaaaaaaaattagccgggcatggtggcacacatctctagtcccaattactcaggaggctgaggcgagagaatcgcttgagcctgggacattgaggctgcagtgaactgtgatggcacaactgcatttcagcccgggagacagcaagattctgtctcaaaaaaaaaaaaaaaaagagtagtttaactactccctactttttattcaatattggacatctacattgggatatttatgttatcacttggtataaaatgtacattagtagaaattgagtttagtttttattattttgtgcgtggagatgattgatcaatggcaaacttattttacgctccagatagctaaaacaaacgttgatattttgatacataactcattacattttaattcagggtttataaaaaagtaatctctaaaatcagaatttgaatgaattttgatgcaagaggcattccagaggagtagagaagtatagaaacagaatttagtaggacacataaactgatggattaagtgacacccatttctgtcagttttcttattcataaatattgttgctctgtcattcagattttaataaaaaaagtttaaagtaattgacacatttaaaaatattctttagaaaagtcaaaacatcattaaataaaataaattaacccttgcataagaccaatatgtctgttgttaagttttcctttcttggaaagacagaaaactcaagtttttttcagcagcacagatatattacattttcattcctgaatatttgatttcaagaactttgagagagaaaaaaatatttttactgcaagtggtgatgaaaaacttcactgacattgataaaattactagatatatttcagaactgtgtcttttgggcatttgaaaagcgtaaatataacagggttgaaagcatttgcctctgaaagcagaaataataaatttcttaattactttattcagaattataattaagattctttttgcccgtgtaagatattataaaatgaaacttcttgtataaaggatttttctgtaatagtacttttctgttttcttaaatacagaaaccaccactctcagcctgtgcagtagcaataattaaggcattctataggtaataattttgcctgatgagccaaatttggtattgagcctcatgaaaacaaatgtggccaaattgaggcctgagaatagtttccatttatgaagcactcattctccttaaggtactattgcaagcacttactatattataattcactcaaccaccgtattactattaggccaaagttataaaattggaacatgagggagggagaggttaaacgattttcccaagtcatgtggctagtgagtaggataataggaatctaaatggagaaatgtctgatgttgaagctaatgatctctaaattctagtgatgactagatcttcggagttataaacacctcacagatagttgatgcttgacattagtgtctaaataaaccttattaaatctcaaaataatgagaaagagaagtaagttaagtgtcagaacttaaatggaactaaagttgtcatttaataaaatattagtatactcagtagtatgcaaatattaagggcattttgaaattcggctattgataatcatgtggttagggaagaaatcactactctgagagtctacatttaagaaaacattgcacgtgggatcaacatttattgttattaactataaagagacgtaatgtgaggctttgaaagtccatagacataaaaatacgtaaaaaaagaattaacatatgaatgaaagaaaagttgtgaactcatggaatcgtacttacacctaaagccaccggatgtcgctgtcgtccacaaaatagctttttagaacaaaggcatcagccagtttctcaaggactaggaagtagcgtcattctgagatctcagccatttcgataaaaaatagatataagaaataggacagaaaatgtcagatcgtatgtgcgttctagaccgctgattcgtcgatttgtaaaacaagagaaggataagatggtttccagatgtagctgcctgggggtccagtgtctgctgctctcgcttcttctcctcgcagcctgggaggtggggagcggccagctccactactcagtctacgaggaggccagacacggcaccttcgtgggccgcatcgcgcaggacctggggctggagctggcggagctggtgcagcgcctgttccgggtggcgtccaaaagacacggggaccttctggaggtaaatctgcagaatggcattttgtttgtgaattctcggattgaccgcgaggagctgtgcgggcggagcgtggagtgcagcatccacctggaggtgatcgtggacaggccgctgcaggttttccatgtggacgtggaagtgaaggacattaacgacaacccgcccaggttctccgtaacagaacaaaagctctcaatacctgaatccagactgcttgactctcgatttccactagaaggcgcatctgatgcggatgttggagagaacgcattgcttacttacaaactcagtccaaatgagtattttgttcttgatattataaacaaaaaagacaaagacaaattcccagtgcttgttctgcggaagctgctggatcgtgaagaaaatcctcagctaaagttgttgttgacagcaactgatggaggcaaacctgaatttaccggatctgtttctctgctgatcctggtgttagatgccaatgataacgcccctatctttgacagaccggtttatgaagttaagatgtatgaaaatcaagtgaaccaaacattagtaatacggctcaacgcttctgattcggatgaaggaataaacaaggaaatgatgtattcatttagctctttggtcccacccacgataagaaggaaattttggataaacgaaaggacgggagaaataaaagtaaatgatgctattgactttgaggacagtaacacttatgaaattcatgtagatgttacagataagggaaacccacctatggttggtcactgcacggtcctagtggaactactggatgaaaatgataattcacctgaggtgattgtcacttctctgtctctcccagtgaaagaagatgctcaagtgggcaccgtcattgccctaatcagcgtttctgaccatgattcaggagccaacggacaggtcacctgctctctgacgcctcacgttccgttcaagctggtgtccacctacaagaattactactcattggtgctggacagcgctctggaccgcgagagggtgtcggcctatgagctggtggtgaccgcgcgggacgggggctcgcctccgctgtgggccacggccagcgtgtctgtggaggtggccgacgtgaacgacaacgcgcctgcgttcgcgcagtccgagtacacggtgttcgtgaaggagaacaacccgccaggctgccacatcttcacggtgtctgcgtgggacgcggacgcgcaggagaacgccctggtgtcctactctctggtggagcggcggttgggcgagcgctcgctgtcgagctacgtgtcggtgcacgcggagagcggcaaggtgtacgcgctgcagccgctggaccacgaggagctggagctgctacagttccaggtgagcgcgcgcgatgggggcgtgccgcctctgggcagcaacttgacgctgcaggtgttcgtgctggacgagaacgacaacgctcccgcgctgctggcgtctcccgctggcagcgcgggcggtgcagtcagtgagctggtgctgcggtcggtggttgcgggtcacgtggtggctaaggtgcgcgcagtggacgctgactctggatacaacgcgtggctgtcgtatgaattgcagtcggcggcggttggtgcacgcatcccgtttcgcgtggggctgtacacgggcgagatcagtacgacgcgcgctctggatgagactgactcgccacgccagcgcctactggtgctggtgaaggaccatggcgagccgtcgctgacggccacggccactgtgcttgtgtcgcttgtggagggcagccaggcacccaaggcctcgtcgcgggcttcagtgggcgtggcgcccgaggtggccctggtggatgtcaacgtgtacctgatcatcgccatctgcgcggtgtccagcttgctggtgctcacgctgctgctgtacactgcactgaggtgctcggcggcgcccaccgagggcgcatgtgggccggtgaagcccacgctggtgtgctctagcgcggtggggagctggtcttactcgcagcagaggcggcagagggtgtgttctggggagggcctgcccaaggcggacctcatggccttcagccccagccttccaccatgcccaatggtagatgtggacggggaagatcagtctattggaggggaccactctaggaaggtgggttattacgttttcattttccttttgtgctttatgaataatattttctcttaccgcattttctcaaatatgtatcagaatatttcatttttgtctacattccatttatgcttgaatatttctagtgatacctttgtaatataatttattccaggagttttaaaatttttttatcctacccagtgtgtcagcctttgattggtacttaaatttttttaaataacaatttattctgaatacactaatattttccaatacaaatatgtgatataggttgcagttctgacgatttactttcataatcacttttcgttacaaatatttgtgagattagtacttcatgttatttcatttccaatctaaattttgatttgattgtatttgcattaccaaaaaattccactgatctatatctcttcagtgaaaatgtgttttcctccatgtgtagaatatgtgtagcgtaccacagcttatactgccatagtagatttcaatgttcagtgattacagctttttctcaatagtgcagtaagtaggtgggcagttcattggtaaaaatttcttaatcttagcaattaagttaaatgctttgaactttaaaaacgttttccatttttattttagttgtagtggtacctgtgtcagtgtgtattattcacttagcagaagaaaatgtatgtttcttttatttacataattttatccagtagctcttcattatctgctcctttatcagcattaggcattgcttatgatattcaggtattagctctttcactttaaggaaggagtcatgcttatgtttaataatgaagagaatttgaacactttttacttttgagactgaaaatactttagtatgaattaatattaaaagtttgaggagaaaataaaattaatgttttctactgatctgatatattgtatagtttaatagcttctctagtcatcttaaacagggttgggttagatgatatagactcagaaatgaaagctaacttagttgcagagtgacaaaactacactatcaattgtgttttcctgaaattggttgttacctgatacccatgatttcatttttaaaaaaaatttattaattctagtgttaccaaacaccaatgccatgaatttgtcatcttgcctatggctcttagcaattacttttttctttcctttctctttgagtatggagattgaatttgttactcagtacgtgcttcacaaatagcttcaaataaaattaaaattattgttcaa

SEQ ID NO: 102 - DNA, 2901 bp, Homo sapiens
ctctctcagtaaccgatgtcgtttcttactcttgtgatcaggactaaagcacagggtcatcccatggctgcttttggatcacagggagtcaggactccaagggcctcgagcgttacctggtccaggcccattttacagatgaaggcactgagccccaaatcacggaagtcacttagaggtcacagagcaagtgaaatgaacaaggtgtctgattcccaggaaggttcttgtccacataaagaaagtggcccaagacttccagggccccagagggagctgtcgggtccattaagtgttactggggtttttggtcccggtaagtgtcattagccatgtcccccaaccggttcttagacatgtcctgatgcagatccaggaggggctgtgggagtgtctctgttcttgtcaccccaggtgcctgtccccgcagggtgtcagcccgcgccaggagctctcacaaaacctgtgtgtctggggaggcactgcccagagcgtcctggacatggtggtggccagtctttaaggggaagcgctgtgtgtggatgcggcagctggtgtcatgctggagacgtggcttctgagagtacctaccgcaatgacaggaggatggcacgcctctgaagtttctctgtttccttctgcagacgtggttaacttggacctcaaatccaccctgagggttctttacaacctgttcaccaagtacaagaacgtggagtgacgggggagctgtggatggtggcaggagtgtcccagcaagaaaggcggcatccgtctgtgccctgtgcctttccagggagccaggcgccatgggcttctggtccaagctgtgttgactgtcatccccaccccacccctacctcacgcctgccccaccccctgcctcttttggttgttgttcttaatctcctctccatgtagttcccagtgggcaagagcctttgaaaatgcaggattctaaacactcgtgcttgcgtttgaagcctcgcgtcactcagtcgcgtgggatgatgagtccgttgttgtctgccttggccgaaagatgaaaaaaagcctgaaccccaacccccagctggttgagagcaccctgcattctgcctcatggtgcagttagcgatcacaggccttcagaagtacaacatcagctcagcaggaacgccggctccccgaggacccaggcttgacgattcaccggggatctcctgggctgggctctccttggaagtgaggccttttattaaaaataaaagggttttgcagtttgaaaaactttaaagtcccagaagcttagatgtgacatgggtgtcctccacccacattcctatcacttcttggtcactcgttttaatgtaggttttgcacaaacatccaagactcaggatggcccagctcccacagtccttgaaaggagctgtctgctggggacgtttcttaatttcttgctgtggttgaggggctgggtctggagatggctctaattgtgctgcttgagacagcttgggtcacagctttccccttcagaggccctttttgggaatgaatgcatctttggaaactttaaaatgaggggggtgcattggttcactggcactgtgtagtaaagtgccacaggggagtggctcagacatcagagaattacatcctcaggcctttcgccttggcttgtagatgccggcttctccccgtgtcttcacatggtctcccctctgtgtgtctgtgtcctcaccgcctcttttattttattttttatttttgtttttattttttgagacagagtctcgctctgtcaccaggctggagtgcagtggtgtgatctcagctcactgcaacctctgcctcccaggttcaagcgattctcctgcctcagcctcccaagtagctggcattacaggcaggtgccaccacacctggctaatttttgtatttttagtagagacggggtttcaccatgttggccaggatggtcttgatctcctgacctcatgatctgcctgcctcagcctcccaaagtgttgggattacaggcgtgagccactgtgcccagcctatttttttttttttttttgagacaagttctcactgtgtcacccaggagtaaagtggtgccatctcagctcactgcagccttgatctcccaggctcaattgatcctcccacctcagcctcccaagtagcggggaccacaagtgcacaccactaggcccatctaatttttgtattttttgtagagatggggtttcaccatgttgcccaggctgttctcaaacccctgggcttgagcgacccacccacctcagcctcccaaagtgctgggattataggcatgagcggacatgcccagcctgcacccctctttttagaagggctgcggtcctattggattagggcccacttatatgacctcatttaatcttgattacctccataaagaccctgtctccaaataccatcacatcagaggtgctggggttaggacttcagcatgtggatttgtggggggcataatttgccttgtaccgggaggatatgaagtgttcatgttactctccctgtagccctgagagcatctcccttagagtatcctataaaaggagtcgctgctcactcagttatgggttgttcaccccctcgctcaccccagctctgcagagaactggggatcccatcggccatgctttctgggctggcctctggtcgcagtcagtccctcgctgtggcgcccccccctcccccagctccttcccagggtgatgacccgctgaccccctggggtgcacctgctgcaaagcagcccccttccttggcatctctcagcattctccgtagtgagcctggcctttctgatcttgttagctttttgtcttcctgccgcagatcagagctttggagtaagttttgata

SEQ ID NO: 103 - DNA, 3199 bp, Homo sapiens
aagtcagtgggaaataaattttggtatatggctccttttacttacatgcagaggaagttgtaccaattcagattacataatttctactgtgtataatcagtttccagtgcgaaaaggtttaaaattcatatcatatcaccagttctgtatgaatccttaaaatcttaatgggactctaaaaaacaccttacagcatagataagctgtaaacaacattgttctccattgattcatgttcctccttggagtaattccacaattttatgtatccaaaaggccaaaaagttaataagatgaataaagattaatatttattgatactctggtttaaacattctcaaactctatgaggtatataattttattacctatatcttagcaatgaagtaaccaaggtaagaattttaattaaattataaagcataaataaacccccatgctaataatgagtagagtcaggatttgattccaggtagtccaaaaaaagaatgtgtgttctttccaccaagcaatactgtcttaaatattagagacactgaaggtcaaagcagcaccttaaccttttagttgaattatcaattcttgtgtgtgccaacattcaaatttaataaatgcattttattcatctatacgttctcactatttttctctatatggtatttgttacgtatccaaattttttttaaaaaaagcagggccaagtgtggtggctcatgcctgtaatcctagcactttagaaggcccaggcacgtggatcacctgaggtcaggagtccagagaccagcctggccaacatggcgaaacctcgtctctactaaaaatacaaaaattagctgggcgtggtggcccacaactgtaatcccagctactcaggagcctgaggcaggagaaatgcttgaacccgggaggtggaggttgcagtgagcccagatcatgccacttcactccagcctgggcgacagagtaagactctgtctcaaaaaaaaaaaaaaaaaaaaaagaaagaacagtaaagaaggtctcatgtaaatgagaaatgttctctacaatattattttagggggctacaacagcctggcagggtgcttaccaggatatctcgatgcttagcacagtgacttgcccatagtgtagattaaaggtcccaacactaggcttccagtcccaacactgcatctaaatatatgaccttggccattctctggctttactttatttattaaatgagcactttggactaggtaatctctaaggtcatttccatttatttatttatttattttatttattttttatttttgtttttttgagagcttgtctcactctgttgcccaggctggagtgcagtggcacaaactcggctcactgcacctctgcctcctgggttcaagcaattctcctacctcagcctcctgagtagctgagattacaggcacctgccaccatgcctggctaattttctttgtattttagtagagacagggtttcactatgttcgtcaggctggtcttgaactcctgacttcaaatgatctgcctgccttggcctcccaaagtgctgggattacacgcgtgagccactgttcccggtggtcattttcatttctataattagatattatatgcttctaagtgacaagagactaaagacatttccgtactgacctttgtatgtaatcagctgacaccacaatttagaatgtcaaactatcctcatggtattgctgatttgattatggttagaggctgatgtgtctctagtgtgcatagttataattgacactgatgggtataaagcagttcacagggcttagaacagacaaaatttgaatcttctaggttcccttcaatgttcacataaactataaatcatcctaattttggaatctgacagcttcagtaaagccttctggatttcaaagtcatctgtgattccaaaaagagtctctgaatattataccagcctctgtgtaacattctgaaatcccagctctaaataaatcttattgggtgtttggtttaaaggtgaactcaagcaaacctattattgaaaatctggttcctggtgcccagtaccaggttgtaatatacctaaggaaaggccctttgattggaccaccttcagatcctgtgacatttgctattggtaagttgctagccacaagaagaatgactgacctatatattagggtattgacggaggggtgcaatgtgcgagctcaaatcattatcatcgtatttggaaggtccatattagttcatccaatatgctaccttcagagtaataaataacaagaattgtatacttggaaaacattcttaatatttattacttggggaaaaaatcagaggcaaacattcttactttagttttcaatgattatacaacaagagtaaagctgtgtgccgtggcacacacctacagttccagctacttgggaggctgaggtgggaggactgcttgagcccagaagttgtttgttttttttgttttgtttgtctggttttttttttgttttgtttttttttttttttggagacagagtctcgctctgtcacccaggttggaatgcagtggtgcaatctcagttccctgcaacttctgcctcccaggttcaagcaattctcctgcctcagcctcctgagcagctgggactacaggtacatgccaccatgcctggctaattttttgtatttttagtagagacggggtttcaccgtgttagccaggatggtctcgatctgacctcgtgatctgcccaccttggcttcccaaagtgctgggattacaggcatgagccaccacacccagccaagcccagaagttttaatctagccttggtaacatagcaagaccctgtctcaaaaaaaaaaaaagaaaagaaagaaaagaagaaagaaagaacgaacgaaagagagagagagagaaagaaagaaagagagaaaggagaaaaagtgagaaagagagtgagaaagaagagagtgagaaagagagagaaaaagaaaaagagagagaaaggaaagaaagaaaagaaagaaagaaagaaaaagaaaagaaaagatgaaaggagggagggagggaagaaggaagggggagggcagggggagggaggaaggaaggggaggaagcaagaaagggaggaaggaaggaaggaaggaaggaagggagggagggaggtaggtattgtatcagagagtga

SEQ ID NO: 104 - DNA, 1695 bp, Homo sapiens
aagtcagtgggaaataaattttggtatatggctccttttacttacatgcagaggaagttgtaccaattcagattacataatttctactgtgtataatcagtttccagtgcgaaaaggtttaaaattcatatcatatcaccagttctgtatgaatccttaaaatcttaatgggactctaaaaaacaccttacagcatagataagctgtaaacaacattgttctccattgattcatgttcctccttggagtaattccacaattttatgtatccaaaaggccaaaaagttaataagatgaataaagattaatatttattgatactctggtttaaacattctcaaactctatgaggtatataattttattacctatatcttagcaatgaagtaaccaaggtaagaattttaattaaattataaagcataaataaacccccatgctaataatgagtagagtcaggatttgattccaggtagtccaaaaaaagaatgtgtgttctttccaccaagcaatactgtcttaaatattagagacactgaaggtcaaagcagcaccttaaccttttagttgaattatcaattcttgtgtgtgccaacattcaaatttaataaatgcattttattcatctatacgttctcactatttttctctatatggtatttgttacgtatccaaattttttttaaaaaaagcagggccaagtgtggtggctcatgcctgtaatcctagcactttagaaggcccaggcacgtggatcacctgaggtcaggagtccagagaccagcctggccaacatggcgaaacctcgtctctactaaaaatacaaaaattagctgggcgtggtggcccacaactgtaatcccagctactcaggagcctgaggcaggagaaatgcttgaacccgggaggtggaggttgcagtgagcccagatcatgccacttcactccagcctgggcgacagagtaagactctgtctcaaaaaaaaaaaaaaaaaaaaaagaaagaacagtaaagaaggtctcatgtaaatgagaaatgttctctacaatattattttagggggctacaacagcctggcagggtgcttaccaggatatctcgatgcttagcacagtgacttgcccatagtgtagattaaaggtcccaacactaggcttccagtcccaacactgcatctaaatatatgaccttggccattctctggctttactttatttattaaatgagcactttggactaggtaatctctaaggtcatttccatttatttatttatttattttatttattttttatttttgtttttttgagagcttgtctcactctgttgcccaggctggagtgcagtggcacaaactcggctcactgcacctctgcctcctgggttcaagcaattctcctacctcagcctcctgagtagctgagattacaggcacctgccaccatgcctggctaattttctttgtattttagtagagacagggtttcactatgttcgtcaggctggtcttgaactcctgacttcaaatgatctgcctgccttggcctcccaaagtgctgggattacacgcgtgagccactgttcccggtggtcattttcatttctataattagatattatatgcttctaagtgacaagagactaaagacatttccgtactgacctttgtatgtaatcagctgacaccacaattt

SEQ ID NO: 105 - DNA, 8047 bp, Homo sapiens
agaaagagttttactaaatttcaacatgacagaactcaactgacagttttttgggcacgaagtaccaattatccaaaataaactcaatagtccacatgctcatgatctcccagtctaccgggtcaaacatccaaagagcaaatatacttataaagtaattattatatacaataataaattccaaatgaaaaatgacttggaaatactgcaataggagtatgtacgaagcacaacatgctgagaaggagcctgtaggttagccttctggggaagagaagggttagcctaagctcggtactgataactagggtctatcaattaaggcatattatgaggaaacctcagcactagtgaaacccgagagtaaaagccacttccactgcccccttccaggaacagaaaccgaaacataacatcagaaaatttccaatcaccaccccactcccaaatacacgtagagtgattattccagttctctgaactggggagggcgcatctttagcctagacgcccctctgggtgactaatgacaggtgagcacattgaacaaggtgactcctaagacaaggctgtatgtagccaacatcttgagagcaatctgaagttggagattttactacagccaaggagaaaacggagaaaaatacttgagaaatgtgttagctgtgttgttattcttaataaacggtaacgctggtcaacgacctgaacactgcagtgggcccaggtcaagcttgacaacatgtaaattttgccctctctgcccaatgcctctccagggctcccagccccaacgtctctctgattacagccccagtgagacccaccttcgcttcctctagagattgaatggcccctacatcctccaggccttcctgaagctcaaaaatgtccaaggtcccatccttgttatagtccaggtaccaaaagagatctccgtagagggagtccatcgaggatgtctccctcgcagctccgcggcctgagtgagccccagcggggtggaagtgcgaccgacgaacgggatctctgcccaccacacacgtccagtgggaagaggcctaagacagcatcctcctcaggggcgccaaacacaatgcaccttcatcggttaaagctctggaaggagagggctcatcctaacggcttcagcgcaaaggcgcgagcgcgcaggacccgggacctgcgtgggaccgcactctgggctgcgctgggagaccgcggagttcctgcctcactcacgtctgatcagaagccccggctcccactccaggaagagtccagtcggggcaactcaagcccctttccccagaaacttccagggagaacccagcacagggccatctgaaagtatagcttctcttttggagagaagtaggttgggaatgttgggacatgggctattgcagcataagtgactggcggtggcggcctgccaacatttaaaaaaaattgtttggctgcacctgtctaggaatccttctttttaaaaatccttataatgattttttaaaataaaataattttattgtagattcaggggttacaccatcagcttgttacaagggtatactgtgtgatactggggtttgagctcctaatcgtgccatcacccaggttgtgaacaaagtacccagtaggaagctttccagcccttgccctcctccctccctccccccttttggagtccctagtgtctattgttcccatctttatgccccatttacccaaggtttagctccccctgtaaatgagaacacagtatttgtttttctgtttctacaataattcgtttaagttattggcttccagctgcattcatattgctgcaaaggacatgattttgctccttttttatggctgcatagtattccatggtgtgtatgtaccacattttctttatccaatctgctgctgatgggtacctacattgtgttgtaggaatccttttctaaggttgcagcactggagaattgctgtaataaagactaggaattgaatgaaaatctgcccacatgggccctttcttctgtgacacctcccctcacagttttttatcttttatcttcatccaaccactacaatggctccagggcaagcctatccttcagctgttagtggctggattggaaagatgatctcaaaataggcaaaagttcagtgatcttgggtcccagagagaagtcagcagatactcataaatactatctaaggcttcctcttaatcctcaccctccagaaccacagagggccctggcttccccagaccaacacctgtgctccctcatcctgcaccactgggaatatggaggtgcagtttcacaataaaaactctccactttttatgtaatttattttcctaaatatggagattgggtaccctaaaaagttgaatattaaaattcaaaaagaaaatttaatttagccattatctgtaagctcttgctctacactacccatcatgtcagatactggggacaaaaacagaccatcacatgtccttgaaatactcataggtttccctctgggaggaggttgcaccatggttagtcaaaaaaactactgtacgcttctcagtaaacattttcccccagagctgctgagcagtggcaaatgtctaatgctgtttcacaagatgtgctgtggcccaatcaagaatgaattctttcaaaaagagaattttatggtccacagggaatggtccttccctgtgcaacacagaaaatgtaggtagtggcaaagagccacagaaggcagatagccaggcagagaatgagccttgggttagagtctacaggaccaagcagaaaagacagaagtcgtggccagggtgataaggaaaacaggctgacagcatttaacagaattgacaggagagaacaaaccatagagttgagagtttcatctaataaaaggcaggtagttttgttgaatagctctttctgctttttgaaattaccctgttcattatttgcttattattttttattccccatgcacctacacacacacacagacctacttactatagggagggttttgagaatacaatgaagaacgctgtcagtgttgttcaccactatatccccagttcattaaacaatgtctggcactgtttgaaaacattaaatgaatgaatttactatttatgctaagttactgggtaggtcttaccattcctagttaacatttgaggcctccaggcattaaataacatgcccaaggccacagtctagcaagcggtgaaaacatttgaaccctgttctgattccacagcctataataataactattacatccactaaaacagttaatgtgtagtaaacactatgatccacgtttcagagttaggcttcaaactttctcaacaaatccttttgttttcataaatcctgtcaaatatagataccttggtggactccattcaatccttaaaaagataagatttttgaactcagcagggtcaaaagaagttaagcagtgtattacagaatgttgtcttgtggaagcttcttttgttttttctggaataccgataaagaaagtgggctaggaagattataaaggtgagttggggccttaaacaatgggcaatcatataccaggcagagaagggggaatgagagaaatctcaggcagagagaagaaaataaagggatcaatgtacatggctgtggcctagtcagggaatatggcatgttgggagtttggaaaggtgacaaaaggcttagaatgctacaaagatagaaagggtattttataccttactaaagaattcttccatttttttcattctttcagacactttatttctgcagagaaggataacatcaaatttagaatataaatcaggagagaacacaaaagatacagattttatatattttagaacatttgacagaaatgtagttggaattccattgtttttcttataccataatctttctgttgtgatgccctaaaattcaccctgtgatttcatatcatgtcttcttaatattgtgccagaaaccataacatgtctgacaattaaaatattaaggaaatgggctggccatggtagctcatgcctgtaatcttagcactttcagaggcagaggcaggcagatcactagaggccaggaattcaagaccagcctgaccaaaatggcaaaatcccatctctactagaaaatacaaaagttaaccaggtgtggtggcatgtgcctgtaatctcagctgcttgggaggctgaggcacaagaatcgcttgaatccaggaagcagaggctgcagtgagccgagatcgcaccactgcactccagccttggtgatagagcaagattctgtctccagaaaaaaaaaaaaaaagcaatattaatgaaataaaaatgaaatgaaccctctttgttaacagaggaattacttaatggagtgaaatcctgattccactcaatgcaataaacatttgctaagctactattcttctatgtgactattttttctgtgattgtaaatgtaaaaacttaaagacagaattaaaaaaatcatagaatgtaagagttagaatggcccttaaatcaggttaccagtccacccactcctctaacattgggtgatcattcagcatacacttcatacccatgggcacagaggttcctcaagaagttcaccagctagtaaatgggataccacattttaaagggttttttaacatgaactttcatattctgcaacatatgaccttgttaaaagctctgtccaggatgcaggcaagatatctgcattttaagaataagaaagtaaagctccagtaaggctcaaacttgacaaggattacacggtcaatttacaccaaggacggaactctcttgtagcttgctgcttcccttcttgctcttgataattgtcctagtccaactgggctgctatgacaaaaatactattggcttacttaaaaaataagcattgatttcttgcagttccagacactggaagtcctagatcgaagtgctaggagatttactgtctagtgaggacccactttccggttccatggaccactgttttctcactgtgtcctcacatggtggaaggggcaaggaaggtcttccaggtcacttttatacaagcactaatcccattcatgaaggctccacaggaagaaagaagatgggggtagaaggaggaagacaagagggagaaggaggtgcgtaaagagaaaataactgaagacttttaaaaggaaataggattactagacaagtataagagaattagtaatggttaaatactgtatctccttgttctcacactacattctactctcagtctatacccttatactactgagtcctaggagaacttaatgtgaattttctctaatttttaactttaatttttcactaatttcatagtgaggagatttggaacatacagaaaagaaaggtcataccagaaaaaaaaatgtagcgctttcacttccaattggttcttaattttgtctcaggacttgccttgaattcttttctcttccctggataattctggaacacttagtaatggttagctattatattccttatacctatttctacattctactcttatttctacattctttccatctaaaatctaaagaaacttaaacagaaatttgttctcttctaaatgctcaattcattacaaatgcttggaaacacggagatgagatcaaatcagatgaaaatttatagagattttgcttcaagctgagtatttggcttagatacaaactactaccttgaaactttccaccgaagagtcaccccacagttctcatttctatgctcaagtagccaatgtcctcactccttgacattacataaacccctgacatgcctctgaaattttctcccataaaggttgactgtgtaatcctaattctatcccatgtgtgatggttaattttatgtatcaactcgtctggactaagggatgcccagataactggtaaaacatgatttctgggtgtgtctgtgaggatgtctctggaggagggtagcatttgaatcagtaaaccaattaaagaagactgccctcaccaaatgggtaggcataatgcaatcctgtggaggatgtgaatagaaccaaaaggcaaagcaagtgctacgttttgtttgtccccacaaaaactcatgttgaagtctgatccctgatgtggccgtgttgggaggagggacctagcaggaggtgtcagggttacggaggcagatccctcatgaatggcttggtgtcattcttgcagtagtgagtgagttctctctctcatgagactgaattagttccctcagtaatggatcagttccctcgaggctgggttgctataaagccaggacacccctcggattttgcttcttcacacatgtccacttccactttgactttccaccatgttgtgacacagcaggaaagccctccccaggagtccagcagatgccagcaccacgcttcttaaacttcccagcctgcggaactgtgagctaaataaatgtcttttctttataaattaccctgtctcagatattccactatagcaacactaaatggactaagacaggaaatgaaaaggaatttcacctgcagaataggagactttacaaagactgataccctgaatgagcgaggatgtggagaagcaagcactgtcagtcaaaagagtgaaaatgggtctaaggtttccgaaaggcaatacgtatcccagtttaaaatgtgtgttaccttcagactcagcaatgtccactcctcaaaatttatcttacgaaagtaactggaccagaatgagaaaatgaatacaaaggacatccattgcaatttcacttacaatcgtttttaaactatcaataaagtaaaaggtgatttaaaaagaattggtaacatatactatgacacaaacatataacagaatatgatgcagttacgtaaaaatggtgatacagcagcaattctcaagctttttgatctcaggatccctttacaatcttaaaaatcattgagcactccaaagagcttttgtatattgtagggaccatggagttgtaccactgagatctcccttcaaaggcacctactgtgaggaacacagttgacttccactctctagcctctaaccctggcatctgctgatgcactgcagcaaggtcgtccctttcctgggctgcttccagccaatgattggacatggtggggaactccaactgggccatttctgggacaatcagcacaaagtaccaaaagttggttccttcaaagtatgaataaaatacacaaaactttggcaagattgaaggggagaaaaggatagatatgaggaatgaaatagagaacctacctacagattcagtcagaagtgttataaaatcatcggtgagtattatgaaccttggacagaacaggcagtttcaaaaaaaattgtaacttactaaatctgactctagaagaaacagtaaactgaagaggcctataactaccaaagacattaaaagagaagtgaaatataactatataacagttgttggccctcatagtaacctaatcactttccctctttggataagagaatgccagtgtcagggaacgcttcaacagggttggagaagttccacatatctccaccctactaaaggggcagaagttcaggggcacagttaagatgactcagagaaaatgaaattgctcagtcgcaggtcaagtcaacccttcagatcaatttatgtacctagggcattaacctaggaatgtcttaaacaatggaatgccgccattccttctcaacaggaagtgggggaaacacgcgattggttttcaaacagttttcaaacagtagacaatacacatagctgctgtaacaaagcagcttcgaaagagatcgaatgtgtgcgcctttatacaaaacttgggacccactgaagtctgacagctaaaacggattacatgtctgcaaggtattaaaacagaaaacaaagaacctgggatggattcaggacaaaagtgtcttaaaaatttaacagtgcccgtgggccagagtgtcc

SEQ ID NO: 106 - DNA, 8314 bp, Homo sapiens
cagcattccactgacttctttctaactttgtagtaatgataggtaaagactgtatctggcttaaaaaatgcttatttttacatacatgtaggtctttgattatgaaagtaccgaggagttcttttgtttatacagtggcagttgaaagaaaacccatgtatatcttgagaagatttattggaactagctttgagaaatgatgagccatatctttaactcaataaaagatatgtattgctgtaccaagccttggtatctgctattctctttagtgtaagcacttttcaaactataggattatacaaatagtagcatcactagttaaaacataaagctatatgatctaaagacatagttttggttattttttgagccatttaattttcatcttttctgtgaccacatttattaaacatgtgacatgaaaatggaatactcttttatgatgacaaaagaaagtatatgcccagccaattatgggataagagtattattttttgtgaacacattatcatcattctagacacctggagaagtgaatatctctgaaagtatcatacatttatactttaactttatttacatatccagttttcagaaaccattgccaatgaaacatttggacaatgtggtatgcaagtactgtatagtaagaagtagggatgttcttgagtaattgttccatttgaattaatccagcatgggtagttgttagacaaccatgaaatgtgctaagctttacctattctaagaggactctattcttacagaccataagcgttcaaaagttttccaagaaaaaaaggttacttctttaaatttagtctgcccattcaaaagctacaataaggcaggtggattaaactgctaggagttgcaatgttagtattgagagcatttaagcaatttaaaatctttcagaatgcctaagatcacaaatttacccctgatcagcctacacagattaacttaaaatacatacagagagatgtcagatagctagagggtcataaattagtgaccaaaattacatcaatctgcatgttgacattgtttaccttatattgattagaaacttttgcttaggaaaaaggggaaataacttttattttaaattatactttaagttctagggtacatgtacacaacgtgcaggtttgttacatatggatacatgtgccatgttggcgtgccgcacccattaactcatcatttagcattaggtatatctcctaatgctatccctccccctcccccaccccacagcagggatgtgtgatattccccttcctgtgcccatgtgttctcattgttcaactcccacctatgagtgagaacatgtggtgtttggttttttgtccttgggatagtttgctgagaatgatggtttccaatttcatccatgtccctacaaaggacatgcactcatcattttttatggctgcatagtattccatggtgtatatgtgccacattttcttaatccagtctatcattgttggacatttaggttggttccaagtctttgctattgtgaatagtgccacagtaaacatacgtgtgcctttgtctttatagaagcatgatttatgttcctttgggtatatacccagtaatgggatggctgggtcaaatggtatttctagttctagatccctgaggaatcaccacactgacttccacaatggttgaactagtttacagtcccaccaacagtgtaaaagtgttcctatttttccacatcctctccagcacctgttgtttcctaactttttaatgattgccattctaactggtgtgagatggtatctcactgtggttttgatttgcatttctctgatggccagtgatgatgagcattttttcatgtgttttttggctgcataaatgtcttcttttgagaagtgtctgttcatatccttcgcccacttgttgatgcggttgtttttttcttgtaaatttgtttgagttcattgtagattctggatattagccctttgtcagaagagtaggttgcaaaaattttctcccattttgtaggttgcctgttcactctgatggtagtttcttttgctgtgcagaagctctttagtttaattagatcccatttgtcaattttggcttttgctgccattgcttttggtgttttagacacgaagtccttaacagcccatgcctatgtcctgaatggtattgcctaggttttcttctatggtttttatggttttaggtctaacatttaagtctttaatccatcttgaattaatttttgtataaagcgtaaggaagggatccaagttcacctttctacatatggctagccagttttcccagcaccatttattaaatagggaatcctttccccatttcctgtttttctcaggtttgtcaaagttcagatagttgtagatatgcgacattatttctgagggctctgttgtgttccattggtatatatatctgttttggtaccagtaccgtgctgttttggttactgtagcctcgtagtatagtttgaagtcaggtagcgtgatgcctccagctttgttcttttggcttaggattgatttggcaatgcgggctctttttcagttccatatgaactttaaagtagttttttccaattctgtgaagaaagtcattggtagctcgttggggatggcattgaatctataaattaccttgggcagtatggccattttcacgacattgattcttcctacccatgcgcatggaatgttcttccatttgtttgtatcttcttttatttcattgagcagtggtttgtagttcttgaagaggtccttcacatcccttctaagttggattcctaggtattttattctctttgaagcaatggtcaatgggaattcactcatgatttggctctctgtttgtctgttattggtatataggaatgcatgtgatttttacacattgattttgtatcctgagactttgctgaagttgcctatcagcttaaggagattttgggccgagatggtggggttttcgagatatacaatcatgtcatctgcaaacagggacaatttgacttcctcttttcctaattgaataccctttatttccttctcctgcctgattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacgtcccatcaatacctaatttattgagagtttttagcatgaatgggctgttgaattttgccaaaggccttttctgcatctattgagataatcatgtggtttttgtctttggctctgtttatatgctggattacatttattgatttgcgtatgttgaaccagccttccatcccagggatgaagccgacttgattatggtggataagctttttgatgtgctgctggattcagtttgccagtattttattgaggatttttgcatcgatgttcatcagggatattggtctaaaattctctttttttggttgtgtctctgccagactttggtatcaggataatgctggcctcatacaatgagttagggaggattccctctttttctattgattggaatagtttcagaaggaatggtaccagctcctccttgtacctctggtaaaattcggctgtgattgcatctggtcctggactttttttggttggtaggctattaattattgcctcaatttcagagcctgttattggtctattcagagattcaacttcttcctggtttagtgttgggagggtgtatgtgtcaaggaatttatccatttcttctagattttctagtttatttgcatagaggtgtttatagtattctctgattgtagtttgtatttctgtgggatcggtggtgatatcccctttatcattttttattgcatctatttgattcttctctcttttcttctgtattagtcttgctagcggtctatcaattttgttgatctgttcaaaaaagcagcttctggattcattgatttttttgcagggttttttgtgtctctatttccttcagttctgctctgatcttagttatttcttgccttctgctagcttttgaatgtgtttgctcttgcttctctagttcttttattgtgatgttagggtgtcaattttagatctttcctgctttctcttgtgggcattttgtcctataaagttccctctacacactgctttgaatgtgtcccagagattctggtatgttgtgtctttgttcttgttgatttgaaagaatgtctttatttctgccttcatttcattatttacccagtagtcattcaggagcaggttgttcagttgccatgtagttgagcggtgttgagttagtttcttaatcctgagttctagtttgattgcactgtggtctgagagacagtttgttatcatttctgctcttttacatttgctgaagagtgctttacttccaactatgtggtcagttttggaataggtgtggtgtggtgctgaaaagaatgtgtattctgttgatttgggttggagagttctgtagatgtctattaggtccacttggtgcagagctgagttcaattcctggagatccttgttaactttctgtctcgtggatctgtctaatgttaacagtggggtgttaaagtctcccattattattgtgtgggagtctaagtctctttgtaggtctctaaggacttgctttatgaatctgggtgctcctgtattgggtgcatatatatttaggatagttagctcttcttgttgaattgatccctttaccattatgtaatggccttctttgtctctttttatctttgttggtttaaagtctattttatcagagactaggattgcaacccctgcctttttttgttttccgtttgcttggtagatcttcctccatccctttattttgagcctatgtgtgtctctgcacatgagatgggtctgctgaatacagcacactgatgggtcttgactctttatccaatttgccagtctgtgtcttttaattggagtatttagcccatatacatttaaggttagtattgttatgtgtgaatttgatcctgtcgttatgatgttagctggttattttgctcgttagttgatgcagtttcttcctagccttgatggtcttcacaatttggcatgtttttgcagtgactggtactggttgttcctttccatgtttagtgcttccttcaggagctcttgtagggcgggtctggtgatgacaaaatctctcagcatttgcttgtctgtaaaggattttatttctccttcacttatgaagcttagtttggctggatattaaattctgggttgaaaattcttttctttaagaatgttgaatattggcccccaatgtcttctggcttgtgaagtttctgccaagagatcagctgttagtctgatgggcttcccattgtgggtaacccgactttctctctggctgcccttaacattttttccttcatttcaactttggtgaatctgacaattatatgttttggagttgctcttctcgtggagtatgttagtggcgttctctgtatttcctgaatgtgaatgttggcctgccttgctaggctggggaagttctcctggataatatgctgcagagtgttttccaacttagttccattctccctatcactttcaggtacaccaatcagacgtagatttggtcttttcacatagtcccatatttcttggaggctttgttcatttctttttattcttttttctctaaacttctcttctcgcttcatttcattcatttgatctttcatcactgatagcctttcttccagttgattgaatcggctactgaggcttgtgcattcatcacgtagttctcgtgccgtggttttcagctccatcaggtcctttagggacttctctgcattggttattctagttagccattcgtctaattttttttcaaggtttttaacttctttgccatgggttcgaacttcctcctttagcttggagtagtttgatcttctgaagccttcttctctcaactcgtcaaagtcattctccatccagctttgttccattgatggtgaggagctgctttcctttggaggaacagaggtgctctgatttttagagtttccagtttttctgctctgttttttccccatctttgttgttttatctacctttggtctttgatgatggtgacgtacaggtggggttttggtgtggatgtcctttctgtttgttagttttccttctaacagttaggaccctcagctgcaggtctgttggagtttactggaagtccactccagaccctttttgtctgggtatcagcagcagaggctgcagaacagcggatattggtgaacagcaaatgttgctgcctgatcgttcctctggaagttttgtctcagaggagtacccggccgtgtgaggtgtcagtctgcccctacaggggggtgcctcccagttaggctcctcgggggtcagggacccacttgaggaggcattctgtcccttctcagatctccagctgcgtgctgggagaaccactactctcatcaaagctgtcagacagagacatttaagtctggacaggtttctctgccttttgtttggctatgccctgcccctagaggtggagtctacagaggcacgcagggctccttgagctgtggtgggctccacccagttcgagcttccagtccactttctttacctattgaagcctcggcaatggcagcgcccatcccccagcctcgctgcagccttgcagtttgatctcagactgctgtgctagcaatgagcgaggctccgtgggcataggaccctccgagccaggtgcgggatataatctcctggtgtaccatttgctaagaccattggaaaagcgcagtattagggtgggagtgacccgattttccaggtgccggctgtcatccctttctttgactaggaaagggaattccctgaccccttgcacttcccaggtgaggtgatgcctcaccctgcttcggctcatgctcggttcactgcacccactgtcctgcacccactgtccaacactccccagtgagatgaacccggtacctcagttggaaatgcagaaatcacccatcttctgtgtccggaaataacttttaatatgtacagcttgagagaaagaatctttcagaaatgagatagagaaacataataaaagaatccttggtgattttcttaaaaagtaaaaaccgtcactactgagaaaaagacatgttttacaaagacatctgaaaatcataggtattgtggcttatgttttgggatggaaatgaaagatttgatgaaaattaccagagatttttacataaaacagctgattaaagccaaccatcctttttagtgttgcctttatttgaggatgttagggagaattttctcattttgtgtttagtcctgattggcctggatcataagaattatactgtatttagtttgtagtaggacctgctcttctctttaggacctgacacataaatagttttgtgtaaaagtgaacattgtaatttctcttaacagctgtaacatcttatgaagatcttggactctttgcatttggattacctggaaaggtaattttttttcctcctcattgtgtccaaaacccaaagtggcatttttccttttgtttcaagttaaaagagacaagtatatacaagaggaagacattagaggaataaaaggaaactaaagtgagaaaagagagaatgataggagcaggcaaagaaagagaagtctttgtgtccttcctaaaaatgcatcaatacatttaattcaatgcttgaatcttttaatatttttcatcctaataaagtagcacaatgacttgaatgactttaaaagagtaacgatgacctgttttaagttgtattaattttgattatgtactcatatgagtaaaccctcataaagacaagaaaagaaaagcaacatcgaattcaaattgtagcatggctatttacaaaaccagtaatcagaagatcatatcacttaagaattgaacattgctacaagattatctagctatcctctcatttataggtgaggaaattaaggaccagagaaattaagggacctatttgtcaactattatataaagccagtaccacatcctagaactctagatctactgcttttcttactcagaataagagaaataacagcagtatttatggggcacccacttgcaatagggatactacactagtttaatag

SEQ ID NO: 107 - DNA, 1090 bp, Homo sapiens
tctttcagaaatgagatagagaaacataataaaagaatccttggtgattttcttaaaaagtaaaaaccgtcactactgagaaaaagacatgttttacaaagacatctgaaaatcataggtattgtggcttatgttttgggatggaaatgaaagatttgatgaaaattaccagagatttttacataaaacagctgattaaagccaaccatcctttttagtgttgcctttatttgaggatgttagggagaattttctcattttgtgtttagtcctgattggcctggatcataagaattatactgtatttagtttgtagtaggacctgctcttctctttaggacctgacacataaatagttttgtgtaaaagtgaacattgtaatttctcttaacagctgtaacatcttatgaagatcttggactctttgcatttggattacctggaaaggtaattttttttcctcctcattgtgtccaaaacccaaagtggcatttttccttttgtttcaagttaaaagagacaagtatatacaagaggaagacattagaggaataaaaggaaactaaagtgagaaaagagagaatgataggagcaggcaaagaaagagaagtctttgtgtccttcctaaaaatgcatcaatacatttaattcaatgcttgaatcttttaatatttttcatcctaataaagtagcacaatgacttgaatgactttaaaagagtaacgatgacctgttttaagttgtattaattttgattatgtactcatatgagtaaaccctcataaagacaagaaaagaaaagcaacatcgaattcaaattgtagcatggctatttacaaaaccagtaatcagaagatcatatcacttaagaattgaacattgctacaagattatctagctatcctctcatttataggtgaggaaattaaggaccagagaaattaagggacctatttgtcaactattatataaagccagtaccacatcctagaactctagatctactgcttttcttactcagaataagagaaataacagcagtatttatggggcacccacttgcaatagggatactacactagtttaatag

SEQ ID NO: 108 - DNA, 8654 bp, Homo sapiens
gaaataggtggaagattattgagtaatattaagggtccaactgatgttgaaagtcaggcatggcagtaatctgcattcttcagtaatgctctccctcagtcctgaagagcatagacataggattagaaaatgtgggctgagcgcagtggctcatgcctgtaatcccagtactttgggaggccgaggtgggtggatcacttgaggtcaggagttcgagaccagcctgaccaacatggtgaaatcccgtctctactaaaaatacaaaattagctgagcatggtggcaggcacctgtaatcccagctacttgggaggctgaggcaggagaatggcttgaactcgggaggcagaggttgcagtgagacgagatcatgccacttcactccagcttgggcaacaggagtgaaactccatcaaaaaaaaaaaaggaaaggaaaggaaagggaagggaagggaaaggaagggaaaggaaaggaaaaatgtgatcttgactttggaggcctgcccagtgtgttggaaaaatctagggaggaagaagtctaaggtcctagtgaaaagactgaagtgagaagtgatgaacccagggaacgaggtaagttgagggaaggaaaggaggcgagggctgggcgcagtggctcacgcctgtaatcccagcactttgggaggccgaggagggcggatcacaaggtcaggagatcgagaccatcctggctaacatggtgaaaccccgtctttactaaaaatacaaaaaattagccgggcatggtggtgggcacctgcagtcccagctactcgggaggctgaggcaggagaatggcatgaacccaggaggcggagcttgcagtgagccaagatcgcgcggctgcactctagcttgggcacagagcgagactctgtctcacaaaaaaaaaaaagaaagaaaaagaaaggaggcaagaaggagactctttggactgagatactagggcagaaagtgcagccaccaaccaaaaatcttgttggattgaagagctgctgtgaagggaatcaagacatgggtgacatggcaggagtatgggttgtggtcatatagtgggaggacagtttttcacgtgggtttcctggagaggaatcagatgtttctgaccattactagctgtgtgccagcctaggaagttcattcttaagtctttcagaagtggaagaaagcaggaaaattgcttgctaaattacccatgaaagtcaaaaccattcttccttagaacttttgaaagcgaattgtcactaggacatatggggcttgatctggtcaaccatctcatgattttaaattttcatttgggatttttatctacctcttcatagcagagcaaaacaaacttgtctttttcccataaatataattaaaaaagagacaggctgaggatacccaccaatgggtcactctaggccctatcaaagtatgggatcaggatatgaagtaaatcccattaattgctgtaattgatagctccaaaagggagtatggcatacaattagaagttcccaaaagtttgctactcccctggagatgttataaaatagaatcagggttattagcccacattcaagcaaaagcttgtttaaagtggggcattttctaacttcttctggatagactaggcctctcttcacagttttgttaaatttagtgtttcatgaaacttaccaaggcctttaatattatgtacgtgcctttaattataagcacatatttcttctctattgcaagatttctcctgaactttacagatctgtcagtgaaagaggaaacttggataccacatgtggaaataacaaaagtgggatatgaacctcaattaactagcacataaagagtgctgttccctgaaaaaaactgttggattcatttaggtaatcatcgcttgatgaatgtactcttgctagtgtaaccttcttattaccatggagttacaaattaggtctgcaaaagacatctggaaacatctggccccttctaaagcaataacattccagtgtgttttttgacatactatgcagactcttccaataattctggatcttacacattgaaagctctcaagcgaaggtgctagttagatttttttaatgctttatttcccccaaaatagcaatcaaataactggatatacacatttccattttataatcactatcacactgtaatctaattacttgtttaaaagtgtgtctcctcactagattagccccttagagaacaaaacatgtatccatctgtgtaacttccttatgaaactacaggtatgtgctggaactgtatcctctacaaacaagagtactaataggtgagtagctttctttaagaacatttattgcagtattgttaaaatggcagcaaactggaactaaaccaaatgtccatcaagtggggaataattttaaaacttataataaatctatagatagaatattatttggcttaaaaaaaatgagttagagctgcatcagttgacctggagagatgtccatgatatattgctccatgagaaaagcaactaacaaatggaattatagagtgttattccaaattgtaaaagtaaacaatgacggcttgtgaaaaagataggtgtttatgattgtgggagaatattcataatgcactaacaggggttaccttaaggatgatcaggaattaaggtaaatgagtgtgggagaatagtgctagcaaaatgcaaaaatactcatgccataatgctaagggaaaatgcagaatgcatgattttagcaatagtttttttaaaagaaaagtttacctttcggtgtcttactggttgatgccaggcatagttcttaaagctctacatagactgtttcacttcctgcccgcaccaactctgtgaggtagggattattatttctttaatttcacataacagaaaactgtggtccatagaagttactgagctggccagtggtcacacaataattggctaagctaagacaaaataataacaggcaaataggcaaaaaatgaaattgcatttttttcctagaaactaatcagatcaaatgaaaagtatccatttaattaagtaatagacctgtggattattttttgcctcgaatttttgctattatttaatattacttcatttaaataaagtaaaattactaaaaataaatacaataaaatggctagtatggtggttttcaaaacctgtcctcaagtcctttgatgtgggaggtctgtgtttcttccctttgaattaggtggggcctgtgactgatggctctgggcaaccacataggagaagcaacattttgtgcttttggatgctgagtcaaaaaaggtaatacaacttcttcctggcttcctttttgggaagcttgctttggaggatgccagccaccatgaagtgagtctcatacagagaggaactgaggccccagccaacaggcagcatctactgtcagacttcagatggtgccagcctctccctagctttggaatcttctagctgaggccccagaaatcacagagcagagacaaattacgccaactacactttgtctgaatcttcagtgagcataataaatgtctgagtttttgtttgttgttattgttttgtttatgtttggttttgtttgttttgttttgctacaaattacatagcaacagatagctggaagagattctgcagtgatgttcgtcagtttggggtaggttttcccttagttttattcttctgctctctttaggcatattgtggtggttaattttatgtatcaatttggctgggccacagcacccaaatatttggccaaacattattctatatgtttctgtgaaggtgtttttttttatgagattaatatttaaatcagcggactttgagtaaagccgatgacattccatgatgtggatgggccttacccattcagataaaaatcttttttttttttttatactttaagttttaaggtacatgtgcacattgtgcaggttagttacatatgtatacatgtgccatgctggtgcactgcacccactaactcgtcatctaacattaggtatatctcccaatgctatccctcccccctccccccaccccacaacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattctatggtgtgtatgtgctacattttcttaatccagtctatcattgttggacatttgggttggttccaagtccttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttgtgatttgcatttctctgatggccagtgatgatgagcattttttcatgtgttttttgtctgcataaatgtcttcttttgagaagtgtctgttcatgtccttcgcccactttttgatggggttgaatagaacaaggactgacctctccagcaagaaggaattctgccagcagattgaactgcaactcttgcccgatcttcctgcctgccacctacctcatcaggttttggattcaccaagcctccagaatcacataagccaattatgtcaaaacaaacctttgtttgtcatcattgttttgtctgtgttttggtttggtttggtttggatgggctcaagtgatcactcttcctcggagccaatccagttcaattaagttcatttcccattgctacccctctaattttctcaccttgttcagcacacagaagagaaatcttacttctgctatgacaaggctgcctagatttggaaacataaaatggcataacataacctctctctctctctctctctctctctctatatatatatatatatatatacacacacacacacactctctctgaatagcacacatattacacacattatacctttaactctgcttcccaaactactcaccagttgcgcctgcatccaaacctcattgtagtatccaaataaatcacttctgtttaagttattatatatgtgatatatttaagaggtctagaaaagagactaatagtagcatagagtcagtcttctaaacttctttctctctcttaggacaaaaattggaagcaatatgcagccatttccaacaaatgagcagcccacatattagatggcaacatcaaggatagaaaactttaggaagataaaggcctgggaagtagattagctgtggctttcgcctggatgtggcttcatggagttacatatgccactgagaattcccgagtgacaaagtgatcaaatccaggcaaaggaaaaaaggaaaggtgcagcttacccctcgaagcagtgggcaactgtcagaacccacttcttggcaatgaggacacagccacagatatgtccactgggttcactctgcagagaacactgccatggccaccttccagggcgactcgtccgacctccaaggatccttttgttcattcgggcagcagggcggcgcccacagtctaccaaggagcagaagacacagtttgtgagttgatgccaaaccttgctaaatgcttagctctttgctgtcacttacaagcgatcactcttcccctgagccaatccagttcaattaagttcatatcccattgccacacctctaattctctcaccttgtttagtacacagaagagaaattttacttctgctctcacaagactgcctggatttggaaacataaaatggtataacattaagttacatatttcttgttcaattcaaacactttaccagtgaaatacaagacagctccaactgttaccaccagaaatcacattctctgagcatttcctgtgttaccacaggaaagcacattcctcttggtgcaggaattctcaaggcaggagtgtggtcagatattaatcatgttgtaggcaggagtatatggaatatatatacttctttttttagtttatttaatgtcatcataatttaatttcacatttgtgggaaaagaaactattttaacaaaatttcccacatcattttggctggtggaaccaccacaatgcaaattcaaactacagttctcaaggggagatgggagtactttttagagtcagtggtgaggaggcagcatgtcagatttttatgcttatacaaagtggtgtgtgctcaaaacaagttgagaaatactccaagatgagtaaaatatgacttcagaaatttgaagaacagattaagaaatggaatatttagactggaaaggagtcttaccaagactctcaaggttaaatttctgctatatgagaagttgacaagaggaaaagtagcttaaatttgcttcatataactttagacgacatgatcagaactagtaggtgcaatttacaagaattgtgggttcaggaaaagaattttctaaaatctaaattcaactttgaatgcaagaacatggtccctgttaaaggatctttcaatgtgatggcacaagataattcagtttggggtagaaattttaatcactaagttctcttccaaccatgaaacatttacattacaacctcaatgtaaatgaaaaaggacaataaaaatccatattgggactttcaaaaatactatgatgtacttagaatcctagatctatcagattgaaaaaaaaaaatgcaaccctaaatatataatttccacattcctttctgaagatttactgtattttcatttcttgctaaatttatgtaggggcaagtgcaattatttgcatacaataaattatgtaatacaggaaaagctcatttgctttctaccctcccacagtctaaaatcctctcttccttactctctattacattattctaaatttatttgcagcacttaccaaagcctaaaattatttttactaatttataatctttattttcacccccatatagtgtatgttccctgagatgagggccttcatttcccctcattcacttctacatcccctcaaagcctaatactgaacttggcattaaagaaatacttaataattagttgttatttgttagattgaaaacacatagctcttaggaataggaaaagtcatcaaagactattcatccaacttcttagtggaaattgcagttatataagataacacttgtagttagtaaaccaggactagaaccaagtttaccaactcccaatctagaatgcattatttatttatttatttacttgacctgaaaggttttttctggaattacaggtttggggaaacaaatcacttggttaaaagatttaggtcattgttttagaggaagtacttcaattgacaaatattcagaaatttggctgcagagtttgttttatgaggaaaatgtcaagaactttttaagaggaaatggtccatttttagttttcctctttaaaattcttaagaagtagcaacatttatgagcttcagagtcagatatatttatttagagttcagacactatcacttagcatctgtgggctgtgagatttgagcaagttatttaaatattcaagctgtaaaatattggataatcatccatggttcacaaatctattatgaggtttaaacgagtcagtgtatataagattacctagctgtgtgcctataaagtaataagaacttagtaagtgtaaatttcctcaatttatcttcctcctacaccccacccatagacaagggaagcaaccctgtttaagatgcaatgattttttagggtaaacttaagtgtactttcaaggcaacttgattataatttcatttttgtgtctattcctctcttagacattccaagttttcttagttatcattacttcagttccctctgtttactagttctatgtagcatctgcaggaaatgcagacatgagggtttattttgaataagatattaaaagtaatccaagattagaacccaagttcctctctcctcgccatgatagtttctgtaatcgtgaataaaagagaaaaaaaatctatgtctagaaagaagaaataaaagcaaccaatgttgaaatgtaaaggcaatagtaaatctatggaaactctttactgatatgacaaatttggattatcttaagttaaaaaatggaagaaaggcccaatgataaactcttgctctgtaatctgactctacacagctcttatgaatgcattcttacccatttactagaagttcatgtaaagtggtcccattgaggctctcccagttggagtgtaatgtcagccaccgcggctctttctcctgttcctgtatcaatttggtcacagatggttctctgatacaaggcaaatactggataagtattcaaagtacaatgatctttgaa

SEQ ID NO: 109 - DNA, 1149 bp, Homo sapiens
accaaaatggtgcaagaaaagaacatgaggtatttataacagttggtttgaacaagtgcagggaaaagagaagactcccagctgatggatgcttccttttgagtcctgtggccaaaataatttggataacttgtactgttgtagggcaaattcatgcagagttccaatgtaattggttcacattgacctaacaaagaaacatacacacaaatatttttaaatttcacatataaaaacaacttctttaagttttacaaacttgaagtctattttattctttctttagagtagctaagactagaatgccagtagtatataacattttttatggatattgaaaataagtaagttgattagtgaagtgccctggcaactaagattcatttctgtatatgtagttgctagcactgtgacaacatcttgctttagaaagtccttcctcattttttcccttggctcaacttatctaaagatgactctctttcatcattccttttattgactccaattcatcttcttcttctgatttacttattactactaaaataggatagccccatcatcttcactgtcactaaactaattaatgaatttgatcaaataggcaagtagataacttctgtctatatgttttattgttgattaatgtgtttaaatataaggctacaagatttcagggcaagaggaggctcagatctgttgaatacttctcactaataagacaaaatccaaaccccttagcttgaagtctgaggctattttatacttcaaccctaggctaacttttcagcttcattgcctgtgattatccaatcaacagtatctctgctgtaataaattctattcccttatgacaccagatattttaagaattgtatgactttatgcaccctgtttgctcctctcttacctcctcttttataacatgctcataattatctccccaaaggtggtcatggttctagctgccagggccatacggcacctgctgcctggattaaccctttcccatcttccccaacaagctaactcctctgtggtctggaagactcagcacaaatacctcttccaggaaaccttcctggccaaccactcttcccattactacttccagaatgagtcttttgtgagtgcaatagcgtcttaggc

SEQ ID NO: 110 - DNA, 165944 bp, Homo sapiens
tctgacatttcccatttggtttcattgatttatgacttgttttctgtcggaagtaggtattttctttgtattttctttttttctcccttcactcttgccttagaggagtagagagagggtattctggtcagccttcctttttccctttggggatgtgtgtgacacactccctcccctcccaccaacaacccaccctccccaagtggggaccctttgccacgggagatggtcacccatgtccaaagattggccaaccccccaaaagcggttgattagaggctggatatgactcgtggaaggagctgcctttggggcattcccttgaacttctggagctgtgggtgacttgggaatccctgggtccctcgatagatgcctgacatgggacattgctgtcctgcctcggctttgtgcattgggagccactccctttccctcagcctctcaggccctggcgtgccttgatgttagagaatgctgtgggatgttttggttctctctttgaagcgcctttctttctctctgctagatttattactgtagtcggacacactcccagctggcccagtttgtgcatgaggtgaagaagagcccctttggcaaggatgttcggctggtctcccttggctcccggcaggtaaacagtagccagtatttccaccaggggccatcctgctcctttcgccacaactttgtcctgctcgtccaggccttgggagacgctgggtctgtgacaggctgaaccgtgtgaggagcagccccctccctgacctggccggcccagcactggaaggcaaaggagaggtggcggggcaggtccacgtgtgttggtaggatgtcatttagctggcaccatctttttgcctctttctttctcctttgctgcagaacctttgtgtaaatgaagacgtgaaaagcctaggttctgtgcagcttatcaacgaccgctgtgtggacatgcagagaagcaggcacggtagccactgggaccatggtgtagccgcaggtggtctggagagagtgaggcaggggtggcagtgactgaagaccattaagtgtctttcatagaaagaatggcagaggagaccccagttccttcctgagtcccctctccttgggaaaaagtgttcctactctctgggtcagtgtctggtccgaatccttggcttggagatgattttacgggctctttctggagaacagaagtaaaaccttacagtgttccgatgagaccacagtaggcagtacttgggagggtcttatagaccctaccccatggaagtgggtctcaacattacacaaccccctcttgggcccgtggacagttgctgtcctctctgttttctctctttgtgcctgtgccaccctcagagaagaagaaaggagctgaggaggagaagccaaagaggaggaggcaggagaagcaggcagcctgccccttctacaaccacgagcagatgggccttctccgggatgaggccctggcagaggtgaaggacatggagcagctgctggcccttgggaaggaggcccgggcctgtccctattacgggagccgccttgccatccctgcagcccaggtgagggccctgcagggccagaaagccgctcttgactctcactgtggtctaggccatgaggggggtcctcatcacactgtagtttgggggatgccccccaccgtggtcaggttgatggcaccttaacccattctctcctgatgtgtgagttggaggaggcgcgtgggatcccttggggtctccaggcagcagggccagttggcattactggggatggtatttaggagccaggaaagccggtgcattcctagtgaaaccacagggagaggggggatgccaggagctgagaagagtgtgctgcatacatctatttacaaatggctttccaagtgatgctcccaacttccatgcctatgatgtgatggaggatgtcagtgatagaaccattcagttttccagtttttcctttttgtaatatcagtactcttaactggaaagctttccctaacttacacctacctgcagcacgtgagaatactgtcttctctgcctcaacttctcttgatttttaaacagaaggaagaactgctaatgtagcagatcaaaagtagtatctcactgttatttggtgggtgcagtttcactatttccttgctacttctttaatttgagtgactttggaaacgggatatcactagtggaaaattctgtataatccagaaaaaaatgtaaggttttaaaagattcagggaactaagtaaccatttgcacagcagctaaatgctcaccagcatacctgctgagctgtgtgggcactggcagagaaactgaggaaagctgccaggccccatggtgtcccaggccttccctcccgtctgtttgcctttagagcaagattagtgctataggcatttatacacaaataccataatatggcccaaaatctttacaatttttgaatttttaaagtactttgaccatattttgcttttatgttaatagtattccagtgaaattctgtgcatggggacactggagcccagaaaagttaagtgactcatattttctcaccaagcgtgggtgatggagccattcagttttccgatattttattttttatatgagtattcctttaactggaaactttcctaacaacaaacacctaaagatgtgcagagttgcttttatttttgttaccccagctccacgccttaaccctcactttgaaataggatgtatcaaccctattttgcagatgaggaaagcaagagtcagagaggttagacaactcttccagagtcacacagctggggagtagcagctccaggagtagaagctggggccgcttcctggtgcaccgatggtctgcaggtgtttgtggaaactcgggggcctccggggcgaccttgaggacatggacaaggctaagcaggggttcccttcacccagccctgcccttggtttactcaggagtcagaccagccctagtttcctgtgtttcatgtattggcttttcatgtgaaactcgaggagagcttgtccgttgccacaagctgtttttcgaatgtctctacacagtccaggcaggaaatagaagcactcacatcaggagctcagtgtcaggcaggcaaggctcctgcaggggagccccgccctgctcaggtggcctcatctcccctcccagctggtggtgctgccctatcagatgctgctgcatgcggccactcggcaggccgcgggcatccggctgcaggaccaggtggtgatcatcgacgaggcgcacaacctgatcgacaccatcacgggcatgcacagcgtggaggtcagcggctcccaggtgtgtgggcctcccctccccgggccagggcctgctgtgacgtaaagggacttggatggttcctccagacacctgggccaagagttcctccggaggtggggcttgatagagggtgcacgagtcaaggcggtgacctcatcggaggctgaccatggctttccagtgcatcgggggaccccgctatgacagagtgcctcatttccctgcacctcatctgcccccatgctcctgagtccctccagccctggatgccagcagccagttctgtaagccagggagatggcatgtgtgaggcagaagtcccctcaggattggattttgtcattactgaagttgtctggaggggactgaattgaggaatgctcaagatcagcgcaggctcctcctgctgccctatcatgcgccatgcatggcaccaggtgtctctggtcttcacgctgactctgccatgggtgtggtgttcctgttttacattggaaacttggagattcaaagatggtcaagctctgtcctgaggtcatgcagctcatgagtgtggagctggggtgtgcccactggtttctgactgtgaaaacccccacgacatcccaccagctctactgacctgtgcctgggctgaattgaggctgggatgtgatggtggccttgaaccatcactctttgtagactccaggtcttttcccaacccggtggaaacttagcagggagattccatacttgaggaattcagcctcttgctttttctctgacccacagtggacactggaggaaaacttcccttccttcccttttctcttagctcccaccagcctaagggctgtggaaacccgtaccttttgtctgcagccagccccctctcctccctttggtggcttcctgtgtgtccagggccagcatcttctaggtgaatctaagatgtcagtaccttagccctcagctgcttgctcagagcctggtttgtgttctttccccagctctgccaggcccattcccagctgctgcagtacgtggagcgatacgggtgagatgtgaccctctgaggtagtgggacagtcccttggtggccccctgcgtgggcctctgagaggcaggcagcactttggttcccacctctggcccgggctgtggcggggtggagctgcatgccattcatgtcctaggcacatcatggtgtgtgctgcacacagacctggaaggctggggactgaccgctggctctgaggcctggggccgtggccagcctgctctctgggaaaggatttgtagcttgtgacccagtttgagaggcaccgggcagcaaggcttccactggggtgggcggggcgagtcgccatcagggcaccaccacttaatgtccgttggcttcttctcaggaagcgtttgaaggccaagaacctgatgtacctgaagcagatcctgtatttgctggagaaattcgtggctgtgctagggggtgagagcctcgtccccctgctgaccccgggcctgcaaaactcgctgggctgctttttccttggatgcccatcaggacacctcagttctctgtgtttttaagaagggtcggccgggtgcggtggctcacgcctgtaatcccagcacttgggaggccgaggcaggtggttcacctgaggttaggagttttgagaccagcctggccaacatggtgaaatcccatctctactaaaaatacaaaaaaattagctgggagtgttgccgtggcctgtagtcccagctgctccagaggctgagacaagagaattgcttgctcaaacccgggaggcggaggttgcagtgagccgagattgtgccactgcagtccagtctgggcgacagagtgagaatcagtctcaaaaaaaaaaaaaaaaaaaaaaaagaagggtcttggtcattgatttagaaaattcttgttctttgtagcttagttgagttgtctgacttgagctttatttagacccatgggttctttgcccatgttctgaggactttttatttcaggccctgctctggggggatattaaggatacagcatcacatagacacacggtgtttccgtgataggcatagttctgtgggttgttcgaagcacttgcatatgcggttttgtgtgccctgtgagaacgcagtgctggtatttgaatccttgttgatagacgcataaactagagctcggagcaagggctgctcccagcacgggagcctgggatcttctgactccagctcccacgcctctttgcatgaccctgtcacgtccccttcttttatgatggggcacccccttggaaggcgtctgtggaagtggaagctgcagaaagcctgtgggagctcctggcgggagctggtctcgtgttgctgctctgagccaccagctctgctttgcctcaggctcaccagtggcctgggcagctcctctgtgctccggtgccctgcataccttggtctggctgctgtgtcccggcctcctggagaaggggtgaaaaacatgaacttacagggctttgggttccacgtgcaagcacgtgagtcagacatgggaggctcctggacccacctgccctctcagtgggtccgttgcatgctataaacagtgaaaagcaaaacaaagccatttaaatacagatgctcttcttacttgatgtgcagtgtggagggagagaagatagggaagggttgggggtcctgagaaccagcattgtgacctatttccattctcttttttagggaacattaagcaaaatcccaatacacagagtctgtcacagacaggtaagagagttgccctcagagggcccagagctgatctgagccacttccgagcttaaccctgggactgaaacctgaggcttagggtgaagctcccaaggcccttcatgtgtttgttctcagggacggagctgaagaccatcaacgactttctcttccagagccagatcgacaacatcaacctgttcaaggtagaggtttccacctttccacattccacatccaatttccttcctgtcaccacctgtgggtaaagtactatgttaagactgtagaaggaagaaaaagcaaaacagatgtgtaattacttaacccttaacgcaacatgcctgtgagacaaaagtcatcttcttttagagtgaaggccacagggatgagggatgggtgagaaagggacctttcttggtgccccatagaacagatagagactccaggtccttgctctctcactccgtcttctggcacagtctccctcaggcttatggacaggaataggacgttgatttgttctgtgcaacccctgtcacgtcttcccacttgggccttgggtctggttgcagcctcagacctctgctcactccaggtctgtgtacccagcgctccccagatgaaacacggccactgccgcctgaaccccaagctcgtaactcaaatcagcaacagtgactgcccccgggtacagggttctgcctctgttgtaggcggcatgccatgtgctgtgctctgagctaggatatccttttgccccagcaaggaaagcaaacaggcccgtggaggtgacttcaggagggtggcgagcacaggcttcccacaagtgagccaatagcaagtggcagagacagcgtccaaacctggctgcactgacttggggccccacattcttcccatcctgcctgccttttttttcttaaaaccagcttttcccctgaattacacatttgggtcactgtcactgccgccatccctgccagacaggctggatccaggtcatccttgatgcctttctccccttgtctcccacatgcctgtgacagccgccaggcctgacagcctgagacagtcctgccgtccctgcgcttctcccacagctgggacatgggtgcaggcactccttctctcgccttccctttgccctccttgctttccttctcccctcttcttcccatgggtctcgggtctcatcactcaccattgagggaatcctcatcgaaggacgtcgctctttttagaaaccggtttaaaggctccaaactcctcatctctgcatcccaagctaagatctggcaccaaaccacacacattggatgcaccgactgagtggcactgccccagcccctgagcaggtcccagccatcatctcctctgtggctttgctcatagaagttccttttttttttttaactctttgtcacctggaaggaaagccaaggggaactggattttactgagcactcttagacttgagagagacatttggaaagagggtctccaccctgaggaggacactgcgttgtgggcaggggcagtagaggagggggtggcctcggagaggagatgacaaggttggtggcaaggaggctccaggtgcctcagaaggtagcactgcgttgtgctgcctgggtggtagaagtggtgttttttgttttgtttttaagattatagcttgctcagtttgcactcatgcctacagctgggcttggtttttgcaggtgcagcgatactgtgagaagagcatgatcagcagaaaggtaactgctcccatcttgtggtcctgaacaagacccagctgtgccccaaccccctgcccttgccatgctttcctcccctgccctcagggaactccagagtccccttcgtctccactctccttggtgcagtgggccttgctggggtggtgggatgtgtgctgcaggtgtcttgggcctggcagagcctccgatccacccagcctctctctcatggctgtacctcgttcctctccactgctctctctcatcccacccagctctttggattcactgaacggtacggagcagtgttctcatcccgggagcagcccaaactggctgggtttcagcaattcctgcagagcctgcagcccaggacgactgaaggtgaggcaggagggtgggcaggcagagccggctgcacgcatgggcaaggacttctgttcctcatgtgtggacctgaccagagggaggcctcctccccgttctgctctgtgcagctcttgcagcccctgcagacgagagtcaggccagcaccctgcgaccagcttctccactgatgcacatccaaggcttcctggcagctctcactacggccaaccaggacggcagggtcatcctgagccgccaaggtaatcaggtggttcttggccaggttcagttcccaggaaggagccaagctgagcccgggagccgcagcgtgaaaggattctttccttccatcctgggaacttcctgggttaggaggaagcagtgcagtgggcactggcctgctgtgacctgggcaagcagtggaggtggatgggaggagatcgaagggctgggatgggggtcccgtgaccagggtaagcagtggaggtggacgggaggagatcgaggagctgggatgggggtcctctagggcaggggtcctagggaaacttctactgtggggtaggtgggctttggtttgggtcatgattttgtcatctatgagccttgtgatttggactattttctttctcaacttcagtttcttcatatgaaaatggagaggataggccgggcgcggtggctcacgcctataatcccagcactttgggaggctgagggggggcggatcgtgagttcaggagatcgagaccatcctggctaacacagtgaaaccccgtctctactaaaaatacaaaaaattagcagggtgtggtggtgggtgcctgtagtcccagctactcgggaggctgaggcaggaaaattgcttgaacccaggaggcggaggttgcagggagccgagattgagccactgcactccagcctgggcaacagatcgagactccatctcaaaaaaaaaaaaaaaaaaggatggagaggacagtgtggtccacctctgtgggctggttgtcctagagattaaatggtgtttaatttaaagagaaagcactagcacttgtgcctcagacctggactcacctgggggaccccctttgctgggacgacagaagtgtctgttgggcttgcactcacctcccaccgatctgtttttccaggcagcctcagtcagagcaccctgaagtttttgctcctgaatccagctgtgcactttgcccaagtggtgaaggaatgccgggcagtggtcattgcggggggtaccatgcagccggtaaggacacctttcccagcccctcgtgccccaggtgttgggatgagatgggggcttgggagagatgcattatcagtcctgttctctcctggggccccaagccagaaagggtcagctcgagcaggcccagtggtgtccgctgggtgacactgctattctctcactgctgtgccttttaggctgcaggagcagtggagactcctctgctgctccattctgtagccccaggatcacatgtctcccagagaaagctgttctgtggtttcaaactcaaggaaaaaaatcatgattccacttttaaaaggttcattttgatgtatatgaatataatagtctttgtaggcgtaatttttacttatgtgcatagctgttttaaaaacaaaagtacggctccctccatgtgctgtcactggaacttgctcttttcactcagcagccagagggtcataaaccctgtctccttgtcagcaagcatgcacgtatttcagtatcccagctgtgctggattccagttacacagatatatagcatttcatgtagctgcttctctcttgttaggtgtgcaagctatttgcagttttctgttttgagcatgactgtgataaatataaccgcatttctgcacagtggtgactcctacctagcgaagggcctcctggacaaaaagctgctgggaatcctgaagcagtgcttcccagccccagctgccttagcttttgatttttatatttttgtatggatagattcatagttttattcattcggcatattaaaagttgtttacagtaattattgtttctgacgttcacattgtgagagccccttcctgctagctcaggtcctccccgtggcccggtcagtctcgcctccagcacagcagaatgtcatgggatcaccatgggtgtcctttccccacactggattgattcatttctccaagctgctctggtttcttgtaatggggaatgacatttagaagtcaagctgtgggtgctagggtgtttgtcgtgctcctggggcgttttggtagacagatctaggaaatgttttcagaatgaatccatactggtatttctttctttctttctttttttttttttttttttttgagacacagtctcgctctgtctcccaggctggagcgcagtgacctgatcacggctctctgcaacctctgcctccggggttcaagcgattctcatgcctcaacctcctgagtagctgtgattacaggcatgtgccaccacacccagctaatttttgtattttagtagagatggggttttaccatgttggccaggctggtcttgaaatcaggtgatccgccagccttggcatcccaaagagctgggattacaggcatgagccaccacgcctggcccatattggtgtttctaagtaaaaatcaaaggatttgtttacttgaccttttattgtacctctttttctcttaagcctgaacatgtgtgctacattaacatacttatctgctctatcctataatatacttaaaagttttgaaatcatagtaccaatattacttctaacaatagatctgattgaaattgcctttcctctttgcctttagagtgtaacccactaaggatgcctggtcactaggctctaaagtcacgtggaaccaggcttctctccgtgtgcttctgttgtcagtttcatagataactaggctgtttttgtttcattttcttttcaattttagaatttgcttttttcttttctgacttgtagtttttaaatatgtaaatatttgtatggctcaaaagtcaaagcaatataaaaagatctattcaggaaagcctcactctcatccctttccagcccattccccacccccatagggaatccgttttactagcttatcctttcagtctttctttttcccctaaataagcaaaaacgtgtcttcatttttccctttcctgttttatttacacagaaggcatcttagtcagttgtctgaccatcgctcctctagtgggctgcgtggttctctgttggacagatgtagggagcttatccaaccagtaccctctggataggcaggcgcatgattacagggaaaggtccgggggcacatgctgtttggtatttgtgggctgtatcttctcactggactcctaaatatgggattcctgggttaaaaagtataaatatgtttaatttgttaactactgtgaaatttcatgagaattgtaccattctgtatcccaccagtactgtctaggaatgcctgtttctccagagtggttacttttggatttttgccagtctaacaggtgaaagcctggagattcttattcagtagtttgggctggggcctggccatgtgtatttttgaaaattttcgctggtgattttgctgcatggccagggttgataatgactgtgccagatttgctggatttcctttgctgttcctgcacatagtttaaacgagactgccagcactgggtatcagtcaccatttttctttttgttagtttgccatcagccttttctttgacctcttctttcagtttgtgtgtacttgctgtctcttagcccagacttctcgcttcctttctgctgggcctctgaggggtcatggggccgtgacgctgtggccttggtctacaggtgtctgacttccggcagcagctgctggcctgtgccggggtggaagctgagcgcgtggtggagttttcctgtggtgagaagctgtgcccagggtggggcaggctagaggtcaggttctggcccccgttttctgtgggtaatacctcatactgcgaccaggcacaggggcggaggagaccccggggtgggagcctcacccttcgtgcgctcgcccaggctctcctgctttgctccctgctgcctgctgcccagtgtgactggtgatggtgggcgggtgagcgctgtcagtcgctgttcctgtgctggatgatggggcagggaaatgccctctctgcagtgtcttgcagcacacctgcatctccagttttcggcccctccctggctcttaccaggtcacgtgatccctccagacaacatcctgcccctcgtcatctgcagcgggatctccaaccagccgctggaattcacgttccagaaaagagagctgcctcagatggtcagtcccagccagctcgccgcaccacagcctggcctcaggcagcaaagggttttctggggcaggggcgctctggcccaccctgagtgttttcagtgttggggaaattgcacagggacacccgcttagagccacacagaatgagcggcgtcgatctagatgcttatggaggaaggtctgagcttccccgcccctcacgccttaggctgcgaaatatgtattcataaaacctccaggcatcctctgaggacgcctcacacaggagaaagctgctagttccctttggctctcttgccctttggttatatctgcccctgccgggggtagggatgtggggcttgggggcatctcctgtggtgtgcctggggtgtgcagcccctgattgtcgttgtggtgcccatcaggaccctggacagaagaagggaggactcagtgccagggcaatagggaggccccctagggacgctagtgctgtgacatgtgtcagaaaggcgcagtcagcagcagcggctgggtgtgtttggtgggaggtggcacctaccaccccgtggttcccacccaggggagccaagtcctcttccttggctgtagtcctgccgagggtctctcctcagttttgagtctcaaggtgaagacgcggtttgtgggtggctgaggggttgctccatgggggctccctccctccctcctttccttccttagatggacgaggtgggtcgcattctctgtaacctgtgcggtgtggttcctggaggggtggtctgtttcttcccctcctacgagtacctgcgccaggtccatgcccactgggagaagggtggcctgctgggccgtctggctgccaggaagaaggtgagtggcctgtcggcagccttcccacttgtgaggacagtgccactgagtcctcctgggagctctcgtgctcatcgggtcaggacaggcttctggctcctcatccccaccgctcccagtccctgactacagaggatttcccccaaagtccctggctgtgaggttctccagtcccctggccagaaaacacaaggccacgagcagactcgagacctggcaccctgaacctgtctctgggaaatgtcctctgtctttctcagatattccaggaacctaagagcgcacaccaggtggagcaggtgctgctggcatattccaggtgcatccaggtgcgggcgtcatgctgggcttgggtctgagatcgtgtgggggtggcagctggaaacgttgtgggtgtcatccaagttttggctcagcaactcagcgtctgggtttctcctacaggcctgtggccaggagagaggccaggtgacaggggccctgctcctctctgtggttggaggaaagatgagtgaagggatcaacttctctgacaacctaggccggtaagtagtggttctgctcgtctcctgggccgtgatacatggccggccctcactcccagcagctgggcccctgcctgctctctgctgccattagagcccacagctgggctgcgactgctcagaccagccagctggagggaggggctcagcagctctgggtttggtcctgggagagcagttggattttaggctacccattgctgtatcaggacccagtcaattggcctagacgggatctctcagccgaacaagccctctccaggtggtaggtacagagtggagagaggctgagttttgatcacagtcggagaggctgagggaaggggtagaacggagcagctggtgacgtgggtgatgacccgggaggtcctgacgtccacctgctgggctcttgtctcccccgcccaggtgtgtggtgatggtgggcatgcccttccccaacatcaggtctgcagagctgcaggagaagatggcctacttggatcaaaccctcgtgagtgaccccagtgtcacagagggtgacaggagagtaggcagtgggtgggagtggcatcacccccagggctgatacagccaggccttccccgctgcgctggcgtctcctgccccctccggaagcttggatgcccctccacaccctcttgatcttccctgtgatgtcacctggacccctgctgctggcattggccacgaagcctcctggtctggctccaaagcctggcagggtcttttcccagggggagctgcaggcagggaacagtcctgatgggtcttccccttcactcccagcccagagcccccggccaggcacccccagggaaggctctggtggagaacctgtgcatgaaggccgtcaaccagtccataggtgagcctggctgcctccagctgggtggacagatgggggctggagaaagggagaacaggaaagaggggttgcctgccctgtttcctatataagtctgaggaaggggagggggtcgccgtgggaatgtgctgtaggggggaggcaggtgttgctcggagccccagcctctgttcctatgcaggcagggccatcaggcaccagaaggattttgccagcgtagtgctcctggaccagcgatatgcccggccccctgtcctggccaagctgccggcctggatccgagcccgtgtggaggtcaaagctacctttggccccgccattgctgctgtgcagaaggtcagtcctacctttttctttctgagagcctccccaccccgagatcacatttctcactgccttctgtctgcccagtttcaccgggagaagtcggcctcttcctgatgggcaaccacaccactgcctggcgccgtgcccttcctttgtcctgcccgctggagacagtgtttgtcgtgggcgtggtctgcggggatcctgttacaaaggtgaaacccaggaggagagtgtggagtccagagtgctgccaggacccaggcacaggcgttagctcccgtaggagaaaatgggggaatcctgaatgaacagtgggtcctggctgtccttggggcgttccagggcagctcccctcctggaatagaatctttctttccatcctgcatggctgagagccaggcttccttcctggtctccgcaggaggctgtggcagctgtggcatccactgtggcatctccgtcctgcccaccttcttaagaggcgagatggagcaggcccatctgcctctgccctttctagccaaggttatagctgccctggactgctcactctctggtctcaatttaaaatgatccatggccacagggctcctgcccaggggcttgtcaccttcccctcctccttcctgagtcactccttcagtagaaggccctgctccctatcctgtcccacagccctgcctggatttgtatccttggcttcgtgccagttcctccaagtctatggcacctccctccctctcaaccacttgagcaaactccaagacaccttctaccccaacaccagcaattatgccaagggccgttaggctctcaacatgactatagagaccccgtgtcatcacggagacctttgttcctgtgggaaaatatccctcccacctgcaacagctgcccctgctgactgcgcctgtcttctccctctgaccccagagaaaggggctgtggtcagctgggatcttctgccaccatcagggacaaacgggggcaggaggaaagtcactgatgcccagatgtttgcatcctgcacagctataggtccttaaataaaagtgtgctgttggtttctgctgagttttttattgatatgtgctgctgttttctctggaagcctctttagggaatcgaggagcgcactggtgcaggggctgggtggagccatcctccgatggagcacaggcagacggaagcccccaccccagctgcgtggcctcaagccagcctcccgctccccgaaggtggtctccacacagacctgggacagtttcatccccgccccttccagggcagcagggctgaggatcccattctggctgtgtccacgtccgggccatggctagagtctgggtttaggggaggaaggcatggcggcgcccgctaggatttccagttgtcctcttcttcctctgcctgtggctgctgggggttagcagagacggtttgttgtctgacatacgggctctctcctcccggcccctcaccagccccagaggtgaaaaggctggaggggaaagggtgagtgagggaggtctgtggggagcactggtttccccaggccccagagacttaaacacaggaagaaaaaggcaagagagaattaacgatgccacagcccatggcagacagcggccctgcctcctacccttgcgtctcaggaccagcttgttgaagagatcccacatcagttccctgccttggcttacggctctcactgcaataggaaagccacggagtggggtgtggggttcagtcacatttgacccccggctccgtgttcctgtcccctgtagtgtttttgttattagacccttttttctccttggtttaggaatgggggccccagggccacccttgtccaggctccctctaccgtagaggtgagaattccagggagctacaatttgaaaaccactattttatgagccaagtagaacaagaaatgacaactattaaaaaaaataagggatttctgaccagctaacaaccccacagaaaatccgccagggatccagaaatgagactgaggtggcctcagagagctccctcctgaaggggatgctgctgctgtcgtcctgcccggcgccttggactgcagtggccggggcctggggtggggatgagggtgcactgaccagcaccgcagcagctgggggaggttggggtgctgttaacgtgccatcttataggtaggaagtggaaatgggagaaagtgtggggtgcctagggaaggaggtgactgagcagggagcctggctgccatcctaacacccagctcactgggcttgagcgacttgagcctggtgccagggcagagtgggtgatgctggggcccaggctggcaccatacttgaggtctgccaggcaggtcaggtaggatggcacatcgaccttgggggacttggcccaggtctggcatgtagaagtagttctctgggacccatgggattaggtggggacatgtgagaggtgacagggacctgcaggagcagctagcgagacctcatgtgcaccctgcacagctgtggtggcataagggattcaatagagcctctcctagagaggagcctggcagggcccccagcccttgcacctgcccctccctctccaccttctgctccagctgctctctcactgatggacaaggggcactgaacagtttatctgtctctacccccagcatcacatgggtctttgttacagcaccagccagtccgtctgggaagacagacttcttgtatctacaggggcgacgtggaggtcaggcaagccggcacctgctgtcctgggaccatgttcctgacctacctctcccatgtcatcagggacactgcactgaggggtcccaggccactgagccaagccaccctggtcaccttctggctcccacctctgtgctgcacctgagtgtgatgccctaggaccccattaagtcaggctgagtcttgcacccacaccctgcgactccattttctgctacacaggatctctctgatgttgacgagcagcatggagacctggggagaccccccaagcgcctcctccatgtcatccttgggctccagcttggcgctcacacacacaggaaaggacttcagcttctcctgggagggctgggtggctgaggggtggtggatttcggagttggactagcagctggcctagaggctactggggaggagggagcagggagcacccactcctgatccagattcactgcttccctcgcatctgtcatgaccccaaagaagcagatcctgaacctgggctcttgtctttacctttgttctcttccactctggggtaattaagaatgatttgctggccaggcgcggtggctcatgcctgtaatcccagcactttgggaggctgaggcaggtggatcacaaggtcaggagatcaaaaccatcctggctaacacggtgaaatcctgtctctactaaaaataatacaaaaaaaattagccagtcgtggtggcacacatctgtagtctcagctactcgggaggctgaggcaggaggatggcgtgaacctaggaggcggagtttgcagtgagtggagattgcgccactgcactccagcctgggcgacagagtgagactccgtctcaaaaaagaaaaaaagaatgatttgctaattaattatgcaggcagctgatccagtgctgtgtaaccttgggggccaccagatgccaatcaatcagtagaatgggagagaaggatggaggaagtgaggacaaggggcaaggaggaaggtctgtccacctgtctcttctgtgcaggaggtgtccaagcaggaggagcacgtcacatccccactgaaaaagcccacagaaaatgaaaagcccacatgcttgtccattgctgcaggatgggggcaagtggagggggagaggtgtcggcgctcccaccttactcccagtcatggctgactcctccctttccttcgttcttgttcctaatctgtcaccatgtcctgtcgttttctttgtctcacccaaccctctctgcctgaaaatcccctgacggcagcctcatccctgtcacctcctgactgtagttggtgacagaagaggaggctgcactagtgaaggagcagggactccaggtctggcaacaaccagggatggggccgggtgggggtgacttggaccaggagaggggcctgagtcaggcagtcacatacttcatgctggggtcccccaagtgaagcacatttagcaagatctgaaatacagggaaacagtcttgtttcttcaataaataaattgcaaaggagaaacaattgatgaaaggagaaacctatagatccagaaatactaacaggcaaatcaaacaatcataaggagagactttatttggattttgattcaaacaaactaacaaaaaaatgaaattactggaaatttggagacagtagggtagttggtagtattaaagaatagtagtgtgcgatggttggtatgataatggtattgcaattttgctttttttttaaaagagttcttggctgggcacagtggctcatgcctgtaatcccagcattttgggatgctaaggcgggaggctcatttgaggccaggagttcatgaccagcttagccaacatggcaaaaccccatttctactaaaaaaaaaaaaaaaaaaaaaaaatacaaaaaattagcctgatgtggtggcacacacctgtaatcccagctactcatgcagctgaagtaggagaatcacttgaacccaggaggcggacgttgcagtgaactgagattccgccactgcattccagcatggatgacagagcaagactctgtctcaaaaataaataaataaataaataaataaatcataagttcttatcactgggtatggtgtctcatgcctataatcccagcacatttgggaagcacaatttgggaagaattgaagtctttattaagtatttctacccatggatccatgtatttcttcattgatttaggtcttctgtgattttgtttacagcattttgtacattttcagcatacagatcttatatagacttaatcattttttcagagatagtacaaatgcaattattttaaaatgttgattttctgttagttattgttagtatatacaaatgaaattgagttttgtattttgaacttgtgctacttctggaatgtgtgtgcgtgtgtgtgtgtgtgtgtgtgtgtgtgtgtgtgtgtgtgtgtgtgtgtatgtagtccttggaatacaccataaccaagtgggtttttcctgggaatgcaagactgcttcaatacttgaagatcagtcaatgtaatctgccatagtaataatctaacaagaaaatcaacatgatcacatcaattgatatagaaaaaaaatttacagaattcaacatattttcctattacagattttctgcaaactaggaatagaagcaagcttcttaacctgatgtatggcaccttcaaaaagcctacagcaaacatcttacttagtgatgaaaacctgattgccttccccataagatttgagaaccaggcaaggatgtttactctcatcatcactcctatccaacatggtactggaagtcctagccaatacaataagggaagaaaatgacacaaaataaaggtagtaagattagaaagaaagaaattgtctctattcacaaacaaggtgatttcttttcctttttcttcttttttttttttaagagacagggtccttctctgtcacccaggcttaagtgcgatcatggctcattgtatcctcaaactcctgggcacacacaaacagtcctcctgcctcagcctcccaagtagctaggactaccggtgcatgctgccaagcccagataattttttttattttttggagacacaggtagtctcattctggtttcagctctggaaggggtgaagaacaagtccccagagcccatcctgtccctcgtggatgacatactgagggctcaggaagactctccctcacagcctgccccagtttccaggctgagccacctgagcagctgcttcagaaagcctcttgtgccatagccatgcttaggaaaaagcatatcttccattcaattcaccaagaaacaccaagaaataactggatacaaagaataaaaaatactctgccacactggcagggcaggagggtgaaaattgtgccccctccaaaggtaatgtctataaaaggataactaaggccagcgccaaagtccacctacagaaggcgggtctgtctcaaccccagctgtcagtcactgtgaacttttagaactggggctgaagcttcttccagttgcttgctcagatgtcagtgagaccgctccacaacagataaggggagctgtgtgtcagggaagtcccagccactagcacaagctgcactccaggcagacgtttctgttcttgtgcaaagaacagcgcaatccattcaagttcacaggggcgggtggcacttgaaaatgtcagggtcaacttgcagggcagaagttagcagggaagtaagtcttcctgggggagtgggagagcccagcagagtttaggaggagggaggggcaacatcggggcaatcctctgagtctctctttcctcctcaggaactgtccaggaagaccctgcagtctctctgcaggctcatgggagctcccagaactgagacaacacacagatccaggcctgcttcgaagtcagtgggatgcggcccttgaaagtcgatgtattgggttcctagggctcttgtgaaaacatgccacacctggctggttttaaacaacaggagtttattctgtcagttgagaaggctagaagtgcaaaatcaaggtattgacgggatgagttccaactagaggctgtgaggcagatcaactccatggctctctcctggcttctgctggtttctggcaaccattcacttcccatgcctggtagacacatcactctaacctctgcctccctttttcacgggcacattcgcgtgtgtgtgtgtgtgtgtgtgtgtgtgtgtgtgtgtgtggatgtgtgtgttaaggacagcaatcattagactaggtggggcccactctaatccactgtgagcttctcttactttggtaacatatgcaaagacccaatttccaaacaaggtcacattccatgttctgggactgtcttctgtgagatgtctcccccaggatccttccaggttttctgcaaagccaggcagaaaaccaggatcagggcaggacaagaggatgctagcctgtgatggctcccactcaggtgggatgtgagaagtgcctgtggcctgggacacaccaacttgctcccaatacctcatctgagatggattgcacagtgtatgtccagggcccatcccggcacactgtgcctttgcaatgctgtctctgcgctttggaaattgactcagcccactgcgtggggtggtctgaggcgggccacaaccatttcttaaccatccctgagtacctgaccagtatcccccgggggtgacaactggctacatctggagcatgaggagcgtgtttacctggtgagtaaggatgcaagcataggacgtcctggccgatcctctgcacaagcaatgcctttgctccaacgggatgggcaacgttggattaggcctgaggcagatttgatcttggaagatacattcaagtctacgtgttttgtgcgtttattttcgtttccttgaattaacatggagtccatttcaactttcacttagtctccttctttctcttcccccacttctctctctctctttctttgtatatggaagaatttaactctgtgttccataatgtctaaatactcaaatttagagttgacagccatacagcaaattattcaagttgctgtcaaaaaaaaatccctgcgttttctaggattaaaactgtgaatagagtactggaagaaaaaaaagtcatagactcagatgcaaaatgacaacatttaatgggatgataaggaaataagacttgtcaagaaaccatagcccactgcagactgttcacgatgtcagatggttcatgatttttttccaggtttgatacagaagaatcagtttgttaaaagaaatgcttctccacctgggatttaaaacatcatttaaacaataaacacatttgtatgtatatataaatagatatttagaaataaaaacatgcatatataggcacatagacatgtatatacatatacacacatatgtacaaatatatatgcctaaatttttactgacctgtcaacttacaaaacaaaaatgagagatttataaaaggtacatatatagctgtgaattctttaaagctatttttaaagaaattaatataatcttaatgattatcagattactcatgcagtacacagctacacaagtctaatgaagtaccagagacttttctttcttcaactattgtcctatcttattcaggttttcattttcttactagatgtgttttcaatggtttatgacgtaataaaatttctttacttcttccagtaattgctttgtctcactcggaaactgaactactgttgatgtggtaaaaagctagggcatattcttctgaaaaaataaagggaacatgtatttttattaaatagatgatataagcacattagatctaatccttccaataattttgaaatagagacaattactttcccattttatacattatgcagaaatatgctaataatatttaagacacttgatgaaatatattctattagtaaatgatagagacagaattcaaacactccacaaacttcacacagcattcaacaagaaataaatagtaccaaccttccagggaacagttgtatggtctctacaacattttagtatatgttttagaaattaatctatcaaatttttaagttaacatttcagaatattccccactcctctttttaagtcaaagtccacagaagtagcttggaacagtcagtcttagcatgaacaacaatgacaataacaaaaagacctggaagcttagtgtggcttgtatttcaagttcaagtggagccctgtcaggttatattgcaaggattctggtgttgaaaaactctggtaactggaaaatgggttcagtcagaagacacatcatgggataaagaaaccagaacacaaagtaatgccatttattgtttactctgtgaagacagaggttgattttggaaagtttagtagctcagggaatgttagatataaacaccacattcaataaccttagggcatggctgttgcttgcctacctttttcgtactaatcgtagaccatgcctggggctggctgaatgttgaacacaaggttgctctgctcagcagaaaaagtgaaactgtctgctcgaccaaaaacctatcatgacacaaattataattacattgtagcaggtctgagaaaagataatcactgagaaaattatccgcagaagtttatgatctacataattaaatagatctagggtatgattaacttacatattggcaaaataatgagttgttaaccttaaatcatataaaatttcaagttcctttgcttacattgaggtgagaggaatttagctggaagtctcagaggaatgtaggcatttatgtgagtggtaacaatacacatagaaaggatgtctctaaagcgcatgccatagtttggcatttcctcagtaaaataaaaatagaactaccctatgatccagcaatcccatttctgggtatgcatccaaagaaaatgagatgaatattttgaagagacagctgcagtcccatgctaattctttcattaatcacaatagccaacataaggaatcaacctaagcgttcgaaacagatgaatggataatgaaactgaggcatatacacatacaaattattcggccttaaaagaagaaagaatttctgccatttgtaacaacactgaagaacttggaggacattatgtggaatgaaacaaaccagatacacacaaaaaacactgcaggatctcacctgtaagttaaatctaaagttgagttcatagatgcagacagtagaatggcagttatcagggatgggaaaatggggagatgctggtcaaaggatagaaagcttcagctgtgcaggatgaatacattctacaaatctcaggtacagcggtggcctacagttaacaatgctgtactgtatatgtaatattccctaagggagtagatcttaagtgctttgtcacaaaaaaagaagaggtaactgtgtgaagagagggatgtgttagccagctaattcacatatagtcacgctagatgataacaatcagctcactatatatatcaaaacatcacaccacataccttcaatacacaattgtaatttcaaaaaattatggcaaactttgtaagactttagtcaaattataaaataattacatatctactctgtgaccagactgtgtttgatagggagatgatgtttctaaaatggaaagctatctagtcacatagccagggcatatatgaaatagccttggaactagcaaggagaagatgatcagtgggataaaacactggtaatccttaacgtcccttattttttccttttacaaatcctatcatacatatctataagaaattgaagcatccaattatccttggaaggaaaaaagaaaaactttaaagaaaaaaaaatatggctaaacttacattttccaagtagaaaagaacatggtcattcttgacttcagtcttcatcacttggcccttgttttcaagctttgaagaaattgttagggaaggatagagaatagatattagaacaaatgacagcgccactgcagaactgaatgtccactcttttctacgtcacgttctgttttatggaacattccttggtgccatgatgttttcataaacacaggtagcaactaaagaaaaacatatgatgaaccatgggaaatactgactgctaattggtacaaatgaagtacaccagctctccagtgttagcgcaaaaatacaaaggtgaatgttgaagaagaattctatagttttgttttgctaaactacggctaaacaagtatttattttatctttatactctatgtagctgtctttgtgatgaaagattaggcttctattatttacctcttcaatggatgacatggttggagtaaatcctgatagcatttttacatctataaccaccatactggatttattgcgaattccagtgtatctgaaaattttaagaaaacactcgtttagatatcaattttaaaaagtgacttatctcataatgagagtgccaggtggataaatactaattggctagaaatctggaggacaggtaaaagctgaagagaaaatatcggaagaaagtcattttcaagcatctgtgaataggcacaaccagaatgataatgaaagagatgatacatagcaacagaaattggagcaaataatgaattatctggacatgaaatcttccccaaaccctgcttttaagcttacctgcagtctcaaagtttgaactgataaacagagcttctaaatcttttacatatacttaggttagtgttagagttgcgtaacacttagaggacatctttgcttaaaaggtggtatatgagcataattatagagtagatgtgtccccaggagaacttctagctcagtttcctgcttctggataagactattggggtatgaagttaagagttccatagttcatcagggcgtggttgctcacacctgtaatcccagcacttctggaggccaaggtgggtggatcacttgagggtcagagttcaagaccagcctggccaatatggcaaaactctgactctactaaaaatagaaaaattagccagatgtggtggtgcacgcctctaatcccagctactcaggaggctgagccgtaagaatcctttgaacccaggagctggaagttgcagtgagctgagattgtgccactgtgccactgtactgcagcctgggtgacaaagtaagactctgtctcaaaaaaaaaaaaaaaaaaaaaaaaccaaaaaagaaaaagagttccccaattcattgagttcttagccctggagctcaagcgatttttatttagaaattctaaaaaatatctcccaaactaattttactcaatgttttccacatattaactaaggctaaaagcctttagcatctataaatcatgcttgaattcaagaggatcatttcgtttttctattctgaaaagtaaaaatctaaaatgttactctttacagttacaaaataaacatttgtgggcttgctactatatgaccatgcatgcttgtcttgagaaagaaatatagaatctctgtttttcaaaactaggagtacttccatacaacagaataaaaagtatcattgaaacatcagtgcagtgaaagctttcaaatcctgctcacatagactgcatgttttcttgcctcattttagctctgatttagctgaagatgtactaaattgtggtgtccggacagacggctaaaaagtgactgtgctgtagaattgtcaccaccaacatgagaactcattaccatgatttatattttgttatttcactactgtttgaacttttaaaatattttaccatcttgttcacgtgggagttactgtcaaaatatgacacttacttgaggttcactgtgaggtcaaaaacagtcaaagagtagttctttactatttccaaggaaagagaaaatccagatgccttcttaggtaggagaacattgtacttaagggtggcctagaaaggatagcaaattataagaaaacccatcctgtattaagaattatacagtctgactatagtcagtagtaatgtgattttacattttaaaataactaagagtatacttcgatcatttgtaacacaatggataaatgcttgaggtgatgcataccccacttgccctgatgtgattcttacacattgcatgcctgtatcatgcacccggtaaatatttacacctactatgtacccacaaaaattaaaaataaaacatttttaaaaagaaagaacctattgtttatttctattactaatgcagtttacatctttatcatcagggaatcaggttaaattctttagttttcagaataacgtaatttaatgaagatagaatactttctaatagcaatattcctcaaacttctcttagacagctgagtagcttttcataaagtaacttgcaattttggctattgatcatgtaaatacacaaaacggtcaaataacacttcacgtagaactgaacagacagtctgactcttttactggcaaacactcatcaccctcttaggcagatttctgtaacctggataaatgtacaaccgcgtccttccacatctactgtgtattgtccaggtgcctgtgttacttctgaacgttggaccagtaggcggttatgaccgttaaactggatctcactggatccttcactgctaaaggtgacagtgttttgattcttagagaagagcccctcttccccgcctggctcttaggatccccattgcagggcggggaggcacccaccgcgagggggagactgagagccagtccctcccacccccggctcttaggactcgcatcgcaagcgggggaggcacgccacgcgaggcggggactgagagccagccccccttccccccgggcttaggacccccatcgcggttcctaagatccttaggacccacctggaggactgtgggtatggggtgtccaagaagaaagctcagatctgcccacggcaggtaccttacttgggatttacaatcgacaggggtccgaacgcagcccgggaaaagaaagaaagcaggtcatttacaatctaccggagccagcccgtcttcccctcgcttgctcttaggtcccccatcgcagtggggggaggcacccctcgtgaggcgggaactgagagccagccccacctcccccctggctcctgggacccccatcgcagtggagggaggcactccccgcgaggcgaggactgagaaccagcccctcttccctccctggttcttaggacccccatcgcagggacggaggcacccgcagcgaggcggggactgagagcctgcccctcttacccccctggctcttaggacccccatcgcaggagtcggaggcaccccccgcgaggcggggactgagagagagctcctcttcccccccaggatcttaggacccccatcgcggggggggaggcactcccgccaggcgaggactgagagccagccccttttcatcccctggctcttaggacccccatcgcagggggggaggcacacaccgcaaggcgggaactgagagccagccccacttcccccctggctcttgtgacccccatcgctgtgcggggaggcaacccccgcgaagcggggactgagagcctgcctctcttcccccccaggctcttcggacccccatcgcaggcgggggaggcaccccctgcgaggcggggactgagagccagccgctcactccccctgactcttaggacccccattgcaggggggggacgcacacccggagaggcggggactgagagccagcccctcttcccccccaggctcttgagacccccatcgcagggggggggcaacccccacgaggcggggactgagagccagcccctctacccccccatggctcttaggacccccaatgcaggcgcgtggcaccccccgcgaggcggggactgagagccagaacctcttccccccctgtgtcttagaacttccatcgcagcgggggaggcactcctcacgaggcggtgactgagagccagaccctcccacccccggctcttaggacccacatcgtagtggcgggaggcaccacccgagagacggggactgagagccagcccctcttccccccctggcccttgggaccccgatcgcaagggggggaggcaccccccgagaggcggggatcgagagcctgcccctattccccccccttggctcttaggacacccatctcatgggtgggaggcacttccagcgaggcgggcactgagagcccgcccctcttccccccctggctcttaggatccccatcgcaaggggggaagacaccgcccacgagtcggggactgagagccagcccctcttcccccgctggcttaggacccccaccgcggattctaagatccttagcacccacctggaggactgggggttttaggtgtccaagaagaaagctcagacctgccgaccgcaggtaccttacctgggatttactatccgacaggggtccgaacgcagctcgggatcagaaaaaaagcaggtcatttgcaatctaccagagccagcccctcttcccccccttgctcttaggacctccatcgcagcggggcaggcacacaccgcgaggcgggaactgagagccagcccctcccacctctggctcttaggactcacattgcaagtgggggaggcatcctccgcgaggcgcggactgagagccagcccctcttccccccctggctctagggacccccatcgcagggggtggaggcaccccacgcgattcggggactgagagccagcccctctccttccccctgctcttcggacccccatcgcagggcggggaggcacccaccgcgaggcggggactgagagccagcccctctaccccccgtggctcttaggagccccatcgcagggtgggaggccacccggcgaggcgaggattgagagccagcccgtcttccccccttggctcttaggagccccatcgcgggtggggaaggcaccccccgcgaggcagggactgagagccagcctctcttcctcccgtggctcttaggacccccatcgcagtggggggaggcaccccccgcgaggcggggactgagagcaagcccatttcccccccccccggctcttaggacacccaacgcagaggggggaggcaccccctgcgaggcaggaactgagagccagacccacttctccccggctcttgggatccccatcgcggggaggggaggcaccccacacgaggcggggactgagagccagcccctcttccccccctggctattaggacccccatcgcaggggggagaggcaccccccgagaggcagggacggagagcctgcacctcttcccccacgggctcttaggacccccatcgcaggcgcttcgcaccccacgcgaggcgggtactgagagccagctcctctttcccccgtctcttaggactgccatcgcagagggggaggtaacccccgccaggcagggactgacagccagcccctcttcacctctggctcttaggcccccatcgcagagtggggaggcaccacatgcgaggcggggactgcgagccagccccacttcccccctggctcttgggaccaccatcgcagtggggggaggtacaccccgcgaggcggggacggagagtcagcccctcttcccccactggctcttgggaaccccatcgcaagggggagaggcaccctccgcgacgcggggactgagagacagcccctcttccccccctggctctagggacccccatcgcagggggtggaggcaccccacgcgatgcggggactgagagccagcccctctccgccccccccgaccccgcccgggtcttcggacccccatcgcagtggggggaggcaccccatgcgaggcggggtctgacagccaaaccctcttccccctctggctcttatgacccccatagcaaggggggaggcaccccccgcgaggcggggactagagccagcccctcttcccaccctggcttaggacccccatcgcggatcctaagatccttaggacccaactggaggactgtgggtattaggtgcccaagaagaaagctcagatctgccgacgttacttgggatttactatccgacaggtgtccgaacacagctcgagatcagaaagaaagcaggtcatttgcaatctaccggagccagcccctcttcccccgcttgctcttaggacccccatcgcagcagggcagacacacaccccaaggcgggaactgagagccagccccacttcccccctggctcttgggacccccatcgctgtgtggggaggctccccccgcgaagcggggactgagagcctgcccctcttccccccccaggctcttcggacccccatcgcagtgggttggaggcaccccctgagaggcggggactgagagccagcggctctttccccctggctcttaggacccccattgcagggggggggacgcaccccccgcgaggcggggagtgagagccagcccctcttcccccccaggctcttcggacccccatcgcagggggggaggcaccccccgcgaggcggggactgagagccagcccctcttccccccctggctaagacccccatcgcgaatcctaagatccttaggacccacctggaggaccctgggtattaggtgtccaagaagaaagctcagatctgccgaccgcaggtaccttacttgggatttactataccacaggggtccgaacgcagcccgggatcaggaagaaagcaggtcgtttgcaatctaccggagcctaagggcagaaggcaggtgagagaattcttaggagctgtggggttttgtagactgtggatcccaaactttgcagtattagccaagcctttgtatgaggtcacaaagggggcggggaccgggaagctttggaatggggatcccaacaacaggaaggctttcaggagttaaaggaaaaacttctggcagccccagccctggggctaccggatctgacaaagccttttccattgtatgcgtcagagagggaaaagatggcagctggacttttatcccaaactgtggggacctggctgaggccggtggcctaagtctctaaacaagtagacagggtttctacaggatggcccccctgtttgagggccttggcagcaactactctgctagtactagaagcaaataagctgactcttgggcaaaacctgaacataaaggcccccccaaactgtggtgactgagagccagcccctcttccccccctggctcttaggatccgcagtggactcacagcctgtttaccatattgtgagtaatatcatctccccctctggagacctctggagattatgaactgtttcacagacaggtgtacacccttggtgtacagagggtgtacacccgtctgtattgggagtaatatcatcctcttcctccctgaatattaagaacagtatcacaggggtgtttctactccctgcgatatcgcgtgtcatatcctcctctcccacgttgcaattagaaacaatatcagtggtggcatgtccaccttctgtcatattgaaagtaatatcattttcttccctccaggatcgtgggaacaatatcccaggggggtttccactttctgccatatatgtagtcacatcgcccactccgccttggaatattattaaggaccatctaacacgagggtgtatacgtcctgcgatattacgagtaatatcaacttcttggcctctgaatatgaggaagaatatcacagggtgggtgtatacctcgtgctctattatgcggagtcgtatctgtctattacggggagtaatatcattctctccctttcaggatattaataacaatttcacaggctgggtgaacacagccggcgatgctgaaattattatcatcctctccccctcttcccctcctggcccttaggacccccatcgcagggggctgaggcaccccccgcgaggcggggactgagagccagtccctcttacccccctggctcttaggacacccatcgcaggggggggaggcaccccccgcgagggggggactgagagccagcccctcttcccccccggcccttgggacccccatagcgggggggggaggcacacccctcgaggcggggactgagagtcagcccctctacccccccggctcttgggaaccccatcgaagtgtggggaggcaccgcccgcgaggcggggactgagagccagccactcttccccaccggctcttgggatccccaccgcagggggggtaggcaccccccgcgaggcagggactgagagacagcccctcttccccccctggctcttaggacccccatcgcagtgggggaggcaccccccgtgaggtggggattgagagccagcccctcttcccccctggctcttggaacccccatcgcagaggggggaggcaccccccgcgaggcggggactgagagccagcccctcttccccccctggctattacccccatcgtggatcctaagacccttaggacccaagtggaggactgtgggtattaggtgtccaagaagaaagctcagatctaccgatggcaggtaccttacttgggatttactgtccgacaggggtccgaatgcagcccgggatcacaaagaaagcaggtcgtttgcaatctaccagagcctaagggcagaaggcaggtgagagaattcttaggagctgtggggttatgaagacagtggatcccaaactttccagttattagccaagcctttgtatgaggtcacaaagggggcggggaccgggaagctttggaatggggatcccaacaacagcaaggttttcatgagttaaaggaaaaacttctggcagccccagccctggggctacccgatctgacaaaaccttttccattgtatgtgtcagagagagaaaagatggcagctggacttttaacccaaactgtggggccctggctgaggccggaggcctacgtctctaaacaactagacagggtttttaaaggatggcccccctgtttgagggccttggcagcatctaccctgctagtactagaagcaaataagctgactcttgggcaaaacctgaacataaaggccacccatgctgtggtgactgagagccagcccctcttccccccctggctcttaggatccgcggtggactcacagcctgtttaccatattgtgagtaatatcatctccccctctggagattatgaactgtttcacagacgggtgtacaaccttggtgtacagagggtgtacacccgtctgtattgggagtaatatcatcctcttcctccctgaatattaagaacagtatcacaggggtgtttctactccctgcgatatcgcgtgtcgcatcctcctctcccacgttgcaatgagaaacaatatcagtggggccgtgtccaccttctgtcatattgaaagtgatatcattttcttccctccaggatcgtgggaacaatatcccatgggggtgtaccctttctgccatatatgtagtcacatcacccactccgccttggaatattattaaggaccatctaacacgagggtgtatacgtcctgtgatattgggagtaatatcaacttctcggcctctgaatatgaggaagaatatcacagggtgggtgtatacctcgtgctctattatgcggagtcgtatctgtctattatggggagtaatatcattctctccctttcaggatattaataacaatttcacaggctgggtgaacacagccggcgatgctgaaattattatcatcctctccccctcttcccctcctggctctcagtccccgcctcacgggttatgtagcgggttatggcaagaagacaaactgcagtttcctgcacagaacagcacaaacaatgatccaagctcagttacaacacaatattggtcatcatttgaccatggacttcaatatcaacccttagaaaccttcctaaaacaggtcagcaaaacaccaagaagcaatatcctgaatgataggaaaatatccttgcttgtgcaaattgtttccacttaatttttttcaacaaatgttaattatatttttactttctaaaaatttttaataaaatatagcctacttggttaaaaatggtgtcaaagcttttctaaaagttaaggcattacataattcagtggcccctgtggctgccatggataattcttttttttctgttcatcttcaaagaagggaattcagaatcaggaaaagatctttggaaattcattagcatatggttttactccgaaactaagaccaaacacaaagagaaatgcagatttttctcatggaaataaaactgcttttttgcattttcaatttgtttccaagtaaggaaaaacatgtcattgtttctcataccccccatttctcctgttttccttcttttcatttgcttttcccagtgtatagcccacagaactagagcgaaagctttctttttggcccgtatataatttgaacagagtatcatcaggtgtctaatgtaccaccaagagtggtgcttacgacaaaaatgtcctctagacttattctatgttcgctgtgtgaatgaagatactaatggtcataaattcctggaacgggagacctcatttcattcatttctatttagaggcttcctagtagagtgcctcatacacaataactggccaataaataattgttgaggaaataaaataagattaataagataataagaatcttattaccaaagattcttcttctcagaaagggtttgttgtgatagctttactattaatatctcactcgtcatagagttacagcttctgcattaaacatattgctattaatatcaggcctacattaatcacctggttggaagaaaagcctccatgggaattcatctgttgggcaagccactgcacaatcttactagcataggtgaggtcaggaattttccgggaaatgacagccaacagcacatagcaactcttctcagtctgagcagaaggtgcccagggaataaaggatggaaattcttctgtcttgggtttcctttctctttcccagtagatgacattatctgagaaaaaggaagaattttcacatagtctgcataaaagtcatgggttacacataaagaaggatgaaaattccattcccgacctctgtttgtgctgaattgttcccctaaaattatatgttgaagccctaacaccaagtacctcaaaatgtggctgtatttggagataagactttttaaagaggtgattaagttaaaatgaagcttatgggccacaatccaatctgactggtgaccttatgagaagaaaaattttggacacacaaaagggagagcagggctgtgcacacacaaaagatcttgtgaagacaaaggaagaatgtggtcatctgcaggtgaagaaaccactttcaacaccttgaacttagacttctagcctccagaagcatgagaaaataaacttctattgctgcagtcatccagtatgtggtattttatgacagctatagcaaactactacagccttcaatagcaactttctaagtagcaggtgattaagcttccccagcagttttgatagcctatggcttggtcaccaggcttgattcccctgacatcactcatttgagaggaagctagcataaagcaaaagaggaaagtctagaatatgtagcgttcttgaaaggtataaaggccactgataaattccataagagaaacagaaacatactggtcaagagggagctcctatgtgactgcttagaacgcttcctcactgtgctccaagatcacctccattagcaacaatgaataataacgcttacttagttttgtggcagattgatccagggtttggagtaaagattccacttgcttctcttttccagctaaggcaaaagcataagctagaattgcatgattgtagccattagtgacaccactgtccaatgccgcttcaaggcaaaagagtgcgtttcgtagagcaggaaactgttggtcaggaagaagaatcatatattgtaaactgatacccgaacattccatgaacttgttgaacatttaaactaatcattgtttataatatatataatatatcctcaaagtatattttacatacaaatccatttatatacacacatatattttatccttcaaaaatatcattaaaataaatttataatgtcattattagtacctaagcaataattttttttgagatagggtctcgctctgttacccaggctggagtgcagtggcatgatctcagctcactgcaacctccacctcccaggttcaagcgattctcctgcctccatcttccgagtagctgggatcacaggcatgcaccaccaagcccagctaatttttgtatttttagtagagatagggtttcaccatgttggccaggctggtcttgaactcctgacctcaggtaatccacccacctcagcctcccaaagtgcttggattataagcatgaaccaccatgcccggcccaatgaaatttagtaagaaaatggcagtttttatatttgatcagtgatattttagttatgaatgtcttctatgcggcaaagcatccaaatttatcataggcctaagagttttttttttctaatgcctaaaatagaggcttacatttctgaagataattttcagggtatactaatgaccctgacaattcctagcatcttagttcaggaatagattttggaaatctaatctatggattgggaggtggctagggtgagccacacttaagttgaaaatgtttactcacttattgtttagagagaaacagaatactaggccacggctttacttagaacagtggttcttaatctgaaattcatggctgaacttcaggagagatgtgaatgcctgcaattgtgtgaataactcttttttgtgtgcatatgtgtattctccctagggagaaacccaatcctgtttttcaaagctgtctatgaatgaaaaacagtttgaacagcatgaatttaaagggtggtaataaactaaatgttatctcggggtttcatccagtcttagaatctcaagtgactctgactctacagtctattgaatgtgcattcagctgcctgaaatcagaaatgacgggaatccatacagtggaattgagcccagcttcaaagaacatcccaacaacatatgcagtgagtgaaatgtcctcttcatctccaccctgaaaacaaaggaacaatgagtcattcgggacagcagagcacaaaatagcaagtattcttttgaagtaaaactaggtatgaaaaaaatactggaacaaataccattattcataaaaacacccgaacatgtgtagtttttaaattagatggttaataaccatactatctaagcaagaattcattcagactctatgcaataattaaatcataattattaagttgttataacaattaatttcaatcatatttatgtggcctggtgttaagcatgcattctaaggaattcacaggactctatttgtctccgcttggtataaatctgaaaaaagccaacaaagaatttctaatgaggtgaagcagaaagttgccgtgaagattcctggaaattcctggaaaagcaccctaggagatcaccagaatcaagtctcagattcttagagtgtaaaatgagaaactcatttataaatcatgtggtttgcaaactgactgtgcataaaactcccctggggtatttaaatcaaccagtgtctacacagagattctggttcaaaaaacttgggaatacgacagcaaaatgcattttaatgggtgctctagtgactctgatgcaaatagcattcagaatggcatctgggatctactgatcttgtagaagcttcccattttatctatttaagcaaaggacaactcctgtcttcttcagaaaagaaatacttctgagaaaccaagtgtttaagatggaaataacagcatatggtagacactaacatgaggtacgaggactgtcagtacatctaaattacagcaagtgggatcaccattcctcagcagtgtaagctttgatttttcccttgcatttttatttctctcaactcaaaacacacacagacacccacccacacagatatttaattatagagaaaatactaggtaagatcagacaaactgtagcagtaatcagcaatgattcaccagtaatgaatccaataagaagaaagatgtgaagatgttttagaagagaacgtgggaaagtttttgatttttctatgaaggagtaagagctcttctccatcagggtcctcctgttgtaaggaataagtttggaatacattaaaaataccacaaagcaatttgaatacaatttgcatgcaaattaaatatcagagtgtctgttttcattcatattttgaggtggattagatatgcattctgggtttcaagaacaggagtgctgattatgaggaaggatgctgaagaaaagctcagggtatttcaggggccatcagagcatgctaaaatgccatgataggagattttgagcaaccacaggggaaaaaaggaggggaaaggagatagaagatgggctggagatggacaggtatctgcaaagaaaggaagttggaagggagggatttacgtaaatatggacaggaaaagggttggattttgccaaggatatacttcacctcatttgtactttggccccggggcaagcttggcctttgaatttttccttgagagggtcttagaaaaacttgcttcattgaaacaatatgaattactagatattctccccagaactttcttgccattcatggacaggaataaactttccttcctcatacactcacagccccctccctttatacattgactgtctccaaatttatgaaagtttcttttctaggttccctttctctcccctcccttctatttctagtttaatttctgaagaggactgactcgggaaggactagagactgaataaggcagacaagagactcagaaggagtcacatccaggctgtagttaaacatgcacaaagcaggaatggtgctgctgaccaacccaccacaggcccaggactgcagtgcctcagaaggtttcataggcacaggaagaatattcatattccagatcaggaaagccagaggcagggcaaggcaggcaatgcccaggaacaaggaaagcctggtgcttctcctctctcacctcccaggcgtggttgaaaagctggccatcattcttaaagcagccgcttgttttctgttggcttgaaagccagattaaggtctgtttttgaacattttcatcaatgaatacaaattttttcattctctccaatgtcttaaaagtaagagcactgagcctgtaatacaaatcaccaaagcaaaagttagataaagaggaagtgacaatgtcagcaattccacagtttcatcaccattgttccctttgagtaaaggatgcattcaactcatctactgtaaaccatctttattgttagtggccctttcctttgggtcaggaaaatattatgactagcaataagtggaaattagagtaggtaattttcagcatgtttgcacccaaaggtcctgttgtatatagcccattagattatctgcacatggagagagaaatgatgtaattaggtattttgggtccttctaatttcactttcccgaatctatatgggactctgagaagcacagagtaagacgtgccgtgccctcttcggtggagttaaccagcggtgcatgtctaggggctgtcatgaaaggatcagactgctaagcaaatcgtcatgagactgaaggaacattgttgcattagaattggaatcactaaatctttagttttatctatttctcttctgtaaattgactttgaaacccactttgcttctaaatccccactgaactctatcctccttcacctccttgcaagccctcctcaggtaattcctatattatataaaataaaatttttatgtctcaccatatgcttcctttctgattctgctgccaaaacacactataggaaccatcagagtttttgaaagataattgcctttgataacctaaaatagaacattgtaggaaattattttttaacctaagaaagttagaagagaaagaatagtgcagtgcaagccctaggtattggtgttagacacaaatcactaggatgatcatttccatttgaacttctgaaactcaggttctgtattcataagggagaaaaaataactcttactttataggattttgatcacaagataatacacatggatatgtctggctcagtaattgcctcgtcattggtacctactaactattcagtatatttcccctaaggtcattttatttcagtgttatctttctgagaagaaaaaccaaagaagattattttatgctcctggacttttccttaacctcacagttcacaacattggccctctttgtgtatacaaagccaatcacttcactgcaacagaccacagctgagcaaacaaatacagacgttgatagatgaaccactgacaacaactcctaacaaaaacaacaataataacaacaataaacaaggtagcttgcaaaataccagacattaaaaaaaaattaagtgcatagcttgaaaactttgcagctgtaaattatgacgctagctgaccacacagattttgaagtcagacggaaaacagcgctaggactgagagttcctcggttcaggttcacttttctttcaccagactactgcataaaaacagcttatgacatcttggtatgagtaacaattgctttcaaaaattatgggcagaaattacttaaatcttctcaccattagataagagaaagaaagccttagattgaacttcctctgtcagttgctcagtagatttcagatagtccagaacataagtatcagatgctagtagggcagcattctgctctccacctccatagggcatttggagaacaaccagattctgcatggcaagtcctagaatatcccctaaaaacaggaaaagcggaaagctgtattgtttatagttgccatctcagcattaataactatagacaaaagaggcatagtgaaataggtaacatttaaaattgagtctaaatggtggaaacaaagaaagttttatgaagcaatttgaaagaggagacagccatgaagggtgaagttaaactgctatgaaaaatatttctgaaaatctcattaccagagagaggaggaagttaggagaatgcatttgtttgcttgtttgctagttttttttaatcaatcaatcctatgaattacaaagtgtaatccatcccttccaagagatgttcatgttaataacagacaaagaagtttgccttttgtatcaacaacaaaaatttctccttttattgagaaaactcccaacatcattaacaggcaaagtcaattcgattctccaagaggtgaatttcatatttcagattaatgattataaagaacctcttgctttctgaacactagttaccatctacccaagctaaggtttcctgggaatataggtctggaaacggtactgtaatccctttagatcccatcaggaaacatagaggatgatctgatcaataattccctccaattgatagcttaggaaaatctctctattctattattttaaggatttttaaagaccacctcaaccaagattttcaaatcatagtgaaacacaaaatttgatcaacttacccacaacagtgaaaaagcctctggctgacccttctactacatcatttggcaagtccaaaactccctgcttggaggctttggcacctagaatgaaaatactgatttaaaaaatgtgatggcttctttatatcagcagatttgggggataaacatattggaaataagattccattacttatttttattttacaagttgtttattagaggagatgaatttggagttttgacccagtttaggataatagtacattcagaaaatggcatataaatctgtgtgttagattgtggcccccgttcttcactggtttagtgcctgaactatttatgtatgaaaaaatgtaaaaactacactgactgtaacacataaaacaacacacacaaaaggtaaagcttgaagactcagatgaaggagtataatcagatcaccatcaaccaggtaaaataatacccctcatggccataaaaccggagactgaggtgcaggggcagtgatgtatctatgggttattttctcctaagagtacaaaagccaagattatattatgtgctattgggcctcaatcctaatatctcattgtccaatattgtgtgacaaccatatcataagaggagctaagagtacacatgatggaaaaaaaaatagataggagcagaccagcctcagaaagtgaactaaaaaccacctcctgaatattctttttgatggctaaaattataccataaagataaagcatgaaacacaagaatcctccacgagttatttaaagtgaaatcacagggcacatggactcatgtggaaggagaggacatgaactgattcttttggtgaattttatttaggactaatttgactccctaaaagatcctcttaccttctgtacagataaggaaactctgggtcctttccttttcaataccttcaggctgtcaaagaataacacaaacaagcacagaagaatgagtctagatcctctgtccatgaaggaaaagtgattaagcaccagctcacttaagcatggctggtgcaagtttatccctgagagaagatccaactcatcttccccttttgttcatatctggaaggcacgggacatcaccggtacccattttagcctctgcgttctgtagcttggacaggcattatcttgatgtcactgtgggacactctcagctcctctgatcctgtatagcatctccagtaaacaactaaaagtgctttgtggagcagggattgccaagaggcaaatcaagagtgttcctctgacaagtgctgattcttgttgaggatgacgggaactgcatgggagtgtaggacaagtagatttgtctcttgaatttgagaatcagaaaaagagaaggaagagaaataggtgtacaggaaacatcttgactcagaaacaaacaaaaaattgtcaagtctatttcaaatgttaagttttactatcctgggtgaggtattaattaaagaaaggatgaactttatgctgttttaattcatttaaaatggcatgtcttgtgtcaaaagtaaatgttgtcaactaattaagtctcttcaatgagaagatcttttaatacaaaacctcttagatgtctgtttcttttcaggaaaagcttgactgtttgcatatccatacctctactaagaagcttttgaccacagtgtctttccagtttagcttttgctgctccattccttcatttgggcaagcactgctttgtttggactcagcaactacagtgatattcactttacctggaagacattcccaaatataaattaaattgatcattggtcccttctgtaatgagaaatgactagagtctgtgaaccatgtcttgaattggattaaccaaattctatcattaagttaatgcttagaacaaaataacttatttcttctccttcctaggtataatgtggtatcttccatttcacctgttccatgattttcatgattccttacattaaatgataaatttacttaattaaaacttaagaaattttaggaaaagtaacattttacaaagttgtctgagtcaatttcctgatattgattgtttataaaggttacttatgacaatataggctaataatgtcagcgaactagggctcctaacttcccaaaatcaagcaagcatagtaaaatatgatatagtagataggcactggattgaaataatgtcctagcaaggaatccattgtttttaaacttcctgatttcacattatgtaattagaactgatctccagtttccttgcttgtgaaaattacaggattgaaaacaatcattcattctttaaggttattattatttacgtgactatataccaatatacataaccaatatattgttctctttgttgttgttgttgttgttgttgtgttttagtgtttctctgtctcaggaagcttgctatttcactcttaaaactgtgtcttcgacttaatgtcataaaactatacaagttggtacagtattctgtctcaattgccaaggtaggattttgaagatcttgtgcagtagaaatattgagaaacttcaaatctaatagaaaaatagtctgagaacagcatcacaactgagctaaaataatctcatagatatattatttgctgttaaaataatacaatgaatatagtacattaaagaacatttgaatggccattttttaaaagtagtgattaaaagtgtcacgcacatcgtatctagcattccttgtttactagaattttaaactttttccattccatgtattttcaatatttcaataggagacaagtttatttttccatcttgcagatagcataggcactaagacaatattctcagttttttatctcaatccaatcatttagtgattttggtatccccatggcacatctagtaaatttacaaacctgacaattccctcattggtcattgtgatggagcagcaattttcttgaaggtggcctgggttcatgatggtaggtgaaggacccagcgagaagtcaaataattaaggtggcattaatgatagcatggccttcatttgggatatggcatatgccaaacatatagtccatgataggtcatgccagttagcatttatattgtattttaattacattatgctcttgtaaaaatgaatggtggttttgatctacacagcattaacaaccagaaattagattactatagattagaatttctaatggagaatttacaataagaattttaaaaatgtgagggagaaaatcacgtttgtatagacaatataaggaaagtaaatggagacaataaatatgggctggtttttccatgagtgactggtgtagacagatagctgcttacccaatttcttaggtataatagtccagatgtttgttttcctccctccagcttgaataacctcactgccattgattttccaggtattaatatttgcttcataattctgagactcctccacttgaacagaaatctaagaaaacaatcatggcaatgaggatagcactggaacacacatcactatgaaacaccatgctcaatacactgtttaaactgtcactgtgaatgaaagcaattgtatttgtttgaggaatatggacctaagtcttatacctttatagtagcattttgcacttgaggataaagagaatatggaaatattaagaatattttagctttgttagatttttgcctccagatcaaacagaacaacgcacctctacacatgtattcaggtagctgaaggcattgacaatcaaatcaaattgttcattttgaacaaccgaaaagggtgaggcaatttcaataaagaaaggttgggagacttctagagtggttgtagaggaaatgccaaatccaacgtcgccattcacacaaaagccacttgcctcccattgggttatcgtatcaggaatgaggaacgaaagattggcagagcctgaggaactggaagaagaggttatcggtaaaacacattctttgtctgaaccaagaacttaaaattaagtgcagagcaagcagaaaagtattgactgaagctcaaaagtgagttatattgtttggatggggcattagataaaaataatgagagctggatttttataaaatttgagtatagaaaggtcatttttctttaaacgccacttttttttttaattggggcaggttaaatctgtctgcataaaatgaatagaagagaaactcttggtgaagggaaaacaatgctagagaaaaaaataaaataaaatgtatgataagtacatgcaaatcaatgatatatattttacaaatatggtactgttttatatacccaggaataaacctgaagaaagaaaaagaaaatagaaataaagacacataggagagaaaatggttaaaactcactcgacactgacgaggtcccacatccatgtctctgggaagtttgttcttactgtttgaattatagcctgttctacatagtcagcattctcccctctgattccactagctaaaaaaaaaaaggaagaagtaccttattcagaccttggactctgcaaattatagtctatatattatcagggtgtaaggtctccataaaacacctcactttcctgtatcacagtcacttactatgactgttttcctgtatcaccatacattgcctgttcccctacacagtcaggtaccacataatgacactgtgatcaatgacagaccacttagactacagtggtcccataaagttagaatggagctgaaaaattcctaccacttattgacatcaaagccatcataacgttgtagtgcaatgcattggtcatgggtttgtggtaatgctggtgtaaacaaacctactgcactgccagtcctataaaaatatagcagacacaattttgtacagtacataatacttgataatgatgactatgttaccggtttttgtgcttactatactatactgtttactgtttagagtgtactgttcttacttatcaaaaaaattaactgcaaaacagcttcaggcaggtccttcaggagatgttccagaagaaggcattgctatcatagatgatgacagctccatgcatgttattgccccagaagaactttcagcggtacaagatgtggaggtagaagacagtgatattgatgatcctgaccttgtataggcctagattaatgtgtgtgtttgcatcttcgttttaaacaaaaaagtataaaagttaaagaaaatttaaaaataggaaaaagcttatagaataagaatgtaaacaaagaaaatatatttgtaccctgactcactcagagtaacttttaaccttgcaagctccattcatgggaagtgctctatataaaagtataacttttttttatcttgtataccacatgttcactgtgccttttccatgtttagcaatgattagatacacaaatagttatcatcgtggtacaactgcctacagtattcagtatagtcacatgctgcggaggtttgtagcctaggaaaaatgggctgtaccacatagcataggtgtgttgcaggctacagcatctaggtttgcgtaagtacactctatgatgttcgcacaacaatatcacctaacaatgcatttttcagaacaaattctccatcactaagtgaagcatgactgtatttctgacattgtattttatcaataaaaataaactacatctcacatctgaagctaatttcttgttatagccaaaagcatgtctagtctgtcttattctgctttatccaactataggatgtctaattgtagccaaaaacatggcataattcacacataaaattccaaaattgcatcatttatcccaaatacactaaattccacaaagcggtttggtcatcccccaacaaaaaaatgtaagattacctacatgcaattctagacggaacactatgcattggaccataattttctgtttctagataaagcggcttagggagtggcagccttctctccatcacacatacttctggttttcggtaatggagattggtaaagactttgagacccatgttctttaaagaaacaaacaacaaaaatattgttcattcttttcatgcaagaactataaaaggcctattatttatattgcaaagataaatggatcataagtatccatattttctgtgttaacaaaggtctgagaagttacaagtcaacttacctctatttgacttatggaaaatccctaatttagagaaaaaattataatcactatgatttatctagcacttattatgtgctagcatttttctaagtattttccattattctccatttcatcctaagtggaaaatacttatgagatcagcactatcattaccctaattaacatcaaacacacacacacacacacacacacacccggcacactcagtaaattaaagaactggaacctgataaagtctgtctgattcaataccccttttcttacacacttgtgatgttaattatagagattatttcatggaaggctcagcatgtctcattaatggcctagggatatctggagtccacactctcttagcctcttgatttgacaatctttgcataagatttattgtattaattggaggctgtcttatttttttaagtgaggttttgtaattatagctacatgatttattttcagcagaaaattttaaaatcaacaaaattaatatctcctttttataagacaatttctatgtactctattggcagattacagacacgaatctcaaagtataggaagaaaactacataattaagaaaacattaatatgcattatgaatactaaaaattgtgatgaaatattttccaaaatccttagtgatcttaccctgacaatattatagatatctccatccccatagttgcttacaggtgtgtaatataaaccattgtagaacatatccctctgaggaatgcaagggtcttccttgccatcatcaagattgaggccatggtagaaataaccatacggctctatacttggaaccatgttatacacctatgagaaaaaacatttcccaataattttaagcacttcttttaaaattacaaaattggcaaattgtctactgtaccatttattcttgttcttttctttaagagcacggccatcatatttaatccagtattttcacataagctcttcctttcaaaagagcaaaccagttttgttttaggcaactgatgtcatgttcacagaatttctcagcttgggcgcaggatttaagagagaatgtaagaaagcaatgcctgactattgattaatccaaggcccattgtacacacagtcaattataatgctagaatttctaagtctggagaataatcttagctgcctgattttaaatcttcttacataatcttctgaagaaaacataaaatcaacaaagagaacaagtaaggatactcatgactaatatctttaacattactacaatacagagaataccatgatcttcaaattatttcttagtagagaaacaaacaccaaatgccaagagagcttctactgctattgcagagggaaggcttaagagactgcagagaaaaagagagcagaatggcatggagaaatgagaagaaacacacaccaagtcaactccaggtaagagaaagtctagcattgttaaaaatacaaatcatagttttcggactcaacagttcccagtacagcacacagggaaagggcttggactgaatgggcctggaagtggaagcttccaaaaaacatggctaaggggaaataatcagatcacaagaagaggtatgcagatccttggagacagggaatttaaaaaaggaaaggatgtcataggataaaataactccctccaccctcatttccatcaccaacattttaaaaataatgcattttactaaaaaaaaaaaaatagaaagggcgctcttcacctatgaacaccctgcacaaaatatcaagaactagaaaaaatcaactccatacaaagcttctgtaagagaaaataggaaatgcaaaccaaaacacttcagctaatgaaacttctccactaaagtcactaagtaaataaataagtaaacaaagaaaagccatgccaaaataatttaacatgagtgaaatattctcaagcatgtatttgaggtatttaaaaggcaccatgagtcagaaattctattaagaaaatacagaaatggacaaaacccaagaagaaataaaatgaggctttattgaactcaggaaaactagacaaaattatatcataaataaactctaaagtacaaggacatcaagagaaaattgttcagagaaaactttaaaagcagcacagaggaaaaacaacagaacaaaactgaaaaagaatgaattaaaacaggtcacaaagtgattgaattggaaagcaggcaaggaagatccaacaaatgtacagagatttttttagaacaaaaaaaatggaaagaccaatatttacaattataattcaggggaactatctgaaaataaaagaagatttgagtttacatattgcatgactccactgtgtacctggcaaaacttctacagaataacattcttactgaaactgttagattaaagtataaaggggaaaaaaacattcaaggccttcagacatagagataaagtagcccataatggaaaatgaattaaactaatgtcagcactattaaaaggcatattcaaagcaagtcaatagtaaggtagcatttcaaaaaattttaaaatgtataaaccaaagatttaatatacaaatacctgtctttcatttattaaggctttagaaaaaataattctgaatatgaaaatgtcagagaattctatacttatgtgatgtcctgaggactctagtagagaatgcactttttaaaaattgttatttatttatttctgagacagggtctcattctcttgcccaggctgaagctcagtggtatgataatggctcacagcagcctcgatctcccaggctcaagcaatcttcccgccccagcctcctggagaatgagctttatgtaaccaaaagatgactcaggaaattagtaagacttgatgaataggagaaacaatacagaatgtaaacattatatattctgacaaaaaaggaaagatgcaacaataaaatgagagaagagggagagaaaagtggaaactagagattactgactgttgtgtaggtagcagttaagactcaaagattaaaaataactgactagattttttttttttaaatggagtctcgctctgtcgcccaggctggagtgcagtggcgcgatctcggctcactgcaagctctgcctcccaggttcatgccattctcctgcctcagtctcctgagtagctgggactacaggcacccgccaccacgcccagctaattttttaatatttttagtagagacgcggtttcaccgtgttagcgaggatggtctcgatctcctgacctcatgatccacccgccttggcctcccaaagtcctgggattacaggcgtgagccaccgcgcccggccataactgactagatattaaggttaagcaagaaaaaatgagattaggatattaggatattataaaatatgtaaatataaaaataaccactaaaataaaaattcaagctagcctgaatactcaaagaagctttaagcaagataacaacaaacaaacataaaagctaaagaaataaagtagctttaaatacaatacagaatcataagaaaaatagtatgatagagctgaggcctaacacatacatcatatcaatagagtgaatagactttattctcctttagaagacaaagatatgcatatttaaaacaaaacataatgctgtacttcatacaaaaaacaagtgaagtgcatatttcaaaaggtgaaatccaaaggaaaagtaaaggaaaataataagaatgcaaaggctgcaatcctcctgttatcggaaatcgtagaagtaaggccaaaagacatcaaacaagatagagaagaatacttactgctaaaagctgcaattcataataaaggcacaacagttatgattatctatgcagaaactacagaagatgcaagaagaaacagagcactatttgtagggtattttaacacatcactcagcagaagaaggttaaataaattttacaaaataagtaagaatacaaagaatcaaaataatccaacctcatggatagaaaacaaactgataatagagactatatcttctcaacacatgagatatattcgcaaaaactcattatatatttgggcacaaaaatataccggtggaaatattgctggccatgaagatatagaacttgaaatttaaaagaaaactctaaaataaattcctttttatatgaaaattataaagtactccagtaagtaaattttcagtgaaagggttaatacaaacagaaattacggaatttctgaaaaataaaaatggtgcaattgctatgtatcaggatctatgagatacttcaaaagtagaaatcatggaaaaacttataggcttaaaaacacctagcccaataaaataaattaatgaaaatgaagtaaatttctaagtgaaaaagctaaaaataacaacaaaatacagcaccagtaaggaaataataaagataaaaatagaaattaatgtgatggagtagcaaaaaacctcacatcatattacatcacattaataaattaaaattatatgtttttggaaaactcggcaaaataggtaaaccaccaactaatctaacaaggaagaaaaagtagctatctgcttaggaacaaaagaaaaacaacttcttccatgactcagttttcagcctcattttttgtccttttagcatcgtgaattggggtccggagttgtttgtatttttctttcacaatagactgatgtatgtaacctagtctcaaatgattcagaaaaaactgaaatggcataaactctgtgtgtgtgtgtgtgtgtgtgtgtatgtatgtgtgtgtgtgtaggggtggagagagtgagaaagagaaaacaagtacggtgaaatgttcacaaactggtgaatcaggccaagggtctacgggagttctctgtgtaattcttgcacttttaaaaattatttaaaactaaaaactaagcttacatagataatacaaaaaataacataaacttatagaatataaattggaattcactcatttatagaacttcacttgatttatactattaatatagctatcaataataaacaagggcaacctcttttggctctgatatattctgagacccctgaataatgcctctagaattttctttttgaggtcccttgatggtcttttcttgaggcagttttcctaagatattgccacctccaactgtagaaagaatgagcagaagctatttactctgaatccatgaaactctcaagggaaaaaaaaggagtgtgtgtgtgtgtacatatataaacatatatatgtacacacacacacacacacacacatatatatatacatattccttttttttctttgagacagggtctcgctctgtcacccaggatggagtgtagtggcacgatcttggttcactgcaacctctgcccccgccagggctcaagtgatcctcccatgtcaatctcccaagtttctgagatcacaggtgcacaccactgtgccctgctcattttttatattttcgggggagacagagtctcatcatgttgtgcaggctggtctcgacctcgtgagcacaaacgatctgcccgccttggcctcccaaagtgctgggattacaggcgtgagcacagcacatggccatattccatatttatagataaatttatcctttatttgttgatgtcccctcagattctgaaagcttctaactaaaagtatttttgctccctgtaatagaaaacttaaatgtatttatgttttgcattgagaaaaatgttttatataatgatctatagttattcaatattattactgaattctataattttatacttaaaactggacttactacagaatgttgaaagcaaaatacaaaactattttttggtgagatctcaagtttgtaaaatatatatgccttcagaaaagagacttgaaaaattacagcaaaactataaagatgcctaagtgttaggactataaatgattttaaagatttccttctttatgtctttgtatactttgcacaaagtacacaatttaaattagatttaaatatgatcataaatttcaatagttatttatatgtaattgtgttagaaataaacggaaaatatccaacaattgttaagcgaaataaattggatgtgaacttctggaattccaggtctggaaatgtttaagaaaatacaatatccatttatagataataactttacactgaatccaagcatatccttgaacatagagatttcattttattccaagtttccacttctgtgattacacctatgatttttaaaaatcacagttgtaaaattcctaaactgttataattatctatcaaattctgtattgttataagcatgctcttaggatagccaagaaaaatacgtatataatccacgaaggaacaaaggaagaaaacattcaatattttcaacatgttcaagacatcatctgaaggataagacttctggtagtccagagaaacatgaaaaacgaggaagtcagagagcttacactttcagctgacagctgttgttcagatttcagtagaaggacgttcccatccacagccccgagggcacagaataagacaggcgccgcttgaagatagagactagcattggaaccaggtaagccctgctcgttagagaactttatgttaacctaaagtagagaaaaaaaagagatgagagtagagaccattttatgtaaagatgatctgaatacatttaatctctcctgaataaatccttatagatttctatacggtatttcctttgcccactctcaccctcagctttctttgcaggagacccccttcaccacgtgctgccgtctcaggattggcactgctgccaaggatcatgcattgtgtttggtgattctcacatcccctaataattcaattatgccagcactgagtgtaagtttcccacgtgaaggtgatagcagtcaggcgagaagacagcagggagcaaactgttcccacttctcaggccagaaataggagaaacatcaccttgtgtttaaagcacttgtcaacctggaatctgacactgtcagccacaatttccccactggggtgaagggtgtagacaaacaggacggctgcaggagccagatcagcactgatgctgagtgggaacgagaagtttccattccaggctgtgtaaataggagacgaagagatacgatgctgaaagtttcctgaatcactggtacacttagataaaagagaatagctcatggacagaaagagtaaattgggccctgttttcaagacaaataaatcaaataataggaagtacatacacaaataaagaagactgcataatttagataataacaatactgggattttgtacaccacttttcttttttttattttttatttattattattattattctttaagttttagggtacatgtgcacaatgtgcaggttagttacatatgtatacatgtgccatgctggtgcgctgcacccactaactcgtcatctagcattaggtatatctcccaatgctatccctccaccatccccccaccccacaacagtcctcagagtatgatgttccccttcctgtgtccatgtgttctcaccgttcaattcccacctatgagtgagaatatgcggttgtacaccacttttctaatgtactcaatgatctgacaataaaagaaacagtagaactctccttcatcaggacatttagtagcttccctcaggctgtgctaactattcccttcatccacaaattgaaataagtgctcgttcttcttttcactatatatatatacacatacatatatacacacatatatatatacacacacacatatatgtttgactatatataaatatattttcttaatatatataatccccatatatataatgtctatatatccttaacaagaaaaaatgaagttagagcacatattttaaaatgaatacattatgtatacctttgtttctgatttccttttgtccactgagtaagatagctccttttaccatcatctgtgtggaacaaagaaaacataacatgcaatatattatctgatgtcatcatattctcatattgagattaggtaattcattacttaatggtaattctgttccataagatagggtagcttccacaagcaaatattaaaaatagactttgcgtaagttggaaaagagcagagaaagtgactaaaactgattgagattctatcatgtactggaaactttgtgaactatgtgcaatgcactgtgcaaagtggcacataaagctctgaaattgtcaaggctgtccggtttcaaatacgccttcacctgctcattaactttgtgacttaaaacatgatgttttacctgtttgcctctgttccattatctgtaaaatggagatatctataaggctaattaaatgagttaacacatatacaatctttataacagtgcctgacacagaacacttaccctaagaggtaagtcttataatctccaattacactgtacacctgaggaagccaagggttaaagagttcaaacaatccgtccaagatgcactaacttgcatgctaactaggagagggtgggggattcaagttaatgtcttaatttccaggtctgtgtcttatcactcttcaacaggccttagagcagaaggccccagtccccaggctgtgtaccggcaggtacgtatccatggcctgtcaggtactaggccacacagcaggaggtgagcagtgcggtgagcaagcattaccacctgagctcctgtcagatcagcagtggtattagattctcataggagcacaagccctggtgtgaactgcacgtgtgagggatctaggttgtgcgctccttatgagaatctaatgcctaaaaatctgtcactgtctcccatcaccaacagataggaccatctagctgcaggaaaacaagcacagggttcttactgattccacattatggtgagtatgtaataataatagaaataaagtgaacaataaatgtaatatgcttgaatcatcctgaagccatcccaccatccccaccccatctgtggaaaaattgtcttccatgaagccagtccctggtgccacaaaggttgggggctcctccttagaaagacaaaatggacagaaccaagagaataaagtccttttactgcttatcaacataagctttccaccttactttctggcatctgcccaatattttactattacaaagtgtcataaatacttgatatgagttacatttgaatgcttaaacaagtggactctgaacagcaagttcttcaaccttagggaaactttaattgccttagatcgttctatgtgtttgtttgttgttaatggatcgaacagtattcaccagcaaagtgagaaggctgcccttactctggtcaccgtggcatgactgatgcatgatttctaagctgtgctgggctaagcagacgtgcaattgaacaggattccaggaacccactgactgagacttaccaaatagaagaactttacattggaatcatcctcatatgcttcactgtttagggagtaatgcacagtaacaaccttctggtgattacattcaagctgctttggttctggaacaatcttcaggaagctgttcgttcgggagtaaaagcgtgagactaagaagtgagcatccaagtactgaggcgtcaaccagctgggaagatagcagctcttaggtcgaacatatgtggcctgagatgacaaaagaaagtgaagggtcttagtatcatgacatccgaagacagttgttactgagaatggaggcttctcaactctccagagtagggaggaatctcagcttgtggctgacgttttaatgttaagttattggaatcaaaataataatagcactctgctctttgtatacaaaacgtgaccatgaaagattgtgtaaatatttcattagactgatggtgaattgttatgttttttacactttaattgaagccacagaattgggtttcagttctgtttctttcagctacatgtgaacactgacaaattatttaactgcaaaattctgtttaagcagcggaaaataaacagaaagtataggatctcccctatctatgcatgaaatgatctgaggaagaaagtcaaatcatcctcatgagctacttcttgtttcctagaggaaaatattagttgttagcaaatttataacaatcgtgatagacttttagcttcccatccccttgaacaagtattctcatgtattatttagtgaacaagcaaatttataaaataagttacattttaaattttctttaaaatagattctgtatacaagctatcttttgagatattcctaatgtttaacatttctgatatccaaatcctctgtgggatgtctaatggtcttcttctgttctttgatgtcttacttttaggttgaactctggatcaaatatgtctgaagtgtcaatggaaaattgagcttcgccattctcgtccgtagtataatttcctataaattcatcattgagctccagttgcaacaacttgttcaccataggtacattattgggatccgaaaatttaagctgtacaagaaaagaataattaatatgacttaaaacacaaaatgtttacatttttacagagaaatagttttctactcataaatgtgatccctagtcattttcctaaattccaacagacagaaagatgctctattaaatacatagatatataatataaagtatggaaaaaatgatactgttatctattgcttctttcaatctaggacactttctagcacctcagacatagtagtgcttaaaatgtattacaaaagtaggaaaaaagtgaccagaaattttcaaagggcaatctatgatccaagaaaatgaaatggaagcatgtattctttagtcaaacctacagttccaaaataagaaatccctcttctgtagaaagtatccatgttctcaaagtttacagttccaagcaattgagtgataaaaactgaggtcttctcactgatctgcatacctgtaaggaatgatgaacacagcagagtgaaaatatctaagttaccatccacagcaatataaatgtgaccagcttgcccagtgtgaatagcatcatgatattgatcaagtatgcttatatagagcactttacaatggcataatcacaaactcctttttaaataacaagaaataattagtagttaaatctgattttcccactccaaattaaataatctctttctcccttctttctggtttttttttttttttttttttgagactgagtcttgatgtgtcacccaggctggaggctggagtgcaatagtgcaatctcagctcactgcaacctccgcctcccgggttcaagcgattctcctgcctcagcctcccgagtagctgggattacaggcattcaccatcatgcccagctaattttttgtatttttgtagagacagggtttcaccatgctggccaggctgattttgaactcctgacctcaggtgatccacctgccttggcctcccaaagtgctgggattacaggcgtgagccaccgtgcccggcctcttctttcattcttttaacaaatacttattgaacactcactttgtgcaatcttgtaaatttttcagtaataatttttgcacttgcaactattcccagttgtattaaattagaaataatctgaattttgtacttagtgctaactcaacaagcttctcccagtaagttgccatacatatatccccaggtcgtccaaaaaatacagtaatttcctgtcccaaattctgtaacaattacagcgacatgaaatgtcatgaacaatcccgaacggtagagttggaagacttttgtatttacaatttgagaaacacaaccattttccaactgaaaaataaagagaaggtataattaaaatgttagagatccaagaggtttttttaagtgtcttttaaaatatggtttttgcacaaatatattaacatccccaccccgtgccacggctctacctcataaacttgttgaaatggccaaagaattagaggaggagtaggaggaggcgaatatttacatcagcattttaaataacggaaggaggtaatctgtattttacagatttcaaggaaattctcctggaaacattgtagatgagaaaagattaaaggatggaaatgaagctgaatggtattgtgaaaggaaagtaaatctcaggagcccaacatccctaagctaaagggaaagggcaagctgggaacagctgggcaaatctgtctcccattttattcccaaataaggtagctacaaagataaaaactacatacctccctcacaatttgcccacaaggaaattctttgtgggcctcaagaacttttccttaaaacagttctttggaaattcaccctggcaatataaattcatagcttatctttacaggcgtgggacaaaagacagactcagtcatccctctgcttacctgagacaaatacatatctgatttatctgattgcttcctctgcctaatagtttatgtaaaaatgcagatttactgagccacactaaggcaggagtgactattcctctatcctcctctcacatgtaatttgtgtattcagtgaaaggctgatcaaagacaaagacttattcttttttttttttttttttttttttagatagagccttgctctgtcactcgggctggggtgaaatagcccaatcttgactcactgcaacctccgcctcccaggttcaagcgattctcctgcatcagtctctcaagtagctgggattacagacacctgccaccacgcctggctaatttttgtatttttagtagagatggggtttctccacgttggtcaggctggtctcgatctcctgacctcacgtgatctgcccgcctcggcctcccaaagtgctgggattacagctgtgaatcactgcacctggcctcaaagacttcttctttatgcaactgtttgtctcttatctacctatgacctggaaacccccttagtttggattgtcctgcctttctggaccgaaccaatgtacatcttacacatatttgttgatgtctcacatctccctgaaatgtataaaagcaagctgtagcccaaccaccttgggcacatgttggtaggacctctggaggctgtcataggtacatccttcaccttggcaacataagctttgcaaattgattgacatctgtctcagatacttttggttcacagtgttttaagaggaagaaattctaatcatctagaaaggcactaaaacagatggaacagaagcgctcagcacatgtgtaacaacaaaacaaacactttttaaggtatattgcttatttaaaataacaaaaaatctatagttaatctatcatcagtaataataattagagaaatataaatttagttatattttataacacagtgtttattccagatttaaaatgttataaggatatattagtttatttgatactcaaaactattacatgagctaggtactgttattatcttactatatagatgaagaaactaaactaggtccatcatgtaacctgtccaagatctcacagctaagagacggtggtgctgaggagctgctctggctccagagtatgtgcttctctatcttaaattaacagccattacatcaacaacaaaagcaattttattttgtctaatgataatatagtcaaattaaaatgaaatcatagaaagtgatcagaagaaccttaattatttcgaaaataagagaaaagccttttttcaggaatccttgaaacaaagagaatacataaagtaaaccaataagaatccagatattagagtaatgaaaaaatacttcgcatcaaagtcaatggtattcagctgcagttcagaagaaatgtaaaacagtgaatgtgcttattactaaaagaaacagctaatatattttttaaaccccaacaaaatcaactacaaatattaggaaaaagaattaataagatgaaagagaaaataaattatttaggaacacaaaataataaaagaaagaaaatagtaaaaataagaaccaataaaatagacgaaactttcgtgggcatgatttaggacaaagagtgagagagaacaaaattgtgagataggtgctaacacaacacagcccacatctggaagaaaaattcccattttagaacatcattggaagtgaactttatgtctattagaaaattgtaaacaatcttaagagcatacttagatagccacatgtacaacacaggggccagtgagattttttttctaaggctggaaacccaggaacataaggaaggtgggtatgtcaaaaatatgacaaagtaaatgagttgcctatttaaataacaggcttgaaaaaaaatgcttgtaggatggaaggcagtacttacctgaaagtttccatttcacatgaacagaaaaacatgggtaattaagagttctcaaatccaaattgataacaaaaatatgaaaagttgctcaaactaaatcgaaattagatagcacaagttaaaacaagctaaatttgtgtctatcaaaatgacaaaaacttttaaaacttctaaatatattgctgaaagtaatttggaaaatatagtattctcatgtacttctgacaggaatttgaatgcctaaaacttttaggagagcaatatgctaatatttattaaaattaaaattatctgtctatgaacattatctatatttcctttgactcaggaaactcactctaagaaatttatttcaagtaaataaagcctctcatatataaagatagttccaccggacagatttttttttttttctttttctgaggcaggtcttgctctgttgcccaggctcgagtacagtggtgcgaacacacttcactgcagccttgacctcctgggctccagtgattcttttgcctcagcctccctgtagctgggaccacagatgtgcaccactgtgcctggctaatttttgtagagaaggggctcactatgttgcgcaggctggtttcgatctcctggaatcaaacgatcctcccgcctcagccttccaacatgctcagattagaggtgtgagccactgctcctagcctctaccagattgtttattggtatttttttcacatggggaaaaaagtaaaccatttgctgagggaacacccatcactgtgtaaaacggttgactgaactctatcagaatgtactgctgacatggaaaaattccaccctagttttctttgcctgcatttcctatgtaaaggtaggattctgcttgtctttgtcaattattgatatttacctagaggatgttcactaaatttgatgagtaactttaggacaattggacttaaaatatgaactatgtggcatacacaagcttcactttggggagtcaaaagacaatttcaaagagataggaagagctgttcacttaaggttaggatgctgcagatagagcaaatgatgacttcacatatgaactgcaagtctaaagtaacatagtgggggtactctgaattgcagttgattgaaagtaagctgtttccactaaaaaaaatccaggtggcatggagagtaatatcacagactcatttaaaggatgattaacgattctccaaagaaaaatcaggaaggctacctaggcgatatataaaacaacaaagcccacgatacctttcatattctaaaaatcccatgaatctataggtggagaacaatttacatggtctatggaataaaaaactgctttaagcactgtattttcttctctttcttcactttatttagctgcaaactccattatcaataaaatgaaaatagtattgttaagctccccttataaatgaaatcaaagaaagaataagaatgaaaaatgagtgagaacttttttttggagtaaagatcatggtctgtacctgtgcaataaattgctcacatatttcattgtcatttttctcacaattgcttgaagaaaaatactctctgcacacccggatttgggttttcccttgcacaggttggccaaaggtgtacctcatgggggaaggtgtagttatgattacagataagcaatatcatagcaatattttatgatcttcttcagaaattatataggaagtctctaaactgtgagtaacccagtctaaccaaattgaattaggaattctccctattggtgagggtttaggttccccacagaattcaggttaaactgggcatttgatctcaggaggatttggctgcctttaaaaaattgaattcagggtaaggcagaatctaaaataatctaaaatctcattgaatatgatttaatgcttaaattgagttttttaaaaatatattttaatctgatagaaacatcataacattgcagcactttcccttttatcagaaaaatatatatgtatataaaacttggatgattcaggatcctgaaacatttccagatcaacattttaaacacgaatttttatttaccactcaataaatataaaggctatggggctggcatgaactggttatgctttgaccaaaaatataataccttacagggtgggtttgagtatctcattttctcctaaaacacaaaactacaacacaagattttaaaggttcaaccaaaggcaaatccagtcaattggagttttttgttttgttaatagacaacaaatgtaaaactagcatataataaaagtgaatattattttcacagattataatacttttttctaattgttggacactgatatatatcatttatttttcccagtgaccctgatttgtaaaatgaggtcaagtaacttctccacattgtaattaatgaaactaaaattcgaactcagatctacctcactccatagcccgtgcccttttctttccactcacctttttctctttctatttaaaaattcctaacacttttgagattctgagtcaaatcataccaataaaatcatgattatataaaggccagacttagatctggccacacatattatacctgaacatttcttcttatttctacttaatgtcttttatttatacaataaaagtcttattgtagtattatctgtaagctaacatatgcctataagacatgtagcttaaattttaaaaacaggacagaataatccctttgtgatttgaaaagctttcagtgaatgctaatgcagtgtattaaaatctctttgtctgtaggtaaattttcttccctcttaaaagcctaagtcatctctgactttgtttgctaaaataatccaatttttttcttgttttctctagtcattccaagctaaatcccagaaaagactaaagaaacacagacacagtatcatacaatttgagacacagtatacaactgacgtgaaccttctagaaacagtgctctcacaatctgcccagaaataactttgtagcaagcacagctccagtctagctgcctggtctcctggcaagatattattattgctgatactgatttactcctatgtaactctatccagaatacaatatcaaagaaatttcaagaaatcaggatcatggattgtaacctgacatactgctaaggaactaccagttccatgttagcatgtggtttgcaagtattttccaaaggccatgcttgagaaacatttttgttcttccaatgtgttgtgggttttgtttttagcatactatcgtgcagataaataaatgagatgttaatgccactgaaagctctggctttgcgtttggcttttctagtgaaacctgtttagtattctggatttcttccaacttgaatttatcacctcatcatttttaacatcagtgatctacacagtctctcatctattacgtatattaaattctggtattttcaactactcttcattaaaacttagaaaaaaatttataatcatttcctaaagtcaaaagaagatttgaaatgctactgaaaaaaaaaaaagaaggctgaaaactggtttgcaagattctctggggcatcaaaggcatcttaagaaccacgcttgcacgttcattagacagccctttaatcaatgtatctttaatagactgctggaaatactcaaaggcaagtaattttcatgtcataaattaaacaaagtgcttaacaaatatggcaaatattaatattgttaactgtttttataaagtatatgacagttattgattaggagagtagctttgaagctgaaaaacctaggtctaaatcctagttctgccatcaacaagctccattactgttgataagttattttaattctctgtgtcttattatctttctttataaaatacagatgacaatagctcctatctcatagcactgtggtaatgatatatgcagagcttaacaaactagttgacattcaaaaaacatttattttattttttattttattttatttttttctgagacagagtttcactcagttgcccaggctgcagtgaggtggcatgatctcggctcactgcaacctctgcttcctgggtgcaagcaattctcctgcctcagcctccccagtagctgagattactggtgcctgccaccatgcccgtctaattttttgtatttttagtagagacggggtttcgctatgttggccaggctggtctcgatctcctgacctcggatgatccctcccccaccttggcctcccaaaatgctggcattacaggtgtgagccaccgtgcctggccaattgtttataaattattattagaaattcgagaaaaggcactaaaaaagaaaaaaaaattaaaaataattttccaaaaacaaaatacaaatttctgaaatcgtgtattttttttacattaagagaattcaaataattcagattaacttgataagatgctttgtcttcactttgccatttcaatagctcatattctaattttaatgaaaatatgccatgatagtaaagattcaatgagaatttcacaccagctgctagaatcctacactggcacaacatgtttagtgaggagtatggcaatcagaagactaaaagaatgttacatattttgtcttggtaattccttttctggaaatctttcttaagtaaacaatttttcattcaaaagctacctattatatgttatacacaaagacatatactgcaaaattattaattaccaggaaaacaaaatgaaacagccaacatattatataataaaataattaaattgggtatagtcacataaaaatatgtgcagcagaaaattggaattcatgaaaagattggcataatacgtaggcatgttttcttaattattataaatagaaaagtatgattgcagtcatggaaaatattcattaaaattagaggaaacttacaatgttagtgacattacaatgttaatggcagttggtcaaattaataataggtaatgtcttgtgtttttctctatatttttcaaattttctacagtgaggattcattgcttctctaataacattaatgtaagcatataaataattaaagtttcatggttaatctcacttctcattctctctgagctttgtgttttcttgtgaaggtaaatctcctgaagaaatactcacttagcacatacatccacttggaattcatcatctgaaatagttactgtttgtggtgcattgaccgtaacttcaaacttgggcagcactggaaacgaagagaaatatacgttagcctgcacaatcacaggcaagcaaaccttattgcagtcatatagcttactatgattccttgtaccctccatctgtatgagctatgtatcatttgccccaaattgtgtggcaccattctacatggtggtgtctcactaatgattaattcttcctctttcttttcttttccctatcctcagaatttcacattttgtttctttttgtttgtttgtttgagacggagtttcactctgttgcccaggctggagtgcagtggtgcaatcttggctcactgcaacctctgcctacagggttcaagccattctcctgcctcagcctcccgagtagctgggattacaggcatgcacgaccacgctgggctaatttttgtatttttagtagagactgggtttcaccatgttggtgaggctggtctccaactcctgacctcatgatccactcacctcagtctctcaaagtgctgggattacaggcgtgagccaccacacccggcctcacattttctttctattgcaatctcttagatctctcctagaagactgtggggattctagaaaaaatgtatattttctagggggaaaaagaaggcaggaatcagaataaggatactggggaaggagtgaggagcagcaaagtgctgatgacaaagccaaccaggtcaaggaagggagacaaagaaaaccagttctagcttcacctactcctgcctaagtctaacacaaatgttgtgttggtccatcctttaaactcttcatctacataggacagctacaaatagcaactggttaccatatcttttaacagcaaattggtgtgtcactgtcttccttgagtttcttttcacaacaatccagtaatctccaaacattggttctgaaatcagttggaacgagagttgggtaatatttcggaaagaagtcacattttgccattgaaaaatccgattgttttgaggatcctagaaaataatgaaaaaaatataaacaatcagaatttgtatgagagtattaccctttgctgccatatttcggatagtttcggatagtttcacaagggttattttaggccaatattttctcttatgaaacaaacaagtagcttttggtagagcctgtgagggcttaagaaccctaatgtctataaatcttagaggattatacactatgctttggtcatacaaacttgtactgcctttattcttttttctttttttaaagtattgtaattgtacatacttaaaggatacaattggcggggcacagtggctcacacctgtaatcctagcactttgggatgccaaggtgggcagatcactagagccaaggagttcaagaccagcttgggtaatattgtgaaaccccatctctactaaaaatacaaaaattagttgggtatggtggcgtgtgcctctgtaatcccagctacttgggaggctgaggcaggagaatcgcttcaacgtgggaggtgaaggttgcagtgaaccgagatcataccactgcactccagcctgggtgacagagtgagactttgtctcaaaaataaaaaaaaaagtgggggggtacaatttgatgtttcaatacacacacacacacacagacacacacacatatctatatatttagtataatgatcatattggggcagtgttaccagtacttcattcatttatcttttttttttatggtgaagacattcaaaaacctctcatctagctattttgtaatttgctaaatcttactgtaaactattgtcatcctactgtgcaatagaacaccagaactcattccttcttcattcttttcagattaaataaaattttaaaacacttgtagagtgtcagatgtgttccaaggactgatccaagtgctcaaggcacaaaaatgtatatgacatgttcacagcccatattagcttaaaattttaagccactgtgctccttgttattatagtcatataattttcttgcattatggctgcaattcacattctgtaatcagggtatagatgtctaagtaaagtgttggcttaataattgttgttctaatcaaattgaattacacgttaacaaaacttacttaaattttccttgtatatttaattctatctcttcccaggccaagtcaaaaaaaatatgaacccttggaagaattacatctagaagtgaccagtcctagtctaaatatttaaatacataacatgaggaattcaggccaaaagtttattctgataggtctattttttgatgtactaataaaactggccatctctgctatagttttgctaacttgttgcagaagtaatctcaagaagaaaacagccctattagattatgtttaggatggatagttcaatatatattttgccaaaatgttatattgagtttacacaaataaacacacacaagctgtcataataagttcatttagcaactgttttaggatagatttttattctggaagatccataatgaattatattttatatgaagacagggctaccttttgcgtcaatattttgatattgaagagtgctggtacatcaataaagtacttgtatagtaaacaaattaaagatgttttgtgaactagctaggccttgaagactcacagggcttggtgtgtaatactgtcattcttagagataattagctccaggttgttctttctgctggaattgtgaattgcaaatccattcttatcagagtgaaatcagaacttcaaccctaatcaaaattgattggatgaattattgagtgttacaaaagtgatgcaatgaagggccctcatatttttgacattcatttttattagatccttcttatctggagattaggtatgtgagaagctcggagaaataatcttagaagagccaagcagaatttttatatctaaatccatgttacttacatagaatatattgttctttaaatataaaaatctataaatctgtacaagaccaatcgatacaagtaaaaaaaaatgtctgatcctgcttgaagtaaattatcaaagccatctacgttgagagatgaaatgtattacgtctctcctgctaacttgaggagtaaaggaatttactaaaaagttactaggatgtttttattccttttctttttttttcttgcagtgaagcctgtagatccttaagattctttaccagttgtgtggtcttaatttcacaaattgaggaatctgatccatagatggttccacttgaacgtggtgggagggtaacattctccttccatgaaatgtaaagactgcattgtgggacatggaggggctccatgagatccatttagttgcattcatcctcctgtccccaaagtatatcagtaaatgtactgtttcttgacagtttggctgtgttatcccagaggactggatgtgggaatctccaaatggccagataatactctcagcttccaattcagtgaaactattcttaagcatgttaatgaaaatatacttctttcctggatcctaaaaggtctaaatgaaaacaactcctattcctgaggatggaaaacaagtattctgcaaaagccactaccaatccgtaccttggttcccagacatatctctagaagagacagaaacaagccctttaatataatttcattcctcaacttccttggaattagtcccttaatgtgtcttgttctaaatccctgatcatcttgccacacatttgttaaggcttataaaagagtgtacatctttacctcaggccatttgtagacttgtcatatactttggtaatttcccaacatatgcgtttcacttccagtaaagaagttagaagactccattcccagattaccttgaatccagggggcaggtaaatgacaggctcgaccaatgagatgctctgttctgagactgggaatcagaagggagtgaaatggggaggccatggaagagtttattttcagggaactgtgagtataatggcaacttctagttcatttaggataagataggcagaaccttttcacatccactccaatgtgtttattccacacacgaggagccacagtgggaattctgatcattgctagacttgtcaattatacctacacatttggaaaatgaataaataaccagaagatggatctggtctctgttagtcctacaatgaagacaatttggccccaaattctggttattcctgatagtcataatctttgcctctcatctcagatgttattagtgaggtaatattcagtattttatagaatatttagatatttatctttccaggagctcatgtgctttggtaatgaggcagaatgtctttgagaaagataggagtgagaccttagggatgggtgtctgcctaactgaagtggactccaatgaaaattatataaatatcaaggcatgaaaattcagcactccctatcacgcactggtgaaaaagataatcaaataatctcctgttcaccattgacaaagtgcctattgacagcaagcatttggggaccacaaatttccactgctatggaacgataccaggctgatcacttctaagagttctgagaaaattaaagaaaagaaaaacaagctaggaactttaaattagcccttaccatccggagttctgtaacagaattatctctaagtctccaatacagctactgaatgtaatgaattaatattacatttattgatgcataaatagtaccattctctcctatgtatcctgaatggtactatttatgcatcaaatggtctctcgaaacattctctgtggagttaaacaataaagcaattttcttatataacagttgagaaaggttgctctaaatttttggttgaagatatacattgaaaagtgagtactttcaatttttatgttaaaactctcatttattgcagagcagttctgtaatcaaaatgcctcattattgtatgtgcttagatagaggctgataatttacctgtgagggattttttaaaaaattactgactgtggaggggaggagccaagatggccgaataggaacagctctggtctacagctcccagcttgagcgacacagaagacggtgatttctgcctttccatctgaggtaccgggttcatctcactagggagtgccagacagtgggcgcaggtcagtgggtgcgcgcaccgtgcgccagccaaagcagggcgaggcattgcctcacttgggaagcgcaaggggtcagggagttccctttccgagtcgaagaaaggggtgacggagggcacctggaaaatcgggtcactcccacccgaatactgggcttttccgacgggcttaaaaaacggtgcaccacgagattatatcccgcacctggcttggagggtcctaccccacggagtctcgctggttgctagcacagcagtctgagatcaaactgcaaggcggcagcgaggctgggggaggggcgcccgccattgcccaggcttgcttaggtaaacaaagcagccgggaagctcgaactgggtggagcccaccacagctcaaggaggcctgcctgcctctgtaggctccacctctgggggcagggcacagacaaacaaaaagacaacagtaacctctgcagacttaaatgtccctgtctgacagctttgaagagagcagtggttctcccagcatgcggctggagatctgagaacgggcagactgcctcctcaagtgggtccctgacccctgacccctgagcagcctaactgggaggcaccccccagcaggggcacactgacacctcacacggcagggtattccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaaacagaacagaaaaactggaaactctaaaaagcagagcgcctctcctcctccaaaggaatgcagttcctcaccggcaacggaacaaagctggatggagaatgactttgacgagctgagagaagaaggcttcagatgatcaaattactctgagctacaggaggacattcaaaccaaagggaaagaagttgaaaacttggaagaaaatttagaagaatgcataactagaataaccaatacagagaagtgcttaaaggagctgatggagctgaaaaccaaggctcgagatctacgtgaagaatgcagaagcctcaggagctgatgcgatcaactggaagaaagggtatcagcgatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgatggggaaaatagaaccaagttggaaaacactctgcaggatattatccaggagaacttccccaatctagcaaggcaggccaacgttcagattcaggaaatacagagaacgccacaaagatactccccgagaagagcaactccaagacacataattctcagattcaccaaagttgaaatgaaggaagaaatgttaagggcagccagagagaaaggtagggttaccctcaaagggaagcccatcagactaacagcggatctctcggcagaaaccctacaagccagaagagagtgggggccaatattcaacattcttaaagacaagaattttcaacccagaatttcatatccagccaaactaagcttcataagcaaaggagaaataaaatactttacagacaagcaaatgctgagagattttgtcaccaccaggcctgccctaaaagagctcctgaaggaagcgctaaacatggaaaggaacaaccggtaccagccgctgcaaaatcatgccaaaatgtaaagaccatcaagactaggaagaaactgcatcaactaacgagcaaaataaccagctaacatcataatgacaggatcaaattcacacataacaatattaactttaaatgtaaatggactaaatgctccaattaaaagacacacactggcaaattggataaagagtcaagacccatcagtgtgctgtattcaggaaacccatctcatgtgcagagacacacataggttcaaaataaaaggatggaggaagatctaccaagccaatggaaaacaaaaaaaggcaggggttgcaatactagtctctgataaaacagactttaaaccaacaaagatcaaaagagacaaagaaggccattacataatgggaaagggatcaattcaacatgaagagctaactatcctaaatatatatgcacccaatacaggagcaccaagattcataaagcaagtcctgagtgacctacaaagagacttagactcccacacattaataatgggagactttaacaccccactgtcaacattagacagatcaatgagacagaaagtcaacaaggatacccaggaattgaactcagctctgcacggacctaatagacatctacagaactctccaccccaaatcaacagaatatacatttttttcagcaccacaccacacctattccaaaattgaccacatacttagaagtaaagctctcctcagcaaatgtaaaagaacagaaattataacaaactatctctcagaccacagtgcaataaaactagaactcaggattaagaacttcactcaaaaccactcaactacatggaaactgaacaacctgctcctgaatgactactgggtacataacgaaatgaaggcagaaataaagatgttctttgaaaccaatgagaacaaagacacaacataccagaatctctgggacacattcaaagcagtgtgtacagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgatagaccgctagcaagactaataaagaaaaaaagagagaagaatcaaatagacgcaataaaaaatgataaaggggatatcaccaccgatcccacagaaatacaaactaccatcagagaatactacaaacacctctacgcaaataaactagaaaatctagaagaaatggataaattccttgacatatacactctcccaagactaaaccaggaagaatttgaatctctgaatagaccaataacaggagctgaaattgtggcaataatcaatagcttaccaacgaaaaagagtccaggaccagatggattcacagccgaattctaccagaggtacaaggaggaactggtaccattacttctgaaactattctaatcaatagaaaaagagggaatcctccctaactcattttatgaggccagcatcatcctgataccaaagccgggcagagacacaaccaaaaaagtgaattttagaccaacatccttgatgaacattgatgcaaaaatcctctataaaatactggcaaaccgaatccagcagcacatcaaaaagcttatccaccatgatcaagtgggcttcatccctgggatgcaaggctggttcaatatatgcaaatcaataaatgtaatccagcatataaacagaatcaaagacaaaaaccacatgattatctcaatagatgcagaaaaggcctttgacaaaattcaacaacccttcatgctaaaaactctcaataaatcaggtattgatgggacgtatctcaaaatcataagagctatctatgcaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagacgatatgattgtttatctagaaaaccccattgtctcagcccaaaatctccttaagctgataagcaacttcagcaaagtctcaggatacaaaatcaatgtacaaaaatcacaagcattcttatacaccaacaacagacaaacagccaaatcatgagtgaactcccattcacaattgcttcaaagagaataaaatacctaggaatccaacttccaagggatgtgaaggacctcttccaggagaactacaaaccactgctcaaggaaataaaagaggatacaaacaaatggaagaacattccatgctcatgggtaggaagaatcaatatcgtgaaaatggccatactgcccaaggtaatttacagattcaatgccatccccatcaagctaagaatgactttcttcacagaattggaaaaaacgactttaaagctcatatggaaccaaaaaagagcctgcatcgccaagtcaatcctgagccaaaagaacaaagctggaggcatcacactacctgacttcaaactatactacaaggctacagtaaccaaaacagcatggtactggtaccaaaacagagatatagaccaatggaacagaacagagccctcagaaataacaccgcatatctacaactatctgatctttgacaaacctgagaaaaacaagcaatggggaaaggattccctatttaataaatggtgctgggaaaactggctagccatatgtagaaagctgaaactggatcccctccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagccaaaattgacaaatgggacctaattaaactaaagagcttctgcacagcaaaagaaactaccatcagagtgaacaggcaacctacaaaatgggagaaaatttttgcaacctactcatctgacaaagggctaatatccagaatctacaatgaactccaacaaatttacaagaaaaaaacaaacaaccccaacaaaaagtgcgcaaaggacatgaacagacacttctcaaaagaagacatttatgcagccaaaaaacacatgaaaaaatgctcatcatcactggccatcagagaaatgccaatcaaaaccacaatgagataccatctcacaccagttagaatggcgatcattaaaaagtcaggaaacaacaggtgctggagaggatgtggagaaataggaacacttttacactgctggtgggactgtaaactagttcaaccattgtggaagtcagtgtggcgattcctcagggatctagaactagcaataacatttgacccagccatcccattactgggtatatacccaaaggactataaatcatgctgctataaagacacatgcacacgtatgtttattgcggcattattcacaatagcaaagacttggaaccaagccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcacaataacaaaaaaccaaacactgcatattctcactcgtaggtgggaactgaacaatgagaacacatggacacaggaaggggaacatcacactctggggactgttgtggggtcaggggcggggggagagatagcattgggagatatacctaatgctagatgacgagttagtgggtgcagtgcaccagcatggcacatgtatacatatgtaactaacctgcacattgtgcacatgtaccctaaaacttaaagtacaataataataaaaaaaaaataaaaataaaataaaatagcgtcctgatgttctgctcttttcctttatcttgttttattttccttacagtagttctttgagagatagtaactcacgatagagaaacatggtctttgggatcagaacgtctggattataatcccatctctgttatttagcatctgttgcattggacaagttacttaacctgcctaagcttcatttttctcattgataagttgcagttaatagcttccaatctatagactgtgatgaataaatgggttgacatttgtaaaatgcttagaatgttgcttggtatgtagcaataattcaggaaagattaactatcagagcacttaataccatctgaaattatgccattgatatagtttgaatatttgtcccctcaaatctcaggttgaactgttatccccagtgttggaggtggggcctggcaggaagtgtttgggtcatgggggcagacccttcattgcttggtgctgttcttgcaatggtgagtgacttcttgtgagatctgattgtttaaaagtatgtgatgcctctcctcttcttgctcccatactggccacgtgagacacttgctcccccttgtctttcaccacgactgtaagttttctgaggcctccccagaaaccgagcagatgccagcaccatgtttgctgcacagcctgcaaaaccgtgagccagtttaacctattttcttccttttttttttttttgaaaaggagtttcactcttgttgcccaagctggagtgcaatggcacaatcttggctcactgcaacctctgcctcctgggttcaagtgattcttctgcctcagcctcccgagtagctgggattagaggcatgcaccaccacgcctggctaattttttgtatttttagtagaaacagggtttcaacatgttacccgggcttgtctcaaactcctgacctcaggtgatctgcctgcctcagcctcccaaagtgctgggattataggtgtgagccaccgcacttggcccctattttctttgtaaattacccagcctcaagtatttctttacagcaacacaagaaatatacaaatgacaatatgcagccatttgtatattgtctgcatcccaaattcaatgtaaacttcacgaatataaagatttacctgcattattctcactgtatttctaacatctgacatgacaggcacattaaatgaattaaaagacaaagcaaaagaaaataatcacctcccctcttttcccaatcagtttaaaagcattaagagattataacctgtcacctgcccttcgcattatactgtgacttacctaagggtatgtaatcagtagattcaagatggttagaatccttgcacaatactggtttccggaggtgagagttggtaaaaatctttaatcctgttgcctttcaagataaaatcaattttagatcacataacaacatagactagcagtctggactggttttttgttctatgtatattttcaatttccacttatttatttctccatctctaattgtcatatatttagagatacttcactgacatttcctaaattccatgtctttgagttccttagtttctctaattctaatggcttttgctctattttcctaattaagagctgttgatgaaaacctttaaataagagaggacaaaaaaagacatctcatatcataccccactgtactttcactactttgaatttggcatttttgttgaactagggatattatctcacttataaacactttaaatatagtagaatactttaaaatagtagaaatcaaattcgagggtagacgtaggagcaaaatggggatttatattagacaccagtatataatgtacataatattatgtcaggaaagctgataattccctcacatattagttcttttcctaatattataatattattagttatttaaaatattattatagttttataatgaagttctaataaccttataacttaaccttattataacattataataaccttataactttataattataactttataacttttaaataaaattatattaatacaacttttaaaaatatattataactataatttattgtaactatatagaataactattatagctttataatattataactattatataattataactataagaactttattaagtctttttgctattataacattatttgagatattatttctcagacattagtactaattgtaaatttgtactctaagaattctgagattaaaaacccacaccatgaatatttctatttatttatatattgtcacatatattcaccattttaagacttagttgccttaccttcacaaggtcatagccatcttttccaaagtcagcccatgcaggtgtgtaataaattccattgtaaaggatatgtccatcttcaagacacggcactttaaggccatcttctaagttaagtcctctgaaataatagccatgtagttcgctggaatgtagctgactatacacctagatgttagaagagaatcaactgtattttttcatagaaaacaattcatttttccccacaagcagtatataaataacctatataatcctatgaatatcctgtgtagaactgtcatcatacctataccaaataaacacatattgagaaagtataggatcttagatctgtaaaaactttgaaatactatttaatcagttaaataactgctggctaaatcacattaaaactaacaaaaagtccatgaggctcaactggattttaatacattccagataaaggcactgctcaatactctttgaggactcattcaaggacattgttagagaatgttctcggttaatttactaaatctccctgagcctaagattagacattaatcaaaatgggaatactgcattagttctatagggttgattaatatgagaataaaattaaataatagatatgggaatactcagtagagcaagtgtcaaatagtagacctttagcaattgttatttatttttaaaagtgttgctcattttttccataagagaatcagtataattggagtagagtcattgtacatgatttctaacctaaaatattttttatgcctggaactctggacaatttttttctcctctagtttatttaaggtatcctgtttttatccaaaggtaaagacataaaactatactgtgggtggtaaacaaagatggttttaatcactcacagtttgtgctggcagctgaccataattccttagtagcaataccctctggtctaccgcccaaagagcataaagagagtttgaagcagccgagacttgaagatcgacattggatcctggtaaacttttttctttagaaaaatttaagttgacctgaaaatgaaaataaaagggcaaaaggatggcaagccatatgagaagaatcatcttttagactattcttaacttttttaaaaacacacataagttaaaagggctttctgtgctttacccacctaataatattattattaggaacaactggatttggaacaacatccaaagtgaatgctataatcctgctactcttcaatcatccaacatattaacttctccatagctttcttttatttttcattttgcaattctatgaaaaattgggagtttaaacccaacactctcttaagttctccttagttttcccccaaattaaaaaagaatcatttttggcacctacctgattttcgaagcatttctcaattggaattgggtgctatcagtgaccatttctcctccaggatgcaagctatagacaagcatatgtactgagggcgctaattcagggttaatgtctatagaaatggaaaatatgcccttcctccctgtgaaaagaaaatttcaaaccgaaaaagtgctttggtgagatagctgactgtcatcttgcagaaaccctccattgagtttctagccatcctacccactgccaaagagactgccccgacccaccaaatttaatttataaagcatttctaggaggagttcataacctattccataaattataaaagaaagaaatagttgaacatttcttattacgtcaaacttcagtctacttttgtttctttttaaaaatcccttcttgtttgaatgtaaaagtacttacctgtctttcttggaaaagaaagggaaggacaatgaccctttcccattatagtagtgtttggaatataattaatgcactattaattaagtaattattttttcatttggcattgtgcctattcacatgtctttacatgttccccaagggtagtttagggggcagtaaacagtcctaaaatgggaggattgtgacttttaaagaaaaatgtaaaatatatcccaattaaagcattctatttgtattaaattatatgctaaaattagaggcctcaccattttcgttgatctcaattttctgttgcccatgaagaatgattacaccttttgaaatcacctaggaaaatgaaaatataatcgtaaagtttagaggatagaaactaaatttcatttaattataaacgaatgtgatttacctccttttcttgtctgagcaatactattgacatgtttactagtaaactcaggttaccagtaaacaagcatatgactctaacagctatattcaagagaatttaggagtcacagataaacttgctataaagcaatttaatgttccacattccaaaacagttttctaagaccaataaacaactttttattcatatttgcaaatgctgaattacatctaaatttatttagttcagtgaaacaaagttacacaaaggcattaagagtctcccagtgcttgtctggttttctgaaaggtgtgtttgatatgcaaggtataagcaaggcctgttcatccatctccacccaaaatttaaagaaaagaaaataaagtagcaagctgggggtgctccagaaaaaagcttctctcacttcacctttatcagcaactgtgtgcaaatttgcatcagcagacttttgttatgatctctaaagtgcaaacaaaggctggagacttgaaatctagtacaaactccttgaatttttaaattacagttttagaatattattttaaaagatgctgagacttgcagaaaatttaaagcttccgtaagatcttgcagcttgaaattgcaggagctggtactcctagtccgtttaatatttcactgaatattaaaattgctttaaatctctgaagtgccaagtttgggttattagctcataaaaaaagaactgagcctcaactagctggaaaatattgttttgggaactagaacatttgcaaaaaggcataaagctcaaagtttaatgagcctgagaggtctcagcactgttggctgtagtagctcactgacttctcaaaatggaaagacagctctcgtaacagatgagtaaactgaagaggcacacagaggtactgatatttgtcaggtcacacaattaagaaaaaagcttaaaagactgagtatcaaattaattactgaaagcctgagaatcaaattaattcagcctctatccattcattctaaaatatgatattgagggttctctctgtgatgtgtaccctgctaggcagaattaaagtccacccagcctattatgaaagaatatgtagaagactggaattgtctaggagattagaaagtttcatttaagccaagagatgaatgctgaggaggaatcagctcggaaaatgaggtgcaggcaggttgggaactgtggtagcaaatgggaacgaagattgttatgggcagaagggaaaacctgtgggaggcttcggagccagaaaagcacatggcttgtccaagaaaatgaaagccctctgtgtctgcaataaagaaggctgaagtgtagaatgatgcaaaatgaagcgggcgagcttcacaggtgcagagcagatacagtgttgcaggcaaaagaaaggagtctggtatttgtttcaatagaaataggcagtcattaactgtatttcaattaggggagtgaaataaataatcctaattgctttttttaaaaatcactctagatttccagaataaagaaagaaagaagaaaaggagggaggaaggaagaagggagagaggaagaaaaaggctattagcagactcatttaaaatggaaatgaggtaaagtaattgtaaaggccttatcagatcagaggggggcaaacctacgctatttcaagagggaagctgatgacaagtagatcaattcacaccacagacctgcaaaatggctcagctctggattaggaagtattggatattaagtcgagcagaggtgtggccagaaaagaaggcaaaagtcaggggcatgtgggagtgtctttataaaaactagttaagaggttcagcttccctgtaatcccggtactttgggaggccgaggcgggcagatcacgaggtcaggagatcgcgaccatcctggctaacacggtgaaaccccgtctctactaaaaaaatacaaaaaaattagccgggcgtggtggcgggcgcctgtagtcccagctactcgggaggccgaggcaggagcatgccgtgaacccaggacgcggagctttcagtgagcggagatcgagccactgcactccagcctgggcgactgagcgaggctctgtctcaaaaaaaaaaaaaaaaaaaagaggttcagcttctcattcaaggatgcttggtatttctcacaccccagtatggcaatattattgttgacatgttgaaggatttctgtaccggttggtaaagagccacttccctgagctccccagagtcccctccctgcttccctagaacctctcctccacaaccagctcctcccactcccaccactttgcccccagtctaaatgagccatgcttggcttagctaagggcttcagtggaattatcactcataccttttctgatggtttggtgtccataccttgctggtttgaaatattttaatgtttgtggaaatgatgaaggaaagaaaaaatgcgagagataatataatgaaaaagtgatagaaattggtgatgcagtaaatagcacgaaaaaaagaagtatcaaaagactattccagaattctaagtttgcaaaatgtgagaaatcatgtggtactactttcattcttcacatagatagactcaaacacctttagttctcagaataatacacttcagacatctttgacctcttatattatttcctaaaataagcttaaatgtgtttctcatatcctctaatcatccagaaaactcctattcatcccacaaaatcctatttaggcatattctctttatgtattttttccttaaaaatatgtatatacatataaatgtaaatatataggcatatatctttttcctaaactagtggttgtcaaattttaatgtgcttcggaggacaagatttctaacttattcctatgttttttttttttttttttttttttttttttgagacagagtcttgctctgtcacccaggttggagtgcagtggcaccatcacggctcactgcaagctccgcctgctgggttcacaccattctcctgcctcagcctcctgagtagctgggactacaggcgcccgccaccatgccaggctgatttctttttgtatttttagtggagacgcggtttcaccgtgttagccaggatggtctggatctcctgacctcgtgatccgcccatctcggccccccaaagtgctgggattacaggcgtgagcccctgcgcctggccacttattcccagaatttctaaattattcctaggtgatgctgatactgctactctaggaaatatactctgataatcactgtcctaaactccagctagagttaatcattcatttttctgtaacacctcagtggccatacatgtttcgtttgtaacacttatgtaattctaatatatgttttgtccccagttatactttttctatttcttctattgttacaattgctaatacagcacctggaatatgaaaaacattcaataagtgttggctgattgaattaattcatgtttcattaattttatatcatcttcctaaatctcaatgaagtatcatgcacccatttagacagtgtaaaataatccataatagcaatatattaaaatcaaactaatacttaatatcttttgtgtgccagaagttgggcaaagggctttatatgtattattaaataattatcttgatgattagacaatatattacaaaaaactaagattctctagaggtttaagtggctttcaaaaagtaacacaaagctagtacatatcagaactctggtttgatcccagcaatgtccaaatagaaatgggtaactctgaagaaagggtctgagaatgacagagtgcatatgggttgtggtgtcatggccttttccctcctttcttaaaaatagataccagttatataagttttatcatttatgttaactttgagcttcctcgtggcatataggtacagggatttcattaggttcaaagaagttttaaagaaaagaagcaattttgattgtggaagaatattttcagctcataccaaataattgaagtctgctgtgtaggttttgtcttcaaagtcttccatattgagaatgcagtgcactagcaccctcttctgctggttgcatctcagttcttccatctcttggacaatctttaggaagctattcatcttggagtaaaatcgatatgcaaagtactcgggctgagggtattgaggcaacacccagccatgagcctggcaattttcattggccttgtaggctgcctagacaaaaaatcaaaattacgggtattttaggataaagagaaaggatgagtgaaagaatatttgataagatggtttatcatcatgctgctttatctctgcaagaaaattttatagccattctacattaaatctaacccaattccccattttctagttatactctagagcgaccactatggtttttacaatttagtctattcaagtcctacttcaataatattacattcaatattttactgtattctttactataattattacttttgctagcaagtagattgctatatctccctcactataatacgaagaacccatgagtgcaaacgtttaccttgctactgataacataatatgaagttttgctgaaagatgggaaagtttttatgaaatacagcaaggagtttactctgaccatagtaatttaccattatcaacacaaaaagtctgaggagtcctttaaaaatatctaggaaggattgatatttaattattacagatagtagtttacttctctcttgaatatatccagagaaattctttacattattccaaggtaatagattacagggtttctcaaatatttccttctataaaaacacaattctctttctatttccttaataaaagtgaagcgttgcttattttcagctaattctcctttatacaatttagtatgtatgctaaccttctgtcttttcccgggactcttaaaataatttttaacctacttttcatagggcctatattcttaatatttaactatttttcagtactctagattcacaccaaggtgtatcttttcatttctgttccataaatataatttcgcatagacctaaaccttagctagccagtgcagttttttgtttgcttgtttgtttttattttacttgcctttcgtttaacttactttcaaagtgatatttgggtatgtaaacgtatatgtgtccaagaaaaactgagcgatgccatttacatctgtggtgtagtttcccacgattttgtccttcagatgcaactgaacaacttcatttgggattggagagttgtctggattaagcaatttaatctgtacaagaggaagaaaatacatttcggaagcatgtagtaaatttgggcatccattttgatggcatttgccaagcttctatcatggggacccctgctctccttggtgcgtatgcacttcctgtgtggtttcatctattcctgttgagtgtatgacatgtaccattaatatactaatgagcctaaactctgtttctcctgcccacgaagatctctgaaaactcaggcccatagaattaaccatcctgagtattttttataataaaaatgctacagaaactctcaaattggaatgatttattactgtgcccaaccttcctttttttctatttctcttatttatctcaaagaatacctcaaccattcacttagtcactgaagtcaaatatctagagacatcttagactttttatttttcttctcccataattttcaattgttgatcaaatattttcaattgtatctttttaacattttctgtttccaactgatcacgtttgttcctgttgctattccttgtatcaatatcttatcttttttccctcatacgtcttctatttttttctatccagtctctctctcctgtattgcttttgcttgttctttctctatactggcatcaaaccaaattttctaaaatgcaaaatttagcattatcctccctaaaacattgtagtgactgctctgataggccatggttattcgctagaaatctctttctcattctcttactagtacaggcaatgattgctttaaaaagtcccttctgaaattgtatgatttgtagtagatacaatgcctgcatcagtatctatgccagtttgaagcctttaaaggcaccttcttaacaacatctaaggccacaacaaccagaagaactgtctgagccatcctttttttagctcagtcagtttctgcaaaacaacttctgctttgagcctttcatcttatttctgccacttatcattttcctgctggtccaagcaaacacaatccttttttcttgctcagcatctgtagactgatgcctcatttgcaccatctacacagattttgaacttagtttcatctcaaggcttgatcttctaagaaaaattcaacttgtctcagcaatccacaggccacagacacgtgacaccatgcctttatgatcacacagaggtttgccctaattttagtacacctagactagaaagatcctttgagtcccttccagtcacagaaagatgaacaagccatgtgatttctgggcactttcctttctttctttttttttttttttgttttatttttattttttttattgatcattcttgggtgtttctcgcagagggggatttggcagggtcacaggacaatagtggagggaaggtcagcagataaacaagtgaacaaaggtctctggttttcctaggcagaggaccctgcggccttccttagtgtttgtgtccctgggtacttgagattagggagtggtgatgactcttaaggagcacgctgccttcaagcatctgtttaacaaagcacatcttgcaccgcccttaatccattcaaccctgagtggatacagcacatgtttcagagagcacagggttgggggtaaggtcaccgatcaacaggatcccaaggcagaagaatttttcttagtacagaacaaaatgaaaagtctcccatgtctacctctttctacacagacatggcaaccatccgatttctcaatcttttccccacctttcccccctttctattctacaaaaccgccattgtcatcctggcccgttctcaatgagctgttgggtacacctcccagacggggtggtggccgggcagaggggctcctcacttcccagtaggggcggccgggcagaggcgcccctcacctcccggacggggctctgatgttagggcttaaattgatttatatttcaaagaattccctaatagattctatagtagcactgaagagtattctattgtaaaactcagaggaaagcaaatgtaattttctttgaacatgaaaaagaaagcaactttgagagtagtcatttagcagtagatgtgcattattatgagaaaacagttctataaattcagggttaattctattaattggaatgtcggtctctaatgtctagcttattatagggtagaaaagagctttctactcagctaatcattaatcattgatccaaaacttaaatacatctatcatttcctggggctattgtgagtactgtatatgtatttagcaaatatttaagacctagtaagtgctcaataaattgtagctgttactacaaaagaaaaaattactttttaaaaaaatatacaaccataatcacacatactagagaagaaaacttaaaactctaagtaattcttaggtaaaaataaaaataaaaataatgaaatcatcaaaaatgattttaattgaacttaaaaattgttaagatggtaaatttgatatgtgcattttttcataatttaaaaaataaaaatagtatagaaaaacacctgtgaggaggaaagaagtattcaggaaaaattgtataaatctgaaaacatggaagtttaacataagtatttataacaagatgctagaaaaaaaaaaccaaaagaggtagaagaaaaaatataataaaaataaatgatgtaatgaaaatcatttaaaataacattaaaaataaagataattaacaaatccaaaaactaatgggaaaaaaacacaaacacaactagtaataaaaaaggggaaataaattatgatagatttattttttcaaatcataagtgaacatattttatgccctctattttaaaacctaaatttaataagaaatatctagatacagaaactaacatattatagaaaattcttagtgaactaaaaaaggaaaattttttgactcgataaagtatgtctcacaaaatgctacagttacttagtaggtttacgcattacatttttaaaagcattccccaaaatatgcaaaatacaaccaggaagtccactatcatctctaatattcaaattggagatctttgccaatcgaataaaacaaactaataacaaaaacctcagaagattaagttcagaaaggaagctaaaatataacattttcacacaaaatgctctttacacagaaaacacttttaaattgcacagaaaagatacaagagacaaatgggaacccaagaaatcatcttgggtaacaacaacgtaagagggaggaaatggagaattctcaagtctagataaaattattttatattcagaaaaaattttatattctttgaagatatctctcagttttatatatttagtaacagaacatggaaatatataaagcaaaaatgtacaaagtgaagagaaaggttagaaaaaattatgttaacattatccaccactattcagtaagtgaagtgaacatatatcaaatttatctatctgccaaagctgtatttcaatctaaatttgttcattaaatgacttttactgaaatttgtttcagtaagtcctttaggtgatgctgatgccagtttgagaaactgctttgtaagatgtaagccaggctacccacttttgtatttcttttttagtgttcttgtgtcaacctaaatattacttcctcagggaaactttccatgatcatttagtccagattttagcaaacttcttttgtaaaacaccatggtctctctctcatatatttttttattttttaaataatcttttaaaaatgttaaaaccactcatagttcactggctgtatcaaggcaggcctctgtctgatttgcctatgggctgtggtttgtcagctcctgatgtagagtagttaaatggtcagtatttcactgacatagcacctatcacaactacaataattctttgtaaaattatctgtttaatgtttattatctctattacactataaactccataaaagcagtgataaaagtgcctctctacatcaccattttattcctaatactgatatagactatataatttattgtccaaacttggacacttttagagtgaagtggttgtaactattaacagttacaacttgataaaacatatacaccaggacagatctatgaaaatcaacagtgtaggtcaccctacagtgcttagcacagagattcctacatagtaatttcttagggaatagctgttggaagattagtagataaatgaaagaacaaatgaatgaatgaataaggtatgtaaaaaatgattgctttctaacctggccaaaataagggagtccctgtttgtaggacatatccatattctcaaaactaatcttcaccactgatgagtctatgtatacgtacttggagcctgtaagctgcacacctgcagtcaattaagtattattgagaaaatgtcacttccaaaaacagacaaacagagcttctgaaaaaaaccacaaaagctcaccattccttctaatagtttcccttccctttcctaagcagttttaatatgtaggtacttcagatgtcttttataaagaaagttaatcaagatggcacaaaatgcttgtgccaactggtgttgctgctttttataaaatatccaattcacttaccatttcttcatgatggattagtaaacgttgatttctcattattcctaagtgattgtttaacaacatttcttttactctctgcttgcctaaaacatatgctttaatttattaatagtaagaattgtaatatatgtgtattattaaaaatggaaatgcttaaaaaagaaaatacaaattaccaaatatcagatatctccaagagaaccaaaattagcattttaggctttttcccacaagttctatttctctttatatttatcatttatattaatatgtttgagattgtgtgtgtatatgtgtacatgcacacatacactcaatatgtgcaaatgtatatgtagttttacatgttttttatcattattttataaagtttttgtaaaaccttataaaaacttatttttaattgctacattatttctcatataaatatggacatatgttatcatgtagcaagcccttccctccttccttcctgccttccttcctttccttccttctctttcttccttccttcctttctttctttttctttctttctctctcttcctttctttctctctctttctctctctctctctttctctctctctttctttttcttttttttttcttgagatagggtctcattctgttgcccaggctggagtgcagtggtgcgatcatggctcactgcagccccaacctcctgggctcaagtgattctcccaccttagcctcctgagtagctgggattacagctgcatgacacaacacccagctaattttgtattgtttgtagagacggggtctcactatgttgccaccgaggatggtctcaaactcctaggctcaaataattcttctgcctcagcctccccaggtgctggggttataggtgtgagccactgtgcctggctattcttttattatttatttagttcagtatgacaaatatacctaattatcaattaaatgtttgtttaatacttgaatttcctctggatgtgacagatacctctaaaactttgaagactgatataagtacattagtaatttaatatttcaggaacagaaattttgctgaaatatcagttacatatgcgtaagtttaaaagtactacagtaacacaaagtggtcagcacagaaaaaagcatttcaaggattaagacttaccattttgtgctttaggaagaaggggtattaggtccaggagatacaagaaattagtcattagaaatattattggccgggcgaggtggctcacgactgtaatccacgcactttgggaggccgaggcgggaggatcacctgaggtcaggagtttgagactagcctggacaacatgatgaaaccccgtctctctactaaaaatgcaaaaacctagtcgggcgtgatggcgggcgcctgtaatcccagctactcgggaggctgaggcggaagaatcgcttgaacctggcgggcggaggtcgcagtgagctaagattacgccaccgcactctagcctgggcaacaagagcgaaactccgaaaaagaaaaagaaggaagggaggaagggagggagggagggagggagtggggagggagacagattttcctggatgagataaagatttttcactggatttattttcagaggcttagtaaaatattctccccaaactattttacttcccatgttctaattctatgctcaccaaaaaaattttataatcgacaactacatgtctcaattatatttatctgtggaatgattaaggaaaaggaatatgcttatatctaaaaccagatactcccattataaatcaataaattggcattcttacttctattgtagccttatttgaatgtaacacttgaccatccatcaacatgtgtgtgaaaattttggttgatatatgaaacattcagaatttgaatcagatgaacccaatgaaaagccctcagggaaaaaatgattgtattgacattgtatagttggcaatcaggtaacaattcgaatgagacagtgatatccattggggtctggcttcttagagagcattacctgttccgtcctctgtaacaagagcatgcactttgaggaaactccagtatccttcccgatttcactcaaaagcatctgtgttaataaacttggagacacagccatctttccccaactgaaaagaacaataaaaaaaagttatattgtaaaggaagactgtaagaaatagctataatagggaaaatgtgtgacctcactgaagcaactttaagaatattgtattacccaagttttagttttttaaaataatccattgtgtttctataattatattttcagttcatgtatttacctataactatttattttttaataaatattaactcttacaatattgtgttttaaaaaactcttcatggtgacattattttgttattatacaagataataaacacatccatcactagtcacgtattcacacatgatatttgcaattttggtaatttcagccatattcttttacagttttgaaactgagttttatattatttagttaccatgccttggacatttatgggactatttacacagcagttaggaacacaggctttacagtcaaacaccagaatttgaaccctggctttaccacttattacttcatacaaaatgaaatcttaataaagagcttgtagaactgtattacattagacaataactggaaagtgtttatttagcacagggcctggcacttagtaaacattcagtaggtagtagatttttaaattagattcctttacatttctctcagtgtctagtcaagtgacaatgtctcactaagtgaaatttttaaagtgtcacaattagtaaccaaaattaaacaggatgaattgtcaaatatttttaaaatgtgggataaattgtgctcataggttcctggactttaatattggggaaaaactgatttcttattctactccttcatcttatgatgatatgaggaaatctagtcctcaagatgtgggtgagatgtcaaaatcctgtgctacttcagggggtccttgaaactataagaaggtctagaaccatttccagaagcttaaagatctagaaaaatttccactatactaaaggtgaataatgagataaattatttagtccacactcctgctttacatgtgcatttgattattttaacttttattttaggttcaagggtgcctgtgcaggtttgttatataggtaaattgtgtgtcatgggggtttggtgtacagattatttcactatccaggtaataagcatagtatccaataggtagtttttttgatcctcaccccttcccaccctacatgtacattttaaatttccagagctctcaaatctcctgaagggcatcctataatatagccaccttcgataatgcattctgggatctacctaccctgtgcactcggcttatattggtttagtctcttctagagtgtgcatctttaaagattatgactgcttcataaagtgcaaaacccatgaggatagtacctgatctgtcttgctcaacaatgaagcttctaaataaaattattcttgcatattaaaagacctcaatatttatctgttgaatgaatttgtggagaaaatttttgtatccctgatatccctaaagatacagccccactagttatttaaatatttatatgacttggttggggtgcagtggctgacacctgtaaccccagcactttgggagaccgaagcgggcagatcacatgagatcaggagttcaagaccaggctggccaacatggtgaaaccccgtctctattaaaaatacaaaattagctgggcgtggtggtgcacgcctgtagtcccagcttcttgggaggttgaggcacgagaattgcttgaacccgggaggcagaggttgcggtaagccaatatcgcgccactgcactccagcatgggcgacacagtgagactgtctaaaaatatatatgtattgacatgtatttatgatctagttttgctgcacccatgatcttgagcaatgtatttaacctctttctgctttaatccactcatcggtaagggggcgataatagtaccccctcatagggtactatttgttttgagaatcaaatgcacataaactacttagctcagtgactgacacaaaataagcatccattaaatgttagcaattattattattataattgttactattgttagcgtttattgtccacattttttaaatttaagaattagaaggttcttaattatttccaacctaaagtattctctaaacaggacaggaatatgtgacactgtgtgtgtgcacctgtgtgtgtgtgtgcacacatgtgtgtggataaatggtatcacactgtagtatggggattgcagctggcagttgtatattagacagtcagatctggcatgattatagctgaaagccttgctacatcctagaccagcctgtttgtgtccgttttctgaatgttggttctcaaaccttccaagtagatcttttaggaaattcctcctttgtcagtttggaaaagttgattcttctctttagtggttaagaacctgactgatagggttcccatctggagctcctatatacacttatttccagtgagaataggttgagaggaaaataattatacatctaatactcttgaatatgcagaaacatcacatctccctgactaaattcacaaagtataaaataaagaacaggacatatgttcccagtaaattgatagggtgtagattttgatatgaaaccaaatgtatttttaattaagaatcgaaatttactactcagtttctgatactataatttgctttttgtcagtcaatagaaaatgaaacttagcatgacaaaagaggaatataaaatttacaaataggaatagaaatatagaataaaagtatatattttaactgtaaagaggaaaacaggaagaaaggaaggtaaatggaaggtgaggataaaaagttaatggaaacctatttataattttgctgatatacctcttacctgaatggtaaaatttttacagagtgaactgataagatgagcacatgaatgataagccgtagattctctgcacacactaagttggaccttcccgtccacaggttcaccataggtatatctaatagaagaatataacaacaacacaattacagaggtcaaggtcgtttttaatctgtatagggttttgaaacctttatttagtagctgaaaccagcactgtaacaacatttaaatagctagttaccataaattttattttctggaggaaatctaaaacaatggtacggactaaaattgagctgaatgctttaggcaaaaatatattttaattaaaaaggttgaaataggcatgtagacgttatatatctaagtcactaaaatacaatgtaaacaaaaaaacaaaaaaatacatcagtcattatttcattaaaaataatattttttgcatactgatagcaatggagtattgaaaaacaaaaaatgaaataaaataacattttgcttcttttagtttttttgtttttaaactgctattatgagcatattttatggtttttacttttaaaatgtaaattatatttatttatttattttttataaatgtcattttaagtcatcagattttggggtaatttctttttgtttgttttggaaagaagtaaaactgttcattttttattattatattttaagttctgggatatatgtgcagaaggtgcaggtttgttacataggtatacatgtgttatggtggtttgctgcacccatcaacccatcatctacattaagtatttctcttaatgctatccctccccttgcccccaacccccgacaggccccggtgtgtgatgttcccctccctgtgcccatatgttctcattgttcaactcctacttctgagtgagaacatgtggtgtttggttttctgttcctgtgatagtttgcagataatgatggtttccagtttcatccatgtccctgcaaaggacatgaactcattcttttttatggctgcatagtattccatggtgtgtatgtgccccattttctttacccagtctaacattgatgggcatttggattggttccaagtctttgttattgtgaatagtgctgcaataaacgtacgtgtgcaggtgtctttatagtagaatgatttataatcctttgggtatatacccactaatgcaattgctggtcaaatggtatttctggttctagatctttgaggaatggccactgtgtcttccacagtggttgaactaatttacactcccaacaacagtgtaaaagcgttcctatttctccacatcctctccagcatttgttgtttactgactttttaatgattgccattttaactggcatgagatggtatctcattgtggttttgatttggatttctctaatgaccagtgatgatgagctttttttcatatgtttgttggctgcataaatgtcttcttttaagcagtgtctgttcatatccttcacccactttttgatggggttgtttgctttttcttgtaaatttatttaagttccttatagattctggatattagccctttctcagatggatagattgcaaaatttttctcccattctgtatgttgcctgttcactctgattatagtttcttttgctatgcagaagctctttagtttaattagatcccatttgtcaatattggcttttggtgcaattgcttttggcgttttagtcataaagtatttgcccatgcctatgtcctaaatggtattgcctaggttttgttccagggtttttatggttttaggtctaacatttaaatctttaatccatcttgagttaatttttgtataaggtgtaaggaaggggtccagtttcagttttctgcatatggctagccagttttcccaacaccgtttattaaatagggaatcctttccccattgcttgttttcatcaggtttgtcataggtcaaatggttgtagatgtgtggtgctatttctgaggccactgctctgttccattggtctatatatctgtttttgtaccagtaccatgctgttttggttaccatagccttgtggtatagtttgaagtcaggaatccaacttccaagggatgtgaaggacctcttcaaggagaactacaaaccactgctcaaggaaataagagaggacacaaacaaatggaaagacaatccatgctcatggataggaagaatcaacatcgtgaaagtggccatgctgcccaaagtaacttatagatacaatgctattcccatcaaactaacattgactttcttcacagaattggaaaaagctactttaaagttcatatggaaccaaaaaaaagcccgcattgccaagacaatcctaagccaaaagaacaaagctggaggcatcactctacctgattcaaactatactacaaggctacagtaaccaaaacagcatggtactggtaccaaaacagagatatagaccaatggaacagaacagagccctcagaaataataccacacatctacaaccatctgacctttgacaaacctgacaaaaacaagaaatgcggaaaggattccctatttaataaatggtgctgggaaaactggctagccatatgtagaaagctgaaactggatcccttccttacaccttatacaaaaattaattcaagacagattattaaagacttaaatgttagacctaaagccataaaaaccctagaagaaaacctaggcaataccattcaggacataggcataggcaaggacttcatgtctaaaacaccaaaagcaatggcaacacaagccaaaattgacaaatgggatctaattaaactaaagagcttctgcacagcaaaagaaactaccatcagagtgaacaggcaactgacagaatgggagaaaatgtttacaatctacccatctgacaaagggctaatatccagaatctacaaagaacttaaacaaatttacaagaaaaaatcaaacaaccccatcagaaagtgggcgaaggatatgaacagacacttctcaaaagaaaacatttaagcagccaacagacacatgaaacaatgctcatcatcactggccattagagaaatgaaaatcaaaaccacagtgagataccatctcacaccagttagaatggcaatcattaaaaagtcaggaaacaacaggtgctggagaggatgtggagaaacaggaacatttttacactgttggtgggactgtaaattagttcaaccattgtggaagacagtgtggtgactcctcaaggatctagaactagaaataccatttgacccagctatctcattactgggtatatacccaaaggattataaatcatgctgctataaagacacatgcacacttatgtttattgcggcactattcacaatagcaaagacttggaaccaacccaaatgtccatcaatgatagatggacatatacaccatggaatactatgcagccatgaaaatggatgagttcatgtcctttgtagggacatggatgaagctggataccaacattctgagcaaactatcgcaaggacagaaaaccgaacaccgcatgttctcactcataggtgggaactgaacaatgagaacacttggacaccgggtggggaacatcccacactggggcctgtcgtggggtgggggcagtggggagggatagcattaggagatatacctaatgtaaatgacaagttaatgggtgcagcacagcaacgtggcacatgtatacatttgtaacaaacctgcatgttgtgcacatgtaccctagaacttaaagtataatttaaaaaattttaaataggtagaaagagcaaagaacaaaattgcttgtaaggaataacagtagattcctctgggctacgttttatgacaatttctcaatttcatcttccaaattactaattctctcttaagcatcatcgatccttctagtcagcctttctacacatatatttttaaattaataatatgcctacttccaaggtctttaattatttttaaagttacactattgactcatatctgagtatacacattttacttatttctaaatttttttctgattgatgttcaacagttttctcaggtatatattgctcttttttttgtttatataataccttgatttcaagtcattagaatcttcaaccatttagtgattcatgcttatgttttgggattcccagctggcttgtcctagagtgctttattttgcttatgcaatacttctccagtaaaaatgacacaggagccaacacacagccactgtgatagggaagtacctagacatttgggctttggggatttctgttactcaggggattttccagcaatgctggcaattccctgcctttatgacccaactacaatgagacttttcagtctctgccttttctgtattcttccaactctggaggtgaagcacaaggtagtgacatcaaaaagttagccatgcttcttcttgactcttaaagacttccagcctaaagtagacacaggaaggaggacaggcaaagctttcaccttaaagtttggcatggaattttagattactgtagtgaagctctcctaataactagaaatttccaggtcacttttttatttttaattatgcaaaattaaaaggaaaagtagtacacatgagtcagggaaaagtagtacacatcaggtctgaggagacaaagttttaatgtttgcaccctggctctctttgctggttatataaactctgtgaatgttgcttaacttagtgacaagaggggaaaacaacctgacctgcttcactgctactcctgccacacgttaatcctcactatttgcccctaagtccctgtctgcccttagtatcctccacactgtgccccgccattaccctagagccacttgtaactcttacagcagttttctctgtgatacatcttgagcttcagttttcttttataatcatgtaatacataaagattgaattgagaaatcatcataaacagaagatattgtccaatggaaatttctgggagatggaatgttctatgttttatgtctatgctctccaattcagtggccactagtcacatgtgacagcttgaaatgtggctaacgcaactgaatatttagttttaattaaaacttaaataaccacatgtggtcacggctactgtattggctggtgcaaaacaatatgttatcttatgatgtaagaaagacagtagtcagttgtcttaaactgttacataaaaccacgtgtcataacatgcattaaaagaattatagatgcatggaagaattcataaaatcagcaaaataatttaacaccttctttttcccttaccttctacacatttatattttacttctttttagccatctatcccattctaatatctttctatgaatacattattctattgtgtacaatttcaacttacaaggcacagacattcactttgaattcagagtccacaactaagatattttctggtgcatccacagtcatttgaaatttgggtaacactgccagtaaaaaaaatatatatatattatattataatgtgtatattatatattattaacataaatacatattaacataaatacattcatacaaaacaattgtttctcctttacaaaccatcaacctttgcttatgtttgccattaataaacagtgtgaggaggacgttgaagtgcctaagactggattttggaattggatagaaaaatgcatattttgaattccaaattcatcacttctcaggtgttgaacttgggaaagtgtttctcaatatcttcatctttaaaatagtaataaagatactacaatagaaattttatgaagattttaggagaaaatatgaagggactaatggctaacatatgactaatgttaattccattcttctcataagaagtgctttacatcccagaaactatcatataaaatagaatccagatactacaaaaggaagatagatagcctaggttaacagagaattgcaggaagattatgggctgaactaggagataaaaatcacagtagatggagaaccctaaaatagtaacagaggacaaggaaagaggaaaggaagagatactcacttgaaaattcattatttaataatcctgcccttgcaaaattggaaagattttataatttttttattaataggtaatattttcattgctattatttaccatattcttccacagagaaggagtgatatgttttcttctcattgagcatctccacggtgatttcataccatccgaggatgggctctgagattaactggaaggagagttgtagaatccctcccacagactcctcattcacccactgttgtattcgattgccttctggatcctgagaataagaaagtgtatttttgcatgctggatgtttttattcattataaagtttcagcaaggtgtttcctacttaggtttccaactgacttaggattcaaaacatgagtgtgtcctcacatcacccaaggagaattggttactctcctatctgaggtcacatagatgcatattacagtacttagtatattttagagctagctgtgatttttttacatttattttctgtgtcaatctctgatttcttaaaggcgagccatattttatccccagtgcataaaacattaagtgtacatttatatacattcaacaactaaacattaaattaaatacaatcatacttgcccgttgtctatattattattgtctgtattaatgggtgcatgctaatatgaatcacatggtggtgggggtggaaacctatttctgtcctcttgaggctgtctacatgaaattaataattctgcgacaatttaaatagacaatcttccctgtgagctgccttttgattttgaggtttagagagatgttcaaaaaatgagaaaacaattcttcaactattagttatcttacctgaagggtgatcactggatactgaaataaaaataaaaataatgttaatatatgaactcaaggtttttttttctagatgagtgaagaggttaattataaatctattattaagcaaagaaacataaacacatttaggacaacccaaacaaatactgatttctgactgaaagtttgaatatctattgattatattgaaactcatctgcctagttttcaagaattttcatttacttctctctctttcacaacatacaccctgcagtctcagtaagcaaccctgcccttgggtctctccaacataataaaaatgccctcttagatgaatcataacttccttatcaacaaattcgtggtcagtcttcactctgacagttgcaatgttttacactgctggttgcctctttttgaaatgcttcaattttgatttctgtatctagcactaattttttttgtcttagattattggccattcctatactccaccatttccttatcagacaagtaaataaacgtagacatttgcccaagtttcccttgcagagtttcctctccttcttccttctccttccacctctctgtatctcctctcagttctctccatgtttaccactcttgccccctctaaacctatagtcaacagtttgactttcatctcttagtgttttctctcaggaccttaaaactaacaagttgaaattaaagactcctaggccagaagccctcatgtgaataggctgatgagaattttaaaaatgagtacatagggtcctttgcccactccccaagttgctaagtgctccttcccactaattgcagcattcattcactaataaaacgtaatgtgtctggagataagaacaggattcataaaccttgtccagaattcttggaactgagaaatataacagttgaattaagggcctacttgttattctaaattcatggaattgaatcttgatgaaatattgagatggtattgaagaaagctactgctgcaacattaactcaagcattaagagaggtagagcttctcatgagatttcctcataggaagaaaatgaagaatatattacccaaaggtgccatgggaagacgttaaccatttggatgagattctaataatgagaaatgaacctagagtactatccctttttgtttgctatttgtaatacttccaatgcagatggcttcaactgtgttcaacaaatttagtttttattacttaatttgtcttttttttttagatttttttttaaactcagcttggtctatttcaaaaaactagtgaacaagaacctagtaaaatcacattttcattgttctaagctgcttgatttttctctaaaaacaattattaaaatgaggctgattctgctgtagtcactaatgactgtctgcactaaatcttgtataaaccagccaagaaccaatacaacaactccttcatgtccccttctggttcatactatctctccctgtccatacacagggcctctttttagaggactagtagttccaggtcttaagataagtttaaagaaagatctgaaacttcttgatgcaaatgaaactttctggaaaaagtatgtttgaatattctacaaaacactgacttaaaggaaaagaaaggcaccatcagcaatgaaattgcagaaaatgaaagaaaagaccgatgtaagatttgggcagaagaaactaggtatatgctctatatcttggctcatttgataatgagcccagttgcatcattactatatttttattatgtagtcaaatttattatgaatgcccaaatctcataggccagccatgcattgaatctatttatctaaatggaatactgaaccagataatgtccagcaattagaaacactggcttgcaaagataaaaccacataatctcttagctgccatcatttttggaaatgctacatcaatttccatctctatacataagcacatgcagtttgttgtgccatggaaactccttgccataaacatttggtacaaatgatcttcttatctatgacccatatttgagggaacagtccattaatcctgttcttatgcaaatgtagttattactaaagcagggagttggataatcatatttggcctaattgacaataataagtcaacattggggggtgagaactaataagggagttatgataatgctgcagctgctttgattttcaagaagacctttacttccccatggtgcttccaatcaaggatgattgtcaaaggattgcagtagaaattctcactgccttggttaaatagaggagttgcattcttagaaatagaagcttcaaccatgaaccaaggagaacaggaaccacatgctatcttacggaagtgatttcggatttagattactacaaggtctttggagcactaaaaattagattcctgctctggaaattaaaattaagcaacagtctagtgaatgtagcataactatagaagatggggaaaggaggtggattaaaagtgacgatgtcttaaggatgaagtacaatttggagggaggaaaaggcactaacagagaaaccatctgcacagcttctgtaagcttcagaagcttcttcgtaactgcgctcagttgatagattgatctgagagaccacaaaagaatgcttagttctaacaggtttctaaactacatgaaatgaaatttgtcaggtatcctgttgtaaagactgaagtccaggtcataattcgttgtcttttgacagttttcactgttgatcgccttggttctcagattgtcgctagctagattgtagtcttctgctgaaatactgtcttagactaccatcaccatattagtctggtctcactttctattttatctgtttactatgctttttcatattttgttcatgccactatatagtagttaatatattgcattataaatatgaagcaacaataaactgtgcaatgaggttttagcaatcatagttaatatcacaccatatttttattcaaaaagaagcatgatgctgggtagattatgaatatttgtagcattataatctcagattgtaatgatcaattttttgaaaactgaatatctctcaattgtgtaagactcctggctcaatttctttgctatgttataacctttcctctgtgcattagactctttactagactgtggatggataagaaattttaaaaaagcaattttaaattaaggtttaatgtttctgtgctctttgaagtagcagccaccttccccacctctgccttctatagctctccttagcaagaatcctagaagccttccttggacatcctcttgtgtcaagcacatatactcttccccctcataagcacctcccacgccagcatgcatgctctcgtaatgtttgttccaccgttgttggtgccagcccaaactgtacagccatgccctgtctttcttgtctagtccttctttctctggtgcctaaatactgacctgaatgccctcttttgtgaagtgagggagggaggcaaagggtcaggggaagaggagtggaaggctggggatagcacaatgcatgcagtgcattcctccatctccagcacatatccctcacctccctctgcttgtgttgttctgggatcacagtgtgttggtgcctaagcaggctctgattactgtgattcccagttcatccacgactgcctcctcaagccatgatccccacatctgtagtgactcctcatgggtgttacttaactacatgaaaatgcctctttagttctatattcagggatttcctttaactcttctattcactgcagcttcttttccttcctttttttttcttttattatatcacattttattttatttttaattattatactttaagttctagggtacttgtgcacaacgtgcaggtttgttacatatgtatacatgtgccatgtttctgtgctgcacccattaactcgtcatttacattaggtatttctcctagtgctatccctccccctctccccactgcacgacaggccttgttgtgtgatgttccccaccctgtgtccaagtgttctcattgttcaattcccacctataagtgagaacatgtggtgtttggttttctgtccttgcaatagttttctcagaatgacggtttccagcttcatccatgtccctgcaaaggacatgaattcatccttttttatggctgcatagtattccatggtgtatatgtgccacattttcttcattcgatctatcattgatggacatttgggtttctttactccaaataagtctatctacttctcattttacggcatggtttttaaattaattctacctcagtgcttttttatgtaccattcatctcatcagaaatgtctatcttctgactgctgtaatctgtattcatcaactccttctgtacccaggaggagagaggaggcttttcagcttaattcaacatcatgctgatcattctattacttgggcaattctctagtcactaggggtatctcattacatgttcatgacatactttgttgctcttttgtttctatttcaaccataagcttgtaagtttgtgtaaattaaattcaaaatccccaaatatgtgattagaatgttattagaataatacggatattattagaatattattagaataatatggatattattagaatagaataaggtgctctttaaaaatacactttctgaggctccccaccccagactcatggaaatgaaatctctaacatttaggctatgtaatctatatttttattttgtatttttaagcaggttctctaataaactttaatacaataaaatttctgagcttgtattgtgtaccatcaattcaaatatcatataagtgacattagttgagggtaacctgatttaggtacactcacctttctgtccaggcttgtaggtgggtttatcagtctgtacaaagaccacattctctctggatctgattgccacagatctcctctcttccaggttgagagtggctcctttagcagaaaatgtaataaatgccagtgggtcagatctggcctgaggaacctagggaacaaataaatactccatgaaactgattttttgttaagaaatctctatcactgtgtgttggtatcactaaaagttttaattcataatttgtcatatctatttcttcaataaccaaccttgtttatttctcttgctttgtcacttccttatctcaccatttaaatggattcttttgcctttcttaaaacttcccttttctgcacaagagtcattctttctatatgtcttattcccttcaacaattttctatcataaaatcaaatgttttggctcttgcccttgttaccatttatgactgtacttaacatcatctcatactgaggactatattattcttttaaaaattaaaataactttacacatacagtcaaatagcctgatctctgtccctaaaaaatcagttatgtgggtggtgttcatgcacctgtaatattcttttctatattaagcagaaagaagtatttacctcaaagctgatgcatttgaagaaattttctccagtaacattttcttcaaatattttggtctggacctcaccatagttgagggagaccgtcaaaacaacagattcagtgagattaaaaagctgggcacaagctttatccaaagagccttcttgtagaacagaaggaatcagcagaacatactgcctacaaaattcaagcaagaccattacaattgaatgtgtgattagttacttagcaattattgtgttaattgaagaatttttgagtttaagagaagtatgttatttttaaatgttagaaatacatcaaatggctaaatctgtatgaaacagaaagatgttggcatatgaattaaatttttaaaagtcaaaaaggaaatcccaattaaaaatcagcaggtaatttgtcattagttctataaaggttaacatcatcagtgttcttgtacaatgcttttgcccccaaactgacacagcacattctgttttatatttgcctactgtttgtccagttccttccccagcagctgtcagacacctcttcctcaacataaatatagcactgttacagctcttactcagcattctggatatctacgaggcagagatgatgatgccaaccaaatttgaaatttactagtcccatgagcatattttgggttatattgtaaaatgataaaattatttaaaatcaaatcactgcaataaaaatgtaatgtttaattattattattattattatttattttttttttttctagacagagtctccctctgtcgcccaggctggagtgcccagtggcacgatcttgcctcactgcaacctccgcctcccaggtttaagcgattctccagtctcagactccagagtagctgggattacaggctcatgctaccacacccggctaatttttgtatttttagtaaagatggggtttcatttcactatgttggccaggctggtcttgaactcctgacctcaggtgatccgcccatctcagcctcccaaagtgctgggattgcaggcgtaagccactgtgcccagcctgaatttttaataccaagctctatttgccttccatgtgaaataataaactgtgtaatcactgacaagtttggagactgagaaagagacagatgaaagagaaaaacacccagatgtattatcttccacatcatgatccaatgagatgaagaaaaagtcaatatgccgtgtctgctagatccacatacaggtcagtgttctaggagcccagacgttctcactagtcagggaagccgagtatgggactatatatccatgcaggagattttgccagtatttcctgagtcattcttaaagtttaagtcatgtttaaattttagccatctcccagtgtgttacatgtcattaggtgtgttatctaatttacaaaacagtcttgcatcagcatttcctagacataatttacaatgcctatgagtgaaaatttcaagaacaaattaaatcccatttcagtaaattcaatcattgtaaattaatttgtatctcactattatttcttggttgagagctaaatctattttgagaactcagtaccaatttctggttggcaatgctctgtatagttattacaatggaagcaatgtaaaaataacaaaggcttaaggaagctctaattgaaaaaaaattaaatattaccatgtcttttttattactaattgttgatgttgtattttccatacgacatatttttatataaaagtatcctggtaggaaagtttattgaagcattactttttctttttttgcatttcattttcttcttttcctttaccaaaattattgccaggtattttgtgtttctttgtctttagagttttgactaaataagatgctcttagaagacaatcgcacgattgctgtgactttatcaagtatcacaaagtggtttcattgggctcagcctctgacattgcccttttactgaaaacagcaggaaatctatttaccaactgttttttcctaaaattcaagttaattatatcatatcctctttaaaaatccttaatggtccactattacctacaagataaattccaaactctttagaaaaaaaagtttcttaaggctcttatctacctatagcccccactgcttgcccacagacgttctgctttcttccctgaaaacaccagcaatgtgccacaccctttcatctctacatgtgtatttgtgggctcagtcttctgtctagaacctctctttatatgacttcctgtctaccaggtacatatatcctccttgttcttttgtgattcggttcaaactttcataattcccaagctgaagttagttgttgctgcttttagctcccataacacaggtactcatctctattacaggatgtcatgtcacactacaaatatttagtttttatgtaatacatgccacttggctgtgggaatctcagagatacagcctgcatgttttattcattgttgaatttccaatgggtggtatatgaatgcaagcacttcttgagtcaatcatgacttttagtcagtctcaggttttccatagaatcttgtgtctgtgtacaactaaccatattcttggggagcaaaataggagaatattaaccctcccaggaggagagcttctttccattcacttctttccattcaacccatcctatgctgcatttgaagtaagcactcttgactcccagacttttaaagcaaacccattattggggtgctagctttctatccagaggttttacacaggttttgtaatgcagtgagaagcagacgcatctttctgactaataatgtcttctgctggtttcccactgctatatattacagagaactagaaaagattaaagccagtatctgtatttagggtatggtcaacttaatgagacattagcttttattttattgttactctattttcacataaccctttctaaaaagcctgttatcatgcacttctttacctatgaaattttggccaaatctaaagacaattgcccttaatcatttgactaagacaatggactttatgctttcaatctactccttcctctttatatcccagttggctaacagtctcagattagtgactacttgtgttgttctttgtgaaaagcaacacccaaacctacctctctttatgtttgcctgttactgattccttggggtttcgttaccccttgctacaacactcattccaaagtgtgaatctaaaatgatcacttactatttgaggaacacagtcaggcatgtacttacatatagagcatctttactaattaaaatgcaaaatataaatcataccaatagtagggcacatctggagatcaaatgctttctcagactttattaacccattacaatttagaaatccaaatctaacatcgataacaggaaagttaatataagaaatttccaaaagacaaattagtacaaatgtttgaatttgttgagtagaaggtggatcttgcagtgcacttatcttttataaggagaattaaattcatctttataaacacacatacaatctcatctatctgatttgattgaagaaatcataactattaaatatttgaataatacccctctgataaataaatatatgagcatactacactgacttgcacatatgagaattttctagattgccagttagcacctaaaatttggagtaaatgccctaaccttctatctgggactcatgtttagaattatgatttattttcttattccatggaattataatacatatggagtaattctattaatattatttatacttgcctccaactctctaagttacatctgacttaaggtatgattgttcatttttttagattttcccccagatctcaaaagtgaactttgtacataaacattatccaaattgagagatagatataaatatagacctccctaatacaccttctaaatttggtaaaagtcttctaactgtttaaatgggaaacagtaagaataacagaacacatatacacatgaacacagacatacgtaagttttttacagtacaataacaatgttatttgcatacaggatacagagcagttgtttctaattctcagtctacgcatgggaaatccccttctactgtgggaaaagatttcatcatttactagacaagaaggatctcattcataaagttaagggtgtggagagagtgggaaaaatgatggtgtgggttgtctgttaggcaaactgggaatgccgtttccagcatatgaaaaaaatccctctttattcacatacattccaatgttcacttcctcatcctgtaaagcagagatgtgtttcattacaactataaaagtgcaatgctgggctaaagcctccttaccattactacaaaaaaggattctaaacaaaatctaaatcaatgcttctaactttaagatcattgctctaatgttttaaaaaaatgcatctgggatgccttttattataattttttaacagcagcaatttattttatgaaattaaaaaaatgagttcagtaattgtcaaaataaaacacaagtaagacataagtccaagtctgagtatattgtgaatactttggaataatgttattaataaacattgtctgcttttatggcagtgaatattcatatatttaatataagaaaacattttatattcaagatgcctttccctacaatgcaaagtaactgaagtttataggtaatatatactattaaaaaataaaaattaatatatactcatgaaaagtaaaaagaaaaataagaaaaagaataaattatgcttccaagcttagtgaagatctattcactcttccaaagtcattttcagaatataacttctctcctgtgttttcaccacctttcttgcttcactttctttaaagtatgaatctttaggtagtattgatcatttttgatattaagaaaatacaaagcttctggaaataattcaaatcattttgcaacttttggctgtgatcactttgcaaagcatgcagtgtttcttcgtagccaattgatgaagggtttagggaaatttgccaggaacttaccatgagtcatgggacaaatgggaacccgtcattccctctgcaaaacctgttcttgagaagccctttgtccagagcctcagtaggcagctggttcataccaaccaatggtaagcaatgctcatctgttctctcccttaaggcctctctttgtgtaaagacccacaagcataagtatctgtggtggggctgtgtcatgagggcaggctcacagtgctctcctctgagttaccactactgaacataatcagggtgtgtaaacttgttttatttggcattaaagccgttacaacaagttataaacatttccagagcttcttactagtggaagcagaggtagtctctcaggcagagtgtggttaggaccgaatgcactctgttgggaaaggcctgtggtaaatgcaacaccttggcacaagaaagttatacttttgttgtagtgtaaaccaaaaataaaattctaagccccccaaccaatagaatgaaccccttctgtcagccaaggacatcctacagtaaatctgaaacactagttcaggccatgataggagtgggaggtcagatgtatctgattacaccttccccctttggaatacaggcactgctgatcagcattaacatcaaaacagagagcttaagacaaaatactctttgtagcaataagacatcaacatgacagataacagggcctaaaagaaattgaagtattttaccctcaaatatatttctttcttttttttactcgaacatgatcattttttaaaaattttactttaacttctggtataatgtgcagaatgttcaggtttattgcataggtatatatgtgccatggtggtttgctgcacctatcaatctgccatccaggttttaagccccgcacccacaatatatttctttgacatattttgaaatggatctgcacagttgtcttttgtggggaaaatctacattctacagagaatcgccatccttttccaggtcattttcctgatccaggagagacttaactaagagtttggcacctttttaagtctgataagagacatttacaatctgttctctctgaagcctgctacgcagaggcttcatctgcataataagaatcttggtctccaaaacccgttatcttaacccagacacttcctcctatcgattccagctctttagataaactatgttaatcaagtgccaatcagaaaatctttgaatccacctaggacctggaagcacagttccctgccccctttgagctgtcctgcctttctagacctaaccaacgtgtaccacaaatgtatcgattaatgtcgtatgtctccctaaaacatgtagattcaaactgtggcccaaccaccttgagcgcatgttctcaggatctcctggggctgtgtcttcatgggccatggtcatgcatatttggctcagaataactctctccaaatattttacagagtttgactcttttcatagacagtagctttcagaaaactacaattactcaacctgactttaaaatattaacatattaagaatttggtttgtgtgtaaaacattcattcctttccttgtaaggtagttacagagaaggacaaaggccttggagcctcatggtgagtgtttggatcttggttctaccacttctcagatgatcaaccttggatgagttatttgaattccctgtgcttcccttcctttgtctatagatgggaataatcacaataccataccttataagcttgttgtggaaattgaacaagtaatatatttaaagtgattagaacagttactgacacagtaaacactgggtaagcctctacagagactaaatattacacccctaaccaccaaacacaccctacaaaattctagtcataaagagcattagtatgaacaatggattactcatgtcagccaagcgctctccaaaatgattttcctgaaatcaatatagaaacaactaaaaagaaatgagatgtcgtaagttctatataatgatgctatagaataaaggaggaaaggaattgaaaaagaaaagtaagaacatctttgtcaggtgcaagtaacagaatacctaaacagacttttaaaaaatcaaacatttataatctcatttggcacaaatcctgagaatggaggactggcattggttcagcagctcatgcatgccatcaaacagtttcctaaattctttccaccctacttccttgatgtgtcagtattatttgcaattttggctcctgacgtagcaaagattattccttcccagcaatatctcaatctgaatgaaaagagtgagcaggaaaaaattttcttctcctacatctctcttttcttttcttttctcttctctccttctttctccttctcctcctcctccaccttctctctttcccttttcctgccccccacctcttttacaaactattgcagatgctatattaggaaattttcctgtatagctccttatccacgcctggtttatatctctcattgctaggccaaagagtgtaccctctagataatccccttcatggcagaggcacttatgaccctagctgctaggaatgttggtggctgttggctgtcagatgaattcacctctgagaacctccctcagcatcagagaaacatttcacccaggttcctcttcctttctaggggcagctcagtgcacaataatgggtactatgtgtgtataaatgcacagctctgttgccttaaattaggacaactctgaacaatcaccccaaccccacagctccccacgggatatactgataactttattgtgactgccttgtagtacagctcctttttctgtacaatcctgcttccttcatcctctacaggtgttgatctttagaattctctccaataaaccctcttcccacaaatcttcatctcagagtctccgttttgtggaacctgatctgtggattccaatcactgtaagaggggactgtgataatatgattgacttaaaaaacaaaatcatgattcatctgagagcacttgaggcctgagcaaaatacacattctctaaacttacaaagaagaggaaaatctcatgtgtgagcaaccacaaacagagaaaagtggattgttcaagacactttgactattgcattgtgttggaaggatgggaaggagagaacagaaagttgtgagcaggataaaaatactaaaatgtcattctttggtacagtaaaaagaaaatgagagctcccaaagatcagtgaacagcaagaacaattatgatattaacatgggcagagtttcctaaaagaagaatccagagatggtctaagcagtgcttctcaaactttaatttgtacatacccaatctgaggatgatcttgttaacatgtggattctggttcagcatatgtgggtaggacctgacattctgcattcatttccaacagcctcccagcaatgcaagtactgctactcttctgaccacacttagagtagcaaggctctggagcctttgaaccccagttcaccattacctatggctggggaagcttggaataaccctgatgtccaagctatgcccttagatcaagggatttaaattgtggtcttggggctagtagtgccagtatcacttgggatcctcttaaaaatacaagttcttccatggtgtatatgtgtcacattttcttaatccagtctatcatttttggacaccgtggaatactatgcagccataaaaaatgatgagttcatgtcctttgtagggacacggatgaagatggaaaccatcattctcagcaaactatcacaaggacaaaaaaacaaacaccgcatgttctcactcataggtgggcattgaacaatgagaacacatggacacgggaaggggaacatcacacaccggggcctgttgtggggttgggggaggggggagggatagcattaggagatatacctaatgtaaatgacgagttaatgggtgcagcacaccaacatggcacacgtatacatatgtaacaaacctgcatgttgtgcacatgtaccctagaacttaaagtataatatatatatacaagttcttgtgcttcagccagacctattgagtcagaattccaggaatgagcctcagcaatctcaccatctgggtgattctgacacacagtagagtttgagaaccactgccttgcttcggcaatcctattaagttggtcgaagtgagacgtcacattaaaaacaaacaaacaaaaaaacctaggctcctagcatgttcaaggaaactccacccaagaaaaatgtgaccttctagtacacttgtgctagaggtttaaaagaacaaatccagcttattttggcatatgctgtcccttatgggatgaaagaaatgggtaactttttttctgcctaagtaagtaaatgatcaatttacagtcctcaatttccttgacacacttgcagcactggacactgttgactactcctttttccctgacagtttttgacctggcttccaggagaccacactgttttggtcttcctctgacttcactggtttctctcttacccagtctccttggctgatttcttcgcaatctgcttcctcccaacctccacatattcaagagcttcacagaaaaggcccaaattctcttccctattcagactcactgcctgagtaatctcttcccatcccacagtctatgtgctcacaattccacaatgtatatattttttttagctcagagctctctctttctctcaaactcctatactgattgtccagcctccaacctgatgtctccacttaagtatataaaatcaaaagctcaaagatgaattattaatcttctaccccaaacctatgtcagccatggcatagctcaggtaatggcaattctttccatagaattagctcaggccaacagcatgggaataatctctgatcactttttttttctcattccttgtatccagtccatcaggaaatcatactggttttactttcaaaatatacctagagtctattgcttcttaccagcttctcccctgctacaaccctggtccaagccacaatcaccttttgcctggattattttcacaacctccacgaggtctcctcacttctactcctgcactcctacagcctatactcaacacagcagctagctgattattttaaaacataatcagatcaggtcactgctctatccaaaaccctgcaaatcattcccagttttgctcagagtgaaatctaaagccctaacaatgacccttgatccccttcctggtttggtgccccaacatgtttcttatctctctacctactactgtatgcacctctttgctccgtctgctctagtgccatgctaacttaattgttgtttcttgaacacacaagacacactttaactttatgggccttgtttttttctagctgatctcactgccaggcctagattttccttagatgtctatgtggccaactccataacctccgtcaagactttgcccaaatgtcgttgcctcaatgatatcaatcctaagccttgtgtttagctttccagtcttctcacctcccagagtgttctatatcctcctgcccttctcttcattttatattttccatagcacttatagcctcttaatttcctagactttgcttacccattatgttcattattatgtttgcgcatttcgtttgattgtattatacgtattgtttgtctcccccattagaatgcaagcaccacaagggcagctgtttttactattttcatgcattgatatttcccaaacaccaggaagagtatttggcaactatcagcattcaagactggaggtctgaactaaagcagcatggcagtgctggataaaatcatgtaggtctatgagtcattcaggaggtagatcaacaattgtcaattatcaacactgagagaaaatgagatgagagagagaaggaggtaaatttgacccttaggtgatgggtgatgatattgtcacacaccgaagcggggatctaagttggagaaactggtttggagtagattatggatcctattgaagtgcctgtgggacattcagttaaagaagcaccttaggcagtgggatatgtggaactgaagtgtgaatatagaggcatatatttgggatacacaaaaatacagacagtaactgaaatgcaggatatttaatgtgtatagtgagaagagaagagggtttgcaatagaatcataaaaaaattatttaatagtaagagaaagtgaggtcaaaatgaagatcattaaatatccagaaagtgagaaggaaaatgtgattattatgggaatataatccatctctctaggatatggatataatccatctttaggatatggattatatgtgatggtggaaggaaaagaaaacaataaacagaaagaggctgaggataaagaagagaaagacaataaaattgatggaatgagaaggtggcgaaacaggatgagatttctagaacatagcaaaggagatgttagtgttaagggtttcagctactcattaaatatatatatctacatttatatatacacacatacatatatacacatatatgtgtatatatatgggcatatgcatgtatacgtatgcacatacacacatacatatgtgtatacacatgtgcacctatctgtacacatacatatattcacatgtacatgtgtatacatgtgtatgtgtatgtatacttacatatactatatgtgtgtatgtgcatgtatacatacatatacacatatatacacccatgtgtatatgtatatacatacacatattgtaggtatatatgtgtatacatgtatgtatgtatatacatatatatacacacaaagtttatttcaaattgcaaaaaagtatgtgattactgtataagaaaatgatagagacagttaattattattcccattgttcaaagtacttttgcatggagcaggaatggtggacataaaagtgccatgtgatgcttcaatagcacaaaccttctccaaatcagagctatacagcctccatgaaatattccgtggtagtctagtttactgaagacctcttcttaaacacacacactcacacatacacaatcacatgaatataatcacatcaaagcttggcactttccattcaacactcctgaattaaaatgttcattatttactataaaaatctggacacggaaaatgacttcagtactctgttcaaaaagaaactggggaaaggttttattgaaaaaggcaagggccgggcacggtgactcacgcctgtaatcccagcactttgggaggccgaggcgggcggatcacaaggtcaggagatcgagaccatcctggctaatgtggtgaaaccccgtatctactaaaaaaatataaaaaattagctgggcatggtggcgggcacctgtagtcccagctactcgggaggctgagggcaggagaatggcatgaacccgggaggcagagcttgcagtgagccgagatcgcgccactgcactccagcctgggcgacagagcgagactctgtctcaaaaaaaaaaaagaaaagggcgagtaagagagctgtattgttcatctacccacatctattctttagatggtatttttctctcagttccttaataccttacatactcattgtgacactgagaattttccaccataaaccttaaatccaagactttttctttgcctttagttataccaaatagctgacttcattatgccttccttgcttgcttataatttgaggagcaattttattatgtaatcaggttaactactaaatacataagtaaaatggggactgaaaatttattatttacttagaaaaaaaaggtttcccataaaggggtgttatgtaccacaaagtacactcccttcattttccttgaacctttatcacaaattgtactagaagagtcactcacattttcctgaagtggagtctctgaaaatccacagggcctagggtactttaagaatatataagtcagtctgagtatggtggtttatgcctgtaatcccagcactttgggaagccaaggcaggggggttgtttgagtctagtagatagggccagctgggcaacacagtgagaccccgtctctacaaaaaatacaaaaatcagctgagtgtggtggtgaacacctgtagtcccagctactcaggaggctggggtgggaggattgcttgagcctgggaggcagaggttgcagtgagccgtgagtgtgccactgcattccagcctgggcaaaagtgcaagactctctctttctttctttctttctttctttctttctttctttctttctttctttctttctttctttctttctttctttcttcctctctctctctctctctctctctctctctctctctctatatatatatatatatatatatatatagagagagagagagagagagagagagactgtcagtatatctagctggactgtcagtatatctatatatttgtcaataaaatttattctcttatcctataacaacacagcttccatcccagttcctggggattgggggataagcccaaatgacaggaacagcgtgtattatcagggttctccagaaggacagaactaataggattgatgtatatataaaggggagattattaaagagtattgactcacacaatcacaatgtgaaatgccacaataggctgtctgcaagctgaggagcaaggaagccaagtctgagtcctaaaacctcaaaagtagggaagccagcagtgcggccttcagtctgcagccgaaagcccaagagcccctggaaaaccactggtttaagtccaagagtccaaaagctgaaaaacttggagtctgatgtttgagggcaggaagcatccagcacaaaagatgaaggctggaagactcagcaagccagctccttccaccgtcttctgcctgctttttctagctggctggtagctggttggatggtgcccacccacattgtgggtaggtcttcctgagggtgggtcttcctctccctgtccactgactcaaatattaatctcttctggcaacacccagaaatgctcagatacacccagaaacaataattagcatccttcaatccaatcaagttgacacttaatattaaccatcgcagggcagaatttcagccagtgtggagcccatagagtgtgctgcaggagtgtctgtaatggagcatggccagggtcccccacactcctaggctttacttgctcccataggagactttagccttagggaaagtattagacccgaaccctgcggggcagtcttgaaaatgagatgaggtcagtccaacctgagcatccctttgtctgctggcctcttctggggcccagactggttgcacttgcttgcagtgcagcccccaagtacctcctgggagccttcattatagctcctgagctggtggacttcacctgaccaatacagtgctccaacagagcagccctcatggacatgtactagcctgcccgttccctcccaagtgcagcctctcccataccattttgctgatatacactcacccatgatcacccctgactttgccttgtttgcattcctcccccaccaatgtgcatgtgcacacgcaccctagcatgccactactgctggcatgagtgcacatcacgcccctcctccctgccacactgccactgtcattgaagtgtttgcaggcagagggcccaccagcccagctcctgctagtgccttgctcctgtgcccgtgccaacactgttgctgacgtaacactagccatggagaacagcagactcacccctgccctgagtggccactgccatccacatgaatgtgcagagggcacacatggtcctgcacccaccagtcccctatccccatgctaacatcacaatcggcatgaaagcatacagtcaccagcaggggccccctgtcccatagaattgtgctgccactactgctgctgggaacacctgcacagaggctggcacctcagcacctgctagtaccttgctgaagctgacaagcatgcaccccacctcactgctgctgctgcttctggtggcatgtgtgagctgctgctgctggtggcatgtgtgaatgaggaggaatcctgctgccactgcactgcagaatgctttggctggcaccacccatcagaatgctgtgaccagcagtctgggagcaccttggtccctccagcacatcaggttcctaaccttgaggagccagggaacaaagtcaggacctgagacctgtccctttgcactagtgcatgcagttcaggagtcctgagctgagccttggccttctaatatcttccagaaaagaagccagtaaatcaaacccaccttataccacaatcaaacccccaaagtcatcaaatagaataaaaggaacaaaatcccattcaaaggacaacaacttcaaagactgaaggaatatcagcctataaaaatgagaaagaaccagcatgagaactatgacaactcaaaaagccagaatgtcttctttcctccaaatgactgcattagctttccagcaagagttcttaatcaggctgatatggctgaaatgacagaaatagaattcagaaatatggataggaatgaagatcactgagattcaggagaacgttgaaactgaacctaaggaagctaagaatcacaataaaaggatacaggaactgacagacaatatagccagtatagaaaaaaatgtaaccaaccgaatagacctgaaaatgctttaaaagaatctcataatgtaattgcaagtattaacaacagaatagaccaagctgaggaaagaactcagagcttggagactggctttctgaataagacagtcaagaagaataaggaaaagagaatgaaaagaaatgaacaaaacccctgagaaatatgggattatgtaaagagaccaaatctatgacttgtttgcattaatgaaaaggattaggagaatggaagcaacttagaaaacatatttcaggatatcattcatgagaacttccacaagctagctagagaggccaactttcaaaatcaggaaatgcacagacccctgaaaaatacttcacaagaagatcatccctaagacacatggtcgtcgactctccaaggtcaaaataatctgtacaatgcgtccttcactttcttcctttcctccccacccctcactgttcaacagataacctgagtgcattcagtttgtaaagcacagtgctggggccgtgaaagccagagacgaatcagacaacacacaaccactctcaaagagattcagggatcccaggagggaagaaaggaacatcagtaagcacaacgccccgcaagcctgggtttcacatctgtttagcagcagcatgaccttaaggaggtcactaacaggtcaacgcctcagcttcttccactgaaaaacaggaatggtcacttctgcgtcactgaattacctctcactgaattacctcgaaggtgaaaaggagctggtgatgtctggtgctcctgtcctggctgacacagctaggtcctcagcattggctattattgcctgcaagacggggagtagtgaggggcttcaggcactcaggaaacccagaactcccacaagtgggcagggcaaagtaggcaaaatttcagggaggaggcggtctagagcagatcacggagagggaagctccaggcttaggagacagacactctgcaagagaacaccgcggaggacgaaacagcagagcaacagcaagcagcgcctctggctggagctgtgcctttcaaggagccgcagtaggaaccacgctcctcttggggtggcagagggatgggcaggaccatgcttgggctccctgttccaccgcctccaaagacgacatccccattccccatgagaatgtttcctatgaagccaggctggcccttgacctctgcagggctgccactggccctggcccatcatcatgccagtccctagaggctgatggtgagaagggagcagaaagcgcccactcctgacccagattcgctgcttctcctcccctgcctctgtcatgaccccagggaagcaaaccctgaaccggggctctcgccttcacctttaccttctccattctgggataaaagaccacacattggatgtagtgtacactgctccccaaaaccattgaaataaaaaataaagaatgatctgctcattatgcaggccacttgggggccaccagatgccaatgagtagaaggagagagaaggacagatggaggaagtaaggacaaggggaaaggggaagggagaaagggagaagaaaggaaggggagtggggaaagaaggagaaagagagggaggaaaggaccaagagccttgcagagaaaattccccctttttctaaggaaaggtgctgggcagtggtgcagcttcttgggtgaagatgttgggcaggggctgacgggaaaaggcagataacagcatccaaacttccacacacgaagtctgtcccctcctcttccccgtgccgtctcaacaacccccatcccccgccctgccttgtcatctatatcttgggaagcaggtgacatatctggcccaatattttggggcctagcttctcccaggtgtggagggggcagatgcagggacaggaagaagtggctgggaggggctggagggtggggctgaagagagcctgggaggtgcttgtcattccctccagtctctgcaagctcccccactgcgacagagcaggaggagagagcatagccaggaatgctaatttgccaggagctcacctgcctgcgtcacaaggcacaggtgccaatgaggccagggtccagtctggggcatgagatggggtggtggggaggagagagacagtctctcctctacccacctgtctcttctgtgcaggtggtttccgagcaggtgaagcacatttaaagggggaggttctaaactggtcacagtcccattgaaaaagcccatgggaaatgaaaagcccacacactcgcccattccattgccacaggcagggggcaggtggaggaggagcggtgggtgctccccacaccactcccaattatcaccgactcctccctttccttcattctccttcccaatctgtcagtgtatcctgtggttggtccctttgaatgtctcacccagccctccttgcttgcaagtcccctgattgcagcctcatccccgccatgtcctgactacagcaacagcctctgggtgtctctgccatctgctctctctctcccttcttgtcccctttgtgacaggtgcttgatgaaccttccccaaactcttctgacccatccctgccctgctcaggacccaatcacagttccctcaccctcctgaatcaaacctgaagtcctgtcctgagtaccccatgggccttaacttactcatcccaacttcactcattgccttgccccacaccctgccagggagcctcccatggcaccgtggaggacgcagaggaaccaaggcaaagctcctgtggcaccatccagagagaccaggcccacaggcatgtggaaagtcagcctccaaccccctgctctgcagggaaggagctgagtgcaagggagaggcagcgctgtctgtgcttcccgtgcagaagtcccagccccagcccctgtgcaggccggcctccccggcagcctgtcatactccgagttcccagccactttcaggcttctctccaagcctgtggcctccatttctagaccccaccccgggacctgcacaccagcctcgctaccttagccccctcctccaggagcctgccctgtgtggagtaggcacatggttttcctctccagcacccattgcctccttactcaagcaatggccctgtttcctctggggaatccatctcaattcatgagcatcagatcagactgcccccagagctcctcagtctaagccaatcagtgtgtcatagtccccagcctcagtgatggattctgggacagacacgaggaccaagccaggtgggatgagtgagtgtggcttctggaggaagtggggacaaaggagagcattctttcctgccagacctaaccctgggtcatgagtccagccccactggttgtcacctcgccaccacgagagcaaggcctgtctgggaatgtagccagcccaaaagaagcaagctgacatggaaggaaagcaaaccaggcctggatgacgtcgtgtaagccctggaactccgaagcctgctctactgattagttactttttgctcaacctggtctggagagttccgactgacagggtgccaccaatttttagtgatttctctcccctctagacccctggaagcctgtgcgattcatgctatgcaatgaagaatcagcctcgccctgtgctctcccattccggcctctaagctcctaaggacaccgtgttggccacatctttggtgtctctcagggtccagcacaatggggagcacacggtgggagatggatgtggtgacctggaactcaggtgtgagggagctgggacacaggcccaggattcctgagagacatcctcccctccctgggccatgcgagccacttggagaacctgcacccactctcaacgaactcagcactcccttccccaggatatgccttcctgccttctcctcatcccatccctgggcaggggacatgcaactgtctacaggtgcctagtaccaggatgggaaaggaaagccaccaaaatctaaggctgccctcagagaagggcaagcatgcagtcctcatcttgatgaggaaacagtttctgagggaatagttttcccctccattccaagcgttggacatgaggcggccataatcaggggctgatggctcttaaagacttccgtcctcttgccgaggcatcccttgggcacatttagcataacaataagcacaaaggagcgtccaacactttctgtaactgttggtagcaagttgatgaatggccaccattcaatgggcagtcaacgagtagagattatcaacaggcaagagctagcatttcctgaaggcttcctaggtgccaggcactgttccattcctttgcatgttttaatttatgtaatctttgcaacagttctatcaggaagatgccatgattaccacagtttcacagatgaggacattgaggcttagagggattgagtaagttgccaagggaacagagcaagcaaacagggaagccagatttgagccaaggcatcagctccaaggcaacctctcagccagttcagtgcaaagcctcttgtttacagggactttctagacaggcttgaagcaggccagtgagtcagtgggcaggggagaggcagaatagttaagaggatctggaggcaatgactatgcttcatcccccattttttagtttgggagggcttccaggaagaggtgggcttccagttcatgacagaagaggaggctgcacagtgaaggagcagggactccaggtctggtgacaatcaggtgtgggccagggtgagggtggcttgcatcaggagagggatctgagtcaggcagtcacatacttcgtgctggggtccctcaagaggcacagcctgaggtcccgggaagaagaccaagcctcatttcaggttgcttgcggccaaagacaggacctgtgtacccaacaacccctgggacctttgcaggaaacagcaaacactattcactcactcgagttagataaacactgagtgaaaagtcactggagccaaaggactgtgcggggtcagcgctgccgatacaagaactgcagccctccagctcggcttcctcaacggcctctctgcgctgcagccacactggcctcctttcaggtcctccacctcagggctgtaggtcatgtgcttccttctttctggaatgttctccctgacctacccactcaccctcaggttttaccacaaatgctatttcctcacatccaccttccctgacccagccaggccccccatgatgagcctcgcagaacctcatctcccctccacagaggtgatcataacccacagaacccagggccacgatccctggctttgaaccctggctctgccactcagctaagtctctgtctttctgtgcctcggtttcctcatctataaaatggagataacagcagtgcctgctcataaaatgtggtgagggttaaatgagttaaggcactcagatcaatggtggagcatggttaatgctatatgcatattagtgaatattataaataggctttatcacaactgtaactaaacaactgctcatgcattggttatttaggtctgtctctcctgccagaatatgcactccagttggacagggacgctgccttattcatcactggatctatagagatttgctcagtgcctcgctcacagtcactgttgggtaaatattttctggctgcaggaaagagtgaaggactagccccctcgccgtgggaggaagagcgtgagttgggagagcagagccaccacaggaaaccagggggcaaagtggggtggaaggcagtgagctctcaggctctcaggagcaaaagcttccaagctgggctctcaccttggcccctcccacccagggaagacagctgggtcttccaggaccaggaatccccaaaggggctgctcccagagggtgtattgctgggactggagagaggactgcccagaaccaccccctctgatcaggtgggggtgggtggcagctcccacctactgaagatgtctctggagaccttctgcaggcactgccaggcatctgccacctgccggacggtctcctctcactgcaggtctggtgggatgacgggcaaggcataggtctgacctgccagggaatgctgggtcctcgcaggagtcgtggtgcctgtgggtagcatcagagccacccacgcccaccggcacccactcaccacaggtagcatggtgttgagacagcacagccctcatcccaactgtgtgcacagcttcggggaggtggggagggggatgggagacaaagcatttggtgggaggccaggagctcataggagatgggattctgctgatgcctgctgagtgaatgagggagggagggggcaggacaagggactggggatttggtagggacaatggaggagctcggagaagaggcaacatttcttcaatccttataaggtgctgggtacctgccaggaaccctgtccatacacgatctcagttcagctcctcaccttgggtacacaagaaaggatccctggctgaagagggaaatagaggctggaaacaggggtacatgggcagggtggtggtggtgagagaattgcccgaatcagctgccaaatggtgcccaggttggaaacgcaaatgtgcacacatgggttcttcccactctaaccctgaggaattcgaggcctgcttctgacacagactgggcagtggctagtgactctaggtatagagtgtccagaccctgctcacccaggctagagcttagggagccagaaggaaggaggtgcatgtgggggtgcgggacaggagggaaaaacactccttaaattgcaaagtgagggcagaatctatttacattgggttgaattaactcctccccttgatgccactaaagcaggaatcacactgcagatggcactgatttgattggcaagagacatgccaggaagaatattaagggaccaggcccctataattaggcctaatcgtagcctgttgtttgaaaagggtatgaaggacattcatcaggcttggcactgtgccctagacctgctctcctgggtagtggggccctccattgcaacagaggtgtgggtgggcctgggagagtgtggcaagaaatgcttaggaggctctacttggccttaaagggctgtgtgaccttgggtaaattgccttctttgaatctctggtcctttccatttcccattctccaggctaagagctgcactctgatacacggttattcccaataataataaccatccaccccgtgcagtggtcataaaccagagagagaaatgtccacatgaaactaggtgctgcatgctggccatcactcatggatcattaatgaaaactaacttggaatcactattttaaggacaggatggtggggaggcatgcttgtaaacagagcccttggcgactcaattcatctgcaactcatttttcatatatgttaaatgtatcccttcaagatcattgcaaagaaaaactaagttaacataagaaacagtgcctggtggctagtgaacattctacaggtgttggatgctgttgtcatcattgttatcattatcagaatggacaagacagaaccccacagtcattcatttcagctctctttttggtgaagaaatgtgttgagcatttagctggaaacctggcacttaggcacaaggttggtgtagaaggcacctgcagacctgacccaggcgcaaggctaggcacccttgtccagttctctgctgacttacaggcagttctccctcactgctcctcacctccagaataaggagactccttcagctttgaagatgtgggaagagcaggggtgagggcaaggaagaggatgtctgagcattgaaaaggccaagaaaagaggctggagccctgaaggcaatcagcacctgttcccaagaatgcaaggctgggccttctcccctctcagacacatccatcatctgtcaagatcagccactcagagccctcaaccttgccccctcctccttcagaccccatggtacactcacaccaaggagggtgtcacagtgcagggatttcatccccagggcagctcattgctgggaaggccacagcacccagctccctctgctgccagattccaggccctgtggacagcatgtgtcacacagcaggtgcacacttactgtcatctcccttccttagtcctggaggtggtctctgctgtggctctgcatgccaccaatgctctctgaccatctctaacggcagcctttgatctcaaaaatgccccagcctctaagtaacccatggcagtatgaagccaacaatgaggaatttcttccgagctctctcctggagatggggtggcgggagggcatgcctgcgactgagataactcccaaagcacagcagggaaggaagaggagaacaatgaggaagaaagggagctgagaagggaggggaagcagacaggagatgaggcggtgcatggaagagagcctggtgccacccccataggctaccctatcacctcagtccctcccagcatccaaggcccttcctcagggctgctgtgcctatcacggccactaacctggctgctccctgagcctggcagccaacaatcacacagaagaagtccaagagcccagctctgcacaccttcagcactcctgtcacagcagcgggaaagggttctggtgtcatggacctggtgccttgagccaacctgggatgggcaatgtctgtggccactaagaagctgacctcagcatggtccggctgggactagaatgggagcagagacggggcttctcgagtctatctgtgcggtgggaaggtcttcctgtgtgtgtggctgcaggtggatctaggaaagggggataaaggccctgccttcagggcaccccaactctactggggagactcactctgacacatgaagcacaccagacatccaagaggcacatgaaatggtgagacatgacgggtgaatacaaaaagccaggaactccattctggaaaaacaggactgatggcattggatcaagtctgcaaaatcacaaaggacaataaagagaactgacacagacctgaaacagaaccccaggcatcccttgaagctcaaaagaatgatctaaggacaaataaacggcagttgagttttacacaacgggcaaaggcaaggagttccttaccgtggggatgacacaggataaaacatggctgagaccaggagaactcagataaactcgtgggagaaccacaatgtgctgtggaggggagcaggcatgcgggtacactcctgacctccacagacggcccctaccaccaggcctgatggagctgcctacctagcatgggtaggcctcattccttcagagaaatggaagaaattttaatttctttaaaataaaatcctttaattttaagagacttaaaatgaaaacctttaagccagccctgcccttgtgtgtgctgagttccagaaccaggcactgccagtgagcagcagagggaatgcacctgcctaggctggaggggagcagggcctgggggtgtgggtggtgtttgctattcttcccaggatcactgagcacctaggtgagctgagctaccggagtccttggaaagacccagtgcccttcttcttagggtcaagaaggaaggcacaaagagggagagaggctcagcagaagaggcccctaagctcccaaggcaggctgctggatgctgagagatgaggccaccaggtcaactgccctaggaggggaaggggaggggagagccctggcaaggaagcccccaaggctactgactccacaggaatcatctcctgagcctggctggggtggtgtgagcctagtgaaccacacgcgctcctttctctgctactccagcaggaactggccgctgtgaaccctcttcccacattagccggctctcacactgtgactaaagagaccagccaccacatggtcccggttacaggggcagctggggccttgccatctggcaggacctgctgccactggcgctcgctgtctgtgagcacagggtctggtgggcaggaggtgactggagggcatgtcttcccaaaggagagctcgccaggccactcctcagaggccccagcccacaccaccagctgcctctgctcctcccaactgtgcacctcgtgccatcgagggagggctgggacccagctccagggctgcggctggcagagaaggacctggcctcctgcccactgggacagagaggtagcgggtgggaattctaccttcctcacctcccgagatgtccacaggctttggggaaatggttgaggggctttggaagttcagggaaagaaaaggaggcccaggaagaggatgaggccagcctggacttgttcatccacagggaccagggtccatgtggctgacagtctcttggggaggggacgggactctgggtcaagaagcctaagtcatagacatagtcatctccctgcctctgcgcagactgctggggtcaaaaacagcatcacgtaagcaccctccaccttggagtgcactgtttggggcaaggtgcccccagacaggccctgttgctaacacttacacccagcagttccgatggacaagctgtaaggacagcctcgccccaggtgccaggcaccagagaacttacaactgacagccaaggccagctggtaagcccttggttcccagcgagagagcctgtgagcacagtggagcctcaggacagcacgatcagagctggcttctcaaaggcggtgcccttgagctcagtcacctctcgcccctttgccgcccattgctggcacctggcttgggctctccgtctgcccaacagctcacttcagaggaaacaggaaaccaacggggccttcgctgccctcctcagccaaacccatgcaaggccagcccatggaaagggagccagggagggtgagagtggaggggcagaggcctggctgcttctcctgctgtgatctgggcacacactaagctgcttagccaacagctctatctcctgggctcagggctcagccatgtgaggaggaagggatcagtacagccctgaggaagagtgaggacctcaagtcagccagagctggtgccccacaaactgctgtggaacgcgagcaacttacttaactactctgagcccccttatgtgcaaaataggaacaacaaacaggagctcccacctcctggggttgtatcggaaattcagtgaggtggtaaagcaccccgctccacgcctggcctatgagagatgctccacaaacggtggctgtgatggcagtggggtcaccaccacatgatggctgagcccagcagacaataagacatggaaatcaaccactgcgcagccactcgcaacaaggaagaaggtggaaaagctcatgagaaacaaacatccttatgacaggcttgcagggacgcctctgtattcagttatttttttctgctttggtttttgtgtttgtttgtttgtttgtttgatttcctgagatggagttttgctcttgttgtccaggctggagtgcagtggcacaatctcggctcaccacaacctccgcctcccaggttcaagcgattatcctgcctcagcctcccaagtagctgggattacaggatgcccggctaattttgtatttttagtagatatggggtttctccatgttggtcaggctggtctcgaactcccaacctcaggttatccacccgcctcagcctcccaaagtgctgggattacaggtgtgagccaccatgcccggcctctgctttggtttttaagactcaacaatgatagcctccttcattcccccaaatataccacccacaccccagctttctcaggctgattcagaggctgtgctacgaggcctctggggacccagttctccacagaactcctggctgaataccctgcctcagagtccctctaggacaggcccacacttcacttctgcgcaattgggaatgtgcgtgaggtacgggtgcggccgccatagaaggaaaggccccgggcctgggtcaagcccagcgactactggagccccttgttcgtctgttacatcctctgctggcaggcaaaggggaaagaaaactcctggccatcggggcacccagattctactctgggctctttccagaactggccatgggagcttgggcaggctgtgtcgcatgtctaggctgttgctccttatctgcagaatgggagccgtgctcactggtggatggaggaggggacaggggacagactgggtggcatcccagggctccaggcattggacagaaggcatgtccagggcctgggccatgcccaaaacaacctagagcagggcaagtggcagagcccctcccaggctgctggcaagggccccctggccctaaagcagcccatcctcatcccaccccggctagtgactttgaaagagcagcttctagatgctcagccaactacacacaaaggcttctccctactgggaacaaagtaagaataacgccaccctcacgggaccaaggaagctctgagaggggatccatgaagccagcctcgggaaccagaggaggcaggggggcggcgagagggctgggcagcagaatgttggctcgcctgattagctgaccccacccagaagaagacggaggattctagttctttaagggaactggcagacttcttctctaggagccctctacctcctgggccccaactctgaagcagctgcctggcagagacagtgaggagggtgcagggagaggactttgccctccactgctctccagccaggacacggccccggctggcagcctttcattctatactgagccaagagacacacaccagagccccaggctggccatgccccaccgcctctccagccccactgggcacactggtaagtctggggcctctgcccacagtcagggcctatcgtggcctggagcccacacctaccacactgactacagcaggactgagggcactcatggtatctcatggaaaacaaactgaggcccaggaggaaaatgtttgtttaaaattttgcacgccatttctccagggccactaagccaggtccacttactttgattactctttagtgctctccttccagccatatgaggaaaacatatatgttttcaaaacttaggaaaatactgtattctatttttcctcacttgaaattacatggacacacctgcaactgtatgtgttttttaaaactccaagaactgtacaccaaaaagagcaaacttaaagctgggagttgtggctcacgcctataatcccagcactttgggaggctgaggtgggtgagtcgcttaagcccaggagtctgagacaagtctggacaacatggcgaaacctgtctctacaaaaaccacaaaaattagctaggcatgttggtgcgcacctgtaatcccagctactggggaggctgaggcttgagtccaggagattaaagctacagtgagctgagatggtgccactacacctccagcccgggcaacagagccagaccctgtctcaaaaaataaattaataaataaataaaaagagaaaactttaaggcatgtatgttggtaatacaatacataattatacatatatacatagtatgtaaacttcacagtgcattgagaacattttccctgtgtcatttaatagtttcccaaacccactcatccatgcacataccatactttatttaaaatgttcccctaatgggccaggtgcaatggctcatgcctgtaatcccagcactttgggaggccaaggtgggtggatcacatggtcaggagttcaagactagcctggccaacatggtgaaaccccatgcctactaaaaatacaaaaattagctgggcatgctggcatgcacatgtaatcctagctactcaagaggctgaggcaggagaattgcttgaacctgggaggcagaggttgcagtgagctgagatcacacaattgcatgttaacctggcaacatagtgagactctgtcccaaaaaataaaaagtaaataaataaaatgttcccataatgtaagaaatttaaattgtttttgattttcctttattataaattgctctttaatgagcactctaacacataagatatttgatagcttttcttattattttcttaatatggagttttagaagtgcagttactggtccaaagatatgcctttagtgcccttagccttagttcttaaggcttgtagtaccctttgcaaagaggcttttctcaaaggttttgacacgctatactccaccagtgctggagtagagggctgcatcatgttagcagttatcagcttaaaaatctgtgcacatttggaaggcaagatggcatgcacctgtagtcccagctactagggaggctgaggcagaagaatcacttgaggccagaaatttgagcctgcagtagctatgattgcaccactgcactccagcctgagcaacaaggtgagatcctatctctataaaaaaaagaataataataaagaaaaaagaaaggcaaaaagtagtatactattgttgccataatttggatttctttgattactagtgatgttctgcattccttctcatgtttattgattgctaatatttcatgtacaaacctagttacagcaacaaccagcaagccacaactctcaaacatccttgccatcttagtgccattgctgtaatatataaaacacacattaaaccacagcagttaatattgtgctcgtggttaataccacagtgcagtagagacaggctggcatagcgtgagaagcagaggttccaagccagacagccctgggtttaaatgtctcctccctcatggaccagccatgtgaccttggcaaagtaacttaaccgctcttaccttgggtgtcatctgctgtggagctataaaatgaaacagtcatcacttccttccagggccccatgagaatcaggtgaggatgacacaggggaggcaggtacacacggccacacacccgaggggactcagcagggggcagtaatgaccacaggggacactactaaagggctgagtatgcagagctcccatcccggagagaaggggggaagaggatgatgccagtgatactgggctgtattgttaggtcactaaagtccagtgtggcatccaaaagtgtgcctgtcagaccgagtcttcccgtcgagtacgctttacagagggcctcatcctctgagggctgaccgtgggaaggcagggaactggacccaaagatcctggcttttcctccccaggagaccagggataagctcagcatccccatacactgaaggcagcaggaagctggctgtctaacacctctcttgctttgtaagagggtccttcctaatgcagagctggggaaaggagagacgctgggaggggctagcatgccgcaccagggaaaggctggtgctctcagcggtggctggctctgcctgcagctacgtgactgagagaagaaagtcattcagagaaatcccaagacacagagagcagcatcgtggcttagatccctcttgcctccctcctccgagggctggcagtggggagtgtatatacctccgaaaatgagagctggctaatagcaggaagcccagggcctctgcacctacttacctcccaccagaagaaagcaccattcctcagcaccacccccatcaactcaggcccaggaacaggtgaatccacccagccagacacaagcaggcggggaaagatgcagggagataccccacctgcgtatctccttaaatctgctttaaaatcttccaggaggctggcagatcactggagctcaggagttccagaccagtccggccaacatggtgaaacccatctctactaaaaatacaaaacttagtcagatgcggtgtcacgcccgtaatcccagctactcgggaggctgagacacaagaatcaaacccaggaggtggaagttgcagtgagctgagatcgcactactgcactccaaactgggaaacagaatgagacctcagctcaaataaataaaatgctccaggagggaaaaaaaaaaggagtgagagtagatggaataaagtcacagtagaatgtggcatcaggtgagggtgacataggggttcactacattattcaccatatttttgtgcatgtttaaatattcccacaatatataaaagctaagaggaaaaaggcgagtaatagaaacagggggactacataaggtcatgatgcctgtccctctttgtcaaacttctctgtacctcttatcttggagatgccctccctgttcctgccctacagccagcattcttttgcctttattccatttcacaatttccacatccctggctgttttcctcacccccactcagctccttgcttatcgccttcttcttcaccctccttgtcacgaccctgtcagaagctctgataaccctccaagaagaccaagtccaagagagcagaccaggaaccaggactcctgggtttcagccccagcaacgccactgtctgcacctatgcaactaacccctacccagttcacatcacatgaaagcccagcagagcccccaaagagatgttcagaagtcactgctgctgctacttctacaaggcaaacaaaggagagcccccatccctcagaacctgtttgctgggatccacctcaggcagcagaacagggacatggaccaggctgcctggcagggcaccacggagggctggggaaatgggaatatagatgccatgatgatcatattaatgagggtaaaaattaggaccaacaggggacgtcccctctgcacatgtgtacaagtgtgtgcctttcacagacaatagaggctgaagtcagggaggcagcatgcacaggcaggcctggctcagacaggggccacgtcccagtcagacagtctcctgccacgcgttcccagcaaggatgtgaaaacagccctgccactcgctttccacccacacccctccatgccttgcctttctccctctttttcatgagggaggagagtgtgctcgccctcttctctcccaggatgacagtcaggcctggaaaacagaaggcaggaccaagggacaaatcagggtgccctcaggtctaatgccagccatgtcctgccatactgggtgcctgcggaacccacatacccctctccaggctgagaagatggccacctgacctcctttgggaggtcattcctttggggtggtcatgttttgggggaaaccagagagaacctgaagtgaggaaacagcttggggatgaaggtgctgtacagacaccgggccagtcccgccggctactcatgtttactatgcacagccagcacacccatgggcgaaagaccttcggtgccccctgctcctaagagctaagcactaaatagtgcatccgctgctgctccctgctaactctcccaatggaccctcacgctgccccactagggactgggatttgaagaggtaacctttaactccattgttgagtgaggaaataagggcaagggattttaccctaaaatagggaatatagactagttggccttgggatctaaagccaggagtcccgactcccagccagggctctccccatgagacatgggagagttggccaagctttctggggaagagcaccatctggggttcggttttcctagctagccaaggagaaggagccggccctgacaaactcagtgacattcacacagggcatcgtgggaacaaataaaagccacaaaccacaattcaacacaaagcaggctggatcctggcagctgcagactgatcagcccaatatgtcccgggggtggggcaggagaggactctgagatgcccgggaaggacatttgtcatgccagccagaccaaggctgccccgcagagtgagagcaacaaaggatgcagatccaggaccaggatcacaggcttagctcagctgcttctaaccaggagccttggacagatcacttggcctctctgactctcagtttttctacctatagagtggggataatgcatcttccttacaggaacaatagaagtgctttgtaaaccataaacagcacaggaaaatgaaggaatatcctagtcctcttgaggattagagggggagggaagaggagggaaggaagagaaaaaggtaggaaaggatccaaaatgaggctgagattttgaaacccaacctgctggctttatagccaagcttttcatcatcactggaaactcaaacctgcagcaattatatgctgaggtcataaacgtgattaaaaaggttgtttgcaaagctgattccagggaaatgagctgcagatggcggtggcatcaatgtccttttgcagcaggcagcagctggctgtgtggactcagggacagctggaaggagttgtgctaatgcccacccccagctttggaaggcgggggcaagctgactgccctctctgtgcctggggacaggggagacttgcagagagctgaaaccctaagccataaaaccgccatttgttccagagagaaaagccagtttttcaattccagcccaaccaggagggtgggccaagctcagagaaagaagagtggactgagagcacgagtccttccacggcagcctgcctcgggcgggacaggctgcagtggctctggctgtccactgggagtgtccttggtgagggaggaaagaaggcaaagccacatctgaagtctctcggccagaagaaccctctgttctgaggccaacaggtagccctggtataaggagaaggtggaaaatacaggcaccagaaccttctctgctgcttatggcttcatagaatgttttgcaggtgacatttcacataagtgggcaccagcctgtctgtctttgatggaaagacatcaggaggcaggacccaggtctctgtcagtggcttcctgtcagagtggccaacacgggatacttaaaaatgtgaagaaggagacgtcgatcaggataatacaatgagcccttggcccaaatttgggaagggccctctcttttgatgtatctcactacctcagctgccatccctctcctggtcacttctacccatgcttcagccacagccccacttactccaggaagccctccctgatgagtcacctgcagcaacctcctgtcctgcagatcctcaccccgtactgctcactgccttggctgctgctcccaatcactcatatgcgtgcccatgtctgtctgacaactgggcgctccctaatggcagaagcacatccatatgacatttctcaaatgttccctatagtacagggaacccagagcacgtccaatgacgttgggatgtgagcctgcagagcttttcacaaatttgcagaacaagctgtgtccttcagcatcattacctgccctccccctccgactgaacctggagaagagtcaacagcctgctaccaaaaatcccccacagcccggactcggatgattcgcctacaaaggctggggagcacagtcccaggcttactaatctcctctctaccccatccccattttttccagtccccagaaagtcccaatcaatctctcagcaaattccacaggatctgtcagattcagatccagtcaactgcaggccgagtgctcttcgcatctcatcttatctactgcaggaagcaacctgagggcagcaaagaggaagacagctggtatgaacgggctctgaaacctaccagctgtgcggcccagagaaagctacctaacctctctgagcttcagctgcttcagctgtaaaatggcaagtataccgcctttctcaggtttactgttgaaatcatgtttgtaaagtgtttataaagtgtttagcactcttagaaagtactcaataatggtaattaacatgaaattatcataccaatctcttcaggtaggtattattgtcttctgtctaccaatgagggtgaaggtcagagacgttaagcaactggttcagagccacacagtatctgctcaggaggcagagctgggggttcagacagagcagcagagcgtgccctcagccctggggaagtttgcaacctcaagtcacagggacagagtagctgtgggaacttgggtcaggtacctccacccctccccaggttcagcagctccccaggaatcctggaacatgaggcatggcctcagcaagtctccatttgagagaatcagctgggatctcccagattaagtgttgttgcaggcagctgggccaaaccgcctgccctggaccctagagctcatcagattggcacctgctcttcccacacaggcaaacacggatggtgccactggccgaaccccgccatcagccttcacacagttgagctcaccaggaaagcagaatctctaaaactccagctgcagtgcaagcccagcccccagggacaccgctgtccacatctgaaatagctggcgatcatcacggggtgggagacaggatgcagtgggcaccttccacattgaaacccactcaattaaaaccccacgtgtgggggacagacacacacgtacccatcacacccagtcttacgtgtccactgagaccctggttacgttagacatggcctcaaaggaagtaggtactttcacaaacatcatctcctttgatcttctcaaccaccctgaggagtatgtacttttgccccactttacagatgaggaaactgagaagacatcaggcaatttttccaacatcacacaaaggataaggaaaatgttaggatgccaaccccatgtctccaggtttctttccactacagcatgctgttcatttgtgatctcgttcattcatccatccttccttccactcattccttcattcactcacctatatttttccctaaacagctacaggtcaccactgtctgggttgtttgctactaccttctgctgctgcctgagaaaacctgggagactgtgatcacattttttttcctgtagagctgcccgaatacagctcttctcaaagccttgcagcagagatgatacagccatcagcagctgatcctggaatgagtgttgagagcagcacagaccactctacgtttctgctctgaccacaggtctggcctagaatttgcccctccactgcacaatgcaggtaaaaacctttaaaaaaataaataaatggtctctgagcctcccagaaatacagcacttagaatgttgtttttggagggggcatgtgataaagaatgggaaagataataaagtagcctgtcacccagctcacaggcaggtgcatgtggctgcaggggatcgtttagtcaatttaatgacatatttgttgagtatctattactgtgcctggtacgggatggagtgggtcagggaataggggagggcacaaagggagtcaaaaagaatagaaagaaagccgtcaaagggctgatggtctggttgagggaaaaagacaggaaccatctgcttagacaacacagatataaagtgtacttgagaaattcagaggatggtaaggtgcctgcaagtggggacacaaaaatttcattcagaccatggaatttcagctagacagggaaggatggccagaatttaaacctgggatggtatagaagaaaattacccaggccaggcgcagtggctcacgcctgtaatcccagcactttggcaggccaaggcgggcggttcacctgaggtcaggagttcaagaccagccccgtctctactaaaaatacaaaaaattagctagccgtggtggcgcacacctatagtcccaactcctcgagaggctgaggcaggagaatcacttgaacccaggaggcagaggttgcagtgagccgagcacgcaccactgcactccagcctgggtaacaagagtgaaactctatctcaaaaaaagaaaagaaattacccaaactgcctgctcaacaccattgctaatgaaaaagcctgccttggtctctccttccctgatcttagcttttctttctatctctgcaaagcctccgtatagaaatctggttttattgtgcctggtaagggtcctagttcagttctaaaacaattaacaaccatgaagggacaaaagtccgaagtgggcatctcgcttatggcacatcagcctctagtcatagtcaccctcagaccccatctagcggctgcccgaattatttcattcagggatctgtgtgtttggctgataaccaggcaccactggcccgtggggtgctatgactattgcagtgttaaaaacaaggcacttggctgggaagacgtctgccgttaagtggcaggctcatggacaacggcctcaaggtatttttccttcagacatttggtcccactttggcaagacatcttggcattgcttgggcaagatattacgctctgcttcttcagagcgttgggtgggagataccccatagacagctgaagggactgggaccttgggaaatcacatttaaaatttttggacttgtttaaaattgtttgacttggtttaaacacagttcaaagcccagctgaggcattaagggtttgtcacctaaggttgtcatctaaaatgggaaatgtgtgctctattcctccttgtggcccggtaggatgtattctgcagaattgggctgcttttagctttgagcttgtgaaaaagaaaaagttttttttattgcaatgcttcctggctataatattccctaggacctggggaatggtagccaggatttggatctttaacgtaaagccaagagctaaagaaaattttagttagttgttagtcatggtggacacatttattggacaggtgcaagcctttccctgccacactgagagggtttcaaaagccttactgaaagaaattttcctcagatttggggttccattccccatacacagtgataacgagagtgcctttattgccactttattgccacttttttttgagacagtgtcccactctgtcacccaggctggagtgcagtggtataatcacagctcacagcagcctcgaccttctgggctcacaggatcctcccacctcaacctcccaagtagctggggctacaggcacgcaccatgtctggctaattttttttttaataggaatgaagtctcactatgctgcctaggctggtctcaaactcctgggctcaagcaatgctccagcctcagccaccccaagcctgttgatttcaccataattaacccactgtctaatttctcattttctgactcaactacaaattactgcataacagaaaaatagcgccgggcgcagtggctcacgcctgtaatcccagcactttgggaggccaaggcaggcagatcacctgaggtccggagttcgagaccagactgaccaacatggagaaaccccatctctactaaaaatacaaaattagccgagcgtggtggcgcatgtctgtaatcccagctactcgggagcctgaggcagcagaatggcttgaacccgggaggcggaggttgctgtgagccgagatcgcgccattgcactccagcctgggcaacaagagtgaaactccatctcaaaaaaaaaaagagagagaaataccattacatgtcccttgcttctaggagctaccttgatcaagtttgccgaagaaggaatcatatgcctcccctttgtttagtttactatcagattgatgggaattctagatgcccttactcttattactgtgattccctaacagcctgttcaggaatgcctccaagctgtatcttggatcgagttaaattcagcaactccttactacaaagcaacactcggaaatagacctaccaggtccttggtttaatccaatccacgaagccctgctacaagattctaaacttaatctatacaatctttctgtgttcctctgtgcatcctcagaatatctatttgtttgtaggggataacaagaaaccctctggatgtatgaatgtattgacagctagcatataggaggaacttgcctgtaaggatactcatttatcccagttttctgtacacaaaactgctgaaaccaagcactggaaaagctccctaaaattacttggtaaaactaaatggtccacaactcactttcgagatatacagattcatacttgcctggtaccaagaagacagagctgggtatttcttcagataaactttgttaccttggcggagaacggtgccccatgagcgcagaattagaaatctctccctttatgaattcttgtcaaggaaattgcaatcgcagcccagcagagaggaattaatgtattgggtcaggttgtcttagataataggatagccctagattacatcttagcggagcagggaggagtatgtatggttgcaaataccgcgtgctatatttacataaacgaatccgtggaggtagaaactcatctaggaaaagttagagagcaagccacttgggtacaacagcctcccagactgtctctgaggactggttttcttttctgttttcttggattcctcgtggaaaacagtctatgttttctgggtggctaaaactaggcatgtcagtcttgttaattgtgcttatgctttctattatgaccaaatgtgcattaaaatgttgtagtgaagctgtgactaaagcaactaatacaatgatagttcagcaccacggtgccatgcctgggactcgtgaatattgtgaactccatgctattatagaaactttctctcttcatatcctagtccccgatctttgccccaattcagcaggaagtagccagagtggtctgttcccctatacccctcaggattgtggagtgacaaggatggaactgagctgcaacaggggcccctttcttaggagcctgaagaccccaagcatgaaaataaagaaaaaccctaagttccttcaagagaaattccaggcacctcactatccccagaagtaaataagaaggtaatagtagcctaaaacaagagccaaggacgtttgagttccagagatgtttgctttccctgtaggaactaaagacaacagctgaacatacgtccttgagttgtctttcagaaacccccactgaggaaccacaccgaacagatccactggcatttagacctcagataagggggaaactgaagataaaacttcttcctgatggggcttagagaaagtcacaccccatcccagccagttaacatttttctgcagatcccaaatttttaaacaaagcttctcttctttaaccagttgcaaatccgaaaatcttcgaatctacctatgacctgtaagcccccctcaagatatcctccccttttaggcctaagtcaatgtgtaatctccatgtattgatttacgattttgcctgtagcttctgctttcctgaaatttactcctgcctttaaaaacccttgcctgcaaaccattgggaaggtcaggatttgagcatttaactgcttggtcctctttgcttggtgccctgcaaatgaacacttttctgtcactgcaaaacctcagggtagatgtctggttttactgcaccaggcaagcagaccccagttcactataacagaaggcggtgaggaagaacttaggtttttattccgagtttagcgggaagcagaggctattaagctgagttacgacatagtctcaccattttagtccaagtcttagtcctagcaaaacactttggctgctgtgtggaataacgcttataagaaaacaagcatgaagccgaaagggaagtaagggcctgggcgcggtggttcatgcctataatcccagcactttgagaagccaaggtgggaggattgcttgagctcaggagttcaagaccagcctaggcaacatggcgggaccccgtctctacaaaaaatttaaaagttagctacacatggtgctgcatgcctgtggtcccagatactcaggaggctgaggtgggaggattgcttgagcccagaaggttgaagttgcattaagccatattcacgccactgcgctcccgcctgggcaatagagcaaaagcttgtctcaaaaaaaaatttgtttaaagacaagtaagggaaatcttccagtattctaggtgagaggtgatactctagactaggttgaaagcactggtaataaagaatagtggatggaccggggatatattttgggagtagggccagaagaatttgctgaatgcctggatggggaaaacaagcaccagggagagctcatgagtgtctagctagagctacggaagaagatgggagaggggcaaggcaaagggtcgaaatcaagagttctctttggttcaggtaaatccaagatgaaattagatgtctggacaacatgccgaaaagaagaaaaaaaagaaaagagaaattagatattgaggtggaaatgccaagtgggcagatggatacacccatcctgagttctgaggagaagtctgccctagaggctatggacaaatctacgcaaagatgacacttagcatccaagaattgcagaagattagccacggagggagtgcaggtgggaaagacgacccaggcctgagcccagatggaggggcctggcagaagcagaggagcagttgccaccagggcagctctgcagaaccatctgaacttgacaaaaccccagaggcagcagtagggagccacagatatgactgggattaagcttcatacctgggctgaatgaaggcttagagtcagaaatgttccctgttacagaaaaattttaaacttgtacttcttggccaggtgtggtggctcaggcctatgattccaacattttgagaggccaaagtaggagaattgcctgagcccagaagttcaagaccagcctaggcaacatagggagaccctgactctacaaaaaatttaaaaattagctgggtgtggtggtgcacacctgtggtcccagctgctcaggaggctgaggtgggaggatcacctgagcccagaaggtcaaggctgcattaagatgtgatcattccactgcactcgagcctgggcaacagagcaaggccctgtttaaaaataataataaatttttaaaaaatatatgtgttttgagacagagtctcactctgtcgcccaagctggagtgcagtgacacgatctctgctcacggcaacctccacctcccaggttcaagcctttctcctgcctcagccccccaagtagctgggcccacaggcacctgccaccacacccagctgatttctgtatttttagtagagatggggtttcaccatgttggccaggctggtctcgaactcctgacctcaggtgatccacccgcctcagcttcccaaagtgctgggattacaggtgtaagccaccgcgcctggcctaaaataaaaactttaagttgtacttcttgcatacctgagtctgaggaatgagatttatatccactactcataaaaataattacataaaattttatatatacataattaactaggttatgtatatgtctttatatgagtgtcacaaaataatcagtgccctgaaggcaaagaaagaactaggaaggagaatgggaaggggctcagtcaagatacagccttcaggggaggcatctcttaagaagtcttcatagcatttctcctttccaatcagacctctgcggcaaacatcctccaccagatcctcggccaggccaagaagcttccaagcttgatcctcctcttaatatttattggagctggaggtcctggagcagcactgtatgtcttgcatctggcactgttcgatcagatgttagtaggggcagaaagaataacccaaaaaccctgagacaaactgggtgccaatgatcagtacaagttcaactcggtgaatgtggattacagcaaactgaagcaagaaggcccagatttctaaatgaaatgtttcactctaaagctgcttagaatgaagctcttccaggagccatccgcacaatttcccacttaaccaggaaacatttctcctctaaaatacatgaaatcatcttgacgtattattttggagattacactaattaatacatatccgagactcgaaaaaaactaaaaaagaaggtttcataaacagaagacaattcaagggagttcctgtgatcctaaagggaggaaggatttttgccaaagggtgagagaacagagagatgaaagctatggaaaggacaacagcgcaatttaaagcttgagaaaccaaaggtaaatgagaatggcaaccacaacaaaaactaaacctgagattgaaggggaactgagtcttcagaggaaagaaagcaaaggaaacatcgtttgaaaggttaaggatataggtagcttgcaactattctcaactgggcttcctcatccgaacagggttccttattcctcatctgacccagagtacatgacataattcgagtgattatttcttaattcccataagaatggcaaattggccgggcacagtggctcacatttgtaatcccatcactttgggaggctgaggtgggcagatcgcttgaggccaggagtttgaaaccagcctggccaacatggcaaaaccctgtctctactaaaaatacaaaaattagccaggtgtggtggtaggcgcctgtaatcccagctacccgggaggctgaagcaagagaatcccttgaacccaggaggcggaggctgcagtgagatgagattgtgccactgcactccaacctgggtgacagaacaagaccctgtctcaaaaaaaaaaaaaaaaaaaaaaaaggcaaatctagaatccagaaggatggcactgatctagatgcatggagggtgaagttgatcaattccatgcaatagatgacatcgggcactggggcttagaatccagattttaaaaggcctgctgttaagatgtctgtttgataaaaaatcataataccagaaaaccagaatcagcaactaaaatttaaaataaaaatagagatctcacccaggggacttttaagcttcactgaggcaatgtggtatgattctggagtggagtgaaagccttttctgacccagatatcctgtcattagtgttcacagccaacacggtctcagttgtgcctacctggcttgcagcattgggctctgccccccggcctctgttatttcgggaccctatcatccccattgctggcagcaagcccagcgctgtaacagcatctcctgccatcagcctgccctttggaatgctgggcggcaactccagggcttctctgtgatgctggtgccctcctcaccaggccatgacttagcacgccggtaaacggagtatgctctgggccctcctagggaacactgtggggggtggattttctggcctctatagtctaaccagtttggcatgcccactgctctggacatcctgattccttccttcaccatttgctgtggcagttcttccaattctacctcacttaacgtgggtcaatacttttccaggcctctaagaggcaacctcttagaggttgtgatgtagtagtatgttggcgccatctcccggggtcctcgtcagggtgtaaattccgtaccgtaaaagaaagttctcccttttccaatttgtattttgtttcctttggttcagcaccctcaagatccagtcccgtacatattcccccagttcctgatggttcacattgaccaggcctacaactacttttttttcttagcaggtttgttttcttagcgggcccagcacttctgtggctgggttatgttctaacttgcccttagcttcgggtctgatggccaagagaggaggcagagctgaatcctgagcagagcacgagttttcttgcaagacacgatcctccacatgatcttcaaataagccggaggctctagcctctaacagagaggagtggatcacttctgcaggccctcttccccacttattaccggcagccttgcactcacaggaatgcctttcttcacaggcttccattccaaagatcttattatcgaaaccgcaaatatgtcgcataccaacgtctgagcccttttaattactgtcattgcctcctccctgacagctgtctacagcacccgaattattttctttgcactgttaggacaacctcacttcacggctgtaattgtcatcaacaaaaacaaccccttcctaatcaattcaatcaaatgcctaacaattggtagtatttttgctggatttttaatctccaacaatattattccaatatcagttccccaaatgactatgctccttcacctaaaactcacaaccctcagcgtaactattttaggcttctcactagcaatagaacttaaccttgtaactaacaacctcaaactcaagcacccatcacaaatatttaatttctccaatatattaggattttacccaatcacaatacaccacacaacaccacactcaaatttccatgcaagacaaaacctaacctctcttctactagaactgatttgattagaaaaatcaacaccaaaaaatactgcccaggttcaaatgatagcctccaccattgtatctaaccagaaagatctaattatgctctactttttctccttccttatcccatctctcctaactctattcttaattatttaaccctattccctcacataatctcaatcacaataaagatactaacagagatcaaccagcaaccaccacccaccaacacccataactgcacaaggcagctacatccatagaatcctcacaaagtaattctatttccccaacctcaaaagtcacccagttttccatatttttaaaatcagttacaattcccacctcatcataatcaattaaccacataattatcaccaactctaacagcaaccctaatagtgaggcatcccaaataacaacactgaccctcaggtctcaggatactcctcagtagccattgccattgtataaccaaaaaccaccatcattccccctaaataaaattttaaaactattaaaccaggccaggcacgtggcccatgcctgtaatcccagcacttagggaggctgaggcgggcggatcatgaggtcaggagttcgagaccagcctgaccaacatggtgaaaccctgtctctattaaaaatacaaaaattagccaggcatgatggcacgtgcctgtaatcccagttactcgggagactgaggcaggaaaattgcttgaacccagagggtggaggttgcagtgagctgagatcgtgccactgcactccagcctgggcaacagagcaagactccatcacaaacaaaacaaaacaaaaaaactattaaacctacaaaagccccaccacaatttaacatagtactgcaacccacacctccactagtaattaatcccaagcctccataaataggagaaggctttgaagaaaatcccataaagcctataataagaataatacttaataagaatacagtgtatgtcataattcttacatgggatataaccataactaatgacatcaaaaatcattgttgtgcttcaactctaagaactctaatgactaacatccgaaaaacacattctctattattaaccactgtttattgagccacctgcacaatcaaacatctcggcatggtaaaatctcagcttgcttctaggtatctgcctggtccttcaaatcatcacagggttttcttagctatacactacatgtcagatactctgaccgccttctcttcagtcactcacttctgctgagatgtaaattattgctgaattataattatgctacatgctaatgaggcttcgatagtctgcatctgcctgtttttacatgtaggccgaggcttatactacgggtcatttactttcctagaaacttggaatattggcagtattcttctatttgcagttatagcaacagtattaataggctccgtactttcatgaagccaaatatcattctgagatgcaacagtaattacaaatctactgttagccatcccatatattggaactgaccttgtacagtgaatctgaggtggattctcattggataaagccactttcacataattcttcacttttcatttaatcttgcctttcattattacagccctagtagccattcacctgttattcctacatgaaaagggatctattaacccctcaggaatttcatcagattctgacaaaatcccttttcacccttattacacaattaaagatattctttattacacaattaaatatattacacaatttattacacaattaaagatattctttattacacaattaaatatattattcttattacacaattaaagatattaattctacttctcttgctcttatcaattctgctgacctcctaggagaccctcacaactacaccccagcaaaccccctcagcactccaccccacatcaaaccagagtggtactctttattcgcctacgcaattctacagtccatcccaaacaaactagggttttcttgcaagacaggatcctccatatgaccttcaaataagccagaggctctagcctttaccagagaggagtgggtcacttctgcaggcccacaggtccagcgggacctgatgattcaagattttttagtgcttggaccaagtgtccccatccaaagtctcagaatcttactgcttccaaatcagcaccctgacctacatatagcagaactggctggagttgagaattaagaattcaacaatttctggaactttgctattcatataagtccttagctgtacggcccttaggcaaccggagatgagattctatttatatacagccaagttctggcttcatacttcccctcacatggttaagtaaccaaccgaggcagtcattgtctttctccaatgcatgcatagcctccaacaacagtcatctaattccaaaattcttgtatttacttaatttcccctgaaactctcaacctcctatatgtgtcacttgccagcctatccccttctaccagtttcgtgtcccagtttgccacctgtaaacatgtgaacactggcactggcatggatgcctggggcaactagcgcttcacctatgatgggggctagcgctctaccagtgatgggggccttattacagccagccaggtgcagcaacaacatcctattttagagtcagttcctaggaccacatccagtaccagctgtcacaggtggagttcactgggaaacacactctgagacaccgagatttctatacagaagttattggagagtaatcgcagaaatagcacctgtaagtgttgaaagacaaagaatttggcagatagaaaagtcgagctgagcctcagtgggtccatggagagctctggatctgggatggcccttctgagatattgcaaactgaggcatggtggacaagtcttggtacctcacaggaaccagtcattggatgtgcacggtccctagggagggagcttaatcttgggcagtgtctttctttggctaaaagcaacactgggaaagcagcacaggtgagaggtgccaggcagcggctcccccagcggctggagaatgagcagtgcctcagtcctggaggggaatccgggcagcacccacagcatccacaatgccctgcagcactgggagcagccctcacctttctgagactgtttcttgacctgcaaaataagggaacacagttggttcttgagcagtgtggcggctagggggcactcccaaaaaacctaagaacctattgttgaccagaagccttcccacagaaacagtcgattaacacatattttgtatgtggtgggtattatatcctgtatctttacaataaagtaagctagagaaaaggaaattataaagaagaaaatatacatttacgctgggcacggtggctcacgtctgtaatcccagcactttgggaggccaaggcgggtggatcgcctgaggtcaggagttcgagaccagcctggccaacatggtgaaaccccatctctactaaacgtgcaaaaattagccaggtgtggtaagcgcctgtaatcccagctactcgtgaggctgaggcaggagaatcgcttgaacccgggaagcagaagttgcaatgagttgagatcatggcactgcactccagcctgggcaacagagactctgtctcaaaaaaaaaaaaaaaaagaaaaaaatagaaaatatatatttactattcattacatggaagtagatcatcataaaggtcttcatcttcatcatcttcacattgagtaggctgaggaggaggaagaggaagacgaggagttggtcttgctgtctcgaggtagtagaggtggaagaggtggaggaggtggaaggggaggcaggcgaggcaggcacactcggggtaacatttgttggaaaaaatccgcacagcctaggcaacaatgcaaaacctctctataaacgatagaaaaattagctgggtgtggtggtgtgcacctgtagtcccagctactggagaggttgaggcaggaggatcacttcaacccggaaggtcaaggcttcagtaagccatgatcacgccactgcacaccagcgaaggtgacaaagggagatcctgtctcaaaaaaagaaaagagaaaaactccgtgtaaaagtagacccacacagttcaaactcatgttgttcaagagtcgactgaaatagctacctcaaagatgtccaaaaaagcaaatgcaaaaacaaatgcaagcaatttgtgaactgttaacaaggttattcttctcatcctaaagtctggagcaatctcatcaccatctttctattatgccccacacccacttctcgtctcaagaagtcagtattttacttttctaccaggatttagctttactgtccactttactgcttctccaaaaagttgcagtgatgatgttgagaagtgactaattcattaggtatatctttatttttcaccataaattaatttctaaaataggctctataattaccaaaactcttctagtctataattgggggttctataaaacataaaattacaggatttatagttctttaaaatggaaaagtgctctcaaaaaatgttactagttcaaaggagattcataaatgaatcatgtaattttaagcaattctcactagatggagctagttacaaataaatacttttttaatatttttcttctttatttttaattttttatttttatttattttttattttttgaggaattaacagtctttattgggctcagatcaggaggccgtgggtcttgaggacctctgtgtatttgtcaattttcttctccacgttcttctcggcctgtttccgtagcctcatgagctgtttcttcttcccgtagtggatcttggctttctctttcctcttctcctccagggtggctgtccctgcctggtacttccagccaaactcgtgagccaggcgccccagataggcaaactttcttgtaggcttcagacgcacaaccttgagggcaacaggaaccaccatccgctttttcttgtcgtagggcggtgggatgccatcaaacaccttgaggcggtccagagcggcctggcctcgcttggtcttgtggggcagcatacctcgcacggtccgccagaagatgcggctgggggcccggaagtggtaggagcctcggtaagagttggtgttcatccgcttgcggaggaaagcgaggtacttcaacttgtttctgtagaaattgccagaaatgttgatgccttcgcagcgtacgaccaccaccttccggcccagcagtacctgtttaccacgatggccgccaggcggcccaggagatggcctcgaccatcaagcaccaggacctgcacctctgccgtcttcgccagccgcttgggaaaggcttttcttctctttaatacaggaatattttaattccttgtaaggaaaatttcctggataattccatgtattttaataatcacagagatagtcttattcttactcattcattaccaaaaataaagacttcagtaacaatttatactccatagagtatacgatctcatctattttgacatccaaaaaaaaaaggcagaaagacaaaacgcaaattctgaggcagaaattaagaaaatataattcttattttttatttaatttattgtttgttccgctgtttgaatgtttatcttccaggagcctacagaagtgagggaaagtatctgcaggctaattttaaataacacgagacagagattaaacattaaatataaaaaaaaaaccttttagcttacttattaaactaggaagaattttccttaaacacatcactcaaattggtctgcaatgcatcaataaatggagaacatagatctcacctaggaaatattttatacattgtggacactacaaaaaagctcatcagaatataaaaattttcaagtcacaatcccctaagcagactaaaaacaagttagcgtttaacctgaaatcagaagtgcaaactctgtaaaaataaaaatattgccattgttctcagcaatctatgaataaatcctacaactccttaaagtcttttcaataaaatgaaccatgatctcttgacaaactccttgcttaaatggcaggtaacttttgaagctggacttctcaatctgtcaagagaagcaagctgcattggcagcattgctcgcttttgaaaatcaccttctgaacagaaggtccagcaaagaccttcaatgcaacactccctgtatatgtgcaagtctgcatgagacgtcctcccgcaggtgcaactcccagccaatgaaccagaaacagatgaaagacaaaaggggaaagtcgaggtcaaatgtttcagtttacccatgctatcccagataaaatgccaagggcttttggaataaaatggacaatatgcaaagatgaggtgaccagatgtcaataatgttgggaatttaaaatgcatgtaccacacatgaacacaattctttaaatgcagctgcaggaagttccgtttgggggtcatcctctttgaaactcccttctgggcagtactgcttgtcatttctatcatctgatacatctatacttccaaataatcctaactgatactcaaagtgatgccttgacaccctctgaggttctacaggctcttccaaatcaaagagaggtcacatcatgcatagtattatttgggggttagcatacgttttataataattatgttaaaattggtaatccctttttgggttcaatgatagctctattaattatattgtcttgttaactgaaatattccactctgtcaatgggattaatggttggagattatgatacaaccaaaaccaaagctgggcaatgggctcttggactggaatcacccattatgaactatccatctgaccaactctttaactttcttcctaaacgtcagatcaccagggcgtttcagtgcagcctgcacaattcagagagtagggtccagattaaagaccttacatttttgtagaattcagaatcatttttcattcagcaagccctctatttgctcactctcttctacatgtaattgttcaactttggttgactgtcgagtcctcatggaagaattcccattctgccactgagcctctctgttagggacttgaaaatggaaggtagtgcagttctttctgaccatctgccaggcaaggagccccgggcttctaggggtaagttcgtcccttttcccaag

SEQ ID NO: 111 - DNA, 104790 bp, Homo sapiens
tctgacatttcccatttggtttcattgatttatgacttgttttctgtcggaagtaggtattttctttgtattttctttttttctcccttcactcttgccttagaggagtagagagagggtattctggtcagccttcctttttccctttggggatgtgtgtgacacactccctcccctcccaccaacaacccaccctccccaagtggggaccctttgccacgggagatggtcacccatgtccaaagattggccaaccccccaaaagcggttgattagaggctggatatgactcgtggaaggagctgcctttggggcattcccttgaacttctggagctgtgggtgacttgggaatccctgggtccctcgatagatgcctgacatgggacattgctgtcctgcctcggctttgtgcattgggagccactccctttccctcagcctctcaggccctggcgtgccttgatgttagagaatgctgtgggatgttttggttctctctttgaagcgcctttctttctctctgctagatttattactgtagtcggacacactcccagctggcccagtttgtgcatgaggtgaagaagagcccctttggcaaggatgttcggctggtctcccttggctcccggcaggtaaacagtagccagtatttccaccaggggccatcctgctcctttcgccacaactttgtcctgctcgtccaggccttgggagacgctgggtctgtgacaggctgaaccgtgtgaggagcagccccctccctgacctggccggcccagcactggaaggcaaaggagaggtggcggggcaggtccacgtgtgttggtaggatgtcatttagctggcaccatctttttgcctctttctttctcctttgctgcagaacctttgtgtaaatgaagacgtgaaaagcctaggttctgtgcagcttatcaacgaccgctgtgtggacatgcagagaagcaggcacggtagccactgggaccatggtgtagccgcaggtggtctggagagagtgaggcaggggtggcagtgactgaagaccattaagtgtctttcatagaaagaatggcagaggagaccccagttccttcctgagtcccctctccttgggaaaaagtgttcctactctctgggtcagtgtctggtccgaatccttggcttggagatgattttacgggctctttctggagaacagaagtaaaaccttacagtgttccgatgagaccacagtaggcagtacttgggagggtcttatagaccctaccccatggaagtgggtctcaacattacacaaccccctcttgggcccgtggacagttgctgtcctctctgttttctctctttgtgcctgtgccaccctcagagaagaagaaaggagctgaggaggagaagccaaagaggaggaggcaggagaagcaggcagcctgccccttctacaaccacgagcagatgggccttctccgggatgaggccctggcagaggtgaaggacatggagcagctgctggcccttgggaaggaggcccgggcctgtccctattacgggagccgccttgccatccctgcagcccaggtgagggccctgcagggccagaaagccgctcttgactctcactgtggtctaggccatgaggggggtcctcatcacactgtagtttgggggatgccccccaccgtggtcaggttgatggcaccttaacccattctctcctgatgtgtgagttggaggaggcgcgtgggatcccttggggtctccaggcagcagggccagttggcattactggggatggtatttaggagccaggaaagccggtgcattcctagtgaaaccacagggagaggggggatgccaggagctgagaagagtgtgctgcatacatctatttacaaatggctttccaagtgatgctcccaacttccatgcctatgatgtgatggaggatgtcagtgatagaaccattcagttttccagtttttcctttttgtaatatcagtactcttaactggaaagctttccctaacttacacctacctgcagcacgtgagaatactgtcttctctgcctcaacttctcttgatttttaaacagaaggaagaactgctaatgtagcagatcaaaagtagtatctcactgttatttggtgggtgcagtttcactatttccttgctacttctttaatttgagtgactttggaaacgggatatcactagtggaaaattctgtataatccagaaaaaaatgtaaggttttaaaagattcagggaactaagtaaccatttgcacagcagctaaatgctcaccagcatacctgctgagctgtgtgggcactggcagagaaactgaggaaagctgccaggccccatggtgtcccaggccttccctcccgtctgtttgcctttagagcaagattagtgctataggcatttatacacaaataccataatatggcccaaaatctttacaatttttgaatttttaaagtactttgaccatattttgcttttatgttaatagtattccagtgaaattctgtgcatggggacactggagcccagaaaagttaagtgactcatattttctcaccaagcgtgggtgatggagccattcagttttccgatattttattttttatatgagtattcctttaactggaaactttcctaacaacaaacacctaaagatgtgcagagttgcttttatttttgttaccccagctccacgccttaaccctcactttgaaataggatgtatcaaccctattttgcagatgaggaaagcaagagtcagagaggttagacaactcttccagagtcacacagctggggagtagcagctccaggagtagaagctggggccgcttcctggtgcaccgatggtctgcaggtgtttgtggaaactcgggggcctccggggcgaccttgaggacatggacaaggctaagcaggggttcccttcacccagccctgcccttggtttactcaggagtcagaccagccctagtttcctgtgtttcatgtattggcttttcatgtgaaactcgaggagagcttgtccgttgccacaagctgtttttcgaatgtctctacacagtccaggcaggaaatagaagcactcacatcaggagctcagtgtcaggcaggcaaggctcctgcaggggagccccgccctgctcaggtggcctcatctcccctcccagctggtggtgctgccctatcagatgctgctgcatgcggccactcggcaggccgcgggcatccggctgcaggaccaggtggtgatcatcgacgaggcgcacaacctgatcgacaccatcacgggcatgcacagcgtggaggtcagcggctcccaggtgtgtgggcctcccctccccgggccagggcctgctgtgacgtaaagggacttggatggttcctccagacacctgggccaagagttcctccggaggtggggcttgatagagggtgcacgagtcaaggcggtgacctcatcggaggctgaccatggctttccagtgcatcgggggaccccgctatgacagagtgcctcatttccctgcacctcatctgcccccatgctcctgagtccctccagccctggatgccagcagccagttctgtaagccagggagatggcatgtgtgaggcagaagtcccctcaggattggattttgtcattactgaagttgtctggaggggactgaattgaggaatgctcaagatcagcgcaggctcctcctgctgccctatcatgcgccatgcatggcaccaggtgtctctggtcttcacgctgactctgccatgggtgtggtgttcctgttttacattggaaacttggagattcaaagatggtcaagctctgtcctgaggtcatgcagctcatgagtgtggagctggggtgtgcccactggtttctgactgtgaaaacccccacgacatcccaccagctctactgacctgtgcctgggctgaattgaggctgggatgtgatggtggccttgaaccatcactctttgtagactccaggtcttttcccaacccggtggaaacttagcagggagattccatacttgaggaattcagcctcttgctttttctctgacccacagtggacactggaggaaaacttcccttccttcccttttctcttagctcccaccagcctaagggctgtggaaacccgtaccttttgtctgcagccagccccctctcctccctttggtggcttcctgtgtgtccagggccagcatcttctaggtgaatctaagatgtcagtaccttagccctcagctgcttgctcagagcctggtttgtgttctttccccagctctgccaggcccattcccagctgctgcagtacgtggagcgatacgggtgagatgtgaccctctgaggtagtgggacagtcccttggtggccccctgcgtgggcctctgagaggcaggcagcactttggttcccacctctggcccgggctgtggcggggtggagctgcatgccattcatgtcctaggcacatcatggtgtgtgctgcacacagacctggaaggctggggactgaccgctggctctgaggcctggggccgtggccagcctgctctctgggaaaggatttgtagcttgtgacccagtttgagaggcaccgggcagcaaggcttccactggggtgggcggggcgagtcgccatcagggcaccaccacttaatgtccgttggcttcttctcaggaagcgtttgaaggccaagaacctgatgtacctgaagcagatcctgtatttgctggagaaattcgtggctgtgctagggggtgagagcctcgtccccctgctgaccccgggcctgcaaaactcgctgggctgctttttccttggatgcccatcaggacacctcagttctctgtgtttttaagaagggtcggccgggtgcggtggctcacgcctgtaatcccagcacttgggaggccgaggcaggtggttcacctgaggttaggagttttgagaccagcctggccaacatggtgaaatcccatctctactaaaaatacaaaaaaattagctgggagtgttgccgtggcctgtagtcccagctgctccagaggctgagacaagagaattgcttgctcaaacccgggaggcggaggttgcagtgagccgagattgtgccactgcagtccagtctgggcgacagagtgagaatcagtctcaaaaaaaaaaaaaaaaaaaaaaaagaagggtcttggtcattgatttagaaaattcttgttctttgtagcttagttgagttgtctgacttgagctttatttagacccatgggttctttgcccatgttctgaggactttttatttcaggccctgctctggggggatattaaggatacagcatcacatagacacacggtgtttccgtgataggcatagttctgtgggttgttcgaagcacttgcatatgcggttttgtgtgccctgtgagaacgcagtgctggtatttgaatccttgttgatagacgcataaactagagctcggagcaagggctgctcccagcacgggagcctgggatcttctgactccagctcccacgcctctttgcatgaccctgtcacgtccccttcttttatgatggggcacccccttggaaggcgtctgtggaagtggaagctgcagaaagcctgtgggagctcctggcgggagctggtctcgtgttgctgctctgagccaccagctctgctttgcctcaggctcaccagtggcctgggcagctcctctgtgctccggtgccctgcataccttggtctggctgctgtgtcccggcctcctggagaaggggtgaaaaacatgaacttacagggctttgggttccacgtgcaagcacgtgagtcagacatgggaggctcctggacccacctgccctctcagtgggtccgttgcatgctataaacagtgaaaagcaaaacaaagccatttaaatacagatgctcttcttacttgatgtgcagtgtggagggagagaagatagggaagggttgggggtcctgagaaccagcattgtgacctatttccattctcttttttagggaacattaagcaaaatcccaatacacagagtctgtcacagacaggtaagagagttgccctcagagggcccagagctgatctgagccacttccgagcttaaccctgggactgaaacctgaggcttagggtgaagctcccaaggcccttcatgtgtttgttctcagggacggagctgaagaccatcaacgactttctcttccagagccagatcgacaacatcaacctgttcaaggtagaggtttccacctttccacattccacatccaatttccttcctgtcaccacctgtgggtaaagtactatgttaagactgtagaaggaagaaaaagcaaaacagatgtgtaattacttaacccttaacgcaacatgcctgtgagacaaaagtcatcttcttttagagtgaaggccacagggatgagggatgggtgagaaagggacctttcttggtgccccatagaacagatagagactccaggtccttgctctctcactccgtcttctggcacagtctccctcaggcttatggacaggaataggacgttgatttgttctgtgcaacccctgtcacgtcttcccacttgggccttgggtctggttgcagcctcagacctctgctcactccaggtctgtgtacccagcgctccccagatgaaacacggccactgccgcctgaaccccaagctcgtaactcaaatcagcaacagtgactgcccccgggtacagggttctgcctctgttgtaggcggcatgccatgtgctgtgctctgagctaggatatccttttgccccagcaaggaaagcaaacaggcccgtggaggtgacttcaggagggtggcgagcacaggcttcccacaagtgagccaatagcaagtggcagagacagcgtccaaacctggctgcactgacttggggccccacattcttcccatcctgcctgccttttttttcttaaaaccagcttttcccctgaattacacatttgggtcactgtcactgccgccatccctgccagacaggctggatccaggtcatccttgatgcctttctccccttgtctcccacatgcctgtgacagccgccaggcctgacagcctgagacagtcctgccgtccctgcgcttctcccacagctgggacatgggtgcaggcactccttctctcgccttccctttgccctccttgctttccttctcccctcttcttcccatgggtctcgggtctcatcactcaccattgagggaatcctcatcgaaggacgtcgctctttttagaaaccggtttaaaggctccaaactcctcatctctgcatcccaagctaagatctggcaccaaaccacacacattggatgcaccgactgagtggcactgccccagcccctgagcaggtcccagccatcatctcctctgtggctttgctcatagaagttccttttttttttttaactctttgtcacctggaaggaaagccaaggggaactggattttactgagcactcttagacttgagagagacatttggaaagagggtctccaccctgaggaggacactgcgttgtgggcaggggcagtagaggagggggtggcctcggagaggagatgacaaggttggtggcaaggaggctccaggtgcctcagaaggtagcactgcgttgtgctgcctgggtggtagaagtggtgttttttgttttgtttttaagattatagcttgctcagtttgcactcatgcctacagctgggcttggtttttgcaggtgcagcgatactgtgagaagagcatgatcagcagaaaggtaactgctcccatcttgtggtcctgaacaagacccagctgtgccccaaccccctgcccttgccatgctttcctcccctgccctcagggaactccagagtccccttcgtctccactctccttggtgcagtgggccttgctggggtggtgggatgtgtgctgcaggtgtcttgggcctggcagagcctccgatccacccagcctctctctcatggctgtacctcgttcctctccactgctctctctcatcccacccagctctttggattcactgaacggtacggagcagtgttctcatcccgggagcagcccaaactggctgggtttcagcaattcctgcagagcctgcagcccaggacgactgaaggtgaggcaggagggtgggcaggcagagccggctgcacgcatgggcaaggacttctgttcctcatgtgtggacctgaccagagggaggcctcctccccgttctgctctgtgcagctcttgcagcccctgcagacgagagtcaggccagcaccctgcgaccagcttctccactgatgcacatccaaggcttcctggcagctctcactacggccaaccaggacggcagggtcatcctgagccgccaaggtaatcaggtggttcttggccaggttcagttcccaggaaggagccaagctgagcccgggagccgcagcgtgaaaggattctttccttccatcctgggaacttcctgggttaggaggaagcagtgcagtgggcactggcctgctgtgacctgggcaagcagtggaggtggatgggaggagatcgaagggctgggatgggggtcccgtgaccagggtaagcagtggaggtggacgggaggagatcgaggagctgggatgggggtcctctagggcaggggtcctagggaaacttctactgtggggtaggtgggctttggtttgggtcatgattttgtcatctatgagccttgtgatttggactattttctttctcaacttcagtttcttcatatgaaaatggagaggataggccgggcgcggtggctcacgcctataatcccagcactttgggaggctgagggggggcggatcgtgagttcaggagatcgagaccatcctggctaacacagtgaaaccccgtctctactaaaaatacaaaaaattagcagggtgtggtggtgggtgcctgtagtcccagctactcgggaggctgaggcaggaaaattgcttgaacccaggaggcggaggttgcagggagccgagattgagccactgcactccagcctgggcaacagatcgagactccatctcaaaaaaaaaaaaaaaaaaggatggagaggacagtgtggtccacctctgtgggctggttgtcctagagattaaatggtgtttaatttaaagagaaagcactagcacttgtgcctcagacctggactcacctgggggaccccctttgctgggacgacagaagtgtctgttgggcttgcactcacctcccaccgatctgtttttccaggcagcctcagtcagagcaccctgaagtttttgctcctgaatccagctgtgcactttgcccaagtggtgaaggaatgccgggcagtggtcattgcggggggtaccatgcagccggtaaggacacctttcccagcccctcgtgccccaggtgttgggatgagatgggggcttgggagagatgcattatcagtcctgttctctcctggggccccaagccagaaagggtcagctcgagcaggcccagtggtgtccgctgggtgacactgctattctctcactgctgtgccttttaggctgcaggagcagtggagactcctctgctgctccattctgtagccccaggatcacatgtctcccagagaaagctgttctgtggtttcaaactcaaggaaaaaaatcatgattccacttttaaaaggttcattttgatgtatatgaatataatagtctttgtaggcgtaatttttacttatgtgcatagctgttttaaaaacaaaagtacggctccctccatgtgctgtcactggaacttgctcttttcactcagcagccagagggtcataaaccctgtctccttgtcagcaagcatgcacgtatttcagtatcccagctgtgctggattccagttacacagatatatagcatttcatgtagctgcttctctcttgttaggtgtgcaagctatttgcagttttctgttttgagcatgactgtgataaatataaccgcatttctgcacagtggtgactcctacctagcgaagggcctcctggacaaaaagctgctgggaatcctgaagcagtgcttcccagccccagctgccttagcttttgatttttatatttttgtatggatagattcatagttttattcattcggcatattaaaagttgtttacagtaattattgtttctgacgttcacattgtgagagccccttcctgctagctcaggtcctccccgtggcccggtcagtctcgcctccagcacagcagaatgtcatgggatcaccatgggtgtcctttccccacactggattgattcatttctccaagctgctctggtttcttgtaatggggaatgacatttagaagtcaagctgtgggtgctagggtgtttgtcgtgctcctggggcgttttggtagacagatctaggaaatgttttcagaatgaatccatactggtatttctttctttctttctttttttttttttttttttttgagacacagtctcgctctgtctcccaggctggagcgcagtgacctgatcacggctctctgcaacctctgcctccggggttcaagcgattctcatgcctcaacctcctgagtagctgtgattacaggcatgtgccaccacacccagctaatttttgtattttagtagagatggggttttaccatgttggccaggctggtcttgaaatcaggtgatccgccagccttggcatcccaaagagctgggattacaggcatgagccaccacgcctggcccatattggtgtttctaagtaaaaatcaaaggatttgtttacttgaccttttattgtacctctttttctcttaagcctgaacatgtgtgctacattaacatacttatctgctctatcctataatatacttaaaagttttgaaatcatagtaccaatattacttctaacaatagatctgattgaaattgcctttcctctttgcctttagagtgtaacccactaaggatgcctggtcactaggctctaaagtcacgtggaaccaggcttctctccgtgtgcttctgttgtcagtttcatagataactaggctgtttttgtttcattttcttttcaattttagaatttgcttttttcttttctgacttgtagtttttaaatatgtaaatatttgtatggctcaaaagtcaaagcaatataaaaagatctattcaggaaagcctcactctcatccctttccagcccattccccacccccatagggaatccgttttactagcttatcctttcagtctttctttttcccctaaataagcaaaaacgtgtcttcatttttccctttcctgttttatttacacagaaggcatcttagtcagttgtctgaccatcgctcctctagtgggctgcgtggttctctgttggacagatgtagggagcttatccaaccagtaccctctggataggcaggcgcatgattacagggaaaggtccgggggcacatgctgtttggtatttgtgggctgtatcttctcactggactcctaaatatgggattcctgggttaaaaagtataaatatgtttaatttgttaactactgtgaaatttcatgagaattgtaccattctgtatcccaccagtactgtctaggaatgcctgtttctccagagtggttacttttggatttttgccagtctaacaggtgaaagcctggagattcttattcagtagtttgggctggggcctggccatgtgtatttttgaaaattttcgctggtgattttgctgcatggccagggttgataatgactgtgccagatttgctggatttcctttgctgttcctgcacatagtttaaacgagactgccagcactgggtatcagtcaccatttttctttttgttagtttgccatcagccttttctttgacctcttctttcagtttgtgtgtacttgctgtctcttagcccagacttctcgcttcctttctgctgggcctctgaggggtcatggggccgtgacgctgtggccttggtctacaggtgtctgacttccggcagcagctgctggcctgtgccggggtggaagctgagcgcgtggtggagttttcctgtggtgagaagctgtgcccagggtggggcaggctagaggtcaggttctggcccccgttttctgtgggtaatacctcatactgcgaccaggcacaggggcggaggagaccccggggtgggagcctcacccttcgtgcgctcgcccaggctctcctgctttgctccctgctgcctgctgcccagtgtgactggtgatggtgggcgggtgagcgctgtcagtcgctgttcctgtgctggatgatggggcagggaaatgccctctctgcagtgtcttgcagcacacctgcatctccagttttcggcccctccctggctcttaccaggtcacgtgatccctccagacaacatcctgcccctcgtcatctgcagcgggatctccaaccagccgctggaattcacgttccagaaaagagagctgcctcagatggtcagtcccagccagctcgccgcaccacagcctggcctcaggcagcaaagggttttctggggcaggggcgctctggcccaccctgagtgttttcagtgttggggaaattgcacagggacacccgcttagagccacacagaatgagcggcgtcgatctagatgcttatggaggaaggtctgagcttccccgcccctcacgccttaggctgcgaaatatgtattcataaaacctccaggcatcctctgaggacgcctcacacaggagaaagctgctagttccctttggctctcttgccctttggttatatctgcccctgccgggggtagggatgtggggcttgggggcatctcctgtggtgtgcctggggtgtgcagcccctgattgtcgttgtggtgcccatcaggaccctggacagaagaagggaggactcagtgccagggcaatagggaggccccctagggacgctagtgctgtgacatgtgtcagaaaggcgcagtcagcagcagcggctgggtgtgtttggtgggaggtggcacctaccaccccgtggttcccacccaggggagccaagtcctcttccttggctgtagtcctgccgagggtctctcctcagttttgagtctcaaggtgaagacgcggtttgtgggtggctgaggggttgctccatgggggctccctccctccctcctttccttccttagatggacgaggtgggtcgcattctctgtaacctgtgcggtgtggttcctggaggggtggtctgtttcttcccctcctacgagtacctgcgccaggtccatgcccactgggagaagggtggcctgctgggccgtctggctgccaggaagaaggtgagtggcctgtcggcagccttcccacttgtgaggacagtgccactgagtcctcctgggagctctcgtgctcatcgggtcaggacaggcttctggctcctcatccccaccgctcccagtccctgactacagaggatttcccccaaagtccctggctgtgaggttctccagtcccctggccagaaaacacaaggccacgagcagactcgagacctggcaccctgaacctgtctctgggaaatgtcctctgtctttctcagatattccaggaacctaagagcgcacaccaggtggagcaggtgctgctggcatattccaggtgcatccaggtgcgggcgtcatgctgggcttgggtctgagatcgtgtgggggtggcagctggaaacgttgtgggtgtcatccaagttttggctcagcaactcagcgtctgggtttctcctacaggcctgtggccaggagagaggccaggtgacaggggccctgctcctctctgtggttggaggaaagatgagtgaagggatcaacttctctgacaacctaggccggtaagtagtggttctgctcgtctcctgggccgtgatacatggccggccctcactcccagcagctgggcccctgcctgctctctgctgccattagagcccacagctgggctgcgactgctcagaccagccagctggagggaggggctcagcagctctgggtttggtcctgggagagcagttggattttaggctacccattgctgtatcaggacccagtcaattggcctagacgggatctctcagccgaacaagccctctccaggtggtaggtacagagtggagagaggctgagttttgatcacagtcggagaggctgagggaaggggtagaacggagcagctggtgacgtgggtgatgacccgggaggtcctgacgtccacctgctgggctcttgtctcccccgcccaggtgtgtggtgatggtgggcatgcccttccccaacatcaggtctgcagagctgcaggagaagatggcctacttggatcaaaccctcgtgagtgaccccagtgtcacagagggtgacaggagagtaggcagtgggtgggagtggcatcacccccagggctgatacagccaggccttccccgctgcgctggcgtctcctgccccctccggaagcttggatgcccctccacaccctcttgatcttccctgtgatgtcacctggacccctgctgctggcattggccacgaagcctcctggtctggctccaaagcctggcagggtcttttcccagggggagctgcaggcagggaacagtcctgatgggtcttccccttcactcccagcccagagcccccggccaggcacccccagggaaggctctggtggagaacctgtgcatgaaggccgtcaaccagtccataggtgagcctggctgcctccagctgggtggacagatgggggctggagaaagggagaacaggaaagaggggttgcctgccctgtttcctatataagtctgaggaaggggagggggtcgccgtgggaatgtgctgtaggggggaggcaggtgttgctcggagccccagcctctgttcctatgcaggcagggccatcaggcaccagaaggattttgccagcgtagtgctcctggaccagcgatatgcccggccccctgtcctggccaagctgccggcctggatccgagcccgtgtggaggtcaaagctacctttggccccgccattgctgctgtgcagaaggtcagtcctacctttttctttctgagagcctccccaccccgagatcacatttctcactgccttctgtctgcccagtttcaccgggagaagtcggcctcttcctgatgggcaaccacaccactgcctggcgccgtgcccttcctttgtcctgcccgctggagacagtgtttgtcgtgggcgtggtctgcggggatcctgttacaaaggtgaaacccaggaggagagtgtggagtccagagtgctgccaggacccaggcacaggcgttagctcccgtaggagaaaatgggggaatcctgaatgaacagtgggtcctggctgtccttggggcgttccagggcagctcccctcctggaatagaatctttctttccatcctgcatggctgagagccaggcttccttcctggtctccgcaggaggctgtggcagctgtggcatccactgtggcatctccgtcctgcccaccttcttaagaggcgagatggagcaggcccatctgcctctgccctttctagccaaggttatagctgccctggactgctcactctctggtctcaatttaaaatgatccatggccacagggctcctgcccaggggcttgtcaccttcccctcctccttcctgagtcactccttcagtagaaggccctgctccctatcctgtcccacagccctgcctggatttgtatccttggcttcgtgccagttcctccaagtctatggcacctccctccctctcaaccacttgagcaaactccaagacaccttctaccccaacaccagcaattatgccaagggccgttaggctctcaacatgactatagagaccccgtgtcatcacggagacctttgttcctgtgggaaaatatccctcccacctgcaacagctgcccctgctgactgcgcctgtcttctccctctgaccccagagaaaggggctgtggtcagctgggatcttctgccaccatcagggacaaacgggggcaggaggaaagtcactgatgcccagatgtttgcatcctgcacagctataggtccttaaataaaagtgtgctgttggtttctgctgagttttttattgatatgtgctgctgttttctctggaagcctctttagggaatcgaggagcgcactggtgcaggggctgggtggagccatcctccgatggagcacaggcagacggaagcccccaccccagctgcgtggcctcaagccagcctcccgctccccgaaggtggtctccacacagacctgggacagtttcatccccgccccttccagggcagcagggctgaggatcccattctggctgtgtccacgtccgggccatggctagagtctgggtttaggggaggaaggcatggcggcgcccgctaggatttccagttgtcctcttcttcctctgcctgtggctgctgggggttagcagagacggtttgttgtctgacatacgggctctctcctcccggcccctcaccagccccagaggtgaaaaggctggaggggaaagggtgagtgagggaggtctgtggggagcactggtttccccaggccccagagacttaaacacaggaagaaaaaggcaagagagaattaacgatgccacagcccatggcagacagcggccctgcctcctacccttgcgtctcaggaccagcttgttgaagagatcccacatcagttccctgccttggcttacggctctcactgcaataggaaagccacggagtggggtgtggggttcagtcacatttgacccccggctccgtgttcctgtcccctgtagtgtttttgttattagacccttttttctccttggtttaggaatgggggccccagggccacccttgtccaggctccctctaccgtagaggtgagaattccagggagctacaatttgaaaaccactattttatgagccaagtagaacaagaaatgacaactattaaaaaaaataagggatttctgaccagctaacaaccccacagaaaatccgccagggatccagaaatgagactgaggtggcctcagagagctccctcctgaaggggatgctgctgctgtcgtcctgcccggcgccttggactgcagtggccggggcctggggtggggatgagggtgcactgaccagcaccgcagcagctgggggaggttggggtgctgttaacgtgccatcttataggtaggaagtggaaatgggagaaagtgtggggtgcctagggaaggaggtgactgagcagggagcctggctgccatcctaacacccagctcactgggcttgagcgacttgagcctggtgccagggcagagtgggtgatgctggggcccaggctggcaccatacttgaggtctgccaggcaggtcaggtaggatggcacatcgaccttgggggacttggcccaggtctggcatgtagaagtagttctctgggacccatgggattaggtggggacatgtgagaggtgacagggacctgcaggagcagctagcgagacctcatgtgcaccctgcacagctgtggtggcataagggattcaatagagcctctcctagagaggagcctggcagggcccccagcccttgcacctgcccctccctctccaccttctgctccagctgctctctcactgatggacaaggggcactgaacagtttatctgtctctacccccagcatcacatgggtctttgttacagcaccagccagtccgtctgggaagacagacttcttgtatctacaggggcgacgtggaggtcaggcaagccggcacctgctgtcctgggaccatgttcctgacctacctctcccatgtcatcagggacactgcactgaggggtcccaggccactgagccaagccaccctggtcaccttctggctcccacctctgtgctgcacctgagtgtgatgccctaggaccccattaagtcaggctgagtcttgcacccacaccctgcgactccattttctgctacacaggatctctctgatgttgacgagcagcatggagacctggggagaccccccaagcgcctcctccatgtcatccttgggctccagcttggcgctcacacacacaggaaaggacttcagcttctcctgggagggctgggtggctgaggggtggtggatttcggagttggactagcagctggcctagaggctactggggaggagggagcagggagcacccactcctgatccagattcactgcttccctcgcatctgtcatgaccccaaagaagcagatcctgaacctgggctcttgtctttacctttgttctcttccactctggggtaattaagaatgatttgctggccaggcgcggtggctcatgcctgtaatcccagcactttgggaggctgaggcaggtggatcacaaggtcaggagatcaaaaccatcctggctaacacggtgaaatcctgtctctactaaaaataatacaaaaaaaattagccagtcgtggtggcacacatctgtagtctcagctactcgggaggctgaggcaggaggatggcgtgaacctaggaggcggagtttgcagtgagtggagattgcgccactgcactccagcctgggcgacagagtgagactccgtctcaaaaaagaaaaaaagaatgatttgctaattaattatgcaggcagctgatccagtgctgtgtaaccttgggggccaccagatgccaatcaatcagtagaatgggagagaaggatggaggaagtgaggacaaggggcaaggaggaaggtctgtccacctgtctcttctgtgcaggaggtgtccaagcaggaggagcacgtcacatccccactgaaaaagcccacagaaaatgaaaagcccacatgcttgtccattgctgcaggatgggggcaagtggagggggagaggtgtcggcgctcccaccttactcccagtcatggctgactcctccctttccttcgttcttgttcctaatctgtcaccatgtcctgtcgttttctttgtctcacccaaccctctctgcctgaaaatcccctgacggcagcctcatccctgtcacctcctgactgtagttggtgacagaagaggaggctgcactagtgaaggagcagggactccaggtctggcaacaaccagggatggggccgggtgggggtgacttggaccaggagaggggcctgagtcaggcagtcacatacttcatgctggggtcccccaagtgaagcacatttagcaagatctgaaatacagggaaacagtcttgtttcttcaataaataaattgcaaaggagaaacaattgatgaaaggagaaacctatagatccagaaatactaacaggcaaatcaaacaatcataaggagagactttatttggattttgattcaaacaaactaacaaaaaaatgaaattactggaaatttggagacagtagggtagttggtagtattaaagaatagtagtgtgcgatggttggtatgataatggtattgcaattttgctttttttttaaaagagttcttggctgggcacagtggctcatgcctgtaatcccagcattttgggatgctaaggcgggaggctcatttgaggccaggagttcatgaccagcttagccaacatggcaaaaccccatttctactaaaaaaaaaaaaaaaaaaaaaaaatacaaaaaattagcctgatgtggtggcacacacctgtaatcccagctactcatgcagctgaagtaggagaatcacttgaacccaggaggcggacgttgcagtgaactgagattccgccactgcattccagcatggatgacagagcaagactctgtctcaaaaataaataaataaataaataaataaatcataagttcttatcactgggtatggtgtctcatgcctataatcccagcacatttgggaagcacaatttgggaagaattgaagtctttattaagtatttctacccatggatccatgtatttcttcattgatttaggtcttctgtgattttgtttacagcattttgtacattttcagcatacagatcttatatagacttaatcattttttcagagatagtacaaatgcaattattttaaaatgttgattttctgttagttattgttagtatatacaaatgaaattgagttttgtattttgaacttgtgctacttctggaatgtgtgtgcgtgtgtgtgtgtgtgtgtgtgtgtgtgtgtgtgtgtgtgtgtgtgtgtatgtagtccttggaatacaccataaccaagtgggtttttcctgggaatgcaagactgcttcaatacttgaagatcagtcaatgtaatctgccatagtaataatctaacaagaaaatcaacatgatcacatcaattgatatagaaaaaaaatttacagaattcaacatattttcctattacagattttctgcaaactaggaatagaagcaagcttcttaacctgatgtatggcaccttcaaaaagcctacagcaaacatcttacttagtgatgaaaacctgattgccttccccataagatttgagaaccaggcaaggatgtttactctcatcatcactcctatccaacatggtactggaagtcctagccaatacaataagggaagaaaatgacacaaaataaaggtagtaagattagaaagaaagaaattgtctctattcacaaacaaggtgatttcttttcctttttcttcttttttttttttaagagacagggtccttctctgtcacccaggcttaagtgcgatcatggctcattgtatcctcaaactcctgggcacacacaaacagtcctcctgcctcagcctcccaagtagctaggactaccggtgcatgctgccaagcccagataattttttttattttttggagacacaggtagtctcattctggtttcagctctggaaggggtgaagaacaagtccccagagcccatcctgtccctcgtggatgacatactgagggctcaggaagactctccctcacagcctgccccagtttccaggctgagccacctgagcagctgcttcagaaagcctcttgtgccatagccatgcttaggaaaaagcatatcttccattcaattcaccaagaaacaccaagaaataactggatacaaagaataaaaaatactctgccacactggcagggcaggagggtgaaaattgtgccccctccaaaggtaatgtctataaaaggataactaaggccagcgccaaagtccacctacagaaggcgggtctgtctcaaccccagctgtcagtcactgtgaacttttagaactggggctgaagcttcttccagttgcttgctcagatgtcagtgagaccgctccacaacagataaggggagctgtgtgtcagggaagtcccagccactagcacaagctgcactccaggcagacgtttctgttcttgtgcaaagaacagcgcaatccattcaagttcacaggggcgggtggcacttgaaaatgtcagggtcaacttgcagggcagaagttagcagggaagtaagtcttcctgggggagtgggagagcccagcagagtttaggaggagggaggggcaacatcggggcaatcctctgagtctctctttcctcctcaggaactgtccaggaagaccctgcagtctctctgcaggctcatgggagctcccagaactgagacaacacacagatccaggcctgcttcgaagtcagtgggatgcggcccttgaaagtcgatgtattgggttcctagggctcttgtgaaaacatgccacacctggctggttttaaacaacaggagtttattctgtcagttgagaaggctagaagtgcaaaatcaaggtattgacgggatgagttccaactagaggctgtgaggcagatcaactccatggctctctcctggcttctgctggtttctggcaaccattcacttcccatgcctggtagacacatcactctaacctctgcctccctttttcacgggcacattcgcgtgtgtgtgtgtgtgtgtgtgtgtgtgtgtgtgtgtgtggatgtgtgtgttaaggacagcaatcattagactaggtggggcccactctaatccactgtgagcttctcttactttggtaacatatgcaaagacccaatttccaaacaaggtcacattccatgttctgggactgtcttctgtgagatgtctcccccaggatccttccaggttttctgcaaagccaggcagaaaaccaggatcagggcaggacaagaggatgctagcctgtgatggctcccactcaggtgggatgtgagaagtgcctgtggcctgggacacaccaacttgctcccaatacctcatctgagatggattgcacagtgtatgtccagggcccatcccggcacactgtgcctttgcaatgctgtctctgcgctttggaaattgactcagcccactgcgtggggtggtctgaggcgggccacaaccatttcttaaccatccctgagtacctgaccagtatcccccgggggtgacaactggctacatctggagcatgaggagcgtgtttacctggtgagtaaggatgcaagcataggacgtcctggccgatcctctgcacaagcaatgcctttgctccaacgggatgggcaacgttggattaggcctgaggcagatttgatcttggaagatacattcaagtctacgtgttttgtgcgtttattttcgtttccttgaattaacatggagtccatttcaactttcacttagtctccttctttctcttcccccacttctctctctctctttctttgtatatggaagaatttaactctgtgttccataatgtctaaatactcaaatttagagttgacagccatacagcaaattattcaagttgctgtcaaaaaaaaatccctgcgttttctaggattaaaactgtgaatagagtactggaagaaaaaaaagtcatagactcagatgcaaaatgacaacatttaatgggatgataaggaaataagacttgtcaagaaaccatagcccactgcagactgttcacgatgtcagatggttcatgatttttttccaggtttgatacagaagaatcagtttgttaaaagaaatgcttctccacctgggatttaaaacatcatttaaacaataaacacatttgtatgtatatataaatagatatttagaaataaaaacatgcatatataggcacatagacatgtatatacatatacacacatatgtacaaatatatatgcctaaatttttactgacctgtcaacttacaaaacaaaaatgagagatttataaaaggtacatatatagctgtgaattctttaaagctatttttaaagaaattaatataatcttaatgattatcagattactcatgcagtacacagctacacaagtctaatgaagtaccagagacttttctttcttcaactattgtcctatcttattcaggttttcattttcttactagatgtgttttcaatggtttatgacgtaataaaatttctttacttcttccagtaattgctttgtctcactcggaaactgaactactgttgatgtggtaaaaagctagggcatattcttctgaaaaaataaagggaacatgtatttttattaaatagatgatataagcacattagatctaatccttccaataattttgaaatagagacaattactttcccattttatacattatgcagaaatatgctaataatatttaagacacttgatgaaatatattctattagtaaatgatagagacagaattcaaacactccacaaacttcacacagcattcaacaagaaataaatagtaccaaccttccagggaacagttgtatggtctctacaacattttagtatatgttttagaaattaatctatcaaatttttaagttaacatttcagaatattccccactcctctttttaagtcaaagtccacagaagtagcttggaacagtcagtcttagcatgaacaacaatgacaataacaaaaagacctggaagcttagtgtggcttgtatttcaagttcaagtggagccctgtcaggttatattgcaaggattctggtgttgaaaaactctggtaactggaaaatgggttcagtcagaagacacatcatgggataaagaaaccagaacacaaagtaatgccatttattgtttactctgtgaagacagaggttgattttggaaagtttagtagctcagggaatgttagatataaacaccacattcaataaccttagggcatggctgttgcttgcctacctttttcgtactaatcgtagaccatgcctggggctggctgaatgttgaacacaaggttgctctgctcagcagaaaaagtgaaactgtctgctcgaccaaaaacctatcatgacacaaattataattacattgtagcaggtctgagaaaagataatcactgagaaaattatccgcagaagtttatgatctacataattaaatagatctagggtatgattaacttacatattggcaaaataatgagttgttaaccttaaatcatataaaatttcaagttcctttgcttacattgaggtgagaggaatttagctggaagtctcagaggaatgtaggcatttatgtgagtggtaacaatacacatagaaaggatgtctctaaagcgcatgccatagtttggcatttcctcagtaaaataaaaatagaactaccctatgatccagcaatcccatttctgggtatgcatccaaagaaaatgagatgaatattttgaagagacagctgcagtcccatgctaattctttcattaatcacaatagccaacataaggaatcaacctaagcgttcgaaacagatgaatggataatgaaactgaggcatatacacatacaaattattcggccttaaaagaagaaagaatttctgccatttgtaacaacactgaagaacttggaggacattatgtggaatgaaacaaaccagatacacacaaaaaacactgcaggatctcacctgtaagttaaatctaaagttgagttcatagatgcagacagtagaatggcagttatcagggatgggaaaatggggagatgctggtcaaaggatagaaagcttcagctgtgcaggatgaatacattctacaaatctcaggtacagcggtggcctacagttaacaatgctgtactgtatatgtaatattccctaagggagtagatcttaagtgctttgtcacaaaaaaagaagaggtaactgtgtgaagagagggatgtgttagccagctaattcacatatagtcacgctagatgataacaatcagctcactatatatatcaaaacatcacaccacataccttcaatacacaattgtaatttcaaaaaattatggcaaactttgtaagactttagtcaaattataaaataattacatatctactctgtgaccagactgtgtttgatagggagatgatgtttctaaaatggaaagctatctagtcacatagccagggcatatatgaaatagccttggaactagcaaggagaagatgatcagtgggataaaacactggtaatccttaacgtcccttattttttccttttacaaatcctatcatacatatctataagaaattgaagcatccaattatccttggaaggaaaaaagaaaaactttaaagaaaaaaaaatatggctaaacttacattttccaagtagaaaagaacatggtcattcttgacttcagtcttcatcacttggcccttgttttcaagctttgaagaaattgttagggaaggatagagaatagatattagaacaaatgacagcgccactgcagaactgaatgtccactcttttctacgtcacgttctgttttatggaacattccttggtgccatgatgttttcataaacacaggtagcaactaaagaaaaacatatgatgaaccatgggaaatactgactgctaattggtacaaatgaagtacaccagctctccagtgttagcgcaaaaatacaaaggtgaatgttgaagaagaattctatagttttgttttgctaaactacggctaaacaagtatttattttatctttatactctatgtagctgtctttgtgatgaaagattaggcttctattatttacctcttcaatggatgacatggttggagtaaatcctgatagcatttttacatctataaccaccatactggatttattgcgaattccagtgtatctgaaaattttaagaaaacactcgtttagatatcaattttaaaaagtgacttatctcataatgagagtgccaggtggataaatactaattggctagaaatctggaggacaggtaaaagctgaagagaaaatatcggaagaaagtcattttcaagcatctgtgaataggcacaaccagaatgataatgaaagagatgatacatagcaacagaaattggagcaaataatgaattatctggacatgaaatcttccccaaaccctgcttttaagcttacctgcagtctcaaagtttgaactgataaacagagcttctaaatcttttacatatacttaggttagtgttagagttgcgtaacacttagaggacatctttgcttaaaaggtggtatatgagcataattatagagtagatgtgtccccaggagaacttctagctcagtttcctgcttctggataagactattggggtatgaagttaagagttccatagttcatcagggcgtggttgctcacacctgtaatcccagcacttctggaggccaaggtgggtggatcacttgagggtcagagttcaagaccagcctggccaatatggcaaaactctgactctactaaaaatagaaaaattagccagatgtggtggtgcacgcctctaatcccagctactcaggaggctgagccgtaagaatcctttgaacccaggagctggaagttgcagtgagctgagattgtgccactgtgccactgtactgcagcctgggtgacaaagtaagactctgtctcaaaaaaaaaaaaaaaaaaaaaaaaccaaaaaagaaaaagagttccccaattcattgagttcttagccctggagctcaagcgatttttatttagaaattctaaaaaatatctcccaaactaattttactcaatgttttccacatattaactaaggctaaaagcctttagcatctataaatcatgcttgaattcaagaggatcatttcgtttttctattctgaaaagtaaaaatctaaaatgttactctttacagttacaaaataaacatttgtgggcttgctactatatgaccatgcatgcttgtcttgagaaagaaatatagaatctctgtttttcaaaactaggagtacttccatacaacagaataaaaagtatcattgaaacatcagtgcagtgaaagctttcaaatcctgctcacatagactgcatgttttcttgcctcattttagctctgatttagctgaagatgtactaaattgtggtgtccggacagacggctaaaaagtgactgtgctgtagaattgtcaccaccaacatgagaactcattaccatgatttatattttgttatttcactactgtttgaacttttaaaatattttaccatcttgttcacgtgggagttactgtcaaaatatgacacttacttgaggttcactgtgaggtcaaaaacagtcaaagagtagttctttactatttccaaggaaagagaaaatccagatgccttcttaggtaggagaacattgtacttaagggtggcctagaaaggatagcaaattataagaaaacccatcctgtattaagaattatacagtctgactatagtcagtagtaatgtgattttacattttaaaataactaagagtatacttcgatcatttgtaacacaatggataaatgcttgaggtgatgcataccccacttgccctgatgtgattcttacacattgcatgcctgtatcatgcacccggtaaatatttacacctactatgtacccacaaaaattaaaaataaaacatttttaaaaagaaagaacctattgtttatttctattactaatgcagtttacatctttatcatcagggaatcaggttaaattctttagttttcagaataacgtaatttaatgaagatagaatactttctaatagcaatattcctcaaacttctcttagacagctgagtagcttttcataaagtaacttgcaattttggctattgatcatgtaaatacacaaaacggtcaaataacacttcacgtagaactgaacagacagtctgactcttttactggcaaacactcatcaccctcttaggcagatttctgtaacctggataaatgtacaaccgcgtccttccacatctactgtgtattgtccaggtgcctgtgttacttctgaacgttggaccagtaggcggttatgaccgttaaactggatctcactggatccttcactgctaaaggtgacagtgttttgattcttagagaagagcccctcttccccgcctggctcttaggatccccattgcagggcggggaggcacccaccgcgagggggagactgagagccagtccctcccacccccggctcttaggactcgcatcgcaagcgggggaggcacgccacgcgaggcggggactgagagccagccccccttccccccgggcttaggacccccatcgcggttcctaagatccttaggacccacctggaggactgtgggtatggggtgtccaagaagaaagctcagatctgcccacggcaggtaccttacttgggatttacaatcgacaggggtccgaacgcagcccgggaaaagaaagaaagcaggtcatttacaatctaccggagccagcccgtcttcccctcgcttgctcttaggtcccccatcgcagtggggggaggcacccctcgtgaggcgggaactgagagccagccccacctcccccctggctcctgggacccccatcgcagtggagggaggcactccccgcgaggcgaggactgagaaccagcccctcttccctccctggttcttaggacccccatcgcagggacggaggcacccgcagcgaggcggggactgagagcctgcccctcttacccccctggctcttaggacccccatcgcaggagtcggaggcaccccccgcgaggcggggactgagagagagctcctcttcccccccaggatcttaggacccccatcgcggggggggaggcactcccgccaggcgaggactgagagccagccccttttcatcccctggctcttaggacccccatcgcagggggggaggcacacaccgcaaggcgggaactgagagccagccccacttcccccctggctcttgtgacccccatcgctgtgcggggaggcaacccccgcgaagcggggactgagagcctgcctctcttcccccccaggctcttcggacccccatcgcaggcgggggaggcaccccctgcgaggcggggactgagagccagccgctcactccccctgactcttaggacccccattgcaggggggggacgcacacccggagaggcggggactgagagccagcccctcttcccccccaggctcttgagacccccatcgcagggggggggcaacccccacgaggcggggactgagagccagcccctctacccccccatggctcttaggacccccaatgcaggcgcgtggcaccccccgcgaggcggggactgagagccagaacctcttccccccctgtgtcttagaacttccatcgcagcgggggaggcactcctcacgaggcggtgactgagagccagaccctcccacccccggctcttaggacccacatcgtagtggcgggaggcaccacccgagagacggggactgagagccagcccctcttccccccctggcccttgggaccccgatcgcaagggggggaggcaccccccgagaggcggggatcgagagcctgcccctattccccccccttggctcttaggacacccatctcatgggtgggaggcacttccagcgaggcgggcactgagagcccgcccctcttccccccctggctcttaggatccccatcgcaaggggggaagacaccgcccacgagtcggggactgagagccagcccctcttcccccgctggcttaggacccccaccgcggattctaagatccttagcacccacctggaggactgggggttttaggtgtccaagaagaaagctcagacctgccgaccgcaggtaccttacctgggatttactatccgacaggggtccgaacgcagctcgggatcagaaaaaaagcaggtcatttgcaatctaccagagccagcccctcttcccccccttgctcttaggacctccatcgcagcggggcaggcacacaccgcgaggcgggaactgagagccagcccctcccacctctggctcttaggactcacattgcaagtgggggaggcatcctccgcgaggcgcggactgagagccagcccctcttccccccctggctctagggacccccatcgcagggggtggaggcaccccacgcgattcggggactgagagccagcccctctccttccccctgctcttcggacccccatcgcagggcggggaggcacccaccgcgaggcggggactgagagccagcccctctaccccccgtggctcttaggagccccatcgcagggtgggaggccacccggcgaggcgaggattgagagccagcccgtcttccccccttggctcttaggagccccatcgcgggtggggaaggcaccccccgcgaggcagggactgagagccagcctctcttcctcccgtggctcttaggacccccatcgcagtggggggaggcaccccccgcgaggcggggactgagagcaagcccatttcccccccccccggctcttaggacacccaacgcagaggggggaggcaccccctgcgaggcaggaactgagagccagacccacttctccccggctcttgggatccccatcgcggggaggggaggcaccccacacgaggcggggactgagagccagcccctcttccccccctggctattaggacccccatcgcaggggggagaggcaccccccgagaggcagggacggagagcctgcacctcttcccccacgggctcttaggacccccatcgcaggcgcttcgcaccccacgcgaggcgggtactgagagccagctcctctttcccccgtctcttaggactgccatcgcagagggggaggtaacccccgccaggcagggactgacagccagcccctcttcacctctggctcttaggcccccatcgcagagtggggaggcaccacatgcgaggcggggactgcgagccagccccacttcccccctggctcttgggaccaccatcgcagtggggggaggtacaccccgcgaggcggggacggagagtcagcccctcttcccccactggctcttgggaaccccatcgcaagggggagaggcaccctccgcgacgcggggactgagagacagcccctcttccccccctggctctagggacccccatcgcagggggtggaggcaccccacgcgatgcggggactgagagccagcccctctccgccccccccgaccccgcccgggtcttcggacccccatcgcagtggggggaggcaccccatgcgaggcggggtctgacagccaaaccctcttccccctctggctcttatgacccccatagcaaggggggaggcaccccccgcgaggcggggactagagccagcccctcttcccaccctggcttaggacccccatcgcggatcctaagatccttaggacccaactggaggactgtgggtattaggtgcccaagaagaaagctcagatctgccgacgttacttgggatttactatccgacaggtgtccgaacacagctcgagatcagaaagaaagcaggtcatttgcaatctaccggagccagcccctcttcccccgcttgctcttaggacccccatcgcagcagggcagacacacaccccaaggcgggaactgagagccagccccacttcccccctggctcttgggacccccatcgctgtgtggggaggctccccccgcgaagcggggactgagagcctgcccctcttccccccccaggctcttcggacccccatcgcagtgggttggaggcaccccctgagaggcggggactgagagccagcggctctttccccctggctcttaggacccccattgcagggggggggacgcaccccccgcgaggcggggagtgagagccagcccctcttcccccccaggctcttcggacccccatcgcagggggggaggcaccccccgcgaggcggggactgagagccagcccctcttccccccctggctaagacccccatcgcgaatcctaagatccttaggacccacctggaggaccctgggtattaggtgtccaagaagaaagctcagatctgccgaccgcaggtaccttacttgggatttactataccacaggggtccgaacgcagcccgggatcaggaagaaagcaggtcgtttgcaatctaccggagcctaagggcagaaggcaggtgagagaattcttaggagctgtggggttttgtagactgtggatcccaaactttgcagtattagccaagcctttgtatgaggtcacaaagggggcggggaccgggaagctttggaatggggatcccaacaacaggaaggctttcaggagttaaaggaaaaacttctggcagccccagccctggggctaccggatctgacaaagccttttccattgtatgcgtcagagagggaaaagatggcagctggacttttatcccaaactgtggggacctggctgaggccggtggcctaagtctctaaacaagtagacagggtttctacaggatggcccccctgtttgagggccttggcagcaactactctgctagtactagaagcaaataagctgactcttgggcaaaacctgaacataaaggcccccccaaactgtggtgactgagagccagcccctcttccccccctggctcttaggatccgcagtggactcacagcctgtttaccatattgtgagtaatatcatctccccctctggagacctctggagattatgaactgtttcacagacaggtgtacacccttggtgtacagagggtgtacacccgtctgtattgggagtaatatcatcctcttcctccctgaatattaagaacagtatcacaggggtgtttctactccctgcgatatcgcgtgtcatatcctcctctcccacgttgcaattagaaacaatatcagtggtggcatgtccaccttctgtcatattgaaagtaatatcattttcttccctccaggatcgtgggaacaatatcccaggggggtttccactttctgccatatatgtagtcacatcgcccactccgccttggaatattattaaggaccatctaacacgagggtgtatacgtcctgcgatattacgagtaatatcaacttcttggcctctgaatatgaggaagaatatcacagggtgggtgtatacctcgtgctctattatgcggagtcgtatctgtctattacggggagtaatatcattctctccctttcaggatattaataacaatttcacaggctgggtgaacacagccggcgatgctgaaattattatcatcctctccccctcttcccctcctggcccttaggacccccatcgcagggggctgaggcaccccccgcgaggcggggactgagagccagtccctcttacccccctggctcttaggacacccatcgcaggggggggaggcaccccccgcgagggggggactgagagccagcccctcttcccccccggcccttgggacccccatagcgggggggggaggcacacccctcgaggcggggactgagagtcagcccctctacccccccggctcttgggaaccccatcgaagtgtggggaggcaccgcccgcgaggcggggactgagagccagccactcttccccaccggctcttgggatccccaccgcagggggggtaggcaccccccgcgaggcagggactgagagacagcccctcttccccccctggctcttaggacccccatcgcagtgggggaggcaccccccgtgaggtggggattgagagccagcccctcttcccccctggctcttggaacccccatcgcagaggggggaggcaccccccgcgaggcggggactgagagccagcccctcttccccccctggctattacccccatcgtggatcctaagacccttaggacccaagtggaggactgtgggtattaggtgtccaagaagaaagctcagatctaccgatggcaggtaccttacttgggatttactgtccgacaggggtccgaatgcagcccgggatcacaaagaaagcaggtcgtttgcaatctaccagagcctaagggcagaaggcaggtgagagaattcttaggagctgtggggttatgaagacagtggatcccaaactttccagttattagccaagcctttgtatgaggtcacaaagggggcggggaccgggaagctttggaatggggatcccaacaacagcaaggttttcatgagttaaaggaaaaacttctggcagccccagccctggggctacccgatctgacaaaaccttttccattgtatgtgtcagagagagaaaagatggcagctggacttttaacccaaactgtggggccctggctgaggccggaggcctacgtctctaaacaactagacagggtttttaaaggatggcccccctgtttgagggccttggcagcatctaccctgctagtactagaagcaaataagctgactcttgggcaaaacctgaacataaaggccacccatgctgtggtgactgagagccagcccctcttccccccctggctcttaggatccgcggtggactcacagcctgtttaccatattgtgagtaatatcatctccccctctggagattatgaactgtttcacagacgggtgtacaaccttggtgtacagagggtgtacacccgtctgtattgggagtaatatcatcctcttcctccctgaatattaagaacagtatcacaggggtgtttctactccctgcgatatcgcgtgtcgcatcctcctctcccacgttgcaatgagaaacaatatcagtggggccgtgtccaccttctgtcatattgaaagtgatatcattttcttccctccaggatcgtgggaacaatatcccatgggggtgtaccctttctgccatatatgtagtcacatcacccactccgccttggaatattattaaggaccatctaacacgagggtgtatacgtcctgtgatattgggagtaatatcaacttctcggcctctgaatatgaggaagaatatcacagggtgggtgtatacctcgtgctctattatgcggagtcgtatctgtctattatggggagtaatatcattctctccctttcaggatattaataacaatttcacaggctgggtgaacacagccggcgatgctgaaattattatcatcctctccccctcttcccctcctggctctcagtccccgcctcacgggttatgtagcgggttatggcaagaagacaaactgcagtttcctgcacagaacagcacaaacaatgatccaagctcagttacaacacaatattggtcatcatttgaccatggacttcaatatcaacccttagaaaccttcctaaaacaggtcagcaaaacaccaagaagcaatatcctgaatgataggaaaatatccttgcttgtgcaaattgtttccacttaatttttttcaacaaatgttaattatatttttactttctaaaaatttttaataaaatatagcctacttggttaaaaatggtgtcaaagcttttctaaaagttaaggcattacataattcagtggcccctgtggctgccatggataattcttttttttctgttcatcttcaaagaagggaattcagaatcaggaaaagatctttggaaattcattagcatatggttttactccgaaactaagaccaaacacaaagagaaatgcagatttttctcatggaaataaaactgcttttttgcattttcaatttgtttccaagtaaggaaaaacatgtcattgtttctcataccccccatttctcctgttttccttcttttcatttgcttttcccagtgtatagcccacagaactagagcgaaagctttctttttggcccgtatataatttgaacagagtatcatcaggtgtctaatgtaccaccaagagtggtgcttacgacaaaaatgtcctctagacttattctatgttcgctgtgtgaatgaagatactaatggtcataaattcctggaacgggagacctcatttcattcatttctatttagaggcttcctagtagagtgcctcatacacaataactggccaataaataattgttgaggaaataaaataagattaataagataataagaatcttattaccaaagattcttcttctcagaaagggtttgttgtgatagctttactattaatatctcactcgtcatagagttacagcttctgcattaaacatattgctattaatatcaggcctacattaatcacctggttggaagaaaagcctccatgggaattcatctgttgggcaagccactgcacaatcttactagcataggtgaggtcaggaattttccgggaaatgacagccaacagcacatagcaactcttctcagtctgagcagaaggtgcccagggaataaaggatggaaattcttctgtcttgggtttcctttctctttcccagtagatgacattatctgagaaaaaggaagaattttcacatagtctgcataaaagtcatgggttacacataaagaaggatgaaaattccattcccgacctctgtttgtgctgaattgttcccctaaaattatatgttgaagccctaacaccaagtacctcaaaatgtggctgtatttggagataagactttttaaagaggtgattaagttaaaatgaagcttatgggccacaatccaatctgactggtgaccttatgagaagaaaaattttggacacacaaaagggagagcagggctgtgcacacacaaaagatcttgtgaagacaaaggaagaatgtggtcatctgcaggtgaagaaaccactttcaacaccttgaacttagacttctagcctccagaagcatgagaaaataaacttctattgctgcagtcatccagtatgtggtattttatgacagctatagcaaactactacagccttcaatagcaactttctaagtagcaggtgattaagcttccccagcagttttgatagcctatggcttggtcaccaggcttgattcccctgacatcactcatttgagaggaagctagcataaagcaaaagaggaaagtctagaatatgtagcgttcttgaaaggtataaaggccactgataaattccataagagaaacagaaacatactggtcaagagggagctcctatgtgactgcttagaacgcttcctcactgtgctccaagatcacctccattagcaacaatgaataataacgcttacttagttttgtggcagattgatccagggtttggagtaaagattccacttgcttctcttttccagctaaggcaaaagcataagctagaattgcatgattgtagccattagtgacaccactgtccaatgccgcttcaaggcaaaagagtgcgtttcgtagagcaggaaactgttggtcaggaagaagaatcatatattgtaaactgatacccgaacattccatgaacttgttgaacatttaaactaatcattgtttataatatatataatatatcctcaaagtatattttacatacaaatccatttatatacacacatatattttatccttcaaaaatatcattaaaataaatttataatgtcattattagtacctaagcaataattttttttgagatagggtctcgctctgttacccaggctggagtgcagtggcatgatctcagctcactgcaacctccacctcccaggttcaagcgattctcctgcctccatcttccgagtagctgggatcacaggcatgcaccaccaagcccagctaatttttgtatttttagtagagatagggtttcaccatgttggccaggctggtcttgaactcctgacctcaggtaatccacccacctcagcctcccaaagtgcttggattataagcatgaaccaccatgcccggcccaatgaaatttagtaagaaaatggcagtttttatatttgatcagtgatattttagttatgaatgtcttctatgcggcaaagcatccaaatttatcataggcctaagagttttttttttctaatgcctaaaatagaggcttacatttctgaagataattttcagggtatactaatgaccctgacaattcctagcatcttagttcaggaatagattttggaaatctaatctatggattgggaggtggctagggtgagccacacttaagttgaaaatgtttactcacttattgtttagagagaaacagaatactaggccacggctttacttagaacagtggttcttaatctgaaattcatggctgaacttcaggagagatgtgaatgcctgcaattgtgtgaataactcttttttgtgtgcatatgtgtattctccctagggagaaacccaatcctgtttttcaaagctgtctatgaatgaaaaacagtttgaacagcatgaatttaaagggtggtaataaactaaatgttatctcggggtttcatccagtcttagaatctcaagtgactctgactctacagtctattgaatgtgcattcagctgcctgaaatcagaaatgacgggaatccatacagtggaattgagcccagcttcaaagaacatcccaacaacatatgcagtgagtgaaatgtcctcttcatctccaccctgaaaacaaaggaacaatgagtcattcgggacagcagagcacaaaatagcaagtattcttttgaagtaaaactaggtatgaaaaaaatactggaacaaataccattattcataaaaacacccgaacatgtgtagtttttaaattagatggttaataaccatactatctaagcaagaattcattcagactctatgcaataattaaatcataattattaagttgttataacaattaatttcaatcatatttatgtggcctggtgttaagcatgcattctaaggaattcacaggactctatttgtctccgcttggtataaatctgaaaaaagccaacaaagaatttctaatgaggtgaagcagaaagttgccgtgaagattcctggaaattcctggaaaagcaccctaggagatcaccagaatcaagtctcagattcttagagtgtaaaatgagaaactcatttataaatcatgtggtttgcaaactgactgtgcataaaactcccctggggtatttaaatcaaccagtgtctacacagagattctggttcaaaaaacttgggaatacgacagcaaaatgcattttaatgggtgctctagtgactctgatgcaaatagcattcagaatggcatctgggatctactgatcttgtagaagcttcccattttatctatttaagcaaaggacaactcctgtcttcttcagaaaagaaatacttctgagaaaccaagtgtttaagatggaaataacagcatatggtagacactaacatgaggtacgaggactgtcagtacatctaaattacagcaagtgggatcaccattcctcagcagtgtaagctttgatttttcccttgcatttttatttctctcaactcaaaacacacacagacacccacccacacagatatttaattatagagaaaatactaggtaagatcagacaaactgtagcagtaatcagcaatgattcaccagtaatgaatccaataagaagaaagatgtgaagatgttttagaagagaacgtgggaaagtttttgatttttctatgaaggagtaagagctcttctccatcagggtcctcctgttgtaaggaataagtttggaatacattaaaaataccacaaagcaatttgaatacaatttgcatgcaaattaaatatcagagtgtctgttttcattcatattttgaggtggattagatatgcattctgggtttcaagaacaggagtgctgattatgaggaaggatgctgaagaaaagctcagggtatttcaggggccatcagagcatgctaaaatgccatgataggagattttgagcaaccacaggggaaaaaaggaggggaaaggagatagaagatgggctggagatggacaggtatctgcaaagaaaggaagttggaagggagggatttacgtaaatatggacaggaaaagggttggattttgccaaggatatacttcacctcatttgtactttggccccggggcaagcttggcctttgaatttttccttgagagggtcttagaaaaacttgcttcattgaaacaatatgaattactagatattctccccagaactttcttgccattcatggacaggaataaactttccttcctcatacactcacagccccctccctttatacattgactgtctccaaatttatgaaagtttcttttctaggttccctttctctcccctcccttctatttctagtttaatttctgaagaggactgactcgggaaggactagagactgaataaggcagacaagagactcagaaggagtcacatccaggctgtagttaaacatgcacaaagcaggaatggtgctgctgaccaacccaccacaggcccaggactgcagtgcctcagaaggtttcataggcacaggaagaatattcatattccagatcaggaaagccagaggcagggcaaggcaggcaatgcccaggaacaaggaaagcctggtgcttctcctctctcacctcccaggcgtggttgaaaagctggccatcattcttaaagcagccgcttgttttctgttggcttgaaagccagattaaggtctgtttttgaacattttcatcaatgaatacaaattttttcattctctccaatgtcttaaaagtaagagcactgagcctgtaatacaaatcaccaaagcaaaagttagataaagaggaagtgacaatgtcagcaattccacagtttcatcaccattgttccctttgagtaaaggatgcattcaactcatctactgtaaaccatctttattgttagtggccctttcctttgggtcaggaaaatattatgactagcaataagtggaaattagagtaggtaattttcagcatgtttgcacccaaaggtcctgttgtatatagcccattagattatctgcacatggagagagaaatgatgtaattaggtattttgggtccttctaatttcactttcccgaatctatatgggactctgagaagcacagagtaagacgtgccgtgccctcttcggtggagttaaccagcggtgcatgtctaggggctgtcatgaaaggatcagactgctaagcaaatcgtcatgagactgaaggaacattgttgcattagaattggaatcactaaatctttagttttatctatttctcttctgtaaattgactttgaaacccactttgcttctaaatccccactgaactctatcctccttcacctccttgcaagccctcctcaggtaattcctatattatataaaataaaatttttatgtctcaccatatgcttcctttctgattctgctgccaaaacacactataggaaccatcagagtttttgaaagataattgcctttgataacctaaaatagaacattgtaggaaattattttttaacctaagaaagttagaagagaaagaatagtgcagtgcaagccctaggtattggtgttagacacaaatcactaggatgatcatttccatttgaacttctgaaactcaggttctgtattcataagggagaaaaaataactcttactttataggattttgatcacaagataatacacatggatatgtctggctcagtaattgcctcgtcattggtacctactaactattcagtatatttcccctaaggtcattttatttcagtgttatctttctgagaagaaaaaccaaagaagattattttatgctcctggacttttccttaacctcacagttcacaacattggccctctttgtgtatacaaagccaatcacttcactgcaacagaccacagctgagcaaacaaatacagacgttgatagatgaaccactgacaacaactcctaacaaaaacaacaataataacaacaataaacaaggtagcttgcaaaataccagacattaaaaaaaaattaagtgcatagcttgaaaactttgcagctgtaaattatgacgctagctgaccacacagattttgaagtcagacggaaaacagcgctaggactgagagttcctcggttcaggttcacttttctttcaccagactactgcataaaaacagcttatgacatcttggtatgagtaacaattgctttcaaaaattatgggcagaaattacttaaatcttctcaccattagataagagaaagaaagccttagattgaacttcctctgtcagttgctcagtagatttcagatagtccagaacataagtatcagatgctagtagggcagcattctgctctccacctccatagggcatttggagaacaaccagattctgcatggcaagtcctagaatatcccctaaaaacaggaaaagcggaaagctgtattgtttatagttgccatctcagcattaataactatagacaaaagaggcatagtgaaataggtaacatttaaaattgagtctaaatggtggaaacaaagaaagttttatgaagcaatttgaaagaggagacagccatgaagggtgaagttaaactgctatgaaaaatatttctgaaaatctcattaccagagagaggaggaagttaggagaatgcatttgtttgcttgtttgctagttttttttaatcaatcaatcctatgaattacaaagtgtaatccatcccttccaagagatgttcatgttaataacagacaaagaagtttgccttttgtatcaacaacaaaaatttctccttttattgagaaaactcccaacatcattaacaggcaaagtcaattcgattctccaagaggtgaatttcatatttcagattaatgattataaagaacctcttgctttctgaacactagttaccatctacccaagctaaggtttcctgggaatataggtctggaaacggtactgtaatccctttagatcccatcaggaaacatagaggatgatctgatcaataattccctccaattgatagcttaggaaaatctctctattctattattttaaggatttttaaagaccacctcaaccaagattttcaaatcatagtgaaacacaaaatttgatcaacttacccacaacagtgaaaaagcctctggctgacccttctactacatcatttggcaagtccaaaactccctgcttggaggctttggcacctagaatgaaaatactgatttaaaaaatgtgatggcttctttatatcagcagatttgggggataaacatattggaaataagattccattacttatttttattttacaagttgtttattagaggagatgaatttggagttttgacccagtttaggataatagtacattcagaaaatggcatataaatctgtgtgttagattgtggcccccgttcttcactggtttagtgcctgaactatttatgtatgaaaaaatgtaaaaactacactgactgtaacacataaaacaacacacacaaaaggtaaagcttgaagactcagatgaaggagtataatcagatcaccatcaaccaggtaaaataatacccctcatggccataaaaccggagactgaggtgcaggggcagtgatgtatctatgggttattttctcctaagagtacaaaagccaagattatattatgtgctattgggcctcaatcctaatatctcattgtccaatattgtgtgacaaccatatcataagaggagctaagagtacacatgatggaaaaaaaaatagataggagcagaccagcctcagaaagtgaactaaaaaccacctcctgaatattctttttgatggctaaaattataccataaagataaagcatgaaacacaagaatcctccacgagttatttaaagtgaaatcacagggcacatggactcatgtggaaggagaggacatgaactgattcttttggtgaattttatttaggactaatttgactccctaaaagatcctcttaccttctgtacagataaggaaactctgggtcctttccttttcaataccttcaggctgtcaaagaataacacaaacaagcacagaagaatgagtctagatcctctgtccatgaaggaaaagtgattaagcaccagctcacttaagcatggctggtgcaagtttatccctgagagaagatccaactcatcttccccttttgttcatatctggaaggcacgggacatcaccggtacccattttagcctctgcgttctgtagcttggacaggcattatcttgatgtcactgtgggacactctcagctcctctgatcctgtatagcatctccagtaaacaactaaaagtgctttgtggagcagggattgccaagaggcaaatcaagagtgttcctctgacaagtgctgattcttgttgaggatgacgggaactgcatgggagtgtaggacaagtagatttgtctcttgaatttgagaatcagaaaaagagaaggaagagaaataggtgtacaggaaacatcttgactcagaaacaaacaaaaaattgtcaagtctatttcaaatgttaagttttactatcctgggtgaggtattaattaaagaaaggatgaactttatgctgttttaattcatttaaaatggcatgtcttgtgtcaaaagtaaatgttgtcaactaattaagtctcttcaatgagaagatcttttaatacaaaacctcttagatgtctgtttcttttcaggaaaagcttgactgtttgcatatccatacctctactaagaagcttttgaccacagtgtctttccagtttagcttttgctgctccattccttcatttgggcaagcactgctttgtttggactcagcaactacagtgatattcactttacctggaagacattcccaaatataaattaaattgatcattggtcccttctgtaatgagaaatgactagagtctgtgaaccatgtcttgaattggattaaccaaattctatcattaagttaatgcttagaacaaaataacttatttcttctccttcctaggtataatgtggtatcttccatttcacctgttccatgattttcatgattccttacattaaatgataaatttacttaattaaaacttaagaaattttaggaaaagtaacattttacaaagttgtctgagtcaatttcctgatattgattgtttataaaggttacttatgacaatataggctaataatgtcagcgaactagggctcctaacttcccaaaatcaagcaagcatagtaaaatatgatatagtagataggcactggattgaaataatgtcctagcaaggaatccattgtttttaaacttcctgatttcacattatgtaattagaactgatctccagtttccttgcttgtgaaaattacaggattgaaaacaatcattcattctttaaggttattattatttacgtgactatataccaatatacataaccaatatattgttctctttgttgttgttgttgttgttgttgtgttttagtgtttctctgtctcaggaagcttgctatttcactcttaaaactgtgtcttcgacttaatgtcataaaactatacaagttggtacagtattctgtctcaattgccaaggtaggattttgaagatcttgtgcagtagaaatattgagaaacttcaaatctaatagaaaaatagtctgagaacagcatcacaactgagctaaaataatctcatagatatattatttgctgttaaaataatacaatgaatatagtacattaaagaacatttgaatggccattttttaaaagtagtgattaaaagtgtcacgcacatcgtatctagcattccttgtttactagaattttaaactttttccattccatgtattttcaatatttcaataggagacaagtttatttttccatcttgcagatagcataggcactaagacaatattctcagttttttatctcaatccaatcatttagtgattttggtatccccatggcacatctagtaaatttacaaacctgacaattccctcattggtcattgtgatggagcagcaattttcttgaaggtggcctgggttcatgatggtaggtgaaggacccagcgagaagtcaaataattaaggtggcattaatgatagcatggccttcatttgggatatggcatatgccaaacatatagtccatgataggtcatgccagttagcatttatattgtattttaattacattatgctcttgtaaaaatgaatggtggttttgatctacacagcattaacaaccagaaattagattactatagattagaatttctaatggagaatttacaataagaattttaaaaatgtgagggagaaaatcacgtttgtatagacaatataaggaaagtaaatggagacaataaatatgggctggtttttccatgagtgactggtgtagacagatagctgcttacccaatttcttaggtataatagtccagatgtttgttttcctccctccagcttgaataacctcactgccattgattttccaggtattaatatttgcttcataattctgagactcctccacttgaacagaaatctaagaaaacaatcatggcaatgaggatagcactggaacacacatcactatgaaacaccatgctcaatacactgtttaaactgtcactgtgaatgaaagcaattgtatttgtttgaggaatatggacctaagtcttatacctttatagtagcattttgcacttgaggataaagagaatatggaaatattaagaatattttagctttgttagatttttgcctccagatcaaacagaacaacgcacctctacacatgtattcaggtagctgaaggcattgacaatcaaatcaaattgttcattttgaacaaccgaaaagggtgaggcaatttcaataaagaaaggttgggagacttctagagtggttgtagaggaaatgccaaatccaacgtcgccattcacacaaaagccacttgcctcccattgggttatcgtatcaggaatgaggaacgaaagattggcagagcctgaggaactggaagaagaggttatcggtaaaacacattctttgtctgaaccaagaacttaaaattaagtgcagagcaagcagaaaagtattgactgaagctcaaaagtgagttatattgtttggatggggcattagataaaaataatgagagctggatttttataaaatttgagtatagaaaggtcatttttctttaaacgccacttttttttttaattggggcaggttaaatctgtctgcataaaatgaatagaagagaaactcttggtgaagggaaaacaatgctagagaaaaaaataaaataaaatgtatgataagtacatgcaaatcaatgatatatattttacaaatatggtactgttttatatacccaggaataaacctgaagaaagaaaaagaaaatagaaataaagacacataggagagaaaatggttaaaactcactcgacactgacgaggtcccacatccatgtctctgggaagtttgttcttactgtttgaattatagcctgttctacatagtcagcattctcccctctgattccactagctaaaaaaaaaaaggaagaagtaccttattcagaccttggactctgcaaattatagtctatatattatcagggtgtaaggtctccataaaacacctcactttcctgtatcacagtcacttactatgactgttttcctgtatcaccatacattgcctgttcccctacacagtcaggtaccacataatgacactgtgatcaatgacagaccacttagactacagtggtcccataaagttagaatggagctgaaaaattcctaccacttattgacatcaaagccatcataacgttgtagtgcaatgcattggtcatgggtttgtggtaatgctggtgtaaacaaacctactgcactgccagtcctataaaaatatagcagacacaattttgtacagtacataatacttgataatgatgactatgttaccggtttttgtgcttactatactatactgtttactgtttagagtgtactgttcttacttatcaaaaaaattaactgcaaaacagcttcaggcaggtccttcaggagatgttccagaagaaggcattgctatcatagatgatgacagctccatgcatgttattgccccagaagaactttcagcggtacaagatgtggaggtagaagacagtgatattgatgatcctgaccttgtataggcctagattaatgtgtgtgtttgcatcttcgttttaaacaaaaaagtataaaagttaaagaaaatttaaaaataggaaaaagcttatagaataagaatgtaaacaaagaaaatatatttgtaccctgactcactcagagtaacttttaaccttgcaagctccattcatgggaagtgctctatataaaagtataacttttttttatcttgtataccacatgttcactgtgccttttccatgtttagcaatgattagatacacaaatagttatcatcgtggtacaactgcctacagtattcagtatagtcacatgctgcggaggtttgtagcctaggaaaaatgggctgtaccacatagcataggtgtgttgcaggctacagcatctaggtttgcgtaagtacactctatgatgttcgcacaacaatatcacctaacaatgcatttttcagaacaaattctccatcactaagtgaagcatgactgtatttctgacattgtattttatcaataaaaataaactacatctcacatctgaagctaatttcttgttatagccaaaagcatgtctagtctgtcttattctgctttatccaactataggatgtctaattgtagccaaaaacatggcataattcacacataaaattccaaaattgcatcatttatcccaaatacactaaattccacaaagcggtttggtcatcccccaacaaaaaaatgtaagattacctacatgcaattctagacggaacactatgcattggaccataattttctgtttctagataaagcggcttagggagtggcagccttctctccatcacacatacttctggttttcggtaatggagattggtaaagactttgagacccatgttctttaaagaaacaaacaacaaaaatattgttcattcttttcatgcaagaactataaaaggcctattatttatattgcaaagataaatggatcataagtatccatattttctgtgttaacaaaggtctgagaagttacaagtcaacttacctctatttgacttatggaaaatccctaatttagagaaaaaattataatcactatgatttatctagcacttattatgtgctagcatttttctaagtattttccattattctccatttcatcctaagtggaaaatacttatgagatcagcactatcattaccctaattaacatcaaacacacacacacacacacacacacacccggcacactcagtaaattaaagaactggaacctgataaagtctgtctgattcaataccccttttcttacacacttgtgatgttaattatagagattatttcatggaaggctcagcatgtctcattaatggcctagggatatctggagtccacactctcttagcctcttgatttgacaatctttgcataagatttattgtattaattggaggctgtcttatttttttaagtgaggttttgtaattatagctacatgatttattttcagcagaaaattttaaaatcaacaaaattaatatctcctttttataagacaatttctatgtactctattggcagattacagacacgaatctcaaagtataggaagaaaactacataattaagaaaacattaatatgcattatgaatactaaaaattgtgatgaaatattttccaaaatccttagtgatcttaccctgacaatattatagatatctccatccccatagttgcttacaggtgtgtaatataaaccattgtagaacatatccctctgaggaatgcaagggtcttccttgccatcatcaagattgaggccatggtagaaataaccatacggctctatacttggaaccatgttatacacctatgagaaaaaacatttcccaataattttaagcacttcttttaaaattacaaaattggcaaattgtctactgtaccatttattcttgttcttttctttaagagcacggccatcatatttaatccagtattttcacataagctcttcctttcaaaagagcaaaccagttttgttttaggcaactgatgtcatgttcacagaatttctcagcttgggcgcaggatttaagagagaatgtaagaaagcaatgcctgactattgattaatccaaggcccattgtacacacagtcaattataatgctagaatttctaagtctggagaataatcttagctgcctgattttaaatcttcttacataatcttctgaagaaaacataaaatcaacaaagagaacaagtaaggatactcatgactaatatctttaacattactacaatacagagaataccatgatcttcaaattatttcttagtagagaaacaaacaccaaatgccaagagagcttctactgctattgcagagggaaggcttaagagactgcagagaaaaagagagcagaatggcatggagaaatgagaagaaacacacaccaagtcaactccaggtaagagaaagtctagcattgttaaaaatacaaatcatagttttcggactcaacagttcccagtacagcacacagggaaagggcttggactgaatgggcctggaagtggaagcttccaaaaaacatggctaaggggaaataatcagatcacaagaagaggtatgcagatccttggagacagggaatttaaaaaaggaaaggatgtcataggataaaataactccctccaccctcatttccatcaccaacattttaaaaataatgcattttactaaaaaaaaaaaaatagaaagggcgctcttcacctatgaacaccctgcacaaaatatcaagaactagaaaaaatcaactccatacaaagcttctgtaagagaaaataggaaatgcaaaccaaaacacttcagctaatgaaacttctccactaaagtcactaagtaaataaataagtaaacaaagaaaagccatgccaaaataatttaacatgagtgaaatattctcaagcatgtatttgaggtatttaaaaggcaccatgagtcagaaattctattaagaaaatacagaaatggacaaaacccaagaagaaataaaatgaggctttattgaactcaggaaaactagacaaaattatatcataaataaactctaaagtacaaggacatcaagagaaaattgttcagagaaaactttaaaagcagcacagaggaaaaacaacagaacaaaactgaaaaagaatgaattaaaacaggtcacaaagtgattgaattggaaagcaggcaaggaagatccaacaaatgtacagagatttttttagaacaaaaaaaatggaaagaccaatatttacaattataattcaggggaactatctgaaaataaaagaagatttgagtttacatattgcatgactccactgtgtacctggcaaaacttctacagaataacattcttactgaaactgttagattaaagtataaaggggaaaaaaacattcaaggccttcagacatagagataaagtagcccataatggaaaatgaattaaactaatgtcagcactattaaaaggcatattcaaagcaagtcaatagtaaggtagcatttcaaaaaattttaaaatgtataaaccaaagatttaatatacaaatacctgtctttcatttattaaggctttagaaaaaataattctgaatatgaaaatgtcagagaattctatacttatgtgatgtcctgaggactctagtagagaatgcactttttaaaaattgttatttatttatttctgagacagggtctcattctcttgcccaggctgaagctcagtggtatgataatggctcacagcagcctcgatctcccaggctcaagcaatcttcccgccccagcctcctggagaatgagctttatgtaaccaaaagatgactcaggaaattagtaagacttgatgaataggagaaacaatacagaatgtaaacattatatattctgacaaaaaaggaaagatgcaacaataaaatgagagaagagggagagaaaagtggaaactagagattactgactgttgtgtaggtagcagttaagactcaaagattaaaaataactgactagattttttttttttaaatggagtctcgctctgtcgcccaggctggagtgcagtggcgcgatctcggctcactgcaagctctgcctcccaggttcatgccattctcctgcctcagtctcctgagtagctgggactacaggcacccgccaccacgcccagctaattttttaatatttttagtagagacgcggtttcaccgtgttagcgaggatggtctcgatctcctgacctcatgatccacccgccttggcctcccaaagtcctgggattacaggcgtgagccaccgcgcccggccataactgactagatattaaggttaagcaagaaaaaatgagattaggatattaggatattataaaatatgtaaatataaaaataaccactaaaataaaaattcaagctagcctgaatactcaaagaagctttaagcaagataacaacaaacaaacataaaagctaaagaaataaagtagctttaaatacaatacagaatcataagaaaaatagtatgatagagctgaggcctaacacatacatcatatcaatagagtgaatagactttattctcctttagaagacaaagatatgcatatttaaaacaaaacataatgctgtacttcatacaaaaaacaagtgaagtgcatatttcaaaaggtgaaatccaaaggaaaagtaaaggaaaataataagaatgcaaaggctgcaatcctcctgttatcggaaatcgtagaagtaaggccaaaagacatcaaacaagatagagaagaatacttactgctaaaagctgcaattcataataaaggcacaacagttatgattatctatgcagaaactacagaagatgcaagaagaaacagagcactatttgtagggtattttaacacatcactcagcagaagaaggttaaataaattttacaaaataagtaagaatacaaagaatcaaaataatccaacctcatggatagaaaacaaactgataatagagactatatcttctcaacacatgagatatattcgcaaaaactcattatatatttgggcacaaaaatataccggtggaaatattgctggccatgaagatatagaacttgaaatttaaaagaaaactctaaaataaattcctttttatatgaaaattataaagtactccagtaagtaaattttcagtgaaagggttaatacaaacagaaattacggaatttctgaaaaataaaaatggtgcaattgctatgtatcaggatctatgagatacttcaaaagtagaaatcatggaaaaacttataggcttaaaaacacctagcccaataaaataaattaatgaaaatgaagtaaatttctaagtgaaaaagctaaaaataacaacaaaatacagcaccagtaaggaaataataaagataaaaatagaaattaatgtgatggagtagcaaaaaacctcacatcatattacatcacattaataaattaaaattatatgtttttggaaaactcggcaaaataggtaaaccaccaactaatctaacaaggaagaaaaagtagctatctgcttaggaacaaaagaaaaacaacttcttccatgactcagttttcagcctcattttttgtccttttagcatcgtgaattggggtccggagttgtttgtatttttctttcacaatagactgatgtatgtaacctagtctcaaatgattcagaaaaaactgaaatggcataaactctgtgtgtgtgtgtgtgtgtgtgtgtatgtatgtgtgtgtgtgtaggggtggagagagtgagaaagagaaaacaagtacggtgaaatgttcacaaactggtgaatcaggccaagggtctacgggagttctctgtgtaattcttgcacttttaaaaattatttaaaactaaaaactaagcttacatagataatacaaaaaataacataaacttatagaatataaattggaattcactcatttatagaacttcacttgatttatactattaatatagctatcaataataaacaagggcaacctcttttggctctgatatattctgagacccctgaataatgcctctagaattttctttttgaggtcccttgatggtcttttcttgaggcagttttcctaagatattgccacctccaactgtagaaagaatgagcagaagctatttactctgaatccatgaaactctcaagggaaaaaaaaggagtgtgtgtgtgtgtacatatataaacatatatatgtacacacacacacacacacacacatatatatatacatattccttttttttctttgagacagggtctcgctctgtcacccaggatggagtgtagtggcacgatcttggttcactgcaacctctgcccccgccagggctcaagtgatcctcccatgtcaatctcccaagtttctgagatcacaggtgcacaccactgtgccctgctcattttttatattttcgggggagacagagtctcatcatgttgtgcaggctggtctcgacctcgtgagcacaaacgatctgcccgccttggcctcccaaagtgctgggattacaggcgtgagcacagcacatggccatattccatatttatagataaatttatcctttatttgttgatgtcccctcagattctgaaagcttctaactaaaagtatttttgctccctgtaatagaaaacttaaatgtatttatgttttgcattgagaaaaatgttttatataatgatctatagttattcaatattattactgaattctataattttatacttaaaactggacttactacagaatgttgaaagcaaaatacaaaactattttttggtgagatctcaagtttgtaaaatatatatgccttcagaaaagagacttgaaaaattacagcaaaactataaagatgcctaagtgttaggactataaatgattttaaagatttccttctttatgtctttgtatactttgcacaaagtacacaatttaaattagatttaaatatgatcataaatttcaatagttatttatatgtaattgtgttagaaataaacggaaaatatccaacaattgttaagcgaaataaattggatgtgaacttctggaattccaggtctggaaatgtttaagaaaatacaatatccatttatagataataactttacactgaatccaagcatatccttgaacatagagatttcattttattccaagtttccacttctgtgattacacctatgatttttaaaaatcacagttgtaaaattcctaaactgttataattatctatcaaattctgtattgttataagcatgctcttaggatagccaagaaaaatacgtatataatccacgaaggaacaaaggaagaaaacattcaatattttcaacatgttcaagacatcatctgaaggataagacttctggtagtccagagaaacatgaaaaacgaggaagtcagagagcttacactttcagctgacagctgttgttcagatttcagtagaaggacgttcccatccacagccccgagggcacagaataagacaggcgccgcttgaagatagagactagcattggaaccaggtaagccctgctcgttagagaactttatgttaacctaaagtagagaaaaaaaagagatgagagtagagaccattttatgtaaagatgatctgaatacatttaatctctcctgaataaatccttatagatttctatacggtatttcctttgcccactctcaccctcagctttctttgcaggagacccccttcaccacgtgctgccgtctcaggattggcactgctgccaaggatcatgcattgtgtttggtgattctcacatcccctaataattcaattatgccagcactgagtgtaagtttcccacgtgaaggtgatagcagtcaggcgagaagacagcagggagcaaactgttcccacttctcaggccagaaataggagaaacatcaccttgtgtttaaagcacttgtcaacctggaatctgacactgtcagccacaatttccccactggggtgaagggtgtagacaaacaggacggctgcaggagccagatcagcactgatgctgagtgggaacgagaagtttccattccaggctgtgtaaataggagacgaagagatacgatgctgaaagtttcctgaatcactggtacacttagataaaagagaatagctcatggacagaaagagtaaattgggccctgttttcaagacaaataaatcaaataataggaagtacatacacaaataaagaagactgcataatttagataataacaatactgggattttgtacaccacttttcttttttttattttttatttattattattattattctttaagttttagggtacatgtgcacaatgtgcaggttagttacatatgtatacatgtgccatgctggtgcgctgcacccactaactcgtcatctagcattaggtatatctcccaatgctatccctccaccatccccccaccccacaacagtcctcagagtatgatgttccccttcctgtgtccatgtgttctcaccgttcaattcccacctatgagtgagaatatgcggttgtacaccacttttctaatgtactcaatgatctgacaataaaagaaacagtagaactctccttcatcaggacatttagtagcttccctcaggctgtgctaactattcccttcatccacaaattgaaataagtgctcgttcttcttttcactatatatatatacacatacatatatacacacatatatatatacacacacacatatatgtttgactatatataaatatattttcttaatatatataatccccatatatataatgtctatatatccttaacaagaaaaaatgaagttagagcacatattttaaaatgaatacattatgtatacctttgtttctgatttccttttgtccactgagtaagatagctccttttaccatcatctgtgtggaacaaagaaaacataacatgcaatatattatctgatgtcatcatattctcatattgagattaggtaattcattacttaatggtaattctgttccataagatagggtagcttccacaagcaaatattaaaaatagactttgcgtaagttggaaaagagcagagaaagtgactaaaactgattgagattctatcatgtactggaaactttgtgaactatgtgcaatgcactgtgcaaagtggcacataaagctctgaaattgtcaaggctgtccggtttcaaatacgccttcacctgctcattaactttgtgacttaaaacatgatgttttacctgtttgcctctgttccattatctgtaaaatggagatatctataaggctaattaaatgagttaacacatatacaatctttataacagtgcctgacacagaacacttaccctaagaggtaagtcttataatctccaattacactgtacacctgaggaagccaagggttaaagagttcaaacaatccgtccaagatgcactaacttgcatgctaactaggagagggtgggggattcaagttaatgtcttaatttccaggtctgtgtcttatcactcttcaacaggccttagagcagaaggccccagtccccaggctgtgtaccggcaggtacgtatccatggcctgtcaggtactaggccacacagcaggaggtgagcagtgcggtgagcaagcattaccacctgagctcctgtcagatcagcagtggtattagattctcataggagcacaagccctggtgtgaactgcacgtgtgagggatctaggttgtgcgctccttatgagaatctaatgcctaaaaatctgtcactgtctcccatcaccaacagataggaccatctagctgcaggaaaacaagcacagggttcttactgattccacattatggtgagtatgtaataataatagaaataaagtgaacaataaatgtaatatgcttgaatcatcctgaagccatcccaccatccccaccccatctgtggaaaaattgtcttccatgaagccagtccctggtgccacaaaggttgggggctcctccttagaaagacaaaatggacagaaccaagagaataaagtccttttactgcttatcaacataagctttccaccttactttctggcatctgcccaatattttactattacaaagtgtcataaatacttgatatgagttacatttgaatgcttaaacaagtggactctgaacagcaagttcttcaaccttagggaaactttaattgccttagatcgttctatgtgtttgtttgttgttaatggatcgaacagtattcaccagcaaagtgagaaggctgcccttactctggtcaccgtggcatgactgatgcatgatttctaagctgtgctgggctaagcagacgtgcaattgaacaggattccaggaacccactgactgagacttaccaaatagaagaactttacattggaatcatcctcatatgcttcactgtttagggagtaatgcacagtaacaaccttctggtgattacattcaagctgctttggttctggaacaatcttcaggaagctgttcgttcgggagtaaaagcgtgagactaagaagtgagcatccaagtactgaggcgtcaaccagctgggaagatagcagctcttaggtcgaacatatgtggcctgagatgacaaaagaaagtgaagggtcttagtatcatgacatccgaagacagttgttactgagaatggaggcttctcaactctccagagtagggaggaatctcagcttgtggctgacgttttaatgttaagttattggaatcaaaataataatagcactctgctctttgtatacaaaacgtgaccatgaaagattgtgtaaatatttcattagactgatggtgaattgttatgttttttacactttaattgaagccacagaattgggtttcagttctgtttctttcagctacatgtgaacactgacaaattatttaactgcaaaattctgtttaagcagcggaaaataaacagaaagtataggatctcccctatctatgcatgaaatgatctgaggaagaaagtcaaatcatcctcatgagctacttcttgtttcctagaggaaaatattagttgttagcaaatttataacaatcgtgatagacttttagcttcccatccccttgaacaagtattctcatgtattatttagtgaacaagcaaatttataaaataagttacattttaaattttctttaaaatagattctgtatacaagctatcttttgagatattcctaatgtttaacatttctgatatccaaatcctctgtgggatgtctaatggtcttcttctgttctttgatgtcttacttttaggttgaactctggatcaaatatgtctgaagtgtcaatggaaaattgagcttcgccattctcgtccgtagtataatttcctataaattcatcattgagctccagttgcaacaacttgttcaccataggtacattattgggatccgaaaatttaagctgtacaagaaaagaataattaatatgacttaaaacacaaaatgtttacatttttacagagaaatagttttctactcataaatgtgatccctagtcattttcctaaattccaacagacagaaagatgctctattaaatacatagatatataatataaagtatggaaaaaatgatactgttatctattgcttctttcaatctaggacactttctagcacctcagacatagtagtgcttaaaatgtattacaaaagtaggaaaaaagtgaccagaaattttcaaagggcaatctatgatccaagaaaatgaaatggaagcatgtattctttagtcaaacctacagttccaaaataagaaatccctcttctgtagaaagtatccatgttctcaaagtttacagttccaagcaattgagtgataaaaactgaggtcttctcactgatctgcatacctgtaaggaatgatgaacacagcagagtgaaaatatctaagttaccatccacagcaatataaatgtgaccagcttgcccagtgtgaatagcatcatgatattgatcaagtatgcttatatagagcactttacaatggcataatcacaaactcctttttaaataacaagaaataattagtagttaaatctgattttcccactccaaattaaataatctctttctcccttctttctggtttttttttttttttttttttgagactgagtcttgatgtgtcacccaggctggaggctggagtgcaatagtgcaatctcagctcactgcaacctccgcctcccgggttcaagcgattctcctgcctcagcctcccgagtagctgggattacaggcattcaccatcatgcccagctaattttttgtatttttgtagagacagggtttcaccatgctggccaggctgattttgaactcctgacctcaggtgatccacctgccttggcctcccaaagtgctgggattacaggcgtgagccaccgtgcccggcctcttctttcattcttttaacaaatacttattgaacactcactttgtgcaatcttgtaaatttttcagtaataatttttgcacttgcaactattcccagttgtattaaattagaaataatctgaattttgtacttagtgctaactcaacaagcttctcccagtaagttgccatacatatatccccaggtcgtccaaaaaatacagtaatttcctgtcccaaattctgtaacaattacagcgacatgaaatgtcatgaacaatcccgaacggtagagttggaagacttttgtatttacaatttgagaaacacaaccattttccaactgaaaaataaagagaaggtataattaaaatgttagagatccaagaggtttttttaagtgtcttttaaaatatggtttttgcacaaatatattaacatccccaccccgtgccacggctctacctcataaacttgttgaaatggccaaagaattagaggaggagtaggaggaggcgaatatttacatcagcattttaaataacggaaggaggtaatctgtattttacagatttcaaggaaattctcctggaaacattgtagatgagaaaagattaaaggatggaaatgaagctgaatggtattgtgaaaggaaagtaaatctcaggagcccaacatccctaagctaaagggaaagggcaagctgggaacagctgggcaaatctgtctcccattttattcccaaataaggtagctacaaagataaaaactacatacctccctcacaatttgcccacaaggaaattctttgtgggcctcaagaacttttccttaaaacagttctttggaaattcaccctggcaatataaattcatagcttatctttacaggcgtgggacaaaagacagactcagtcatccctctgcttacctgagacaaatacatatctgatttatctgattgcttcctctgcctaatagtttatgtaaaaatgcagatttactgagccacactaaggcaggagtgactattcctctatcctcctctcacatgtaatttgtgtattcagtgaaaggctgatcaaagacaaagacttattcttttttttttttttttttttttttagatagagccttgctctgtcactcgggctggggtgaaatagcccaatcttgactcactgcaacctccgcctcccaggttcaagcgattctcctgcatcagtctctcaagtagctgggattacagacacctgccaccacgcctggctaatttttgtatttttagtagagatggggtttctccacgttggtcaggctggtctcgatctcctgacctcacgtgatctgcccgcctcggcctcccaaagtgctgggattacagctgtgaatcactgcacctggcctcaaagacttcttctttatgcaactgtttgtctcttatctacctatgacctggaaacccccttagtttggattgtcctgcctttctggaccgaaccaatgtacatcttacacatatttgttgatgtctcacatctccctgaaatgtataaaagcaagctgtagcccaaccaccttgggcacatgttggtaggacctctggaggctgtcataggtacatccttcaccttggcaacataagctttgcaaattgattgacatctgtctcagatacttttggttcacagtgttttaagaggaagaaattctaatcatctagaaaggcactaaaacagatggaacagaagcgctcagcacatgtgtaacaacaaaacaaacactttttaaggtatattgcttatttaaaataacaaaaaatctatagttaatctatcatcagtaataataattagagaaatataaatttagttatattttataacacagtgtttattccagatttaaaatgttataaggatatattagtttatttgatactcaaaactattacatgagctaggtactgttattatcttactatatagatgaagaaactaaactaggtccatcatgtaacctgtccaagatctcacagctaagagacggtggtgctgaggagctgctctggctccagagtatgtgcttctctatcttaaattaacagccattacatcaacaacaaaagcaattttattttgtctaatgataatatagtcaaattaaaatgaaatcatagaaagtgatcagaagaaccttaattatttcgaaaataagagaaaagccttttttcaggaatccttgaaacaaagagaatacataaagtaaaccaataagaatccagatattagagtaatgaaaaaatacttcgcatcaaagtcaatggtattcagctgcagttcagaagaaatgtaaaacagtgaatgtgcttattactaaaagaaacagctaatatattttttaaaccccaacaaaatcaactacaaatattaggaaaaagaattaataagatgaaagagaaaataaattatttaggaacacaaaataataaaagaaagaaaatagtaaaaataagaaccaataaaatagacgaaactttcgtgggcatgatttaggacaaagagtgagagagaacaaaattgtgagataggtgctaacacaacacagcccacatctggaagaaaaattcccattttagaacatcattggaagtgaactttatgtctattagaaaattgtaaacaatcttaagagcatacttagatagccacatgtacaacacaggggccagtgagattttttttctaaggctggaaacccaggaacataaggaaggtgggtatgtcaaaaatatgacaaagtaaatgagttgcctatttaaataacaggcttgaaaaaaaatgcttgtaggatggaaggcagtacttacctgaaagtttccatttcacatgaacagaaaaacatgggtaattaagagttctcaaatccaaattgataacaaaaatatgaaaagttgctcaaactaaatcgaaattagatagcacaagttaaaacaagctaaatttgtgtctatcaaaatgacaaaaacttttaaaacttctaaatatattgctgaaagtaatttggaaaatatagtattctcatgtacttctgacaggaatttgaatgcctaaaacttttaggagagcaatatgctaatatttattaaaattaaaattatctgtctatgaacattatctatatttcctttgactcaggaaactcactctaagaaatttatttcaagtaaataaagcctctcatatataaagatagttccaccggacagatttttttttttttctttttctgaggcaggtcttgctctgttgcccaggctcgagtacagtggtgcgaacacacttcactgcagccttgacctcctgggctccagtgattcttttgcctcagcctccctgtagctgggaccacagatgtgcaccactgtgcctggctaatttttgtagagaaggggctcactatgttgcgcaggctggtttcgatctcctggaatcaaacgatcctcccgcctcagccttccaacatgctcagattagaggtgtgagccactgctcctagcctctaccagattgtttattggtatttttttcacatggggaaaaaagtaaaccatttgctgagggaacacccatcactgtgtaaaacggttgactgaactctatcagaatgtactgctgacatggaaaaattccaccctagttttctttgcctgcatttcctatgtaaaggtaggattctgcttgtctttgtcaattattgatatttacctagaggatgttcactaaatttgatgagtaactttaggacaattggacttaaaatatgaactatgtggcatacacaagcttcactttggggagtcaaaagacaatttcaaagagataggaagagctgttcacttaaggttaggatgctgcagatagagcaaatgatgacttcacatatgaactgcaagtctaaagtaacatagtgggggtactctgaattgcagttgattgaaagtaagctgtttccactaaaaaaaatccaggtggcatggagagtaatatcacagactcatttaaaggatgattaacgattctccaaagaaaaatcaggaaggctacctaggcgatatataaaacaacaaagcccacgatacctttcatattctaaaaatcccatgaatctataggtggagaacaatttacatggtctatggaataaaaaactgctttaagcactgtattttcttctctttcttcactttatttagctgcaaactccattatcaataaaatgaaaatagtattgttaagctccccttataaatgaaatcaaagaaagaataagaatgaaaaatgagtgagaacttttttttggagtaaagatcatggtctgtacctgtgcaataaattgctcacatatttcattgtcatttttctcacaattgcttgaagaaaaatactctctgcacacccggatttgggttttcccttgcacaggttggccaaaggtgtacctcatgggggaaggtgtagttatgattacagataagcaatatcatagcaatattttatgatcttcttcagaaattatataggaagtctctaaactgtgagtaacccagtctaaccaaattgaattaggaattctccctattggtgagggtttaggttccccacagaattcaggttaaactgggcatttgatctcaggaggatttggctgcctttaaaaaattgaattcagggtaaggcagaatctaaaataatctaaaatctcattgaatatgatttaatgcttaaattgagttttttaaaaatatattttaatctgatagaaacatcataacattgcagcactttcccttttatcagaaaaatatatatgtatataaaacttggatgattcaggatcctgaaacatttccagatcaacattttaaacacgaatttttatttaccactcaataaatataaaggctatggggctggcatgaactggttatgctttgaccaaaaatataataccttacagggtgggtttgagtatctcattttctcctaaaacacaaaactacaacacaagattttaaaggttcaaccaaaggcaaatccagtcaattggagttttttgttttgttaatagacaacaaatgtaaaactagcatataataaaagtgaatattattttcacagattataatacttttttctaattgttggacactgatatatatcatttatttttcccagtgaccctgatttgtaaaatgaggtcaagtaacttctccacattgtaattaatgaaactaaaattcgaactcagatctacctcactccatagcccgtgcccttttctttccactcacctttttctctttctatttaaaaattcctaacacttttgagattctgagtcaaatcataccaataaaatcatgattatataaaggccagacttagatctggccacacatattatacctgaacatttcttcttatttctacttaatgtcttttatttatacaataaaagtcttattgtagtattatctgtaagctaacatatgcctataagacatgtagcttaaattttaaaaacaggacagaataatccctttgtgatttgaaaagctttcagtgaatgctaatgcagtgtattaaaatctctttgtctgtaggtaaattttcttccctcttaaaagcctaagtcatctctgactttgtttgctaaaataatccaatttttttcttgttttctctagtcattccaagctaaatcccagaaaagactaaagaaacacagacacagtatcatacaatttgagacacagtatacaactgacgtgaaccttctagaaacagtgctctcacaatctgcccagaaataactttgtagcaagcacagctccagtctagctgcctggtctcctggcaagatattattattgctgatactgatttactcctatgtaactctatccagaatacaatatcaaagaaatttcaagaaatcaggatcatggattgtaacctgacatactgctaaggaactaccagttccatgttagcatgtggtttgcaagtattttccaaaggccatgcttgagaaacatttttgttcttccaatgtgttgtgggttttgtttttagcatactatcgtgcagataaataaatgagatgttaatgccactgaaagctctggctttgcgtttggcttttctagtgaaacctgtttagtattctggatttcttccaacttgaatttatcacctcatcatttttaacatcagtgatctacacagtctctcatctattacgtatattaaattctggtattttcaactactcttcattaaaacttagaaaaaaatttataatcatttcctaaagtcaaaagaagatttgaaatgctactgaaaaaaaaaaaagaaggctgaaaactggtttgcaagattctctggggcatcaaaggcatcttaagaaccacgcttgcacgttcattagacagccctttaatcaatgtatctttaatagactgctggaaatactcaaaggcaagtaattttcatgtcataaattaaacaaagtgcttaacaaatatggcaaatattaatattgttaactgtttttataaagtatatgacagttattgattaggagagtagctttgaagctgaaaaacctaggtctaaatcctagttctgccatcaacaagctccattactgttgataagttattttaattctctgtgtcttattatctttctttataaaatacagatgacaatagctcctatctcatagcactgtggtaatgatatatgcagagcttaacaaactagttgacattcaaaaaacatttattttattttttattttattttatttttttctgagacagagtttcactcagttgcccaggctgcagtgaggtggcatgatctcggctcactgcaacctctgcttcctgggtgcaagcaattctcctgcctcagcctccccagtagctgagattactggtgcctgccaccatgcccgtctaattttttgtatttttagtagagacggggtttcgctatgttggccaggctggtctcgatctcctgacctcggatgatccctcccccaccttggcctcccaaaatgctggcattacaggtgtgagccaccgtgcctggccaattgtttataaattattattagaaattcgagaaaaggcactaaaaaagaaaaaaaaattaaaaataattttccaaaaacaaaatacaaatttctgaaatcgtgtattttttttacattaagagaattcaaataattcagattaacttgataagatgctttgtcttcactttgccatttcaatagctcatattctaattttaatgaaaatatgccatgatagtaaagattcaatgagaatttcacaccagctgctagaatcctacactggcacaacatgtttagtgaggagtatggcaatcagaagactaaaagaatgttacatattttgtcttggtaattccttttctggaaatctttcttaagtaaacaatttttcattcaaaagctacctattatatgttatacacaaagacatatactgcaaaattattaattaccaggaaaacaaaatgaaacagccaacatattatataataaaataattaaattgggtatagtcacataaaaatatgtgcagcagaaaattggaattcatgaaaagattggcataatacgtaggcatgttttcttaattattataaatagaaaagtatgattgcagtcatggaaaatattcattaaaattagaggaaacttacaatgttagtgacattacaatgttaatggcagttggtcaaattaataataggtaatgtcttgtgtttttctctatatttttcaaattttctacagtgaggattcattgcttctctaataacattaatgtaagcatataaataattaaagtttcatggttaatctcacttctcattctctctgagctttgtgttttcttgtgaaggtaaatctcctgaagaaatactcacttagcacatacatccacttggaattcatcatctgaaatagttactgtttgtggtgcattgaccgtaacttcaaacttgggcagcactggaaacgaagagaaatatacgttagcctgcacaatcacaggcaagcaaaccttattgcagtcatatagcttactatgattccttgtaccctccatctgtatgagctatgtatcatttgccccaaattgtgtggcaccattctacatggtggtgtctcactaatgattaattcttcctctttcttttcttttccctatcctcagaatttcacattttgtttctttttgtttgtttgtttgagacggagtttcactctgttgcccaggctggagtgcagtggtgcaatcttggctcactgcaacctctgcctacagggttcaagccattctcctgcctcagcctcccgagtagctgggattacaggcatgcacgaccacgctgggctaatttttgtatttttagtagagactgggtttcaccatgttggtgaggctggtctccaactcctgacctcatgatccactcacctcagtctctcaaagtgctgggattacaggcgtgagccaccacacccggcctcacattttctttctattgcaatctcttagatctctcctagaagactgtggggattctagaaaaaatgtatattttctagggggaaaaagaaggcaggaatcagaataaggatactggggaaggagtgaggagcagcaaagtgctgatgacaaagccaaccaggtcaaggaagggagacaaagaaaaccagttctagcttcacctactcctgcctaagtctaacacaaatgttgtgttggtccatcctttaaactcttcatctacataggacagctacaaatagcaactggttaccatatcttttaacagcaaattggtgtgtcactgtcttccttgagtttcttttcacaacaatccagtaatctccaaacattggttctgaaatcagttggaacgagagttgggtaatatttcggaaagaagtcacattttgccattgaaaaatccgattgttttgaggatcctagaaaataatgaaaaaaatataaacaatcagaatttgtatgagagtattaccctttgctgccatatttcggatagtttcggatagtttcacaagggttattttaggccaatattttctcttatgaaacaaacaagtagcttttggtagagcctgtgagggcttaagaaccctaatgtctataaatcttagaggattatacactatgctttggtcatacaaacttgtactgcctttattcttttttctttttttaaagtattgtaattgtacatacttaaaggatacaattggcggggcacagtggctcacacctgtaatcctagcactttgggatgccaaggtgggcagatcactagagccaaggagttcaagaccagcttgggtaatattgtgaaaccccatctctactaaaaatacaaaaattagttgggtatggtggcgtgtgcctctgtaatcccagctacttgggaggctgaggcaggagaatcgcttcaacgtgggaggtgaaggttgcagtgaaccgagatcataccactgcactccagcctgggtgacagagtgagactttgtctcaaaaataaaaaaaaaagtgggggggtacaatttgatgtttcaatacacacacacacacacagacacacacacatatctatatatttagtataatgatcatattggggcagtgttaccagtacttcattcatttatcttttttttttatggtgaagacattcaaaaacctctcatctagctattttgtaatttgctaaatcttactgtaaactattgtcatcctactgtgcaatagaacaccagaactcattccttcttcattcttttcagattaaataaaattttaaaacacttgtagagtgtcagatgtgttccaaggactgatccaagtgctcaaggcacaaaaatgtatatgacatgttcacagcccatattagcttaaaattttaagccactgtgctccttgttattatagtcatataattttcttgcattatggctgcaattcacattctgtaatcagggtatagatgtctaagtaaagtgttggcttaataattgttgttctaatcaaattgaattacacgttaacaaaacttacttaaattttccttgtatatttaattctatctcttcccaggccaagtcaaaaaaaatatgaacccttggaagaattacatctagaagtgaccagtcctagtctaaatatttaaatacataacatgaggaattcaggccaaaagtttattctgataggtctattttttgatgtactaataaaactggccatctctgctatagttttgctaacttgttgcagaagtaatctcaagaagaaaacagccctattagattatgtttaggatggatagttcaatatatattttgccaaaatgttatattgagtttacacaaataaacacacacaagctgtcataataagttcatttagcaactgttttaggatagatttttattctggaagatccataatgaattatattttatatgaagacagggctaccttttgcgtcaatattttgatattgaagagtgctggtacatcaataaagtacttgtatagtaaacaaattaaagatgttttgtgaactagctaggccttgaagactcacagggcttggtgtgtaatactgtcattcttagagataattagctccaggttgttctttctgctggaattgtgaattgcaaatccattcttatcagagtgaaatcagaacttcaaccctaatcaaaattgattggatgaattattgagtgttacaaaagtgatgcaatgaagggccctcatatttttgacattcatttttattagatccttcttatctggagattaggtatgtgagaagctcggagaaataatcttagaagagccaagcagaatttttatatctaaatccatgttacttacatagaatatattgttctttaaatataaaaatctataaatctgtacaagaccaatcgatacaagtaaaaaaaaatgtctgatcctgcttgaagtaaattatcaaagccatctacgttgagagatgaaatgtattacgtctctcctgctaacttgaggagtaaaggaatttactaaaaagttactaggatgtttttattccttttctttttttttcttgcagtgaagcctgtagatccttaagattctttaccagttgtgtggtcttaatttcacaaattgaggaatctgatccatagatggttccacttgaacgtggtgggagggtaacattctccttccatgaaatgtaaagactgcattgtgggacatggaggggctccatgagatccatttagttgcattcatcctcctgtccccaaagtatatcagtaaatgtactgtttcttgacagtttggctgtgttatcccagaggactggatgtgggaatctccaaatggccagataatactctcagcttccaattcagtgaaactattcttaagcatgttaatgaaaatatacttctttcctggatcctaaaaggtctaaatgaaaacaactcctattcctgaggatggaaaacaagtattctgcaaaagccactaccaatccgtaccttggttcccagacatatctctagaagagacagaaacaagccctttaatataatttcattcctcaacttccttggaattagtcccttaatgtgtcttgttctaaatccctgatcatcttgccacacatttgttaaggcttataaaagagtgtacatctttacctcaggccatttgtagacttgtcatatactttggtaatttcccaacatatgcgtttcacttccagtaaagaagttagaagactccattcccagattaccttgaatccagggggcaggtaaatgacaggctcgaccaatgagatgctctgttctgagactgggaatcagaagggagtgaaatggggaggccatggaagagtttattttcagggaactgtgagtataatggcaacttctagttcatttaggataagataggcagaaccttttcacatccactccaatgtgtttattccacacacgaggagccacagtgggaattctgatcattgctagacttgtcaattatacctacacatttggaaaatgaataaataaccagaagatggatctggtctctgttagtcctacaatgaagacaatttggccccaaattctggttattcctgatagtcataatctttgcctctcatctcagatgttattagtgaggtaatattcagtattttatagaatatttagatatttatctttccaggagctcatgtgctttggtaatgaggcagaatgtctttgagaaagataggagtgagaccttagggatgggtgtctgcctaactgaagtggactccaatgaaaattatataaatatcaaggcatgaaaattcagcactccctatcacgcactggtgaaaaagataatcaaataatctcctgttcaccattgacaaagtgcctattgacagcaagcatttggggaccacaaatttccactgctatggaacgataccaggctgatcacttctaagagttctgagaaaattaaagaaaagaaaaacaagctaggaactttaaattagcccttaccatccggagttctgtaacagaattatctctaagtctccaatacagctactgaatgtaatgaattaatattacatttattgatgcataaatagtaccattctctcctatgtatcctgaatggtactatttatgcatcaaatggtctctcgaaacattctctgtggagttaaacaataaagcaattttcttatataacagttgagaaaggttgctctaaatttttggttgaagatatacattgaaaagtgagtactttcaatttttatgttaaaactctcatttattgcagagcagttctgtaatcaaaatgcctcattattgtatgtgcttagatagaggctgataatttacctgtgagggattttttaaaaaattactgactgtggaggggaggagccaagatggccgaataggaacagctctggtctacagctcccagcttgagcgacacagaagacggtgatttctgcctttccatctgaggtaccgggttcatctcactagggagtgccagacagtgggcgcaggtcagtgggtgcgcgcaccgtgcgccagccaaagcagggcgaggcattgcctcacttgggaagcgcaaggggtcagggagttccctttccgagtcgaagaaaggggtgacggagggcacctggaaaatcgggtcactcccacccgaatactgggcttttccgacgggcttaaaaaacggtgcaccacgagattatatcccgcacctggcttggagggtcctaccccacggagtctcgctggttgctagcacagcagtctgagatcaaactgcaaggcggcagcgaggctgggggaggggcgcccgccattgcccaggcttgcttaggtaaacaaagcagccgggaagctcgaactgggtggagcccaccacagctcaaggaggcctgcctgcctctgtaggctccacctctgggggcagggcacagacaaacaaaaagacaacagtaacctctgcagacttaaatgtccctgtctgacagctttgaagagagcagtggttctcccagcatgcggctggagatctgagaacgggcagactgcctcctcaagtgggtccctgacccctgacccctgagcagcctaactgggaggcaccccccagcaggggcacactgacacctcacacggcagggtattccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaaacagaacagaaaaactggaaactctaaaaagcagagcgcctctcctcctccaaaggaatgcagttcctcaccggcaacggaacaaagctggatggagaatgactttgacgagctgagagaagaaggcttcagatgatcaaattactctgagctacaggaggacattcaaaccaaagggaaagaagttgaaaacttggaagaaaatttagaagaatgcataactagaataaccaatacagagaagtgcttaaaggagctgatggagctgaaaaccaaggctcgagatctacgtgaagaatgcagaagcctcaggagctgatgcgatcaactggaagaaagggtatcagcgatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgatggggaaaatagaaccaagttggaaaacactctgcaggatattatccaggagaacttccccaatctagcaaggcaggccaacgttcagattcaggaaatacagagaacgccacaaagatactccccgagaagagcaactccaagacacataattctcagattcaccaaagttgaaatgaaggaagaaatgttaagggcagccagagagaaaggtagggttaccctcaaagggaagcccatcagactaacagcggatctctcggcagaaaccctacaagccagaagagagtgggggccaatattcaacattcttaaagacaagaattttcaacccagaatttcatatccagccaaactaagcttcataagcaaaggagaaataaaatactttacagacaagcaaatgctgagagattttgtcaccaccaggcctgccctaaaagagctcctgaaggaagcgctaaacatggaaaggaacaaccggtaccagccgctgcaaaatcatgccaaaatgtaaagaccatcaagactaggaagaaactgcatcaactaacgagcaaaataaccagctaacatcataatgacaggatcaaattcacacataacaatattaactttaaatgtaaatggactaaatgctccaattaaaagacacacactggcaaattggataaagagtcaagacccatcagtgtgctgtattcaggaaacccatctcatgtgcagagacacacataggttcaaaataaaaggatggaggaagatctaccaagccaatggaaaacaaaaaaaggcaggggttgcaatactagtctctgataaaacagactttaaaccaacaaagatcaaaagagacaaagaaggccattacataatgggaaagggatcaattcaacatgaagagctaactatcctaaatatatatgcacccaatacaggagcaccaagattcataaagcaagtcctgagtgacctacaaagagacttagactcccacacattaataatgggagactttaacaccccactgtcaacattagacagatcaatgagacagaaagtcaacaaggatacccaggaattgaactcagctctgcacggacctaatagacatctacagaactctccaccccaaatcaacagaatatacatttttttcagcaccacaccacacctattccaaaattgaccacatacttagaagtaaagctctcctcagcaaatgtaaaagaacagaaattataacaaactatctctcagaccacagtgcaataaaactagaactcaggattaagaacttcactcaaaaccactcaactacatggaaactgaacaacctgctcctgaatgactactgggtacataacgaaatgaaggcagaaataaagatgttctttgaaaccaatgagaacaaagacacaacataccagaatctctgggacacattcaaagcagtgtgtacagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgatagaccgctagcaagactaataaagaaaaaaagagagaagaatcaaatagacgcaataaaaaatgataaaggggatatcaccaccgatcccacagaaatacaaactaccatcagagaatactacaaacacctctacgcaaataaactagaaaatctagaagaaatggataaattccttgacatatacactctcccaagactaaaccaggaagaatttgaatctctgaatagaccaataacaggagctgaaattgtggcaataatcaatagcttaccaacgaaaaagagtccaggaccagatggattcacagccgaattctaccagaggtacaaggaggaactggtaccattacttctgaaactattctaatcaatagaaaaagagggaatcctccctaactcattttatgaggccagcatcatcctgataccaaagccgggcagagacacaaccaaaaaagtgaattttagaccaacatccttgatgaacattgatgcaaaaatcctctataaaatactggcaaaccgaatccagcagcacatcaaaaagcttatccaccatgatcaagtgggcttcatccctgggatgcaaggctggttcaatatatgcaaatcaataaatgtaatccagcatataaacagaatcaaagacaaaaaccacatgattatctcaatagatgcagaaaaggcctttgacaaaattcaacaacccttcatgctaaaaactctcaataaatcaggtattgatgggacgtatctcaaaatcataagagctatctatgcaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagacgatatgattgtttatctagaaaaccccattgtctcagcccaaaatctccttaagctgataagcaacttcagcaaagtctcaggatacaaaatcaatgtacaaaaatcacaagcattcttatacaccaacaacagacaaacagccaaatcatgagtgaactcccattcacaattgcttcaaagagaataaaatacctaggaatccaacttccaagggatgtgaaggacctcttccaggagaactacaaaccactgctcaaggaaataaaagaggatacaaacaaatggaagaacattccatgctcatgggtaggaagaatcaatatcgtgaaaatggccatactgcccaaggtaatttacagattcaatgccatccccatcaagctaagaatgactttcttcacagaattggaaaaaacgactttaaagctcatatggaaccaaaaaagagcctgcatcgccaagtcaatcctgagccaaaagaacaaagctggaggcatcacactacctgacttcaaactatactacaaggctacagtaaccaaaacagcatggtactggtaccaaaacagagatatagaccaatggaacagaacagagccctcagaaataacaccgcatatctacaactatctgatctttgacaaacctgagaaaaacaagcaatggggaaaggattccctatttaataaatggtgctgggaaaactggctagccatatgtagaaagctgaaactggatcccctccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagccaaaattgacaaatgggacctaattaaactaaagagcttctgcacagcaaaagaaactaccatcagagtgaacaggcaacctacaaaatgggagaaaatttttgcaacctactcatctgacaaagggctaatatccagaatctacaatgaactccaacaaatttacaagaaaaaaacaaacaaccccaacaaaaagtgcgcaaaggacatgaacagacacttctcaaaagaagacatttatgcagccaaaaaacacatgaaaaaatgctcatcatcactggccatcagagaaatgccaatcaaaaccacaatgagataccatctcacaccagttagaatggcgatcattaaaaagtcaggaaacaacaggtgctggagaggatgtggagaaataggaacacttttacactgctggtgggactgtaaactagttcaaccattgtggaagtcagtgtggcgattcctcagggatctagaactagcaataacatttgacccagccatcccattactgggtatatacccaaaggactataaatcatgctgctataaagacacatgcacacgtatgtttattgcggcattattcacaatagcaaagacttggaaccaagccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcacaataacaaaaaaccaaacactgcatattctcactcgtaggtgggaactgaacaatgagaacacatggacacaggaaggggaacatcacactctggggactgttgtggggtcaggggcggggggagagatagcattgggagatatacctaatgctagatgacgagttagtgggtgcagtgcaccagcatggcacatgtatacatatgtaactaacctgcacattgtgcacatgtaccctaaaacttaaagtacaataataataaaaaaaaaataaaaataaaataaaatagcgtcctgatgttctgctcttttcctttatcttgttttattttccttacagtagttctttgagagatagtaactcacgatagagaaacatggtctttgggatcagaacgtctggattataatcccatctctgttatttagcatctgttgcattggacaagttacttaacctgcctaagcttcatttttctcattgataagttgcagttaatagcttccaatctatagactgtgatgaataaatgggttgacatttgtaaaatgcttagaatgttgcttggtatgtagcaataattcaggaaagattaactatcagagcacttaataccatctgaaattatgccattgatatagtttgaatatttgtcccctcaaatctcaggttgaactgttatccccagtgttggaggtggggcctggcaggaagtgtttgggtcatgggggcagacccttcattgcttggtgctgttcttgcaatggtgagtgacttcttgtgagatctgattgtttaaaagtatgtgatgcctctcctcttcttgctcccatactggccacgtgagacacttgctcccccttgtctttcaccacgactgtaagttttctgaggcctccccagaaaccgagcagatgccagcaccatgtttgctgcacagcctgcaaaaccgtgagccagtttaacctattttcttccttttttttttttttgaaaaggagtttcactcttgttgcccaagctggagtgcaatggcacaatcttggctcactgcaacctctgcctcctgggttcaagtgattcttctgcctcagcctcccgagtagctgggattagaggcatgcaccaccacgcctggctaattttttgtatttttagtagaaacagggtttcaacatgttacccgggcttgtctcaaactcctgacctcaggtgatctgcctgcctcagcctcccaaagtgctgggattataggtgtgagccaccgcacttggcccctattttctttgtaaattacccagcctcaagtatttctttacagcaacacaagaaatatacaaatgacaatatgcagccatttgtatattgtctgcatcccaaattcaatgtaaacttcacgaatataaagatttacctgcattattctcactgtatttctaacatctgacatgacaggcacattaaatgaattaaaagacaaagcaaaagaaaataatcacctcccctcttttcccaatcagtttaaaagcattaagagattataacctgtcacctgcccttcgcattatactgtgacttacctaagggtatgtaatcagtagattcaagatggttagaatccttgcacaatactggtttccggaggtgagagttggtaaaaatctttaatcctgttgcctttcaagataaaatcaattttagatcacataacaacatagactagcagtctggactggttttttgttctatgtatattttcaatttccacttatttatttctccatctctaattgtcatatatttagagatacttcactgacatttcctaaattccatgtctttgagttccttagtttctctaattctaatggcttttgctctattttcctaattaagagctgttgatgaaaacctttaaataagagaggacaaaaaaagacatctcatatcataccccactgtactttcactactttgaatttggcatttttgttgaactagggatattatctcacttataaacactttaaatatagtagaatactttaaaatagtagaaatcaaattcgagggtagacgtaggagcaaaatggggatttatattagacaccagtatataatgtacataatattatgtcaggaaagctgataattccctcacatattagttcttttcctaatattataatattattagttatttaaaatattattatagttttataatgaagttctaataaccttataacttaaccttattataacattataataaccttataactttataattataactttataacttttaaataaaattatattaatacaacttttaaaaatatattataactataatttattgtaactatatagaataactattatagctttataatattataactattatataattataactataagaactttattaagtctttttgctattataacattatttgagatattatttctcagacattagtactaattgtaaatttgtactctaagaattctgagattaaaaacccacaccatgaatatttctatttatttatatattgtcacatatattcaccattttaagacttagttgccttaccttcacaaggtcatagccatcttttccaaagtcagcccatgcaggtgtgtaataaattccattgtaaaggatatgtccatcttcaagacacggcactttaaggccatcttctaagttaagtcctctgaaataatagccatgtagttcgctggaatgtagctgactatacacctagatgttagaagagaatcaactgtattttttcatagaaaacaattcatttttccccacaagcagtatataaataacctatataatcctatgaatatcctgtgtagaactgtcatcatacctataccaaataaacacatattgagaaagtataggatcttagatctgtaaaaactttgaaatactatttaatcagttaaataactgctggctaaatcacattaaaactaacaaaaagtccatgaggctcaactggattttaatacattccagataaaggcactgctcaatactctttgaggactcattcaaggacattgttagagaatgttctcggttaatttactaaatctccctgagcctaagattagacattaatcaaaatgggaatactgcattagttctatagggttgattaatatgagaataaaattaaataatagatatgggaatactcagtagagcaagtgtcaaatagtagacctttagcaattgttatttatttttaaaagtgttgctcattttttccataagagaatcagtataattggagtagagtcattgtacatgatttctaacctaaaatattttttatgcctggaactctggacaatttttttctcctctagtttatttaaggtatcctgtttttatccaaaggtaaagacataaaactatactgtgggtggtaaacaaagatggttttaatcactcacagtttgtgctggcagctgaccataattccttagtagcaataccctctggtctaccgcccaaagagcataaagagagtttgaagcagccgagacttgaagatcgacattggatcctggtaaacttttttctttagaaaaatttaagttgacctgaaaatgaaaataaaagggcaaaaggatggcaagccatatgagaagaatcatcttttagactattcttaacttttttaaaaacacacataagttaaaagggctttctgtgctttacccacctaataatattattattaggaacaactggatttggaacaacatccaaagtgaatgctataatcctgctactcttcaatcatccaacatattaacttctccatagctttcttttatttttcattttgcaattctatgaaaaattgggagtttaaacccaacactctcttaagttctccttagttttcccccaaattaaaaaagaatcatttttggcacctacctgattttcgaagcatttctcaattggaattgggtgctatcagtgaccatttctcctccaggatgcaagctatagacaagcatatgtactgagggcgctaattcagggttaatgtctatagaaatggaaaatatgcccttcctccctgtgaaaagaaaatttcaaaccgaaaaagtgctttggtgagatagctgactgtcatcttgcagaaaccctccattgagtttctagccatcctacccactgccaaagagactgccccgacccaccaaatttaatttataaagcatttctaggaggagttcataacctattccataaattataaaagaaagaaatagttgaacatttcttattacgtcaaacttcagtctacttttgtttctttttaaaaatcccttcttgtttgaatgtaaaagtacttacctgtctttcttggaaaagaaagggaaggacaatgaccctttcccattatagtagtgtttggaatataattaatgcactattaattaagtaattattttttcatttggcattgtgcctattcacatgtctttacatgttccccaagggtagtttagggggcagtaaacagtcctaaaatgggaggattgtgacttttaaagaaaaatgtaaaatatatcccaattaaagcattctatttgtattaaattatatgctaaaattagaggcctcaccattttcgttgatctcaattttctgttgcccatgaagaatgattacaccttttgaaatcacctaggaaaatgaaaatataatcgtaaagtttagaggatagaaactaaatttcatttaattataaacgaatgtgatttacctccttttcttgtctgagcaatactattgacatgtttactagtaaactcaggttaccagtaaacaagcatatgactctaacagctatattcaagagaatttaggagtcacagataaacttgctataaagcaatttaatgttccacattccaaaacagttttctaagaccaataaacaactttttattcatatttgcaaatgctgaattacatctaaatttatttagttcagtgaaacaaagttacacaaaggcattaagagtctcccagtgcttgtctggttttctgaaaggtgtgtttgatatgcaaggtataagcaaggcctgttcatccatctccacccaaaatttaaagaaaagaaaataaagtagcaagctgggggtgctccagaaaaaagcttctctcacttcacctttatcagcaactgtgtgcaaatttgcatcagcagacttttgttatgatctctaaagtgcaaacaaaggctggagacttgaaatctagtacaaactccttgaatttttaaattacagttttagaatattattttaaaagatgctgagacttgcagaaaatttaaagcttccgtaagatcttgcagcttgaaattgcaggagctggtactcctagtccgtttaatatttcactgaatattaaaattgctttaaatctctgaagtgccaagtttgggttattagctcataaaaaaagaactgagcctcaactagctggaaaatattgttttgggaactagaacatttgcaaaaaggcataaagctcaaagtttaatgagcctgagaggtctcagcactgttggctgtagtagctcactgacttctcaaaatggaaagacagctctcgtaacagatgagtaaactgaagaggcacacagaggtactgatatttgtcaggtcacacaattaagaaaaaagcttaaaagactgagtatcaaattaattactgaaagcctgagaatcaaattaattcagcctctatccattcattctaaaatatgatattgagggttctctctgtgatgtgtaccctgctaggcagaattaaagtccacccagcctattatgaaagaatatgtagaagactggaattgtctaggagattagaaagtttcatttaagccaagagatgaatgctgaggaggaatcagctcggaaaatgaggtgcaggcaggttgggaactgtggtagcaaatgggaacgaagattgttatgggcagaagggaaaacctgtgggaggcttcggagccagaaaagcacatggcttgtccaagaaaatgaaagccctctgtgtctgcaataaagaaggctgaagtgtagaatgatgcaaaatgaagcgggcgagcttcacaggtgcagagcagatacagtgttgcaggcaaaagaaaggagtctggtatttgtttcaatagaaataggcagtcattaactgtatttcaattaggggagtgaaataaataatcctaattgctttttttaaaaatcactctagatttccagaataaagaaagaaagaagaaaaggagggaggaaggaagaagggagagaggaagaaaaaggctattagcagactcatttaaaatggaaatgaggtaaagtaattgtaaaggccttatcagatcagaggggggcaaacctacgctatttcaagagggaagctgatgacaagtagatcaattcacaccacagacctgcaaaatggctcagctctggattaggaagtattggatattaagtcgagcagaggtgtggccagaaaagaaggcaaaagtcaggggcatgtgggagtgtctttataaaaactagttaagaggttcagcttccctgtaatcccggtactttgggaggccgaggcgggcagatcacgaggtcaggagatcgcgaccatcctggctaacacggtgaaaccccgtctctactaaaaaaatacaaaaaaattagccgggcgtggtggcgggcgcctgtagtcccagctactcgggaggccgaggcaggagcatgccgtgaacccaggacgcggagctttcagtgagcggagatcgagccactgcactccagcctgggcgactgagcgaggctctgtctcaaaaaaaaaaaaaaaaaaaagaggttcagcttctcattcaaggatgcttggtatttctcacaccccagtatggcaatattattgttgacatgttgaaggatttctgtaccggttggtaaagagccacttccctgagctccccagagtcccctccctgcttccctagaacctctcctccacaaccagctcctcccactcccaccactttgcccccagtctaaatgagccatgcttggcttagctaagggcttcagtggaattatcactcataccttttctgatggtttggtgtccataccttgctggtttgaaatattttaatgtttgtggaaatgatgaaggaaagaaaaaatgcgagagataatataatgaaaaagtgatagaaattggtgatgcagtaaatagcacgaaaaaaagaagtatcaaaagactattccagaattctaagtttgcaaaatgtgagaaatcatgtggtactactttcattcttcacatagatagactcaaacacctttagttctcagaataatacacttcagacatctttgacctcttatattatttcctaaaataagcttaaatgtgtttctcatatcctctaatcatccagaaaactcctattcatcccacaaaatcctatttaggcatattctctttatgtattttttccttaaaaatatgtatatacatataaatgtaaatatataggcatatatctttttcctaaactagtggttgtcaaattttaatgtgcttcggaggacaagatttctaacttattcctatgttttttttttttttttttttttttttttttgagacagagtcttgctctgtcacccaggttggagtgcagtggcaccatcacggctcactgcaagctccgcctgctgggttcacaccattctcctgcctcagcctcctgagtagctgggactacaggcgcccgccaccatgccaggctgatttctttttgtatttttagtggagacgcggtttcaccgtgttagccaggatggtctggatctcctgacctcgtgatccgcccatctcggccccccaaagtgctgggattacaggcgtgagcccctgcgcctggccacttattcccagaatttctaaattattcctaggtgatgctgatactgctactctaggaaatatactctgataatcactgtcctaaactccagctagagttaatcattcatttttctgtaacacctcagtggccatacatgtttcgtttgtaacacttatgtaattctaatatatgttttgtccccagttatactttttctatttcttctattgttacaattgctaatacagcacctggaatatgaaaaacattcaataagtgttggctgattgaattaattcatgtttcattaattttatatcatcttcctaaatctcaatgaagtatcatgcacccatttagacagtgtaaaataatccataatagcaatatattaaaatcaaactaatacttaatatcttttgtgtgccagaagttgggcaaagggctttatatgtattattaaataattatcttgatgattagacaatatattacaaaaaactaagattctctagaggtttaagtggctttcaaaaagtaacacaaagctagtacatatcagaactctggtttgatcccagcaatgtccaaatagaaatgggtaactctgaagaaagggtctgagaatgacagagtgcatatgggttgtggtgtcatggccttttccctcctttcttaaaaatagataccagttatataagttttatcatttatgttaactttgagcttcctcgtggcatataggtacagggatttcattaggttcaaagaagttttaaagaaaagaagcaattttgattgtggaagaatattttcagctcataccaaataattgaagtctgctgtgtaggttttgtcttcaaagtcttccatattgagaatgcagtgcactagcaccctcttctgctggttgcatctcagttcttccatctcttggacaatctttaggaagctattcatcttggagtaaaatcgatatgcaaagtactcgggctgagggtattgaggcaacacccagccatgagcctggcaattttcattggccttgtaggctgcctagacaaaaaatcaaaattacgggtattttaggataaagagaaaggatgagtgaaagaatatttgataagatggtttatcatcatgctgctttatctctgcaagaaaattttatagccattctacattaaatctaacccaattccccattttctagttatactctagagcgaccactatggtttttacaatttagtctattcaagtcctacttcaataatattacattcaatattttactgtattctttactataattattacttttgctagcaagtagattgctatatctccctcactataatacgaagaacccatgagtgcaaacgtttaccttgctactgataacataatatgaagttttgctgaaagatgggaaagtttttatgaaatacagcaaggagtttactctgaccatagtaatttaccattatcaacacaaaaagtctgaggagtcctttaaaaatatctaggaaggattgatatttaattattacagatagtagtttacttctctcttgaatatatccagagaaattctttacattattccaaggtaatagattacagggtttctcaaatatttccttctataaaaacacaattctctttctatttccttaataaaagtgaagcgttgcttattttcagctaattctcctttatacaatttagtatgtatgctaaccttctgtcttttcccgggactcttaaaataatttttaacctacttttcatagggcctatattcttaatatttaactatttttcagtactctagattcacaccaaggtgtatcttttcatttctgttccataaatataatttcgcatagacctaaaccttagctagccagtgcagttttttgtttgcttgtttgtttttattttacttgcctttcgtttaacttactttcaaagtgatatttgggtatgtaaacgtatatgtgtccaagaaaaactgagcgatgccatttacatctgtggtgtagtttcccacgattttgtccttcagatgcaactgaacaacttcatttgggattggagagttgtctggattaagcaatttaatctgtacaagaggaagaaaatacatttcggaagcatgtagtaaatttgggcatccattttgatggcatttgccaagcttctatcatggggacccctgctctccttggtgcgtatgcacttcctgtgtggtttcatctattcctgttgagtgtatgacatgtaccattaatatactaatgagcctaaactctgtttctcctgcccacgaagatctctgaaaactcaggcccatagaattaaccatcctgagtattttttataataaaaatgctacagaaactctcaaattggaatgatttattactgtgcccaaccttcctttttttctatttctcttatttatctcaaagaatacctcaaccattcacttagtcactgaagtcaaatatctagagacatcttagactttttatttttcttctcccataattttcaattgttgatcaaatattttcaattgtatctttttaacattttctgtttccaactgatcacgtttgttcctgttgctattccttgtatcaatatcttatcttttttccctcatacgtcttctatttttttctatccagtctctctctcctgtattgcttttgcttgttctttctctatactggcatcaaaccaaattttctaaaatgcaaaatttagcattatcctccctaaaacattgtagtgactgctctgataggccatggttattcgctagaaatctctttctcattctcttactagtacaggcaatgattgctttaaaaagtcccttctgaaattgtatgatttgtagtagatacaatgcctgcatcagtatctatgccagtttgaagcctttaaaggcaccttcttaacaacatctaaggccacaacaaccagaagaactgtctgagccatcctttttttagctcagtcagtttctgcaaaacaacttctgctttgagcctttcatcttatttctgccacttatcattttcctgctggtccaagcaaacacaatccttttttcttgctcagcatctgtagactgatgcctcatttgcaccatctacacagattttgaacttagtttcatctcaaggcttgatcttctaagaaaaattcaacttgtctcagcaatccacaggccacagacacgtgacaccatgcctttatgatcacacagaggtttgccctaattttagtacacctagactagaaagatcctttgagtcccttccagtcacagaaagatgaacaagccatgtgatttctgggcactttcctttctttctttttttttttttttgttttatttttattttttttattgatcattcttgggtgtttctcgcagagggggatttggcagggtcacaggacaatagtggagggaaggtcagcagataaacaagtgaacaaaggtctctggttttcctaggcagaggaccctgcggccttccttagtgtttgtgtccctgggtacttgagattagggagtggtgatgactcttaaggagcacgctgccttcaagcatctgtttaacaaagcacatcttgcaccgcccttaatccattcaaccctgagtggatacagcacatgtttcagagagcacagggttgggggtaaggtcaccgatcaacaggatcccaaggcagaagaatttttcttagtacagaacaaaatgaaaagtctcccatgtctacctctttctacacagacatggcaaccatccgatttctcaatcttttccccacctttcccccctttctattctacaaaaccgccattgtcatcctggcccgttctcaatgagctgttgggtacacctcccagacggggtggtggccgggcagaggggctcctcacttcccagtaggggcggccgggcagaggcgcccctcacctcccggacggggctctgatgttagggcttaaattgatttatatttcaaagaattccctaatagattctatagtagcactgaagagtattctattgtaaaactcagaggaaagcaaatgtaattttctttgaacatgaaaaagaaagcaactttgagagtagtcatttagcagtagatgtgcattattatgagaaaacagttctataaattcagggttaattctattaattggaatgtcggtctctaatgtctagcttattatagggtagaaaagagctttctactcagctaatcattaatcattgatccaaaacttaaatacatctatcatttcctggggctattgtgagtactgtatatgtatttagcaaatatttaagacctagtaagtgctcaataaattgtagctgttactacaaaagaaaaaattactttttaaaaaaatatacaaccataatcacacatactagagaagaaaacttaaaactctaagtaattcttaggtaaaaataaaaataaaaataatgaaatcatcaaaaatgattttaattgaacttaaaaattgttaagatggtaaatttgatatgtgcattttttcataatttaaaaaataaaaatagtatagaaaaacacctgtgaggaggaaagaagtattcaggaaaaattgtataaatctgaaaacatggaagtttaacataagtatttataacaagatgctagaaaaaaaaaaccaaaagaggtagaagaaaaaatataataaaaataaatgatgtaatgaaaatcatttaaaataacattaaaaataaagataattaacaaatccaaaaactaatgggaaaaaaacacaaacacaactagtaataaaaaaggggaaataaattatgatagatttattttttcaaatcataagtgaacatattttatgccctctattttaaaacctaaatttaataagaaatatctagatacagaaactaacatattatagaaaattcttagtgaactaaaaaaggaaaattttttgactcgataaagtatgtctcacaaaatgctacagttacttagtaggtttacgcattacatttttaaaagcattccccaaaatatgcaaaatacaaccaggaagtccactatcatctctaatattcaaattggagatctttgccaatcgaataaaacaaactaataacaaaaacctcagaagattaagttcagaaaggaagctaaaatataacattttcacacaaaatgctctttacacagaaaacacttttaaattgcacagaaaagatacaagagacaaatgggaacccaagaaatcatcttgggtaacaacaacgtaagagggaggaaatggagaattctcaagtctagataaaattattttatattcagaaaaaattttatattctttgaagatatctctcagttttatatatttagtaacagaacatggaaatatataaagcaaaaatgtacaaagtgaagagaaaggttagaaaaaattatgttaacattatccaccactattcagtaagtgaagtgaacatatatcaaatttatctatctgccaaagctgtatttcaatctaaatttgttcattaaatgacttttactgaaatttgtttcagtaagtcctttaggtgatgctgatgccagtttgagaaactgctttgtaagatgtaagccaggctacccacttttgtatttcttttttagtgttcttgtgtcaacctaaatattacttcctcagggaaactttccatgatcatttagtccagattttagcaaacttcttttgtaaaacaccatggtctctctctcatatatttttttattttttaaataatcttttaaaaatgttaaaaccactcatagttcactggctgtatcaaggcaggcctctgtctgatttgcctatgggctgtggtttgtcagctcctgatgtagagtagttaaatggtcagtatttcactgacatagcacctatcacaactacaataattctttgtaaaattatctgtttaatgtttattatctctattacactataaactccataaaagcagtgataaaagtgcctctctacatcaccattttattcctaatactgatatagactatataatttattgtccaaacttggacacttttagagtgaagtggttgtaactattaacagttacaacttgataaaacatatacaccaggacagatctatgaaaatcaacagtgtaggtcaccctacagtgcttagcacagagattcctacatagtaatttcttagggaatagctgttggaagattagtagataaatgaaagaacaaatgaatgaatgaataaggtatgtaaaaaatgattgctttctaacctggccaaaataagggagtccctgtttgtaggacatatccatattctcaaaactaatcttcaccactgatgagtctatgtatacgtacttggagcctgtaagctgcacacctgcagtcaattaagtattattgagaaaatgtcacttccaaaaacagacaaacagagcttctgaaaaaaaccacaaaagctcaccattccttctaatagtttcccttccctttcctaagcagttttaatatgtaggtacttcagatgtcttttataaagaaagttaatcaagatggcacaaaatgcttgtgccaactggtgttgctgctttttataaaatatccaattcacttaccatttcttcatgatggattagtaaacgttgatttctcattattcctaagtgattgtttaacaacatttcttttactctctgcttgcctaaaacatatgctttaatttattaatagtaagaattgtaatatatgtgtattattaaaaatggaaatgcttaaaaaagaaaatacaaattaccaaatatcagatatctccaagagaaccaaaattagcattttaggctttttcccacaagttctatttctctttatatttatcatttatattaatatgtttgagattgtgtgtgtatatgtgtacatgcacacatacactcaatatgtgcaaatgtatatgtagttttacatgttttttatcattattttataaagtttttgtaaaaccttataaaaacttatttttaattgctacattatttctcatataaatatggacatatgttatcatgtagcaagcccttccctccttccttcctgccttccttcctttccttccttctctttcttccttccttcctttctttctttttctttctttctctctcttcctttctttctctctctttctctctctctctctttctctctctctttctttttcttttttttttcttgagatagggtctcattctgttgcccaggctggagtgcagtggtgcgatcatggctcactgcagccccaacctcctgggctcaagtgattctcccaccttagcctcctgagtagctgggattacagctgcatgacacaacacccagctaattttgtattgtttgtagagacggggtctcactatgttgccaccgaggatggtctcaaactcctaggctcaaataattcttctgcctcagcctccccaggtgctggggttataggtgtgagccactgtgcctggctattcttttattatttatttagttcagtatgacaaatatacctaattatcaattaaatgtttgtttaatacttgaatttcctctggatgtgacagatacctctaaaactttgaagactgatataagtacattagtaatttaatatttcaggaacagaaattttgctgaaatatcagttacatatgcgtaagtttaaaagtactacagtaacacaaagtggtcagcacagaaaaaagcatttcaaggattaagacttaccattttgtgctttaggaagaaggggtattaggtccaggagatacaagaaattagtcattagaaatattattggccgggcgaggtggctcacgactgtaatccacgcactttgggaggccgaggcgggaggatcacctgaggtcaggagtttgagactagcctggacaacatgatgaaaccccgtctctctactaaaaatgcaaaaacctagtcgggcgtgatggcgggcgcctgtaatcccagctactcgggaggctgaggcggaagaatcgcttgaacctggcgggcggaggtcgcagtgagctaagattacgccaccgcactctagcctgggcaacaagagcgaaactccgaaaaagaaaaagaaggaagggaggaagggagggagggagggagggagtggggagggagacagattttcctggatgagataaagatttttcactggatttattttcagaggcttagtaaaatattctccccaaactattttacttcccatgttctaattctatgctcaccaaaaaaattttataatcgacaactacatgtctcaattatatttatctgtggaatgattaaggaaaaggaatatgcttatatctaaaaccagatactcccattataaatcaataaattggcattcttacttctattgtagccttatttgaatgtaacacttgaccatccatcaacatgtgtgtgaaaattttggttgatatatgaaacattcagaatttgaatcagatgaacccaatgaaaagccctcagggaaaaaatgattgtattgacattgtatagttggcaatcaggtaacaattcgaatgagacagtgatatccattggggtctggcttcttagagagcattacctgttccgtcctctgtaacaagagcatgcactttgaggaaactccagtatccttcccgatttcactcaaaagcatctgtgttaataaacttggagacacagccatctttccccaactgaaaagaacaataaaaaaaagttatattgtaaaggaagactgtaagaaatagctataatagggaaaatgtgtgacctcactgaagcaactttaagaatattgtattacccaagttttagttttttaaaataatccattgtgtttctataattatattttcagttcatgtatttacctataactatttattttttaataaatattaactcttacaatattgtgttttaaaaaactcttcatggtgacattattttgttattatacaagataataaacacatccatcactagtcacgtattcacacatgatatttgcaattttggtaatttcagccatattcttttacagttttgaaactgagttttatattatttagttaccatgccttggacatttatgggactatttacacagcagttaggaacacaggctttacagtcaaacaccagaatttgaaccctggctttaccacttattacttcatacaaaatgaaatcttaataaagagcttgtagaactgtattacattagacaataactggaaagtgtttatttagcacagggcctggcacttagtaaacattcagtaggtagtagatttttaaattagattcctttacatttctctcagtgtctagtcaagtgacaatgtctcactaagtgaaatttttaaagtgtcacaattagtaaccaaaattaaacaggatgaattgtcaaatatttttaaaatgtgggataaattgtgctcataggttcctggactttaatattggggaaaaactgatttcttattctactccttcatcttatgatgatatgaggaaatctagtcctcaagatgtgggtgagatgtcaaaatcctgtgctacttcagggggtccttgaaactataagaaggtctagaaccatttccagaagcttaaagatctagaaaaatttccactatactaaaggtgaataatgagataaattatttagtccacactcctgctttacatgtgcatttgattattttaacttttattttaggttcaagggtgcctgtgcaggtttgttatataggtaaattgtgtgtcatgggggtttggtgtacagattatttcactatccaggtaataagcatagtatccaataggtagtttttttgatcctcaccccttcccaccctacatgtacattttaaatttccagagctctcaaatctcctgaagggcatcctataatatagccaccttcgataatgcattctgggatctacctaccctgtgcactcggcttatattggtttagtctcttctagagtgtgcatctttaaagattatgactgcttcataaagtgcaaaacccatgaggatagtacctgatctgtcttgctcaacaatgaagcttctaaataaaattattcttgcatattaaaagacctcaatatttatctgttgaatgaatttgtggagaaaatttttgtatccctgatatccctaaagatacagccccactagttatttaaatatttatatgacttggttggggtgcagtggctgacacctgtaaccccagcactttgggagaccgaagcgggcagatcacatgagatcaggagttcaagaccaggctggccaacatggtgaaaccccgtctctattaaaaatacaaaattagctgggcgtggtggtgcacgcctgtagtcccagcttcttgggaggttgaggcacgagaattgcttgaacccgggaggcagaggttgcggtaagccaatatcgcgccactgcactccagcatgggcgacacagtgagactgtctaaaaatatatatgtattgacatgtatttatgatctagttttgctgcacccatgatcttgagcaatgtatttaacctctttctgctttaatccactcatcggtaagggggcgataatagtaccccctcatagggtactatttgttttgagaatcaaatgcacataaactacttagctcagtgactgacacaaaataagcatccattaaatgttagcaattattattattataattgttactattgttagcgtttattgtccacattttttaaatttaagaattagaaggttcttaattatttccaacctaaagtattctctaaacaggacaggaatatgtgacactgtgtgtgtgcacctgtgtgtgtgtgtgcacacatgtgtgtggataaatggtatcacactgtagtatggggattgcagctggcagttgtatattagacagtcagatctggcatgattatagctgaaagccttgctacatcctagaccagcctgtttgtgtccgttttctgaatgttggttctcaaaccttccaagtagatcttttaggaaattcctcctttgtcagtttggaaaagttgattcttctctttagtggttaagaacctgactgatagggttcccatctggagctcctatatacacttatttccagtgagaataggttgagaggaaaataattatacatctaatactcttgaatatgcagaaacatcacatctccctgactaaattcacaaagtataaaataaagaacaggacatatgttcccagtaaattgatagggtgtagattttgatatgaaaccaaatgtatttttaattaagaatcgaaatttactactcagtttctgatactataatttgctttttgtcagtcaatagaaaatgaaacttagcatgacaaaagaggaatataaaatttacaaataggaatagaaatatagaataaaagtatatattttaactgtaaagaggaaaacaggaagaaaggaaggtaaatggaaggtgaggataaaaagttaatggaaacctatttataattttgctgatatacctcttacctgaatggtaaaatttttacagagtgaactgataagatgagcacatgaatgataagccgtagattctctgcacacactaagttggaccttcccgtccacaggttcaccataggtatatctaatagaagaatataacaacaacacaattacagaggtcaaggtcgtttttaatctgtatagggttttgaaacctttatttagtagctgaaaccagcactgtaacaacatttaaatagctagttaccataaattttattttctggaggaaatctaaaacaatggtacggactaaaattgagctgaatgctttaggcaaaaatatattttaattaaaaaggttgaaataggcatgtagacgttatatatctaagtcactaaaatacaatgtaaacaaaaaaacaaaaaaatacatcagtcattatttcattaaaaataatattttttgcatactgatagcaatggagtattgaaaaacaaaaaatgaaataaaataacattttgcttcttttagtttttttgtttttaaactgctattatgagcatattttatggtttttacttttaaaatgtaaattatatttatttatttattttttataaatgtcattttaagtcatcagattttggggtaatttctttttgtttgttttggaaagaagtaaaactgttcattttttattattatattttaagttctgggatatatgtgcagaaggtgcaggtttgttacataggtatacatgtgttatggtggtttgctgcacccatcaacccatcatctacattaagtatttctcttaatgctatccctccccttgcccccaacccccgacaggccccggtgtgtgatgttcccctccctgtgcccatatgttctcattgttcaactcctacttctgagtgagaacatgtggtgtttggttttctgttcctgtgatagtttgcagataatgatggtttccagtttcatccatgtccctgcaaaggacatgaactcattcttttttatggctgcatagtattccatggtgtgtatgtgccccattttctttacccagtctaacattgatgggcatttggattggttccaagtctttgttattgtgaatagtgctgcaataaacgtacgtgtgcaggtgtctttatagtagaatgatttataatcctttgggtatatacccactaatgcaattgctggtcaaatggtatttctggttctagatctttgaggaatggccactgtgtcttccacagtggttgaactaatttacactcccaacaacagtgtaaaagcgttcctatttctccacatcctctccagcatttgttgtttactgactttttaatgattgccattttaactggcatgagatggtatctcattgtggttttgatttggatttctctaatgaccagtgatgatgagctttttttcatatgtttgttggctgcataaatgtcttcttttaagcagtgtctgttcatatccttcacccactttttgatggggttgtttgctttttcttgtaaatttatttaagttccttatagattctggatattagccctttctcagatggatagattgcaaaatttttctcccattctgtatgttgcctgttcactctgattatagtttcttttgctatgcagaagctctttagtttaattagatcccatttgtcaatattggcttttggtgcaattgcttttggcgttttagtcataaagtatttgcccatgcctatgtcctaaatggtattgcctaggttttgttccagggtttttatggttttaggtctaacatttaaatctttaatccatcttgagttaatttttgtataaggtgtaaggaaggggtccagtttcagttttctgcatatggctagccagttttcccaacaccgtttattaaatagggaatcctttccccattgcttgttttcatcaggtttgtcataggtcaaatggttgtagatgtgtggtgctatttctgaggccactgctctgttccattggtctatatatctgtttttgtaccagtaccatgctgttttggttaccatagccttgtggtatagtttgaagtcaggaatccaacttccaagggatgtgaaggacctcttcaaggagaactacaaaccactgctcaaggaaataagagaggacacaaacaaatggaaagacaatccatgctcatggataggaagaatcaacatcgtgaaagtggccatgctgcccaaagtaacttatagatacaatgctattcccatcaaactaacattgactttcttcacagaattggaaaaagctactttaaagttcatatggaaccaaaaaaaagcccgcattgccaagacaatcctaagccaaaagaacaaagctggaggcatcactctacctgattcaaactatactacaaggctacagtaaccaaaacagcatggtactggtaccaaaacagagatatagaccaatggaacagaacagagccctcagaaataataccacacatctacaaccatctgacctttgacaaacctgacaaaaacaagaaatgcggaaaggattccctatttaataaatggtgctgggaaaactggctagccatatgtagaaagctgaaactggatcccttccttacaccttatacaaaaattaattcaagacagattattaaagacttaaatgttagacctaaagccataaaaaccctagaagaaaacctaggcaataccattcaggacataggcataggcaaggacttcatgtctaaaacaccaaaagcaatggcaacacaagccaaaattgacaaatgggatctaattaaactaaagagcttctgcacagcaaaagaaactaccatcagagtgaacaggcaactgacagaatgggagaaaatgtttacaatctacccatctgacaaagggctaatatccagaatctacaaagaacttaaacaaatttacaagaaaaaatcaaacaaccccatcagaaagtgggcgaaggatatgaacagacacttctcaaaagaaaacatttaagcagccaacagacacatgaaacaatgctcatcatcactggccattagagaaatgaaaatcaaaaccacagtgagataccatctcacaccagttagaatggcaatcattaaaaagtcaggaaacaacaggtgctggagaggatgtggagaaacaggaacatttttacactgttggtgggactgtaaattagttcaaccattgtggaagacagtgtggtgactcctcaaggatctagaactagaaataccatttgacccagctatctcattactgggtatatacccaaaggattataaatcatgctgctataaagacacatgcacacttatgtttattgcggcactattcacaatagcaaagacttggaaccaacccaaatgtccatcaatgatagatggacatatacaccatggaatactatgcagccatgaaaatggatgagttcatgtcctttgtagggacatggatgaagctggataccaacattctgagcaaactatcgcaaggacagaaaaccgaacaccgcatgttctcactcataggtgggaactgaacaatgagaacacttggacaccgggtggggaacatcccacactggggcctgtcgtggggtgggggcagtggggagggatagcattaggagatatacctaatgtaaatgacaagttaatgggtgcagcacagcaacgtggcacatgtatacatttgtaacaaacctgcatgttgtgcacatgtaccctagaacttaaagtataatttaaaaaattttaaataggtagaaagagcaaagaacaaaattgcttgtaaggaataacagtagattcctctgggctacgttttatgacaatttctcaatttcatcttccaaattactaattctctcttaagcatcatcgatccttctagtcagcctttctacacatatatttttaaattaataatatgcctacttccaaggtctttaattatttttaaagttacactattgactcatatctgagtatacacattttacttatttctaaatttttttctgattgatgttcaacagttttctcaggtatatattgctcttttttttgtttatataataccttgatttcaagtcattagaatcttcaaccatttagtgattcatgcttatgttttgggattcccagctggcttgtcctagagtgctttattttgcttatgcaatacttctccagtaaaaatgacacaggagccaacacacagccactgtgatagggaagtacctagacatttgggctttggggatttctgttactcaggggattttccagcaatgctggcaattccctgcctttatgacccaactacaatgagacttttcagtctctgccttttctgtattcttccaactctggaggtgaagcacaaggtagtgacatcaaaaagttagccatgcttcttcttgactcttaaagacttccagcctaaagtagacacaggaaggaggacaggcaaagctttcaccttaaagtttggcatggaattttagattactgtagtgaagctctcctaataactagaaatttccaggtcacttttttatttttaattatgcaaaattaaaaggaaaagtagtacacatgagtcagggaaaagtagtacacatcaggtctgaggagacaaagttttaatgtttgcaccctggctctctttgctggt

SEQ ID NO: 112 - DNA, 158264 bp, Homo sapiens
aacttgtgagccttggatttcaactatttttgtattggtctcatctcctctatgactttggacacctgctggtggcaaggccaatgtcagactcacctatctttctgttatgtttaaaatttaccatgtgtactatacttgacttaactaagtctgaagataatatctttttccttcctccaaatgatacaatccatggatctttgaatgcttgaattctgatcacagcctcccacatgatatactaatgttgcccagtattaaaatactgggctaaagctccacctttgtatttaacctgtaaatttgctctttatgtcatcatcttcatgactgtcatgattttgtacagttaatactggtttagatctacccatatgcttacaaatttcttggcttatatttctttcttccagctctttcctcccttttagatttattttgtttttccttcctttgtggttccttcagtgagggtctcttagtagtaaacatttttagtctttgaaaatgtctttatttggccttatatttgtctctgctttcagcagtctgtgatgtttctaggcatacatttccttggttttagtctgtttgaggttcactgagcaactttaatctctaaattgatacctttcaccaaacttggaaagtttttactattatttctagaattgttgttcagccccaccatgctctttctcttcttttaggactctcacgacacaaatgttacaccttttgttatggtctcaggtcacaagatacttttggttttgaatcatttttctctctgttcagagtggataatttttattgatctgttttcaagttcactgattctttcctttggcatctccattttactatggagcctacccaagcttatatttttcagttctaaagctttccacggtttttctgtatgtcttctatttctttgctgagactatttctgttatttcaagagtgttcaccgtggctttttggaacactttgcacagtaaccgctttaaagtttttattacataattccaatctctttccccttgacttcagggcatgttcattttcttcccatgtgagttgaaatgttcctggtcctttgcatgctgagtgattatggattgaatcatagacattatgaatatgatattatgtgactgtgggtcttccaagagtgtcctggtaattttagcaggcaattgacctatttaccttcaggctgccaatcctgtcagccgtccgcgggttgtgattccaatgccagttcttggttcgaagcctctgctattgtgcatttgggccaccagccagcctgggacctggatagtagtccatcctgtagttcagttctcattgtctatgacgtgctggtcagggtcagacctgggtatgtaatgagctcgggagttcataaacacctttataggatcactttcctcctctctgccacctccctggtactttacagttccctggggctccccttcttcagtggccagaaagctggggcttttgttgctccacagtgccaggcacttctgtgactgtccccacatctggtgctaagtggcaagcggcagagaagaaataaagcaatgggaattttcctcatcctcttgggcccacagtgactgcaaatggagaggagggcttccctccctcagttttgttttctgcaggttcccatggggcctgcttggaggctgaggcttgagagaccgagagaaaaagaaacgagggatttcttcacttcctttgagcattgtgaagtgtttctggctccttgggtgttacctagagggattctctcagagctctctctgtatcccggtgcatacacctccgtttctggttgtgtggcttgcaggctgtggatcccaggagatattacaacccatgccctggggggttattgggaccagtgatgccctccaacccctagtaggtggagtgtcagcaaactttttgtttttggtccctagagatttctcttactctcctgcaagctcagctatgcatatatataatattttatctagtatatcaaggtgtttagagtaagaaggttgttatcttccatattgctgaatttggaagtcaggagctatagtccaagtgagaagtactaagtggccatcacctacacagaggccacctggggaaatggtaagagctgcaccacagggcccctcagatgtgggtgctgggtgctgctttgccattcacccagtcatgtggagggaggcagggcactgaggcaaagcttactggtctcatcatctgtgaaactttcttctactattttggttcacatgccctcttttctcttctgtctgttccatttttggaatttacttggatttattctctatgtttcttaatttctcttccatatttcccatttctttgtctactttggaagaatttctgggctgattcacttttaacgaattcaccctttagttgtggttattctgctattcaacccacctattgaattttcatttaactttttgtttttctaatgcagaaggtactctatatttttctcttctggatgatgttgtggtatcttgatagttatttcattattctgtggcgatattgcctgaccagtgcctgtattgatttatttattgatttatatataacttcaaattttgaatttctaagcactttaggaactgaactcaatatcttttaagaaaaagtttctggggattcaatagtactttctctaaagttttgttcagattttattgttaactccatccttggatggtgggttttcttttggttttgcttgcttgaaacagggtctggatctgtcacccaggctggactgcagtggcaggatcatgactcacggcggccttaacctcccaggctcgtgatcctcccacctcagcctcccagctggtactacaggcacatgtcaccatgcctggctaattttgcatttttttgtagagatggggatcaccatgttgcacagtctggtcttgaactcctgggctcaagcaatactgtgcctctgcctccaaaagtgctgggataataggtgtgagccactgtgcccggctggatgctgggtgttgtgtttcttgaacgtttcctttcatctgtagtgctggttttcctaaatgtatatcgatccttggtagtgacttctggcatttttatactagaatttcttggctggccctgtgtgaaagcaacacccgtgactgcagatgaatctttaggattcacagtcaaatgggtgaacatccaccagatccacgatgaggatatgcagctgatatgggatggtgagtctgggccttgcacctgggttctgggtgacactagggggcggggtgagagagaatgggggatgaagacatttcttaagaacatggttcatcattttatttttaccattatcaatgtcatatagaaaagtggaaaatggagaaaagtatttggaacgaataaattatacattgtcccactagtgagataaaaagactgctaatattttggggatctccccttccagtccatgaacatttataatgtgctataggtgcttacagtgaaatggtgttcaagacagacacatccctgctcttcataaacttgcagttttttgttttttattgcactgaactcttctaacattaatttatatttacagaagaaaatgcacaaatacagtgtctttacaaaagagtagaaatgtgaccaacaagggtaaagttgcactcaccccactccacctcgctcctctgccctcctcccctgcctgtttgctgtagagtcctgtgttctttgtctttatatacattctataaatacacatatacaaatataatttttatttattagtagtatttcaatagttttgggggaacaggctgtttgcttagatggatacattctttagtggtgatttctgagattttggtgcactcatcacccaagcagtgtacactgcattgaatgtatagtcttttatccctcaccaccctcccaccccttcccaagtctccagagttcagtgtatctttcttatgcctttgcatcctcatagcttagctcccacttataagtgagaacatatggtgtttggttttccattcctgagttacttcacttagaataatggtctccaactgcatccaggttgctgcaaatgccattattttgttacttttttatggctgagtagtattttatgttgtgtgtgtgtatatatatatatacaccacaattcctttactcactcgttggttgatggacatttaggctggttccatatttttgcaattgtgaattgtgctgctataaacacatgtgtgcaagtgtctttttcatataatgacttcttttgggaaggcagatacccagtagtgggattgctgggtcaaacggtaattctacttttagttctttaaggaacctccgtaaggttttccatcatggttgtactagtttacatttccaccggcagtgtaaaagtgtttcctttccaccacatccacaccaacatctattgttttttgatttttaaattttggacattcttgcagaaggaaggtggtatctgtggttttgatttgcatttccctgatagtgatattgagcattttctcacatgtttgatggccatttgtacatcttcttttgagaattgtctattcatgtccttagccctctttttgatggaattgtttttttcttgctggtttgagttcctggtagattctacatattagtcctttgttggatgcatagtttgcaaatattttcttccactctgtgggttgtttactctgctgattatttctttttctgtgcagaaggttttttagtttaattaagtctcatctatttatatttgtttttgttgtatttgcttttaagtttttggtgatgaaccctttgcctaggccaatgtctggaagaattcttctgttagcttccagaatttttatggtttcaggtcttagatataagtctttgatccatcttgagttgatttttgtgtaaggtgagagatgaggatccagtttcattcttctacatgcggcttgccaattatctcagcaccatttattggttagggtgtcctttccccactttatgttgttgtttactttgttgaagatcagttggctgtatttggctttatttctgggttttattctgttccattggtctatgcacctgtttttatactagtatcatgcttttttggtaactatagccttatagtatagtttgatgttgggtaatgtgatatttccagatttgttgtttttgtttagtcttgctttgactatgcaggctctttttttgttccatatgaactttaggattgttttctctagttctgtgaagaatgatgctggtatttggatggagaaaataatttggatggagcattgaatttatagattgcttttggaagtatggtcattttcacaatatttattctacctatgcatgagcatgggatgcgtttccatttgtttgtgtcatctatgatttttttcaggggtgttttgtagtttgcattgcagagatctttcacctctttgattaggtatattcctaagttttttttttaagctgttgtaaaaggggttgagttcttgatttgattctcagcttagtcactgttggtgtatagcagtgctactgatttgtgtacattgatcttgtattctgaaacttcactgaattcatttatcagataaaggagctttttggatgagtctttagggttttctaggtatacgatcatatcatcaacaaacagcaacagtttgacttcctctttaccaattgggatgccctttatttcattctcttgtctcattgctctggctaggacttccagtactaagctgaatagaagtggtaaaagtgggcatccttatattgctccagttctcaaaggaaatgctttccacttttccctgttcagtataatgttggctatgggtctgtcatagatggcttctattaccttaagatttgtcccttccatgctaattttgctgagggtcttaataataaagaaatgctggatttgtatcaaatgctttttctgtgtctattgagatgatcacatgatttttgcttttacttctgtttatgtggtgtatcacatttattaactcatatatttttcaggggttggggacagagtcttgctctgtcacccagtctggagtataatggcatgatcttggctcattgcaacctccacctcccgggttcaaaggatattcatacctcagcctcacaagtagcagggatttcaggtgtgtgtcaccatgcccaactaatttatttgtattttttagtagagtcagggttttgccatgttggccaggctggtctcaaactcctggccttaagtgatccaaccaccatggcttcccaatgtgctagattacaggtgtaagccactgtgcccggcctgacttgtgtatgttaaaccaaccctgaatccctggtatggagcccacttgatcacggtgtattatctttttgatacgctgttgaatttggttagctagtattttgttgaggatttttgcattgatgttcataagggatatttataaatatgtgtatgaaaagtttcagacacttgtttgtttcccactgaaatgttggttccaacagatctactgcattcccagtagtgttccgtggtattgatattctagagtttagaaatcatttcccatgtagatgaacactgaagttgttcccaggatgttactattcaagcaatactagcatgaacttttttttattgttatattaaattctggggcgcatgtgcaggatgtgtaagtttgttaaataggtaaatgtgtgccatggtggtttgctgcacctatcaacccatcatctaggtattaagcccagcatgcattagttatttttcctgatgctgttcctcccactgtccccagaacgtttttaaatatgcctccttatacacaattgtgaagggttctccgggctaggtaccaaaaagtagacttttatcatgcattctaaacttaacagagtgtgaagtaaaaccacattataaccttctgtcctgtcttgacactcattccaatcactgtccttcccaattacaggcttttgatggccattattttagttctatctagcccagaaattagaggctgtattagttcgttctcacacggctatgaagagactgggtaatttattcaggaaagaggtttaattgactcacagttctgcatggctggggaggcaggaaacttacaatcatgatggaaggtgaagaggaagcaaggcgccttcttcgcaaggcagcaggtggaagaattgctagcaagagcagggaaatctcccttataaaaccttgagacctcgtgagaactcactatcatgaggacggcatggaggaaaccacccccatgatccaattacctccacctgatctctcccttgacacctggcattagggggattacaattcaagatgagattttgggtggggacacagccaaaccattatcagaggctatgactgccatcattttatacaaactgtttagatttacatacattcttacatttcttttgcatgtctgaccttcctttgaggcccatccacttctcttcattgcagagtcagcttttaaaagtttctttagtgctcttaagtgagctcccttagtttttgtttgaaatgttatttactgtcattcttgaaagaccactgtactgatgactcaattctagagtgacaattgttttcccttggcactttgaagatattatatagtatagttttctggctttctttgtcggtgtgaagaagcctggggtcattctaatttttgttcctttgtaggtgatcttttttctctaggtggtttaagattttccttttttttcgtttatttattcacttttattttaagttcattggtgcatgtgtaagcttgttatctaggtgaacatgtgtcatgggggttggttgtacagattatttcatcacccaggtactaagcctactactcaatagttattcttcctggtcctctttctccttccaccctccaccacttgataggccccagtgtgtgttgttcccctctatgtgtccatgtgttctcattatttagctcccacttataagtgagatcaagcagtatttggttttctgttcctgtgttagtttgctaaatataatcgacactagttccatccatgtccctgaaaaatacatgatcttgtttttttattttatggctgcaaagattttcagttgtgttttcagtgctctacagaagtatagagaatggtatcacaaactcccatgtgcccattccccagccacagcaactcacgccacccgtgtttttctgtctccttacttacactgtctccctgccaggattattgtgaatcagatcccagacttcttattgtttcatctataactattttggtgcatatttctaaaatcatattattttaaaattgaaacatttttaaaaattgtagtgggcaaattatagagtaaagtgcaagctaggcacaaatttctaagataaaagagatcccaagattgtgtagaatagagaggccctgagcaattcatccagacaccagagattgccagctcactctcatttacccatcctgacatccaaccctacccattacagaggctaagccatttgtccaaggtcacatagagaatgactgggagaatcagtagaattccaattcagggctcttcccacagcccgtgttccctacattgttcttgaatcttcccaaagtcctgagaaagaaaagaggtagggagtgggagttgtggctacggagaaagaggagttgatatttccaatgtatatcagaagcaaacttgaactcacctttcacagccttccttagcaccaacagccaaacacaaatacctgtgttttatacagaatgcacttctgccaactcccacccttgctgtttacacaaatttgtttcttaattattgaaaacctcctgtgtgccaggtgattctctaagccctggggatgctgcactgaattaagctgatgtccctggcttcatgcaacttacattctagtcaaggagaggaagcaagccctcaacaagggcatacatgtcagggaagcaccatggagaaaataaagcaaggggaggggctgagcagtgtatgagggtgaggtgacagaaatgtcctctccaataaggaggcacttcaccagagacccctgttaaactaaaggacgcaagaaggtcagaatttaccttaaatagagttgatttaggcacaaacgttgaggacaggcctgtgtgggaagcccagattccacagaatggaagtctgtattccaaagtgaagtttgggatcctttatacagaggaagcttgggaaagcctagcagaatttcaacatctttctgtgtaaggtttaatgcatcatttaaatgatctaattagtccaggtggtctttttctttgtggaaaggtagatttaacattcctcactgaagatttaacagtcttggcatctcgggtgtcatctggtcttagcaaggtacacgacaataaaggagtcagttaacctataacaaagatctgggttcggtagtgggcaaggcctggtctctggtctctcctactcattcacagaagaggaacaatggggaagagagttctcctttaatctgagaagcagaattggaaaccggtggtgcgactcagtcttgggtcttaatatccttctgggtgtaataaacttggagggtgctgaaacagtattttctttgacaccttgaaggaagggagaaagggagctctatggctctctaagggaagagtccttggcatgttcaaggatcaagaagccagtatgatgatcatggagggagcagaaggaagagcaggagatgagatgagagaagagtagtggggccagaatcctcttgggtcttctaggcacagtcaagattgagggttttactttgagtgggatgggagctcactgaagcacagtttttaacttctctaagaaggaagagaggggtgaacagtgcttgtgatagggtgtgaggatagtcagtccattctaggaccaagcagaaataggttataaattacttgttcctgttttccatgtaacaatttccttcctttgatgtggagacaaaacagaaagaatgtttgctttggtagatcatcttcagcatccctctgtgcttaaggaggcgtatgcacattggaatgtcctgacatgagtgtccagggtgctgttgttgccttttttgttgcaaactcttgtccttgaggtgtttgccttctgatttgaacctaatcagggtattgaatactgtggctgctaagagatcatattttgcataagctgcttttgagagaacggtgaatgattgactcctcagagaaaatgcctagcagacctctgcagatggagaattccttatttcccatatgtgtcattcccagttctttgtctagagagtcaagtattgaactaaacgatatttcagggtcctctctctcctcctagtcagtggtgaaatggaaaagcaggggctccagaaccagccagatcagtttccataccagctctatgagtcaggaccctgcagacttgggcacgtgacttcatctctaggcctttcttcatctgtgtcatgagagtaacagcgctgatcttgaacatcgttgtcattattgaataaaaatgcacataatgtgctgagctttgctgggcacatagatgtcccacaagacaatttcattgccttgattcgggtgtctaggtgcgggcgggggatgatatggagggtggcaggtagggagcgtccttatagctgtagtcagggaaaactgaaatagtcagttgcttctccgagagcagccgtgccacctctgaagcacgagtaactggcagggctgtctgtcccctttgggctgcaacctggcttcaattctgaccctgacattgtgtgcttctgaagccttctcctcttgttttgacacctgaagtccccctgtatatcctagacttctcagtctaccagagcattcaccttactttcttcatcccaccctgcctttgatgatgcctaagtccccgagacaggaggaagtcttccccagaaaggtactatagcagcacttatacccatgtttaatgtcccagaaaccttgtgttcaagtaatgctttctcaagggtcttatgtcttttctgttagagcttcagccccgttcttgtgttctgttctaagtgaatgaaacgaacattatgctgtagacattgatgggtttgaaggcctaaaatgaacaagttttgttgaacaaagattctttctcgtctttatccttttcatgctaaggaatttcctgtctccatttcttttgttcccaccctactctacaccctcatgattccctaacgggaccactttaacagcctcccaacaccctcttcctcttctctatacgattctgctcttagcagccagattctctttagaacatgcatgctggaacatgccactccttgctttaaacccctcagcagctccctactgctcttagggtctcagtctgctcccatattctcactcacccgactcagaatgtcctgacctctgaggcctctcacccttagcctacaccacttcctgcccctctgggaactgcagtcacactggtactttctatgacacaaagagaccccccacacacaccacgtggaagtcttctgcccttgccctgtgtgttcgtaggctggctttcaacttcgggtctgagctggagcatcaccttctcagagaaacatcccctgatgggcctaagggctcctcccccgtcatttggtctcagaactcccctcagcttcctcccttttacttaatttgcatttaactgctgatttgtctttcccccaccagaatgctaacttctcaagggtgggaatctgtttttcttgtcctcccctggatccccagcccctagcagtgcctggtaatagtaagtcctcaatatatagttgctgaatgaatttatgattactttttataacactgaaagattgcaaagaatctaattattcagaaatagggtattcaccaaaaaaattatgatagaattagtcagatgtggtggctcacacctatagtcccaatgactcaggaggctgaggtaggaggatcacctgagcccagaaggttgaggctgcagtgagatatgatcacgccattatactttagcctgggtgactggttgaggccctgtttttttttttttaaaaaagttatggtagaatcatgtgattgcctgttatgctgtatagaggaatatattatggaatgaaaaaaattactagtcctattttgtgaaaaaaaaatctatcaacattcggttgttttttgttgttgtttgtttgtttgtttttttggttgctgttttaaaaaaagactgcaaggacagctaccaaatattagcagtgttatctctggggtgagtgatttttcttcttttccttaaaaaaaattgtgtattaagtatttcctacagtgaaacaagtattgcttttatagtggaaacatgattctaagcagagctgtgcaatgctgacctggcatggggtgggaagaagggggttagggaggcggtgcttagggtccagagtctgagttggcctcattctggtttcagctctggaaggagtgaagaatgagtcactggagcccatccagtccctcatggatgacatactgagggctcaggaagatgcccccttgcaacctgcctcagcttccaggctgagtcacctaagcagcttctttcagaaagcctttcacaggcacactcaggaagaagtacatcttcaattgaacaagaaataatatgaataaaaaatgtaaagaataaaaaatgcactgccacactggtggggcaggagggtgaaagtcgtgcccctcacaataggtaatgtctataaaaggacaaccgaggccatcaccaagtccacctacagaaggcgggtctgtctcaaccccagctgtcagtcactgtgaacctttagaactggggctgaagcttcttccagttgcttgctcagatgtcagtgagaccgctccacaacagataaggggagctgtgtgtcaggaaagtcccagccaccaggacaagctgcactccaggcagacgtttctgttcttgtgcaaagaacagcgcaatccattcaagttcacaggggcaggtggcacttgaaaatctcagggtcaacttgcagggcagaagttagcagggaagtcttcctgggggagtgggagagcccagcagagtttaggaggagggaagggcgatatcggggcaatcctctgagtctctctttcctcttcaggaactgttcaggaagaccctgcagtctctctgctggctcatgggagctcccagaactgaagcaacatacagatccaggccactctaagctctgcctgcattttcacagggcacattcttgtgtatatgtgtgtgtgtgtgtgtttggtgcatgtgtgtctgtgtgtgtgttctcttcttaataaaaccagcaatcactggactaggtagggcccactctaatccactgagctccccttaccttggtaacatctgcaaagaccctattttcaaacaaggtcacattccgggttctgagtggacatgaactttttcaacccagtacatctgggaacaggcagtcaagggtagaagagatcaacctgaggatgaggtttggatgcagagttttgagagaagggtgatcagagctagggtctaagcaacattggtctgctcccttggaggagaattttccctttttccttctgccctttagccagtgctgcagccacctcctctctcatagctggcatttaaaagccaaatggatgccacaaccttctaaggcatctagatatgcaactaaaatattaaaaaaattccagcaaggtcaaaataatctcaggcctagatttgccaccagtgccctcttctgggcagctttattttacagtagtgtcacgaaacacttgtttgtcaatatatgtatttgtgcactaagtgtcaccagaaaatacatttatgtctgttggttacagcctaaaaagtttaagaaaccatgtttagatgttttcccagtcaggaaaggccaaactaaaaagggctgtgtgtgtgtgtgcgtgtgcgcgtgtgtgtgtgtgtgaaaaagagagatgggggcccccattccactaagaagatgacagaggctgtgcaggttttttctctgtgatctcccctcctcctacaaatcatgcccagaggagggatcttgaggacctgcccctgcctccccagacccatctccacacccaggccatcctgggcagaggacagcagagctcacatctctgtggagagcagactgggctcactgcaggcctctgtgtcattgttcatcttcacttcataagtctcattctgagacctctcctgacacaccatggctatctggctctcctgggaaaagcacttacaacattcaagatagagaaaatcatcagcagctgccaaccctcctcctcttccctcagcaagtaaggcatcacgcatgcacatatgcacacgtgcacaaacacatgaacttgtgtacacacacacaggcacacacacacatgaacatgcatgcaatttctgtggcctcattttcttgtgatggctgatgaagccatgacgccatggaagtgttaagattagggagagggttccatgtgggaggatgtctggtgtggatccaaggagatctgagtcctgactccaattcacttaccctctggcccaagtcacttagcccaccccatgcctcagtttctctttctatgaaataggagtgacatatgccctgcctgactcagaggcctgttgtgagttacaaataaagcaacagataagacggcgctttgagactgggaaaagtcagctttgacctaagggtcctgggctgtgccataaagggcagggtgggcctgtgaggaggcctacctgtgagggcctgccctcccacccctacctgcaatagctgagcctttgggcattagtttggcacagctgagatgtctgtggcatcctattttgatggtgcccttgattctgacacaagctccctgcagtaaaggcacagaaaggaaacctcacctaggagggtttgctctcccaagcagagggcagtgagccggagtccctactgagcctgaatccttcctgaactccagacctgcctgtaccagaacatgtctttccctatggggacacagtcctctgctcactgggtcctgtcttcttcagctctgagccatgagctcttccttttcctgtttgtgctcagctcagtgcctctctccatctttatcctcagaccccagaaggcattaagggaagatcccagtccatcttcttggagctgagagctggatcagtgcccctggctttgaggcagggtaggggcagttctctctcagggaggcctgcagatcgccacctgccccacggtgggaaggaaagatgacaggtgggagctccaggtggattgggaggggagggagatggagtgggctttggcaaggcatggggggataagcttgagatgcagagtggcagcaggcaggcaacaacatttctggagaccaccaggcacaggacatgctggcctgtcctcaggacaagcaatgccagggcctgagctgcccttacccttcaggacgaggcctgggaactggaatgtgggctatgcttttcttcaccaaactgaagcttggcaccctgagtgttgtttgtaccaactgcagtaggcagacggggaaccaacacttcatgagcactgactgtgtgctgtgcactgtattgcgtgctttctgtttgtttgtttcatggagagatgtatctctggggagagggaaatcccctgagaatcccccctctcctctaaagcccccgccaccccaggttctctaaaaatccctctccccttatgtcacagagaataaagcttcacaggaaaatgcccttagaaagggggatttaattcactctgagatgctaaagatggccacggagacctccttaagcagaggctttcaggagaccgacagagaagaaggcagtgcagggacccagcgtgtcctcaactttggctaaataaacctgtaatcgattgaaacatgtcgcagtcactttttggttaacaaggtcaacggaggcacaagcaccaaagtccacctgaagaagttgggtctatctacgaaccacttgtgagtcactgtgaatatttagaaccgggggctaaagcttattccagttgtctgtctggatgtcagtgaggccactccatagtagattctcccacctttggtttaatgggatggacaactttggattaggactaaggaggtagatttgatcttggaagataccttaggcttcttgtctcttatctccctaggaaactgttggctgtcagtatctatactaggggtaagcccaagtgacagaacagttctggaagcatctccttgagttttcaggaaaggtttcactgacacaagaagagagtagggtggcagagcagcatcgggtttggttttcaattcccttttctatctccacacgtgttgggtgaaattcacagggttgccacactctcgtgggtatatttggattacggatgagagcataggaaggtgggctgtgggatacatacagtggagtgctgctgactatagcccccgtcatgtaagaaagcacgtcagattgccatagaacaagttatgctattgttggaataactgaagttcattctaatttagtttttaaaatcattctgaaactttgtcccccctaccgcatagtagttgaagggtactccgttttccctttttctgtcctaaccaagaaacagagcgtgcctcaactgttctgtgaccccatcagctgcacaatttgcccggcaggctggaacccaaggttacgctttgaacactcccaggcacctacaaaggtgtttaggttgttgccccaaacactgagaggaactggccaggccctgagccaaatgccttaatctctcaccaactccattccctgatcctcatgctgcagacctcactaggtagagcacctctttccctaactgcctatctggaggaaatggtgaaacccagtttctacctaagttctcataataaatgctttgatctgatcaccctggcgtctagtgcttctttctttgggattccaactggtcccatcttgggatggcttggggtactcccttgtgggaactcccctgatgccagcagtggcaccccagatgccactgctgaggtgactccagctgtgaattcactggaaaagaacacaggtattcctgattagttctttatgctccctcaaaggtcagagctcaatttccttgcacctgatttctcatccacaaaatggtatttataacacctctgtggaactgtcctccaatacccttcttcctttttaaaaaaccatgcatttggccacctggaatggagaacatgttttccaccccccttgcagctaggtgtggccacgtaactaagttctgaccaagcagtggaaggtagagtcccatatggcactttcaagaagtattcttaaagagcaagggcacatgcatttctatcctgcctgtcttcttcgtgactagaatgaaacacgatgcctggggctaaacagtgatcttaaaccatcaggaggaagtgatatattaaaaggcggaagagccaaaagatagaaagaacctagatcacttatgctagcagagctattcatcattttgcacagtttaccttcagactttgttcataagggggcaagggagtgtgagttttctatcacaggcaaacccaatcctgagggattgacttaatctatcaacattgctgtgaggatttaaggagataatataaaatccttagcagtttttctggcatgaagtcagagggcaactttttcttttttctcaaaagtaatgaaatattaaggctattgaaacttggttctgagaacactgaaagatatggaaagaccatagaacctgtttccacattggccagaatggactgacattacatctttgaagtcggtcataatcagaatgtttttcactgcttctaaattgtatgcactattggataaaactggaacagtacatggccaggcacagtggctcatgcctgtaatcccagcactctgggaggccaaggcaggcggatcacgaggtcaggagatcgagaccatcctggctaacacagtgaaaccctgtttctactaaaaatacaaaaaaaaaatgagccgggcatgatggcgggtgcctgtagtcccagctactcgggaggctgaggtaaaagaatggcgtgaacccaggaggcagagcttgcagtgagcagagatcacgccactgcactccagcctgggcaacagagagagactctgaatcaaaaaaaaaaaaaaaaccaaaaaaacaaaaaactataacagtactgactccatgttagagaaaagcttgtttgcttgaatacagttattgcttttcctgagactgtagattattcattaaaaacagcctcagaaatacaggatcttcagcagacataaaagaaaaaacactgacaaacaactctgggaatgggctaagtggcttgataagaatagcctgatggtacctgcagaaggtcatacaacattgaccaagaaaacagtgattgcctgcctgcctgcctgagacttcacatgtttcataagaatgctctgatcagccaggtacagtggttcagactggtattcctagcacttcacgaagctgaggtaggaggattgctggaggccaggaggatgaaaccagcctgtgcagaaaagcgagaccctgcctatacacaaacaaaaataataataataataaataataataatagctaggtatggtggtgcatgcctgtcatcttatctactcaggaggatcacttgagtccaggaggtcaaggctgcactgagccaagataacatcactgcactccagcctgggtgacaaagtgagaccctgtgtctaaaaagagagagagaaaaaaagctaaggctattttcaggttaggtcaggcttagtaacaaaaactttttgtgaaatgcttcgatcattgtttgccctgctcctaatttcccttaaaacctcccggatcagacaggtggtctttgaagatgagttcacagcctccctcgagtttttggcttcctgaatgtagctaactttccctttcaccaacatttgtctctagacttttggctttcaagcaacaagtggcctagatctgggtttggttacaaattttggcaagcccagccagaagccgtgtgctctgggctgtttgcaccctgtcagctcccaacagacaaagcaattggtcacagcttcataccaggactaactcatccatattgttgggaggacttcttggttcccaagaggtggagcaattgatggcggcagcaggtcagggctaactcattcacattaccagaggttagcggcaaatgctctgtggcactggctactcatggcagaagggaactgcagagacagccccaaagtctgccaaagagaggctgccaaaactctttctacttcagggaaacttcctcctttcccccattcagtactgactgcctacttttgcttttagttggtgaaaggaaactagctttattttttttattttaattttttttgagatggagtctcgctctgtcacccaagctggtgtgcaggggcgcaatctcggctcactgcaagctctgcctcctgggttcatgccattctcctgcctcagcatcctaggagtagctgggactacaggcgcccgccaccatgcccggctaatttttgtattttcagtagagacggggtttcaccttgttagccaggatggtctccatctcctgacctcgtgatccgcccgccttggcctcccaaagtgctgggaaactagctttttggatgagctgatgagctgtacaaccaggtaagtctactggggtgcaaagtagtagtccactttctttaccatttgggcctttggaccatttgtggtaccactggtagaagaaatgactcatagtgactccataccagtctcttcctttgtgaaagcctgggttggaaaagtgcttcatttgttttggttgtgttttgtttgtgtccaccatgggaagtttttttcatcagtcccctctcagagcccactgtggttcatattggctgactggtaagcctacagtgataaccctacgacaaaaaagataatctactgcaataaggtgtggtcaatgtacgtgatacatgaggaagataggtggccattacatggttctttgaatttaatgttatacagcttgaacatttcaatctgagatcaggaaattgggactgcataccttatattcaagcttttatgttggtacataataagcacgcttcccagaaaggttgctggctgatggtgcaaacaggaccatatcaggtaaaatctcctcactctccattacctgaggaggaaaagaaggagataggataatcttgtcaactataaaccctccacaggcaaatgatgctgaggctttgcaggtgcctgtcccattgcagcctgctctggcacctgtgcaggctcccatggaggccccagctgcagtaccagcacagtaccctgagttgccccatctctgccccctccaccagaggattatccagataatacagacttacagggtgtggtggcccctcctcattttaaaggtagccaagaaataggctccccttttaagacctgacaaggcaactaaatttgaccacagcgtacaccctcatgcggcagaacaatttctgttatgcaaattccccgctggaggattaaatgcacagggccatactcctgggctattttggttattcaccattttctatctttgactaagtaaatggaaaaatattcaagtccatcctatagggatgatccataggagatgactgaaatattcaccagtattttttctattcatcattccacaatagcaggtgtacaagcattattaaattttatgatgaaagggggttatttttagacaagactaatgatggagccagaaggctataccaggaagaccctgctgggtcctccaacatcccagaggcaatttccttagtgaaacgcaaatgaaaccttaataatgaggttatatcttgactgtaggattactcctaagaaagggagtacctaagcagcaaagcctcaataaaaaacatccatgacctctggtaggaggccagtgaaaacccagcagcttggttgaaacaagtgtaacaggcttacagaaaatattcagatattgatccagaggctctggaacatgtttgggtcataaatataactttcatcagccaaagtgcttctgacattaacagaaaattagaaaagcaggaagggactgttggaatgaacccttcccagtttacagatattgcttacaaagacttcaatgctagagaaacaagaaaagctagacaggcaaccattttcatggagactgttcaaaaaggtggaagaatgaggggtgaaatagaaaggaatccctagacaaggaccagtgtgcctacagtggggaaatctggacatgagaagtatgcccccctaagctacagagaaaagatggtaataaaaaagacaagggagaggaaaagggaaatatacgccaaagaaggagatggtggagcaggattgtgactctgatgaagactgatggggcacagggactccgcctgatttaacagagcaacagtaatttccctacaggagccctgggtacaagcgacagtggggaacaaaatgactggcttattggttgatactgtagcaatgtttccagccaaggctggagtcactgggaagttacaacagagactctttcttaagccctaagaatataaattgagggatataagattgaggtatagctttctgtatatgccacattgccctattccattgttgggccaagatttgttatgtaaattaaatgcccaagtcacttttgctcctgagaaacaacatctaagaatccaggtatcacccaaacatgtcctatgcctacaggcactggtgattcagccagagaaaagaactcaagaaccattcctgctggaagtctacaacagagggagttgcactgtttgggaagacaagggaacctgaactagcagtcaaagctcagcctgtgcacgttgaatttaaaaaagcattaattccacataaaaacaacactgcttaaaaggtaaagaattagaagtcatacagggggattacacaggtttctaaagcacagacttattcaatcatgacagtctcaatacaataccactatcttgccagtgaagaaaccaaactccaattagtatcaatttgtgcaaatttgagagctattaatgacatcgttcaagatacccacccaatcgtggctaacccatataccccacttacagctaccccaggggattatggctggttctcagcataggaattaaaggatgcttttgttcagtgtctactaattgaggagaaagcccagttgtttttgcacttgaatggcaagatctggagactagggcaaacttccaaaactgctagactgtactgcccaaatatttaagtattcctttaccatttttgaaaaaaatcttactaaaagatttgagaagcttgcaattaaacaggggaatactattacaatgcatgggtaatttactcattgctagccccacttatgaagactgtttataccagtttttgtttgattgttttgaaacaaggtctcactctgccacccatgctagagtgcagtggtgtgatcatgggtcactgcagccttgccctcctaggctcaagcgagcttcccaccttagcctcccaagtagctgggactgcatgtgtgtgccactgcacatggctaatttttaaaatttatttgttgtagagatggagtctcacagtgttgtccaggctggccttgaacttttgtgcttaagcgatccttcaactgtggcctcccaaagtgtctggattacaggcgtgagccaccgcacctggccaatactagttttaaacagcctggtggaattggatcataaagtatctctttgcaaatatgcaaagagcaggtagtctattcaggggtttgcctgcaataaggtaagcagagtctgatgcctgacaggtaacaagcaatagccactatcaaggctctcaaaaatcagataactaaaaggagtcttaggtatagttggcttttgtcacctttgatccctaattttggtctcctagtaaaggacttatctgaggcatttaaaatgtcagagtcagaacctttatattagacagtggaatgccaacagtcattcaataacattaaagaaaaactaaggaaattctttatgggcccccaagatgtttaccctaagatagttacgttgaatttcaccctgaccatgtaaattgatggcttatcttcacaggcatggaacaagagacataagtcatccctcttctcacctgagacaaatgcatatctgattgctccccctgcctgtttatcttatgtaaaaatgcaggttcattgaactagatgaatgtttaagtgactgttcccctaccctcttacatgtgaaggctaatcaaagactcaaaagaatgcaactgcttgcctcttatctacccatacccttttaaaaatgtatcttcctctttcaatacctggccttttccctttaaatattgggatcccaagaccctctttggaaaaagcatgaaacacaatgtttcctgtggatctacgttctttcctggacatgtcctcaacctcagcaaataaacctaaaatgatcaggactcaccttggtcatttttctttagtttacatttcctaagctacagacctgtgcagcacatgactatactgaatactgtgggcaacttcaacatgatggtatctgtgtctccaaatgtctcaacaaagaaaaggtacagtaaacatatggtttgaaagataaaagtggtatgcctctaaagggcactaaagggcactatagcattatagtatttatatgtctttgtccagggttcctggctcataacttctatggccctcattatagtcttgttatagtgctgggacactttaggctcagaaaacagactctctctgtctctgactttctcctgccctcctttcacctgcccaaggcaggactctgcacatcataagatcctcattccagagagggtcctgcccatccttaggaggtgggaatgctgcacagagaggccaagaatctggataagccttggtgggttttcccatctcagacaactagtgttagatcatcccttctggtccagttgtatttgtacatggttgtcaatcatgtctacccaatgatgtctccattgaaggctcaagaggacagggctcagggagcttctggaaagctgaacacgtggaggctgacaaaactcttccctatgccaggagggtggccacaccccaactccacagaagctcctgggttagggacccctccagactcaccccatgtatctcttcatctggctgtttatttgtatcatgtaaaataccctttgtaataaaccagtaaacataagtgtttccctgagttgtgtgagcactctagcaaattaatcaaacacaaagaagaggtcataggaaccccaacttgaagctggtgggtcagatgttctacagacctggacttgctatcttgggaaggaggggacagtcttgggagaatgagcctacaacctgtgggatctgatgctatctccaggtaggcggtgtcacaattgaactggaggacacctagctggtgtcccctccagaactgcttgtttgcttggtgtgtggggagaaattcccctgtatgtcgtcatagaagtcttccatgttgatggttgctgtggtgtgagagcagaagaaaaacacattggaggtggtttttccacacacaggcacttactatgaatggagcttgcaggactggaagttgctctgggtgagtcagggagtgtgtgttgcgtgcaggtgaaagcctaggacattactgcacactgttgtggactttataaacagtggacacttaggctacactaaatttgttaaaatattgttctttcttcagtaaattaaccttaggtttctgtatctctttcactttataaacgttttaattttttaaactttttgactcttgtaataacgcttaatttaaaacacaactgtacagcttttctttataagcttttttctatttaaaaaaatttcttttaaacttttctgttaaaaattaagacacaaacacacacattagctcaggcctaaacagggtcaggatcatcaatatcactgtcttccacgtgttgtcccactggaaggtcttcaggggcagtaacgcgtatgaagctgccgcgtcttatggtaacaatgcttccttctgggatatttcctgaaggatcttggctgaatctgcttttcagtcagcttcgtttttggaaagcagaggccgggcatggtggctcacacctgtaatccccgtactttgggaggacaaggtagaaggatcacatatagccaggagttcaagacaagtttagacaacagagcaagaacctgtctctacaaaaagtaaagataaaaaaaattagtcgggtgtgatagtgtgcatctgttgtccagctacttgggggactgaggtgagaggatggcatgagcccagttcaacactttagtgagctatgattatgccgctgcagtccagcctaggcaacagagcgagactctgtctcaaaaacagaacaaaactagaaagagtacactctaaaataataataaaagtattgtaaacacataaaccagtaacagtcatttatgatcattatcaagtattgtgtactgtatgtaactctccaagctatactcttatacactggcaactcaggtttgcttataccaggaccaccacaaacatgtgagtcatgcgttgtgctaccatgttatgatagttactatgccactaggtcacagaaattgctcagctctgttataatctatggaaccaccttcctatatgcagtctgttgttggctgaaatatcgttatgcagcccgtgactgtgcattggcatttgtccacttggtcttcagcctagctttgtactttgtctttgacattttggcttccactgcaatttacttcaggcttggactccttgaggatctctccaaacctgccatggtctgtttcttgccaccagtccctagctgcacattcttagggcagctgccccagcttagtctgatttatggggccccttatctcgtaacttttagaatcttgaccaagtcaggctacccggcaggaggaaatgtcaaaggcagaggcaaaagtggccctctcactttatctgtatctccagggtcttcctttgcatggtctcctttccttccaccctcaagtccattcctctcctgtttctctccgcccctccaggtttcctcctttaaccgcatcacctagagtcatcttcaccgtgcaaagtggttttgttcaaactaatgtattaacactcaactcagtgcagttgccctttgaatgatcacacccaggagacttttttctaattagtgttcaccttgactgtactatatttcagtgttgatcattttgtcctttggctcagatagctgtaaactgccttctatttcactgattcatcattctctcatcttcctttcccatcttcaaatgtggatatttcctaaaggtcattctctgttcctcattttttttcaaaaacttttaataaaatatacataatcaaatgtaccttaaccctgttcaaatgtacacttcattcatgttgaacatactggcattgttgtgcgaccagtctccagaacttttcctcttgcaaaactgaaattcttacacccgtaaaacaactccctatttgcccttcccccagcccctgacaatcactcttctactttctgtctctatgaatctgactactctaacaacctcatgtaagtagaataatacagtatttgtcttttgactggctttttcactgagtataatgtgatggttaattttatgtgtcaacttggctgagccaccgtacccatacatttggccaacattattctgggtgtttctgtgaaggtgttttttggatgagattaacatttaaatcaatggactctaagtaaagcagattaccctccgtaatgtgggtggacctcatccaattaggtgaagaccttactagaacaaagactgacttcccctgaacaaggagttgtgccagcagactgcctttggccttgaaccataactcttccctaggtctccagcctgccagccaatacaatcagattttcactcaccagtcctccacaactgcatgagctaattctttaagcctctttttcgctctgtgtagacacacacacacacacacacacacacacacacaccctgctggttgtttctctggagaaccctaatacaaataatagcctcagggctcatccatgtcgtagcatgtgtcagaacttccttccaagactgaatcatattccattgtatgtatataccacactttatgcacttatctgtcaatagacacttgggttgcttctaccttttggctgttgcaaataatgttgttataaacacaggtgtgcaaaaatgtcaagacactgcttttacttctgttgtttacaaacccagatgtgaaattgttggatcatatggtaattctatttttaatttttttccatagtgactaccccattttacattcccaccagccatgtacaaaagttctaatttctctatatccttgccatcatttattttttgttttgctccttttgggttgaggttttttctttcttctttttttttgagacagggtcttgctctgtcacccaggctggagtgcagtggtgcaattatagctcactacagccttgaactcccgggctcacacaatcctcctacctcagccttttgggtagctgggactacaggtgtgtgccacgattcccccctaatatttttttaaattttttgcagagatctggtctcactatgttacacaggatggtcttgaacacctgccctcaagttatcctctcgcttcagcttcccaaagtgctggaattgcaagcataagccactgtgcctggctgtgtgtgtgtgtgtgtgtgtgtgtgtaatagtagccatccccatggattgcagtggtacctcatcgtggctttgagttgcattttcccagtgactgggatgtcgagcatcttttcatgtgcctgtgggccatttgcacatcttttacggagaaatatctatttaagtattttgccaatttttttaatcagattgttttcatgttgctgagatatagaagttctttatatattctggttattaaccccttatcagatagatgatttacaaatacttgctcccattctgtaggttgccttttcactctgttgatcctgcccttcaatgcacagaagttgtaacttttgttgttgtccaattcatctatttttatgttattttacaaatccctcaactcatcaccaattttttttgttgcctgtgctttttggtgtcatagccaaggaatcattgccaaatgcaatgtcataaagcttttcccctctgttttcttctaccagttttatagttttatagcttttaactttaatttttaattttaacttcattttaactttagaaaatccatcttaagttaatttggatatattgtataagacaaggatcctacttcattcttttatatgtggatacctccttccttttggaaacttttcctttcagtaatcttactacctccacagctttagtttagatgttttttgttgttgttgttgtttcccaggggtgatcaaatccatatatccagcttttaccaccttcctgagttctagtccccccattttcaaacaccactgaaaatttagtttgactaagtacatcaacctattatgtgaagaaacaccatgtcccacccccactacggtgtggcttaatgagctaaagtaatatatcaagatagacataataatccaagaaactggggttcagagaagtaaatattattagggtgcatcttgcgctgttccagagtgaggcatatagggttttggggacagaacaatctagtctctgataatgttttctcttatagcacaggcacatttcatgagcctttcccactacctaggtgttccagtttggatgtggtttgtttggcctaagtctcatgttgaaatctgatttccagtgttggaggtggcgtctggtgggcaatgtttggaccatgggggtacatccctcatgaaaggcttgctgcccttatggcagaagtgactcagttctcactcttagttcccaagagaattgcttgttgaaaacaaacttgtacctcctacatgctctccttctagaagaggatctaaggaaatttataataaaagcagaggaacgctgaaaccaaacccaattcatatcagtaatagctaccatttgttaagcttccacaatgacaagtaagatgttaagccctttatgttaccaggattatctcatttatctcataagaattctagaacataggtcctattattatctttattttattcgtgagaaaagcagagactcagaaggcttaagtcataggccaaggtcatccagccagttgaatggtggagtggggaatatctggatccaggcagtcagactgtttttttttgtttttttttttttgagacggagtctcgctctgtcacccaggctggagtgcagtgccgtgatctcggctcactgcaagctccgcctcccaggttcacgccattctcctgcctcagcctcccaagtagctgggactacaggcgcccaccaccacgcccggctaattttttttttttttgtatttttagtagagacggggtttcaccatgttagccaggatggtctcgatctccagacctcgtgatctgcccaccaggcagtcagactttattagaacatgcacttaaaattagcaagaaggaatgagaacaacaacaacaaaattaaaaaatgcttgccaaagaaaactaaaacaatgtgcaatatttagccctgagatcactagcagtgaaggcaaagaagaatgcataatgggtttctacagctctcactgtccggttatagaaaatatttctacattagtacaagcacttttcttcctaagccctgagttttgagagtttatcaagaaggcctctgagttcattcaattaatggcatcatctaaggctgtttaataacaaatgcagaggtagtccacataaggaacttttgcctttacctttgagacaaagcccagggcctcacgttaggagtacagctctctaaatataagcctccagggcagaagcgaggggaggatggagggacacaatgcagatttacagcctggtgggtacggcctttgtcctctccatgtctattgtcactcttgaggtccaagcctctactgcactgcctggtttactgcacaacccaacttggctgcttgcttctggtctctccccaccaaaccatccttcacactgcttccagcttaatatttccaagacactgcatttgcaaatccactcctctgtttaaaaatgtttcagtgacttgcaacttgtctacagtgtgaagtataaatttattagcttgttgtttaaagccttctacaaccagaccccgaccgaccttcacgtcctattgagaggtgacagcctgctggcagccctcgcagccctggctcgctcttggcgcctcctcggccttggcacccactctggccgcgcttgaggagcccctcagcccgcagctgcactgtaggagcccctttctgggctggccaaggccggagccagctccctcagcttgcagggaggtgtggagggagaggcgcaggcgggaaccggggctgcgctcggcgcttgcgggccagcgcgagttcccggtgggcgtgggctcggcgggccccgcaatcggagcagccggcccgccagccccgggcagtgaggggtttagtacctgggccagcagctgccgtgctccatttctcgccgggccttagctgcctccccgcggggcagggctcgggacctgcagcccaccatgactgagcagcccgccatgactgagccgcctgccggcgccccagccatgggctcctacgcggccggagcctccccgacgagcgccgccccctaatccgcggtgcccagtcccatcaacccccaaagggctgaggagtgccggtgcacagcgcgggattggcaggcagctccacctgctgcccgctgccgcatccacttggtgaagccagctgagttcctaagtctagtggggacttggagaacctttatgtctagctaagggattgtaaatacaccaatgggcactctgtatctagctcaaggtttgcaaacacaccaatcagcaccctgtgtctagctcagggtttgtgaatgaaccaatcggcactgtgtatctagttaatctggtggggacttggagaacctttgtctagctaagggattgtgaatgcaccaatcggcactctgtatctagctcaaagtttgtaaatgcaccaatcagcactctgtgtctagctcacggtttgtaaatacaccaatcgacactgtgtatctcgctaatctagtggtgacctggagaacttttgtgtctagctcagggattataaacgcaccaatcagcaccctgtcaaaacggctcaatcagctctctgtaaaacagaccaatcagctctctctaaaatggaccaatcagcaggatgtgggtggggccagagaagagaataaacacaggctgccctaagacagcagcagtaactcactaggattttcttaccacagtatggaagctttgttctttttgttttttaggtctgcactgcctttatgagctgtaacactcactgcaaatgtctgcagcttcactcctgaagctagtgagatacacgaacccaccggggtgaactagcaactccagtacatgccgtcttaaaagctgtaacactcaggcgaaggtctgcagcttcactcctgagccagcaagaccacaaacccaccagaaggaaaaaactccaaacccatcggaacatctgagggaacaaactccagacacaccgcctttaaaaactaacaccgcgagggtctgcagcttcagtcttgcgttagtgagaccaagaacccatcaattctggacacactatcaactttgtttctccaagggtgcttcttaaactggatgatgcacaccctaggagtgtgtgtgtaggatggggtttgaagcagtagggtaaaaaacctagcatacattctattccagaggtgtcaatttaccagacaacagttattttaaaacttttttatgcaaaaacatgttatagggtggaatgcaacatttttatgggcctgtgggccatttgtatacatctttggagaaatggctatttaagtactctgcccattaattctaaacttaaaactaagacttcaaagtccctctaaggattttgctgggccacatcccaagaccctgaagggtattacttactcgccctctccaaactgccgaagtcggaagcaggtgacaaaaaagctgaccctggaatcaccttttgtaaatttcccacctccaagcttttcgatagtttgtaacactggctcctctccccaaaagcctttccttcaagtcccagcaactctccctgaccctgctgggaaggcgcaccaattacctgtcattccaggaaagctcatagcataagatgatcccattggtcatctcccagaaccagactttctgaaaagtcctcaaggaccagctagtccaatccctcactgaataaaggagaagcaaagtctagggaggtgaggtgattcgttgtcctcctaattagcaggtgagctcctggcagggctggggtttcatcttctgggctctctgcaaggtcgtgcccggcacgggccaggaacaatttcataaactcgtcatctagacggcctttgactgacaccatctctccgtgtggaggagccgctggggtgcacggggcaggtgtcgtccgtttcaaaggtaaaataacccagctgcagacctccagaggccgactagagccggggtcagaaaacaggttttccctctcggggacagcgcccaggggaccggcattagaacatcggctgatgtttcatctggtcagggaaccatccagcgcttagtacacctggcgctaatcggcggggattaatctcacaccccgcagctggcggaaagcagcgggaggaggcacctagccctggggttgagatcccagttcccgcgtgcgcaaaccacgcccctgtagattctcgctgctgcgtgttcgcgcgcgtcccggagtgcgcatgcgcagcggcgggggttgttccggctgcctttcactgaggggacccgccagtttctaactcagtggcgtttgccctgattcccggggcctggctttcagcgtagcaattctgccggcgaagaaggtgagcgcagtgctgtgtggcagcagagctccttaggacgaggagcagcgggacgaggaagggcagactggtgaaatcgcaaactgggcgtctgttccggcgccggacccctatttgcaaaggtgggtggcccgtccggagcgggaaaacattccggaagtggagggccgggccagcgtgattgacaagcgggaacccctgtgtggggacgggtaggcctaggaaggttgtgcctgcggtggaactgggcggtgcgcagaagtgggcattaacagcagccgcgtgtctgggtcttagatttggcccagctgtgttgagcttttcatggattatcttacgtagataagacactgcaacagtgagtgagcgcttgtaacccacctgtctcttacggaaactgagccccagcgatgctaactttagcaaggatacagctgggatcctaaacttggcaatcagagcccagagccgataaagttagctgcatgagtctagcttcccccagggcgggaatcgaggcggagcagggtacagtacggaggccaggaatgagtgcacttgaccagattgttgacggaagtgtcataaaaatggacttaaatgctgataagcagctgtttgggttccacacagggtgcgagctcaggatgcacgttggaggggacacagggccagagcaaggtgggaatgcgggtattatgggccaggccatcctccagctggtggagcaccgcagtactgcagtgtgtggccctggcttaacagcagtgcggaaaagcttttttcttggggctgtggtgctttccaggtgtgtgaagttaaaacattttagggccatacggtagatagtacctgccacatagttgtcttggtcagccccggctgccatgacaaaataccataaactgggtggcttagacacagaaatgtgttttctcacagtcccagaggcttgggatgtccaagatcaatgtggggaggacacaactgagcccacaacaatagtctgtactcagtaatgagtgataattggggactgaagaaaatgaacacgttaagaactaatatgttcctgaagtgctttcacaactctaacctcgttttatgagcgtgagctttgctgtcctggtgtgtgccttggcactgggaggtgatggttgtcctccacacagccaacctgaagagggctgaacaagtcactgcaaatgtttttaatagggcttagtgaatccgttatactcagatttatctaaacctctatgatttagcctgtgctgcttctggaataatgagatccataattaccactgatggggaagtgaaataatacttacgtttcttctgtattgtttagtgttgtcattctagagtttggtaaccaagtctgtcttttttatcccacttatcctggtgggaggaaaagtgaggagatagaaagtttcaggtggcttgggggtctggcagatgtggttcaaatcctgagttcaagcacttgctgagtgaccttgggcaagtcatataagtttactgagtctcagtttctttctctataaaatagagcttataaaaataccacacagggtttttgtggggttatctgaaaacggtttgaaaccattaaagaactggccatttaactaataggtattcaagtcatgggacctccgttacccagcctcggaagagaaaccttcacttacagccccgatgtctggctggctactcattcgttcatcagatttttgttgaatgcctatgaggtgtcgaagcacctagttctgagtcctggagccagagaagagcaagacagacaaggttcctctatttatggaacgtatattccagtgaggaagaataaataggttcagatggtgctaagagctatgaataaattaaatacagagtaatgtgattttttaaaagtgacttagagcaagctagggggtgaggagtgggggtggtgtttgaccactgtccagcggccagacagccggagaggcttctctgaggaggtgagccaaagcctggatattgaggaggactccttctccaggccaaggggagcagcaagtgcaaggcccgagctgagtagatgaggctgggagcctgaccagtctcaggctgaccagtgctctgtcttgagaggagctgctggtcagctttttgtcttgggattcagaacgaggagacatgaagactttttacttggcagtgggagctgaagctgaaaggtccaggggctgatgaggccacgtgtaagcgaaagtttgggataagcagaaaccgagtgcgctgagggagtgagattgtggctgtatccggcacctggctgagcaggagagtgaaccccgtgggtgtgtgtttgctggtgacgttcctggagctgtcttgaagtccgagctgccttgcagcttgtagtctgcctctgtttttggctttcccagatagtttcaattcttactctcagtttgtgaacctcccttcagtgaacctcccttcacttatgctggatatctcttgcaaccggatgagcttcactaaagcagagtcatttggacctggattcgaatccctggttttccactttttagctgtgactttgagcaattatttaatttctgtaagcatcagtatccagtagctgtatccttatagtgttgtacagattaaatgagataataaaagcaaaagaccactgtagagtgtttaacacataggaggtactcaaaaatttgttaggtacctttcttcccctttccttcatgtgttaaagctttttcagtacatacccctctctcaggattgaattgtaaatcatgttttttgattacccttcttgtaataattcctctacctctgtagtcatgtttttcttttttcattttttcttgtccccagaatgtctaacaaaacagccaaatatacctctgtgaagacagagggtaaaataatgctagttctgtgagttctctcttcttgtgcaaatccataaactgccaccaatctgtagtcattttaattgcccctaaaccgaagagcatcgtggcaactacctttcccctcgtaaatagagtgacactatcactagtcttattgaggccaaagttataaagatgggctctcgatctactaatattagtaaaatgggtttgggacttactaacatttgtgcttagaagagacagacctggcaaagagcttggagaagtgagttccaaagagagaggtgtgggaaccaggatggaagagtcaggcctccagatagcgtttacttctcctttcttccttgaatcactgtctcagagataattaggttcaggagaggagaaaaaaaaagatgacgtcaacgtggagcagagtttttcttagaccttagcctagcaaggaaagagaaatgcctggtctcagtactgggaagctgttccagccagagccccgtggctgtgaagagagctctcctgtctggaaccaaacagaaagctcataggtctagaggccagaaaagttagtaggtggtggctctgttcggtgctggaaatggaggccaggatgaactaagaagcaaactaaagatacttgtaagataaggacgtgtaggccgggtgcggtggctcacgcctgtaatcccagcacttcgggaggccaaggcgggcggatcacgaggtcaggagatcgagaccatcctggctaacacggtgaaaccccgtctctaccaaaaaaaaaaattagctgggcgtggtggcgggcacctgtagtcccagctactcgggaggctgaggcaggagaatggtgtgaacccgggaggcggagcgtgcagtgagccgagattgcgccactgcactccagcctgggcgacagagtgagactctgtctcgaaaaaaaaaaaaaaaaagatagggacgtgtatgttaacttgcgctatccaaacaacaagctgtgcttatggtcctctgcctgtgcgtcatgattttccaggacttcacaacgggataaagtgaagtagcttcggcttgtgaatgtgcattgcagagacgtgggagaagaaagctgcaaaagtcattataagcaacacccttgatcttaggggtgctggtctgtgagaagagagctctaagccttttgtagaggcattagaaaggtatcggagccacggtgaaatgcaggggagattgggtttaggggctttcctggtctgcattctgctacagccgttaaatgccgctagatggagtgcgtgattctggtatggcctcacgtggacctgctgcgaaggatggagagaacatggtctctgcttcccagaaaaaaggagaaatttggtaataagtgtggagactgctcttaaataatgctccagatttcaagccacttcttcctggaccatgagagagctccctaatgttgtatttatttttcctaggtccatggctaatgaaacacagaaggttggtgccatccattttccttttcccttcacaccctattccatccaggaagacttcatggcagagctgtaccgggttttggaggctggcaagattgggatatttgagagtccaactggcactgtgagtatgaacagtgagagatactgaaaaggacaacttaacagcagccgtactagcttttcctgtttgcctatccagagattttcatagtttgaagttgggcagagtagtctctgtttatctgagtaatagtcacttcctctattaaagtcttttttttttttttttgagacggagtctcgctgtgtcgcccaggccagagtgcagtgggacgatctcggctcactgcaagctccgcctcccgggttcacgccattctcctgcctcagcctcttgagttgctgggactacaggtgcccgccgccacgcccggctaattttttgtagttttaatagagacagggtttcaccgtgttagccaggatgatctcagtcttctgacctcgtgatccgcccgcttcggcctcccaaagtgctaggattacaggcatgagtcaccgtgcccggcctaaagtcttaaacatagctctgtggtctgagaaaaattaggctgaagtcattggtgcctacctattacggtagatgagacggctttcttaccaactcttttccctcccgttccccatccttcaaatataattctaagttttagtctctgctgagtgaaccagtgtgttatgattatgttttgaacataattttgtcttgaacaatatgtcttaatattctgttttttctagttaataattgcccttttaaagttagtttagtttttaatatacctatgccagttcctcccacatcatccagtggcctctcaatatgattttccatacagataactcctgtcttagtcggccaggactgccatagtaaaataccatagactgggtgacttaacaggaatttattttctcaccattctggaggctggaaagttgaagatccagattctggcagggttctggttctggggagggggtctcttcctggcttgcagatggctgcgttcttactgtggagcaagaaaagacgaggaggagaaaaacaaatctttggtgtctctttctcttttatgaggacaagggctgctcccttatggctgctccgttatgacctcctttacccttgaaggccagatctgtagtagagtcacatggcggggttaggatttcaacatatgtttgtttgttaagatgggcagtctcactatgtggcccaggctggtctcgaactcaagcgatcctcccctctcagcctcccaagtacctggtggctggcaagatccaagattactggtgcacaccaccatacacagcttcttttgttttgtttttgttctttaaaaacatttttttaacatgcattttggtggggatacaattcagtccacagcagtgaccaattccatttttaccttggagccctcctggaatcctccatcctttccctgtcatttgaattagttgctcctcagactgacttgacagatttcagcatgagtgttaatggggacagacggccgcacccacaccacatcagggtatacgtccgtttggaggctttcctcaaacgtctggcagccctggactgcctgtgtatgctgaagaacagggcacagaaaggctgagtctgcagggcactggctgtggctgccaggctgggctcctttgttgggggcctccagttgccagcacatctgtgggattttccctagagtcttcagtctctccagagcaggtgcctctgagccctggcccagcaggtacagacgctgaagcccaatagccggtcttccgggaggtggtctggggaaggggatccaggtggagagtccccctcagtgcctgctttcagcctggccctcctccccctccctcttgcctcctcaatctgccggttgcctccagggctctcctagctcagcttccacttagagcccacttcctgtcttctgcaaggagcaggagcagggattgcaacctgagaatctaattgttcttaaaaagaatttcaacccgtccctttgttttcagtggcctgctgtgttcctaccacttcctgagtctttctgagaatgagtgggggagatctctggggacacttgggcttgagtgtctctgccgaaatcacttccatgtctctgccttctttccctctctcctaaaacatattactccttccactttctttttgtgggtgtaagcctccatattactttggttaattttagtgtgctttggaacacagatgagtgcatgttcattctgccttgtttaattttagagacagggtgttgctctgttgcccagggccgagtgcagtgttaagatcatggtttactgcagcctcaaccttctggcaacaagtgatcttcccacgtcagcctcctgagcagctgggactacaggtgtgcaccatcacacctagctaattttttaatttgtagaaatgagatctcactatgctgctcaggccggtggtcttaaacccctaggctcaagcaatcctccctccttggcctcccatagtgctgagattacaggcatgagccactgtacctgacccctttcaccttgtttagcctgacaacccatcttctccctctcaggtctttccatctcagtcttctgcactccaggcttctgcgtcttcttcctctgctcagcctttaattgtcgatgtttctggttctatagcttcatcttcttgtgtgcagtctctgtgaatgtaccctgtggctttattacctttgacattcttctgtcttctaaatcatctcctgaatagagtgttttctcctgtcctgggtgtcccgcagcccatagaagcagccatgctgtgggacaccctgagtggggtttgtgttacctgttgtgcctaccatgcccttccccgccgtggatgcacaggtgccccaccttagctgccccagatgctgtttatccttgatagtcaccttttaagccttatacaggtctatcaagttgagtcaccattaccacttggtgtgtgctgtgccttgtgtaatactgcagttccgggagtcatccaacctggaatgcatgctttgcggggatctatgatgccctcgaattgtatgttacatgtgaacctgtgagcattttctaggggctctgcacctttgtgtcctcagctctgagccccatgcttgctgcaaccagcaggtgttcagagtgaatgaatttgcttatcttggcataaatcatgtaactgttgatgataccccaggaaggtgagcctttggttataaatccttttaacattttccagtctaaaagttttgtggtcttattacacgatgtagaaaacagtgggcctcagttattcttttgctgttgtgccggagtataccacggttgtttttgaaagataactttgaccatacccttaggaacttcctcagctcactttcaaatggagggcactggctttctaaccattgtgtctcccagcccagtgacagctgaagctgactgcttccgatatcacagacagcacagaagagccgccctccaggtgctgctgggaaatgctgcctggaactctttgccatttactttctatcaaaagctgagggaaatggtacatatggggctttcctaaaaatatgggatccatccatttgtcaacaatgtcattctatcctatcccagggcctttcaagattttgatgaaaactaatagatcccatattccagaataatgctattaataattttattattattacttaatgatagcaaaaagttagctaactccaaccgctcacttgttatttgccaggtaatcctctaatccagaggatttggccttttgtgtgtgttaatgtcctgcttgcaccagctctatgaggaaggtgccgctgttgtcatttccatttctgcactcgtggaaacaagcgtagtgaggccagcctgagccacagagctgcaggtgggggagacagctggaaccctggcacctggctgtggagtttgagactctgactcctgcgccgcgctgctgccccaaccgtagtcatacgaggtgtttcaccccgccctggatactctgagatcccctctgggttcagcaggctcagagagctgactgcctggagcagaaggcatggggtcctccagagactcccctgagctgagttcccctgtggacaccagggccgcctccttgtggcgctccctgaagggtcctctctggaagaactgtattggttccctggggctgctagaggaaagcttcacaaactggggcttaaacaacagaaactgacatcccacagcgctggaggctggagtccgagatcaaggtgtcagcatgcttggtcccttctgagggtcgtgagggaaagatctcttcaggcccctttccttggcttataggtggcgtgttctccttgggtatcatcacatcgcctgccttctgtgcatgtctgcatccacgtgtcccctttccaataaggatattagccctttaggctgggtcccgtcctagtagtctcatcttaactaattacatttgcgacagtcctatttccagatcaggccacattctgagatgctgggggttaggatttcaacacaggaatttggaggaatacaactcaatcaggcttatggaaaattctggtcttaagtcaagggtagtgttctccagtctgtatatggaggcgcacacctatggtcccagccacttgggaggctgaggccagagaactgtgtgagcccaggagttccataccagcctgggcaacatagcaagacctcctctcaaaaacagacagagtggtgtcttccagagtgattagtttgcttaaaaaaaaaaaaacaaaacaaaacacaaaccgtaagcactggcgctcatgactgatcatcctgtatccacgcacgagctgcacgaaggccgcgcggtcactctggctccctgttggcgagtacctgggatttcttgctcagcattttggggccttaattcttttaggggactttttgtctaatgtctccccttcttctaattatgtgcgatatttacatagaatctgataaactgcttcaaatttgttttcagaacagtgagctggataattaaagaagctttttcctgcttcttgggcccagtttccatttctttcttttttctgtttttcctggctattctagtgctaatttccttcctttcctttcctaggctggtcttagagcatcctctcctatgtacagccagaccttctttcaagcttttattaaaatggggaaaggtcatttgggaggctttgttgttttcctgtttctaaagatcatttttcttcctgcaggggaagtccttaagtcttatttgtggggccctctcttggctccgtgactttgaacagaagaagcgtgaagaagaggcacgactccttgaaactggaactggccccttacatgatgagaaagatgaatccctgtgtctgtcttcttcctgcgaaggggctgcaggcaccccgaggcctgctggagaaccggcctgggttactcagtttgtgcagaagaaagaagagagggacctggtggaccgactaaaggtgagacctggggtatccggaagtgggagtactggaggaaacagggcttcagcgattgttctggggcgattccgagactcaggcagtgcatgctcccctgccgttgccgtgcctctcagctcttccctcagctccttgggtctatggtgctgccgctgtgctgtcttttttgagctggaggtcagcaggccttctccacataaggaactgttggtgcccatttattactcacctgggaaaggacctgatcattgccattggcagcatggttcaatggctgcaaatggatctgatggagagcgtgtggctttgggaggagtgtgccgccttccgcagtgagcagcgaggctgggaccggcagggatgaggtcccgggaggggatgcggcagcccttgagtgctggccggggaaggagagatgcccccagtgaggaggcgccgggctgagtggcccagactccttaggagaggcctggttttgggcttccttggtgattttccttcatgtctgcctcctgtaggcggagcaggccaggaggaagcagcgagaagaacgcctgcagcagctgcagcacagggtgcagctcaagtatgcagccaagcgcctggtgagcctcatttcttggggggcaggattatgtccaggcagggttgctctgcttggaggctcatgggtgcgtggtcagggccttggtctcccctccgtgaccctcactggctatgtgctcccgtacagaagctgggctgtgagtggttgaggcgtggatcctaggagtcgacctctctccagccaggcagccaggcctatgtgaatggggcgtggtgtgctttgtctctggcatgtggggaggtgggtactggtgctgagacttcttcctccctcaccacctccactacccctgtccagaggcaggaagaagaagaaagagagaatctcctccgcctcagcagggagatgctagagacaggcccggaggctgagcggctggagcagctggagtctggggaggaggagctggtcctcgccgaatacgagagtgatgaggagaaaaaggtggcgagcaggtgagacagaggcggtagcactaccctgccccaggccaggggacacccttgaagacagctctttccctcatgccacagatgccatgaagcacctggcaagaggcatggtggcctctgccctctgctctaagccgggtccttcctagggtccatgagtgccagtggcagtgaggacagtcaccggcctggcctgtgtcctctcagctgtcctcacggcagctcaggcagggcaggaacatttgtgtctgcgccttatacacaaggaggctgcagccccacaaggagagactccttggctgaggccacaagcctcggcagtggagagctgggctagaactcagctggcctggctctagatctcaggctctgaggcagctgactgcactgggtaacctgtgaggtgccaaccatcaaggcgtccttagcctgagctttccttctcccataaagcctctgttggtccagactcaaggtttccacttgatgagccatgagctgctgggtgacttagccctgagcaggccacccaggccatttcgggcccacaggatccctggtcacagccctgttcccattcacactggaacctcaccaccatccctgagtgtctgctctgagtatggcactgtccagatgctgtggacatagaagggaagaagacatggaggggacagttaatagacatgaaaacaaatagcacctatgtgaagtcagcatgtttgcctacaaggaaaacaaaatggtgatgtggatggggtggggggctgcacctgatgatgagtcccgtgtgtcctgtgacatcctggccaccacatctgtcggagggtaactgcaagaccagagaccctccatggatattcctgaaggttcatccccggccttcacagtctgtctgcagggcgccttctgatgccacctccagccgccatccaccagacgccagcttccccgctgccctgaacttcctccagcgcaccaggccttcctctgtcctgtctgaggatttgctcatgcaacgtgctgtggccaaacaccctgccctcctcccttggcagatgtcttcctctcctttaaggcctggctcaggtgtcgtcttggtggcttcgggtgtcagctgctctgttttgctcatgcacctgcttgtgcttctgttgttgcctcctctccctggctgggctcgagctgcttcagggcaggaaccacgtctttatagtttgatgttcccagagctgacccagtgtttggcataggggtgtgctcaataaaatcgagttgacatgaatgagcagatgctgcctcgttgcagtctggtagtgtaattccaggctgcgcatgtgaacttcgacttctgcccctgcccagggcagagaccaccgtgttgctttatgcctcgctggtgagagggggtcataaacagtttgtgctccatgaacccttcctgcccgcctccgaggtcatgtttctgctccctctcttctcccttagagcccgtggggacaaggcagagaacttgagtggagatggaggtggtgaatattaaaggaacaaagtgctccttcaggtctgggcaagagccatggatcctgtaggtcagcttctggggcttcccatgccctcacgtttcaggagataacgtgagcctcggaggacctgagttctgaatagaaaatttttgctcttcatttcttcacacacccagcctctcagtgagctcctgctggctttgtccagcatgcgacataagattgaatccaagccttttaagatagagccgcctgctctttagtgaccatgaagccaagcctgtaataattactcttctgatagcccaagacaattgtattctgttttgttagaaaggaatttcgaggtgaacaaaaatgttttctttttatgtgatgttgccataggtagcgtgtgcctgtcagatggttttgtgttttctgaggagcatagactagtagagctagctcagcttcaggccatgggatgcagggctggcttccctgccaacgcctggcgctgatggattcttcccgcattgctgggaagggcagactgaggcactgacacaagaagagttgtagctggtcataagtgacagcatcctctgttcactcgattggtcagttgtagcttcatccaggagatggtcatggggttcctgctgcataccaagctctaggtgaggccacggggactcagcagaaacaaggccgacctgggtcctcccttgtggacatgacagtctggggagatagaccgagaggaagcgattttgaatgagatgggtgtgaagagcaggggccatgaatctgtgtcagagcagccaggcctaccagggaaggtcaaagaaggcttcctggaggaggtgatgtttctgctgctatctcagagttgactgggagctggtgaggggagacaacattccaggcacagaacatccgaaggcctgagatgatgaagagcaaatatccgccctggggcctcagaggggtccagcttgctggagggagggcagagaggagagcagcctgccatgagtcccgaggcttccgactcaagacttgggttgggggtgctgagcccctttctcctttttacatttccctacccacagacctgagcggccatgggaggttggggttggcatttgcctgggggagtttctgagcgagcagcacctgctaccttggtggaacccattgctgggaatggccagggctcagcaccagcgctcagcagatgctcagtgcgttttgctgagtttgctgagggaagactgttttctgttctctctcacacacacagagtggatgaggatgaggatgacctggaggaagaacacataactaaggtaacacaagtgtcctcagctggtgctgtgctgggggtataggctgggctgtgcacccctggggaggaggctggagtcacttggctacttctcaccctcctctccacaaaggaggagcttccagcacttggactccgttgcttcttgcacacaaccctggtcctaagttgctcccttggccagctgcagtggaccctggagtcctctcctggggtcagggcctggggagtcctctcctggggagacctttcctgggaacagggacctgaggagacctctcttgagtttggggcctggggagacatctcctgggttcggggcctggggagacctctcctgggggcagggccatgcttgccaccccagggcatcgaggaacagctgttctgggctgaaatctgggtgttttctgtccctgctgggtggtacgggtaggacagacatgagtcccctgccctttgggtctctcatggtgtgcttctccctttgtctgtgttcccatttgcatggagggctatgggttgtgtatggtctgacatttcccatttggtttcattgatttatgacttgttttctgtcggaagtaggtattttctttgtattttctttttttctcccttcactcttgccttagaggagtagagagagggtattctggtcagccttcctttttccctttggggatgtgtgtgacacactccctcccctcccaccaacaacccaccctccccaagtggggaccctttgccacgggagatggtcacccatgtccaaagattggccaaccccccaaaagcggttgattagaggctggatatgactcgtggaaggagctgcctttggggcattcccttgaacttctggagctgtgggtgacttgggaatccctgggtccctcgatagatgcctgacatgggacattgctgtcctgcctcggctttgtgcattgggagccactccctttccctcagcctctcaggccctggcgtgccttgatgttagagaatgctgtgggatgttttggttctctctttgaagcgcctttctttctctctgctagatttattactgtagtcggacacactcccagctggcccagtttgtgcatgaggtgaagaagagcccctttggcaaggatgttcggctggtctcccttggctcccggcaggtaaacagtagccagtatttccaccaggggccatcctgctcctttcgccacaactttgtcctgctcgtccaggccttgggagacgctgggtctgtgacaggctgaaccgtgtgaggagcagccccctccctgacctggccggcccagcactggaaggcaaaggagaggtggcggggcaggtccacgtgtgttggtaggatgtcatttagctggcaccatctttttgcctctttctttctcctttgctgcagaacctttgtgtaaatgaagacgtgaaaagcctaggttctgtgcagcttatcaacgaccgctgtgtggacatgcagagaagcaggcacggtagccactgggaccatggtgtagccgcaggtggtctggagagagtgaggcaggggtggcagtgactgaagaccattaagtgtctttcatagaaagaatggcagaggagaccccagttccttcctgagtcccctctccttgggaaaaagtgttcctactctctgggtcagtgtctggtccgaatccttggcttggagatgattttacgggctctttctggagaacagaagtaaaaccttacagtgttccgatgagaccacagtaggcagtacttgggagggtcttatagaccctaccccatggaagtgggtctcaacattacacaaccccctcttgggcccgtggacagttgctgtcctctctgttttctctctttgtgcctgtgccaccctcagagaagaagaaaggagctgaggaggagaagccaaagaggaggaggcaggagaagcaggcagcctgccccttctacaaccacgagcagatgggccttctccgggatgaggccctggcagaggtgaaggacatggagcagctgctggcccttgggaaggaggcccgggcctgtccctattacgggagccgccttgccatccctgcagcccaggtgagggccctgcagggccagaaagccgctcttgactctcactgtggtctaggccatgaggggggtcctcatcacactgtagtttgggggatgccccccaccgtggtcaggttgatggcaccttaacccattctctcctgatgtgtgagttggaggaggcgcgtgggatcccttggggtctccaggcagcagggccagttggcattactggggatggtatttaggagccaggaaagccggtgcattcctagtgaaaccacagggagaggggggatgccaggagctgagaagagtgtgctgcatacatctatttacaaatggctttccaagtgatgctcccaacttccatgcctatgatgtgatggaggatgtcagtgatagaaccattcagttttccagtttttcctttttgtaatatcagtactcttaactggaaagctttccctaacttacacctacctgcagcacgtgagaatactgtcttctctgcctcaacttctcttgatttttaaacagaaggaagaactgctaatgtagcagatcaaaagtagtatctcactgttatttggtgggtgcagtttcactatttccttgctacttctttaatttgagtgactttggaaacgggatatcactagtggaaaattctgtataatccagaaaaaaatgtaaggttttaaaagattcagggaactaagtaaccatttgcacagcagctaaatgctcaccagcatacctgctgagctgtgtgggcactggcagagaaactgaggaaagctgccaggccccatggtgtcccaggccttccctcccgtctgtttgcctttagagcaagattagtgctataggcatttatacacaaataccataatatggcccaaaatctttacaatttttgaatttttaaagtactttgaccatattttgcttttatgttaatagtattccagtgaaattctgtgcatggggacactggagcccagaaaagttaagtgactcatattttctcaccaagcgtgggtgatggagccattcagttttccgatattttattttttatatgagtattcctttaactggaaactttcctaacaacaaacacctaaagatgtgcagagttgcttttatttttgttaccccagctccacgccttaaccctcactttgaaataggatgtatcaaccctattttgcagatgaggaaagcaagagtcagagaggttagacaactcttccagagtcacacagctggggagtagcagctccaggagtagaagctggggccgcttcctggtgcaccgatggtctgcaggtgtttgtggaaactcgggggcctccggggcgaccttgaggacatggacaaggctaagcaggggttcccttcacccagccctgcccttggtttactcaggagtcagaccagccctagtttcctgtgtttcatgtattggcttttcatgtgaaactcgaggagagcttgtccgttgccacaagctgtttttcgaatgtctctacacagtccaggcaggaaatagaagcactcacatcaggagctcagtgtcaggcaggcaaggctcctgcaggggagccccgccctgctcaggtggcctcatctcccctcccagctggtggtgctgccctatcagatgctgctgcatgcggccactcggcaggccgcgggcatccggctgcaggaccaggtggtgatcatcgacgaggcgcacaacctgatcgacaccatcacgggcatgcacagcgtggaggtcagcggctcccaggtgtgtgggcctcccctccccgggccagggcctgctgtgacgtaaagggacttggatggttcctccagacacctgggccaagagttcctccggaggtggggcttgatagagggtgcacgagtcaaggcggtgacctcatcggaggctgaccatggctttccagtgcatcgggggaccccgctatgacagagtgcctcatttccctgcacctcatctgcccccatgctcctgagtccctccagccctggatgccagcagccagttctgtaagccagggagatggcatgtgtgaggcagaagtcccctcaggattggattttgtcattactgaagttgtctggaggggactgaattgaggaatgctcaagatcagcgcaggctcctcctgctgccctatcatgcgccatgcatggcaccaggtgtctctggtcttcacgctgactctgccatgggtgtggtgttcctgttttacattggaaacttggagattcaaagatggtcaagctctgtcctgaggtcatgcagctcatgagtgtggagctggggtgtgcccactggtttctgactgtgaaaacccccacgacatcccaccagctctactgacctgtgcctgggctgaattgaggctgggatgtgatggtggccttgaaccatcactctttgtagactccaggtcttttcccaacccggtggaaacttagcagggagattccatacttgaggaattcagcctcttgctttttctctgacccacagtggacactggaggaaaacttcccttccttcccttttctcttagctcccaccagcctaagggctgtggaaacccgtaccttttgtctgcagccagccccctctcctccctttggtggcttcctgtgtgtccagggccagcatcttctaggtgaatctaagatgtcagtaccttagccctcagctgcttgctcagagcctggtttgtgttctttccccagctctgccaggcccattcccagctgctgcagtacgtggagcgatacgggtgagatgtgaccctctgaggtagtgggacagtcccttggtggccccctgcgtgggcctctgagaggcaggcagcactttggttcccacctctggcccgggctgtggcggggtggagctgcatgccattcatgtcctaggcacatcatggtgtgtgctgcacacagacctggaaggctggggactgaccgctggctctgaggcctggggccgtggccagcctgctctctgggaaaggatttgtagcttgtgacccagtttgagaggcaccgggcagcaaggcttccactggggtgggcggggcgagtcgccatcagggcaccaccacttaatgtccgttggcttcttctcaggaagcgtttgaaggccaagaacctgatgtacctgaagcagatcctgtatttgctggagaaattcgtggctgtgctagggggtgagagcctcgtccccctgctgaccccgggcctgcaaaactcgctgggctgctttttccttggatgcccatcaggacacctcagttctctgtgtttttaagaagggtcggccgggtgcggtggctcacgcctgtaatcccagcacttgggaggccgaggcaggtggttcacctgaggttaggagttttgagaccagcctggccaacatggtgaaatcccatctctactaaaaatacaaaaaaattagctgggagtgttgccgtggcctgtagtcccagctgctccagaggctgagacaagagaattgcttgctcaaacccgggaggcggaggttgcagtgagccgagattgtgccactgcagtccagtctgggcgacagagtgagaatcagtctcaaaaaaaaaaaaaaaaaaaaaaaagaagggtcttggtcattgatttagaaaattcttgttctttgtagcttagttgagttgtctgacttgagctttatttagacccatgggttctttgcccatgttctgaggactttttatttcaggccctgctctggggggatattaaggatacagcatcacatagacacacggtgtttccgtgataggcatagttctgtgggttgttcgaagcacttgcatatgcggttttgtgtgccctgtgagaacgcagtgctggtatttgaatccttgttgatagacgcataaactagagctcggagcaagggctgctcccagcacgggagcctgggatcttctgactccagctcccacgcctctttgcatgaccctgtcacgtccccttcttttatgatggggcacccccttggaaggcgtctgtggaagtggaagctgcagaaagcctgtgggagctcctggcgggagctggtctcgtgttgctgctctgagccaccagctctgctttgcctcaggctcaccagtggcctgggcagctcctctgtgctccggtgccctgcataccttggtctggctgctgtgtcccggcctcctggagaaggggtgaaaaacatgaacttacagggctttgggttccacgtgcaagcacgtgagtcagacatgggaggctcctggacccacctgccctctcagtgggtccgttgcatgctataaacagtgaaaagcaaaacaaagccatttaaatacagatgctcttcttacttgatgtgcagtgtggagggagagaagatagggaagggttgggggtcctgagaaccagcattgtgacctatttccattctcttttttagggaacattaagcaaaatcccaatacacagagtctgtcacagacaggtaagagagttgccctcagagggcccagagctgatctgagccacttccgagcttaaccctgggactgaaacctgaggcttagggtgaagctcccaaggcccttcatgtgtttgttctcagggacggagctgaagaccatcaacgactttctcttccagagccagatcgacaacatcaacctgttcaaggtagaggtttccacctttccacattccacatccaatttccttcctgtcaccacctgtgggtaaagtactatgttaagactgtagaaggaagaaaaagcaaaacagatgtgtaattacttaacccttaacgcaacatgcctgtgagacaaaagtcatcttcttttagagtgaaggccacagggatgagggatgggtgagaaagggacctttcttggtgccccatagaacagatagagactccaggtccttgctctctcactccgtcttctggcacagtctccctcaggcttatggacaggaataggacgttgatttgttctgtgcaacccctgtcacgtcttcccacttgggccttgggtctggttgcagcctcagacctctgctcactccaggtctgtgtacccagcgctccccagatgaaacacggccactgccgcctgaaccccaagctcgtaactcaaatcagcaacagtgactgcccccgggtacagggttctgcctctgttgtaggcggcatgccatgtgctgtgctctgagctaggatatccttttgccccagcaaggaaagcaaacaggcccgtggaggtgacttcaggagggtggcgagcacaggcttcccacaagtgagccaatagcaagtggcagagacagcgtccaaacctggctgcactgacttggggccccacattcttcccatcctgcctgccttttttttcttaaaaccagcttttcccctgaattacacatttgggtcactgtcactgccgccatccctgccagacaggctggatccaggtcatccttgatgcctttctccccttgtctcccacatgcctgtgacagccgccaggcctgacagcctgagacagtcctgccgtccctgcgcttctcccacagctgggacatgggtgcaggcactccttctctcgccttccctttgccctccttgctttccttctcccctcttcttcccatgggtctcgggtctcatcactcaccattgagggaatcctcatcgaaggacgtcgctctttttagaaaccggtttaaaggctccaaactcctcatctctgcatcccaagctaagatctggcaccaaaccacacacattggatgcaccgactgagtggcactgccccagcccctgagcaggtcccagccatcatctcctctgtggctttgctcatagaagttccttttttttttttaactctttgtcacctggaaggaaagccaaggggaactggattttactgagcactcttagacttgagagagacatttggaaagagggtctccaccctgaggaggacactgcgttgtgggcaggggcagtagaggagggggtggcctcggagaggagatgacaaggttggtggcaaggaggctccaggtgcctcagaaggtagcactgcgttgtgctgcctgggtggtagaagtggtgttttttgttttgtttttaagattatagcttgctcagtttgcactcatgcctacagctgggcttggtttttgcaggtgcagcgatactgtgagaagagcatgatcagcagaaaggtaactgctcccatcttgtggtcctgaacaagacccagctgtgccccaaccccctgcccttgccatgctttcctcccctgccctcagggaactccagagtccccttcgtctccactctccttggtgcagtgggccttgctggggtggtgggatgtgtgctgcaggtgtcttgggcctggcagagcctccgatccacccagcctctctctcatggctgtacctcgttcctctccactgctctctctcatcccacccagctctttggattcactgaacggtacggagcagtgttctcatcccgggagcagcccaaactggctgggtttcagcaattcctgcagagcctgcagcccaggacgactgaaggtgaggcaggagggtgggcaggcagagccggctgcacgcatgggcaaggacttctgttcctcatgtgtggacctgaccagagggaggcctcctccccgttctgctctgtgcagctcttgcagcccctgcagacgagagtcaggccagcaccctgcgaccagcttctccactgatgcacatccaaggcttcctggcagctctcactacggccaaccaggacggcagggtcatcctgagccgccaaggtaatcaggtggttcttggccaggttcagttcccaggaaggagccaagctgagcccgggagccgcagcgtgaaaggattctttccttccatcctgggaacttcctgggttaggaggaagcagtgcagtgggcactggcctgctgtgacctgggcaagcagtggaggtggatgggaggagatcgaagggctgggatgggggtcccgtgaccagggtaagcagtggaggtggacgggaggagatcgaggagctgggatgggggtcctctagggcaggggtcctagggaaacttctactgtggggtaggtgggctttggtttgggtcatgattttgtcatctatgagccttgtgatttggactattttctttctcaacttcagtttcttcatatgaaaatggagaggataggccgggcgcggtggctcacgcctataatcccagcactttgggaggctgagggggggcggatcgtgagttcaggagatcgagaccatcctggctaacacagtgaaaccccgtctctactaaaaatacaaaaaattagcagggtgtggtggtgggtgcctgtagtcccagctactcgggaggctgaggcaggaaaattgcttgaacccaggaggcggaggttgcagggagccgagattgagccactgcactccagcctgggcaacagatcgagactccatctcaaaaaaaaaaaaaaaaaaggatggagaggacagtgtggtccacctctgtgggctggttgtcctagagattaaatggtgtttaatttaaagagaaagcactagcacttgtgcctcagacctggactcacctgggggaccccctttgctgggacgacagaagtgtctgttgggcttgcactcacctcccaccgatctgtttttccaggcagcctcagtcagagcaccctgaagtttttgctcctgaatccagctgtgcactttgcccaagtggtgaaggaatgccgggcagtggtcattgcggggggtaccatgcagccggtaaggacacctttcccagcccctcgtgccccaggtgttgggatgagatgggggcttgggagagatgcattatcagtcctgttctctcctggggccccaagccagaaagggtcagctcgagcaggcccagtggtgtccgctgggtgacactgctattctctcactgctgtgccttttaggctgcaggagcagtggagactcctctgctgctccattctgtagccccaggatcacatgtctcccagagaaagctgttctgtggtttcaaactcaaggaaaaaaatcatgattccacttttaaaaggttcattttgatgtatatgaatataatagtctttgtaggcgtaatttttacttatgtgcatagctgttttaaaaacaaaagtacggctccctccatgtgctgtcactggaacttgctcttttcactcagcagccagagggtcataaaccctgtctccttgtcagcaagcatgcacgtatttcagtatcccagctgtgctggattccagttacacagatatatagcatttcatgtagctgcttctctcttgttaggtgtgcaagctatttgcagttttctgttttgagcatgactgtgataaatataaccgcatttctgcacagtggtgactcctacctagcgaagggcctcctggacaaaaagctgctgggaatcctgaagcagtgcttcccagccccagctgccttagcttttgatttttatatttttgtatggatagattcatagttttattcattcggcatattaaaagttgtttacagtaattattgtttctgacgttcacattgtgagagccccttcctgctagctcaggtcctccccgtggcccggtcagtctcgcctccagcacagcagaatgtcatgggatcaccatgggtgtcctttccccacactggattgattcatttctccaagctgctctggtttcttgtaatggggaatgacatttagaagtcaagctgtgggtgctagggtgtttgtcgtgctcctggggcgttttggtagacagatctaggaaatgttttcagaatgaatccatactggtatttctttctttctttctttttttttttttttttttttgagacacagtctcgctctgtctcccaggctggagcgcagtgacctgatcacggctctctgcaacctctgcctccggggttcaagcgattctcatgcctcaacctcctgagtagctgtgattacaggcatgtgccaccacacccagctaatttttgtattttagtagagatggggttttaccatgttggccaggctggtcttgaaatcaggtgatccgccagccttggcatcccaaagagctgggattacaggcatgagccaccacgcctggcccatattggtgtttctaagtaaaaatcaaaggatttgtttacttgaccttttattgtacctctttttctcttaagcctgaacatgtgtgctacattaacatacttatctgctctatcctataatatacttaaaagttttgaaatcatagtaccaatattacttctaacaatagatctgattgaaattgcctttcctctttgcctttagagtgtaacccactaaggatgcctggtcactaggctctaaagtcacgtggaaccaggcttctctccgtgtgcttctgttgtcagtttcatagataactaggctgtttttgtttcattttcttttcaattttagaatttgcttttttcttttctgacttgtagtttttaaatatgtaaatatttgtatggctcaaaagtcaaagcaatataaaaagatctattcaggaaagcctcactctcatccctttccagcccattccccacccccatagggaatccgttttactagcttatcctttcagtctttctttttcccctaaataagcaaaaacgtgtcttcatttttccctttcctgttttatttacacagaaggcatcttagtcagttgtctgaccatcgctcctctagtgggctgcgtggttctctgttggacagatgtagggagcttatccaaccagtaccctctggataggcaggcgcatgattacagggaaaggtccgggggcacatgctgtttggtatttgtgggctgtatcttctcactggactcctaaatatgggattcctgggttaaaaagtataaatatgtttaatttgttaactactgtgaaatttcatgagaattgtaccattctgtatcccaccagtactgtctaggaatgcctgtttctccagagtggttacttttggatttttgccagtctaacaggtgaaagcctggagattcttattcagtagtttgggctggggcctggccatgtgtatttttgaaaattttcgctggtgattttgctgcatggccagggttgataatgactgtgccagatttgctggatttcctttgctgttcctgcacatagtttaaacgagactgccagcactgggtatcagtcaccatttttctttttgttagtttgccatcagccttttctttgacctcttctttcagtttgtgtgtacttgctgtctcttagcccagacttctcgcttcctttctgctgggcctctgaggggtcatggggccgtgacgctgtggccttggtctacaggtgtctgacttccggcagcagctgctggcctgtgccggggtggaagctgagcgcgtggtggagttttcctgtggtgagaagctgtgcccagggtggggcaggctagaggtcaggttctggcccccgttttctgtgggtaatacctcatactgcgaccaggcacaggggcggaggagaccccggggtgggagcctcacccttcgtgcgctcgcccaggctctcctgctttgctccctgctgcctgctgcccagtgtgactggtgatggtgggcgggtgagcgctgtcagtcgctgttcctgtgctggatgatggggcagggaaatgccctctctgcagtgtcttgcagcacacctgcatctccagttttcggcccctccctggctcttaccaggtcacgtgatccctccagacaacatcctgcccctcgtcatctgcagcgggatctccaaccagccgctggaattcacgttccagaaaagagagctgcctcagatggtcagtcccagccagctcgccgcaccacagcctggcctcaggcagcaaagggttttctggggcaggggcgctctggcccaccctgagtgttttcagtgttggggaaattgcacagggacacccgcttagagccacacagaatgagcggcgtcgatctagatgcttatggaggaaggtctgagcttccccgcccctcacgccttaggctgcgaaatatgtattcataaaacctccaggcatcctctgaggacgcctcacacaggagaaagctgctagttccctttggctctcttgccctttggttatatctgcccctgccgggggtagggatgtggggcttgggggcatctcctgtggtgtgcctggggtgtgcagcccctgattgtcgttgtggtgcccatcaggaccctggacagaagaagggaggactcagtgccagggcaatagggaggccccctagggacgctagtgctgtgacatgtgtcagaaaggcgcagtcagcagcagcggctgggtgtgtttggtgggaggtggcacctaccaccccgtggttcccacccaggggagccaagtcctcttccttggctgtagtcctgccgagggtctctcctcagttttgagtctcaaggtgaagacgcggtttgtgggtggctgaggggttgctccatgggggctccctccctccctcctttccttccttagatggacgaggtgggtcgcattctctgtaacctgtgcggtgtggttcctggaggggtggtctgtttcttcccctcctacgagtacctgcgccaggtccatgcccactgggagaagggtggcctgctgggccgtctggctgccaggaagaaggtgagtggcctgtcggcagccttcccacttgtgaggacagtgccactgagtcctcctgggagctctcgtgctcatcgggtcaggacaggcttctggctcctcatccccaccgctcccagtccctgactacagaggatttcccccaaagtccctggctgtgaggttctccagtcccctggccagaaaacacaaggccacgagcagactcgagacctggcaccctgaacctgtctctgggaaatgtcctctgtctttctcagatattccaggaacctaagagcgcacaccaggtggagcaggtgctgctggcatattccaggtgcatccaggtgcgggcgtcatgctgggcttgggtctgagatcgtgtgggggtggcagctggaaacgttgtgggtgtcatccaagttttggctcagcaactcagcgtctgggtttctcctacaggcctgtggccaggagagaggccaggtgacaggggccctgctcctctctgtggttggaggaaagatgagtgaagggatcaacttctctgacaacctaggccggtaagtagtggttctgctcgtctcctgggccgtgatacatggccggccctcactcccagcagctgggcccctgcctgctctctgctgccattagagcccacagctgggctgcgactgctcagaccagccagctggagggaggggctcagcagctctgggtttggtcctgggagagcagttggattttaggctacccattgctgtatcaggacccagtcaattggcctagacgggatctctcagccgaacaagccctctccaggtggtaggtacagagtggagagaggctgagttttgatcacagtcggagaggctgagggaaggggtagaacggagcagctggtgacgtgggtgatgacccgggaggtcctgacgtccacctgctgggctcttgtctcccccgcccaggtgtgtggtgatggtgggcatgcccttccccaacatcaggtctgcagagctgcaggagaagatggcctacttggatcaaaccctcgtgagtgaccccagtgtcacagagggtgacaggagagtaggcagtgggtgggagtggcatcacccccagggctgatacagccaggccttccccgctgcgctggcgtctcctgccccctccggaagcttggatgcccctccacaccctcttgatcttccctgtgatgtcacctggacccctgctgctggcattggccacgaagcctcctggtctggctccaaagcctggcagggtcttttcccagggggagctgcaggcagggaacagtcctgatgggtcttccccttcactcccagcccagagcccccggccaggcacccccagggaaggctctggtggagaacctgtgcatgaaggccgtcaaccagtccataggtgagcctggctgcctccagctgggtggacagatgggggctggagaaagggagaacaggaaagaggggttgcctgccctgtttcctatataagtctgaggaaggggagggggtcgccgtgggaatgtgctgtaggggggaggcaggtgttgctcggagccccagcctctgttcctatgcaggcagggccatcaggcaccagaaggattttgccagcgtagtgctcctggaccagcgatatgcccggccccctgtcctggccaagctgccggcctggatccgagcccgtgtggaggtcaaagctacctttggccccgccattgctgctgtgcagaaggtcagtcctacctttttctttctgagagcctccccaccccgagatcacatttctcactgccttctgtctgcccagtttcaccgggagaagtcggcctcttcctgatgggcaaccacaccactgcctggcgccgtgcccttcctttgtcctgcccgctggagacagtgtttgtcgtgggcgtggtctgcggggatcctgttacaaaggtgaaacccaggaggagagtgtggagtccagagtgctgccaggacccaggcacaggcgttagctcccgtaggagaaaatgggggaatcctgaatgaacagtgggtcctggctgtccttggggcgttccagggcagctcccctcctggaatagaatctttctttccatcctgcatggctgagagccaggcttccttcctggtctccgcaggaggctgtggcagctgtggcatccactgtggcatctccgtcctgcccaccttcttaagaggcgagatggagcaggcccatctgcctctgccctttctagccaaggttatagctgccctggactgctcactctctggtctcaatttaaaatgatccatggccacagggctcctgcccaggggcttgtcaccttcccctcctccttcctgagtcactccttcagtagaaggccctgctccctatcctgtcccacagccctgcctggatttgtatccttggcttcgtgccagttcctccaagtctatggcacctccctccctctcaaccacttgagcaaactccaagacaccttctaccccaacaccagcaattatgccaagggccgttaggctctcaacatgactatagagaccccgtgtcatcacggagacctttgttcctgtgggaaaatatccctcccacctgcaacagctgcccctgctgactgcgcctgtcttctccctctgaccccagagaaaggggctgtggtcagctgggatcttctgccaccatcagggacaaacgggggcaggaggaaagtcactgatgcccagatgtttgcatcctgcacagctataggtccttaaataaaagtgtgctgttggtttctgctgagttttttattgatatgtgctgctgttttctctggaagcctctttagggaatcgaggagcgcactggtgcaggggctgggtggagccatcctccgatggagcacaggcagacggaagcccccaccccagctgcgtggcctcaagccagcctcccgctccccgaaggtggtctccacacagacctgggacagtttcatccccgccccttccagggcagcagggctgaggatcccattctggctgtgtccacgtccgggccatggctagagtctgggtttaggggaggaaggcatggcggcgcccgctaggatttccagttgtcctcttcttcctctgcctgtggctgctgggggttagcagagacggtttgttgtctgacatacgggctctctcctcccggcccctcaccagccccagaggtgaaaaggctggaggggaaagggtgagtgagggaggtctgtggggagcactggtttccccaggccccagagacttaaacacaggaagaaaaaggcaagagagaattaacgatgccacagcccatggcagacagcggccctgcctcctacccttgcgtctcaggaccagcttgttgaagagatcccacatcagttccctgccttggcttacggctctcactgcaataggaaagccacggagtggggtgtggggttcagtcacatttgacccccggctccgtgttcctgtcccctgtagtgtttttgttattagacccttttttctccttggtttaggaatgggggccccagggccacccttgtccaggctccctctaccgtagaggtgagaattccagggagctacaatttgaaaaccactattttatgagccaagtagaacaagaaatgacaactattaaaaaaaataagggatttctgaccagctaacaaccccacagaaaatccgccagggatccagaaatgagactgaggtggcctcagagagctccctcctgaaggggatgctgctgctgtcgtcctgcccggcgccttggactgcagtggccggggcctggggtggggatgagggtgcactgaccagcaccgcagcagctgggggaggttggggtgctgttaacgtgccatcttataggtaggaagtggaaatgggagaaagtgtggggtgcctagggaaggaggtgactgagcagggagcctggctgccatcctaacacccagctcactgggcttgagcgacttgagcctggtgccagggcagagtgggtgatgctggggcccaggctggcaccatacttgaggtctgccaggcaggtcaggtaggatggcacatcgaccttgggggacttggcccaggtctggcatgtagaagtagttctctgggacccatgggattaggtggggacatgtgagaggtgacagggacctgcaggagcagctagcgagacctcatgtgcaccctgcacagctgtggtggcataagggattcaatagagcctctcctagagaggagcctggcagggcccccagcccttgcacctgcccctccctctccaccttctgctccagctgctctctcactgatggacaaggggcactgaacagtttatctgtctctacccccagcatcacatgggtctttgttacagcaccagccagtccgtctgggaagacagacttcttgtatctacaggggcgacgtggaggtcaggcaagccggcacctgctgtcctgggaccatgttcctgacctacctctcccatgtcatcagggacactgcactgaggggtcccaggccactgagccaagccaccctggtcaccttctggctcccacctctgtgctgcacctgagtgtgatgccctaggaccccattaagtcaggctgagtcttgcacccacaccctgcgactccattttctgctacacaggatctctctgatgttgacgagcagcatggagacctggggagaccccccaagcgcctcctccatgtcatccttgggctccagcttggcgctcacacacacaggaaaggacttcagcttctcctgggagggctgggtggctgaggggtggtggatttcggagttggactagcagctggcctagaggctactggggaggagggagcagggagcacccactcctgatccagattcactgcttccctcgcatctgtcatgaccccaaagaagcagatcctgaacctgggctcttgtctttacctttgttctcttccactctggggtaattaagaatgatttgctggccaggcgcggtggctcatgcctgtaatcccagcactttgggaggctgaggcaggtggatcacaaggtcaggagatcaaaaccatcctggctaacacggtgaaatcctgtctctactaaaaataatacaaaaaaaattagccagtcgtggtggcacacatctgtagtctcagctactcgggaggctgaggcaggaggatggcgtgaacctaggaggcggagtttgcagtgagtggagattgcgccactgcactccagcctgggcgacagagtgagactccgtctcaaaaaagaaaaaaagaatgatttgctaattaattatgcaggcagctgatccagtgctgtgtaaccttgggggccaccagatgccaatcaatcagtagaatgggagagaaggatggaggaagtgaggacaaggggcaaggaggaaggtctgtccacctgtctcttctgtgcaggaggtgtccaagcaggaggagcacgtcacatccccactgaaaaagcccacagaaaatgaaaagcccacatgcttgtccattgctgcaggatgggggcaagtggagggggagaggtgtcggcgctcccaccttactcccagtcatggctgactcctccctttccttcgttcttgttcctaatctgtcaccatgtcctgtcgttttctttgtctcacccaaccctctctgcctgaaaatcccctgacggcagcctcatccctgtcacctcctgactgtagttggtgacagaagaggaggctgcactagtgaaggagcagggactccaggtctggcaacaaccagggatggggccgggtgggggtgacttggaccaggagaggggcctgagtcaggcagtcacatacttcatgctggggtcccccaagtgaagcacatttagcaagatctgaaatacagggaaacagtcttgtttcttcaataaataaattgcaaaggagaaacaattgatgaaaggagaaacctatagatccagaaatactaacaggcaaatcaaacaatcataaggagagactttatttggattttgattcaaacaaactaacaaaaaaatgaaattactggaaatttggagacagtagggtagttggtagtattaaagaatagtagtgtgcgatggttggtatgataatggtattgcaattttgctttttttttaaaagagttcttggctgggcacagtggctcatgcctgtaatcccagcattttgggatgctaaggcgggaggctcatttgaggccaggagttcatgaccagcttagccaacatggcaaaaccccatttctactaaaaaaaaaaaaaaaaaaaaaaaatacaaaaaattagcctgatgtggtggcacacacctgtaatcccagctactcatgcagctgaagtaggagaatcacttgaacccaggaggcggacgttgcagtgaactgagattccgccactgcattccagcatggatgacagagcaagactctgtctcaaaaataaataaataaataaataaataaatcataagttcttatcactgggtatggtgtctcatgcctataatcccagcacatttgggaagcacaatttgggaagaattgaagtctttattaagtatttctacccatggatccatgtatttcttcattgatttaggtcttctgtgattttgtttacagcattttgtacattttcagcatacagatcttatatagacttaatcattttttcagagatagtacaaatgcaattattttaaaatgttgattttctgttagttattgttagtatatacaaatgaaattgagttttgtattttgaacttgtgctacttctggaatgtgtgtgcgtgtgtgtgtgtgtgtgtgtgtgtgtgtgtgtgtgtgtgtgtgtgtgtatgtagtccttggaatacaccataaccaagtgggtttttcctgggaatgcaagactgcttcaatacttgaagatcagtcaatgtaatctgccatagtaataatctaacaagaaaatcaacatgatcacatcaattgatatagaaaaaaaatttacagaattcaacatattttcctattacagattttctgcaaactaggaatagaagcaagcttcttaacctgatgtatggcaccttcaaaaagcctacagcaaacatcttacttagtgatgaaaacctgattgccttccccataagatttgagaaccaggcaaggatgtttactctcatcatcactcctatccaacatggtactggaagtcctagccaatacaataagggaagaaaatgacacaaaataaaggtagtaagattagaaagaaagaaattgtctctattcacaaacaaggtgatttcttttcctttttcttcttttttttttttaagagacagggtccttctctgtcacccaggcttaagtgcgatcatggctcattgtatcctcaaactcctgggcacacacaaacagtcctcctgcctcagcctcccaagtagctaggactaccggtgcatgctgccaagcccagataattttttttattttttggagacacaggtagtctcattctggtttcagctctggaaggggtgaagaacaagtccccagagcccatcctgtccctcgtggatgacatactgagggctcaggaagactctccctcacagcctgccccagtttccaggctgagccacctgagcagctgcttcagaaagcctcttgtgccatagccatgcttaggaaaaagcatatcttccattcaattcaccaagaaacaccaagaaataactggatacaaagaataaaaaatactctgccacactggcagggcaggagggtgaaaattgtgccccctccaaaggtaatgtctataaaaggataactaaggccagcgccaaagtccacctacagaaggcgggtctgtctcaaccccagctgtcagtcactgtgaacttttagaactggggctgaagcttcttccagttgcttgctcagatgtcagtgagaccgctccacaacagataaggggagctgtgtgtcagggaagtcccagccactagcacaagctgcactccaggcagacgtttctgttcttgtgcaaagaacagcgcaatccattcaagttcacaggggcgggtggcacttgaaaatgtcagggtcaacttgcagggcagaagttagcagggaagtaagtcttcctgggggagtgggagagcccagcagagtttaggaggagggaggggcaacatcggggcaatcctctgagtctctctttcctcctcaggaactgtccaggaagaccctgcagtctctctgcaggctcatgggagctcccagaactgagacaacacacagatccaggcctgcttcgaagtcagtgggatgcggcccttgaaagtcgatgtattgggttcctagggctcttgtgaaaacatgccacacctggctggttttaaacaacaggagtttattctgtcagttgagaaggctagaagtgcaaaatcaaggtattgacgggatgagttccaactagaggctgtgaggcagatcaactccatggctctctcctggcttctgctggtttctggcaaccattcacttcccatgcctggtagacacatcactctaacctctgcctccctttttcacgggcacattcgcgtgtgtgtgtgtgtgtgtgtgtgtgtgtgtgtgtgtgtggatgtgtgtgttaaggacagcaatcattagactaggtggggcccactctaatccactgtgagcttctcttactttggtaacatatgcaaagacccaatttccaaacaaggtcacattccatgttctgggactgtcttctgtgagatgtctcccccaggatccttccaggttttctgcaaagccaggcagaaaaccaggatcagggcaggacaagaggatgctagcctgtgatggctcccactcaggtgggatgtgagaagtgcctgtggcctgggacacaccaacttgctcccaatacctcatctgagatggattgcacagtgtatgtccagggcccatcccggcacactgtgcctttgcaatgctgtctctgcgctttggaaattgactcagcccactgcgtggggtggtctgaggcgggccacaaccatttcttaaccatccctgagtacctgaccagtatcccccgggggtgacaactggctacatctggagcatgaggagcgtgtttacctggtgagtaaggatgcaagcataggacgtcctggccgatcctctgcacaagcaatgcctttgctccaacgggatgggcaacgttggattaggcctgaggcagatttgatcttggaagatacattcaagtctacgtgttttgtgcgtttattttcgtttccttgaattaacatggagtccatttcaactttcacttagtctccttctttctcttcccccacttctctctctctctttctttgtatatggaagaatttaactctgtgttccataatgtctaaatactcaaatttagagttgacagccatacagcaaattattcaagttgctgtcaaaaaaaaatccctgcgttttctaggattaaaactgtgaatagagtactggaagaaaaaaaagtcatagactcagatgcaaaatgacaacatttaatgggatgataaggaaataagacttgtcaagaaaccatagcccactgcagactgttcacgatgtcagatggttcatgatttttttccaggtttgatacagaagaatcagtttgttaaaagaaatgcttctccacctgggatttaaaacatcatttaaacaataaacacatttgtatgtatatataaatagatatttagaaataaaaacatgcatatataggcacatagacatgtatatacatatacacacatatgtacaaatatatatgcctaaatttttactgacctgtcaacttacaaaacaaaaatgagagatttataaaaggtacatatatagctgtgaattctttaaagctatttttaaagaaattaatataatcttaatgattatcagattactcatgcagtacacagctacacaagtctaatgaagtaccagagacttttctttcttcaactattgtcctatcttattcaggttttcattttcttactagatgtgttttcaatggtttatgacgtaataaaatttctttacttcttccagtaattgctttgtctcactcggaaactgaactactgttgatgtggtaaaaagctagggcatattcttctgaaaaaataaagggaacatgtatttttattaaatagatgatataagcacattagatctaatccttccaataattttgaaatagagacaattactttcccattttatacattatgcagaaatatgctaataatatttaagacacttgatgaaatatattctattagtaaatgatagagacagaattcaaacactccacaaacttcacacagcattcaacaagaaataaatagtaccaaccttccagggaacagttgtatggtctctacaacattttagtatatgttttagaaattaatctatcaaatttttaagttaacatttcagaatattccccactcctctttttaagtcaaagtccacagaagtagcttggaacagtcagtcttagcatgaacaacaatgacaataacaaaaagacctggaagcttagtgtggcttgtatttcaagttcaagtggagccctgtcaggttatattgcaaggattctggtgttgaaaaactctggtaactggaaaatgggttcagtcagaagacacatcatgggataaagaaaccagaacacaaagtaatgccatttattgtttactctgtgaagacagaggttgattttggaaagtttagtagctcagggaatgttagatataaacaccacattcaataaccttagggcatggctgttgcttgcctacctttttcgtactaatcgtagaccatgcctggggctggctgaatgttgaacacaaggttgctctgctcagcagaaaaagtgaaactgtctgctcgaccaaaaacctatcatgacacaaattataattacattgtagcaggtctgagaaaagataatcactgagaaaattatccgcagaagtttatgatctacataattaaatagatctagggtatgattaacttacatattggcaaaataatgagttgttaaccttaaatcatataaaatttcaagttcctttgcttacattgaggtgagaggaatttagctggaagtctcagaggaatgtaggcatttatgtgagtggtaacaatacacatagaaaggatgtctctaaagcgcatgccatagtttggcatttcctcagtaaaataaaaatagaactaccctatgatccagcaatcccatttctgggtatgcatccaaagaaaatgagatgaatattttgaagagacagctgcagtcccatgctaattctttcattaatcacaatagccaacataaggaatcaacctaagcgttcgaaacagatgaatggataatgaaactgaggcatatacacatacaaattattcggccttaaaagaagaaagaatttctgccatttgtaacaacactgaagaacttggaggacattatgtggaatgaaacaaaccagatacacacaaaaaacactgcaggatctcacctgtaagttaaatctaaagttgagttcatagatgcagacagtagaatggcagttatcagggatgggaaaatggggagatgctggtcaaaggatagaaagcttcagctgtgcaggatgaatacattctacaaatctcaggtacagcggtggcctacagttaacaatgctgtactgtatatgtaatattccctaagggagtagatcttaagtgctttgtcacaaaaaaagaagaggtaactgtgtgaagagagggatgtgttagccagctaattcacatatagtcacgctagatgataacaatcagctcactatatatatcaaaacatcacaccacataccttcaatacacaattgtaatttcaaaaaattatggcaaactttgtaagactttagtcaaattataaaataattacatatctactctgtgaccagactgtgtttgatagggagatgatgtttctaaaatggaaagctatctagtcacatagccagggcatatatgaaatagccttggaactagcaaggagaagatgatcagtgggataaaacactggtaatccttaacgtcccttattttttccttttacaaatcctatcatacatatctataagaaattgaagcatccaattatccttggaaggaaaaaagaaaaactttaaagaaaaaaaaatatggctaaacttacattttccaagtagaaaagaacatggtcattcttgacttcagtcttcatcacttggcccttgttttcaagctttgaagaaattgttagggaaggatagagaatagatattagaacaaatgacagcgccactgcagaactgaatgtccactcttttctacgtcacgttctgttttatggaacattccttggtgccatgatgttttcataaacacaggtagcaactaaagaaaaacatatgatgaaccatgggaaatactgactgctaattggtacaaatgaagtacaccagctctccagtgttagcgcaaaaatacaaaggtgaatgttgaagaagaattctatagttttgttttgctaaactacggctaaacaagtatttattttatctttatactctatgtagctgtctttgtgatgaaagattaggcttctattatttacctcttcaatggatgacatggttggagtaaatcctgatagcatttttacatctataaccaccatactggatttattgcgaattccagtgtatctgaaaattttaagaaaacactcgtttagatatcaattttaaaaagtgacttatctcataatgagagtgccaggtggataaatactaattggctagaaatctggaggacaggtaaaagctgaagagaaaatatcggaagaaagtcattttcaagcatctgtgaataggcacaaccagaatgataatgaaagagatgatacatagcaacagaaattggagcaaataatgaattatctggacatgaaatcttccccaaaccctgcttttaagcttacctgcagtctcaaagtttgaactgataaacagagcttctaaatcttttacatatacttaggttagtgttagagttgcgtaacacttagaggacatctttgcttaaaaggtggtatatgagcataattatagagtagatgtgtccccaggagaacttctagctcagtttcctgcttctggataagactattggggtatgaagttaagagttccatagttcatcagggcgtggttgctcacacctgtaatcccagcacttctggaggccaaggtgggtggatcacttgagggtcagagttcaagaccagcctggccaatatggcaaaactctgactctactaaaaatagaaaaattagccagatgtggtggtgcacgcctctaatcccagctactcaggaggctgagccgtaagaatcctttgaacccaggagctggaagttgcagtgagctgagattgtgccactgtgccactgtactgcagcctgggtgacaaagtaagactctgtctcaaaaaaaaaaaaaaaaaaaaaaaaccaaaaaagaaaaagagttccccaattcattgagttcttagccctggagctcaagcgatttttatttagaaattctaaaaaatatctcccaaactaattttactcaatgttttccacatattaactaaggctaaaagcctttagcatctataaatcatgcttgaattcaagaggatcatttcgtttttctattctgaaaagtaaaaatctaaaatgttactctttacagttacaaaataaacatttgtgggcttgctactatatgaccatgcatgcttgtcttgagaaagaaatatagaatctctgtttttcaaaactaggagtacttccatacaacagaataaaaagtatcattgaaacatcagtgcagtgaaagctttcaaatcctgctcacatagactgcatgttttcttgcctcattttagctctgatttagctgaagatgtactaaattgtggtgtccggacagacggctaaaaagtgactgtgctgtagaattgtcaccaccaacatgagaactcattaccatgatttatattttgttatttcactactgtttgaacttttaaaatattttaccatcttgttcacgtgggagttactgtcaaaatatgacacttacttgaggttcactgtgaggtcaaaaacagtcaaagagtagttctttactatttccaaggaaagagaaaatccagatgccttcttaggtaggagaacattgtacttaagggtggcctagaaaggatagcaaattataagaaaacccatcctgtattaagaattatacagtctgactatagtcagtagtaatgtgattttacattttaaaataactaagagtatacttcgatcatttgtaacacaatggataaatgcttgaggtgatgcataccccacttgccctgatgtgattcttacacattgcatgcctgtatcatgcacccggtaaatatttacacctactatgtacccacaaaaattaaaaataaaacatttttaaaaagaaagaacctattgtttatttctattactaatgcagtttacatctttatcatcagggaatcaggttaaattctttagttttcagaataacgtaatttaatgaagatagaatactttctaatagcaatattcctcaaacttctcttagacagctgagtagcttttcataaagtaacttgcaattttggctattgatcatgtaaatacacaaaacggtcaaataacacttcacgtagaactgaacagacagtctgactcttttactggcaaacactcatcaccctcttaggcagatttctgtaacctggataaatgtacaaccgcgtccttccacatctactgtgtattgtccaggtgcctgtgttacttctgaacgttggaccagtaggcggttatgaccgttaaactggatctcactggatccttcactgctaaaggtgacagtgttttgattcttagagaagagcccctcttccccgcctggctcttaggatccccattgcagggcggggaggcacccaccgcgagggggagactgagagccagtccctcccacccccggctcttaggactcgcatcgcaagcgggggaggcacgccacgcgaggcggggactgagagccagccccccttccccccgggcttaggacccccatcgcggttcctaagatccttaggacccacctggaggactgtgggtatggggtgtccaagaagaaagctcagatctgcccacggcaggtaccttacttgggatttacaatcgacaggggtccgaacgcagcccgggaaaagaaagaaagcaggtcatttacaatctaccggagccagcccgtcttcccctcgcttgctcttaggtcccccatcgcagtggggggaggcacccctcgtgaggcgggaactgagagccagccccacctcccccctggctcctgggacccccatcgcagtggagggaggcactccccgcgaggcgaggactgagaaccagcccctcttccctccctggttcttaggacccccatcgcagggacggaggcacccgcagcgaggcggggactgagagcctgcccctcttacccccctggctcttaggacccccatcgcaggagtcggaggcaccccccgcgaggcggggactgagagagagctcctcttcccccccaggatcttaggacccccatcgcggggggggaggcactcccgccaggcgaggactgagagccagccccttttcatcccctggctcttaggacccccatcgcagggggggaggcacacaccgcaaggcgggaactgagagccagccccacttcccccctggctcttgtgacccccatcgctgtgcggggaggcaacccccgcgaagcggggactgagagcctgcctctcttcccccccaggctcttcggacccccatcgcaggcgggggaggcaccccctgcgaggcggggactgagagccagccgctcactccccctgactcttaggacccccattgcaggggggggacgcacacccggagaggcggggactgagagccagcccctcttcccccccaggctcttgagacccccatcgcagggggggggcaacccccacgaggcggggactgagagccagcccctctacccccccatggctcttaggacccccaatgcaggcgcgtggcaccccccgcgaggcggggactgagagccagaacctcttccccccctgtgtcttagaacttccatcgcagcgggggaggcactcctcacgaggcggtgactgagagccagaccctcccacccccggctcttaggacccacatcgtagtggcgggaggcaccacccgagagacggggactgagagccagcccctcttccccccctggcccttgggaccccgatcgcaagggggggaggcaccccccgagaggcggggatcgagagcctgcccctattccccccccttggctcttaggacacccatctcatgggtgggaggcacttccagcgaggcgggcactgagagcccgcccctcttccccccctggctcttaggatccccatcgcaaggggggaagacaccgcccacgagtcggggactgagagccagcccctcttcccccgctggcttaggacccccaccgcggattctaagatccttagcacccacctggaggactgggggttttaggtgtccaagaagaaagctcagacctgccgaccgcaggtaccttacctgggatttactatccgacaggggtccgaacgcagctcgggatcagaaaaaaagcaggtcatttgcaatctaccagagccagcccctcttcccccccttgctcttaggacctccatcgcagcggggcaggcacacaccgcgaggcgggaactgagagccagcccctcccacctctggctcttaggactcacattgcaagtgggggaggcatcctccgcgaggcgcggactgagagccagcccctcttccccccctggctctagggacccccatcgcagggggtggaggcaccccacgcgattcggggactgagagccagcccctctccttccccctgctcttcggacccccatcgcagggcggggaggcacccaccgcgaggcggggactgagagccagcccctctaccccccgtggctcttaggagccccatcgcagggtgggaggccacccggcgaggcgaggattgagagccagcccgtcttccccccttggctcttaggagccccatcgcgggtggggaaggcaccccccgcgaggcagggactgagagccagcctctcttcctcccgtggctcttaggacccccatcgcagtggggggaggcaccccccgcgaggcggggactgagagcaagcccatttcccccccccccggctcttaggacacccaacgcagaggggggaggcaccccctgcgaggcaggaactgagagccagacccacttctccccggctcttgggatccccatcgcggggaggggaggcaccccacacgaggcggggactgagagccagcccctcttccccccctggctattaggacccccatcgcaggggggagaggcaccccccgagaggcagggacggagagcctgcacctcttcccccacgggctcttaggacccccatcgcaggcgcttcgcaccccacgcgaggcgggtactgagagccagctcctctttcccccgtctcttaggactgccatcgcagagggggaggtaacccccgccaggcagggactgacagccagcccctcttcacctctggctcttaggcccccatcgcagagtggggaggcaccacatgcgaggcggggactgcgagccagccccacttcccccctggctcttgggaccaccatcgcagtggggggaggtacaccccgcgaggcggggacggagagtcagcccctcttcccccactggctcttgggaaccccatcgcaagggggagaggcaccctccgcgacgcggggactgagagacagcccctcttccccccctggctctagggacccccatcgcagggggtggaggcaccccacgcgatgcggggactgagagccagcccctctccgccccccccgaccccgcccgggtcttcggacccccatcgcagtggggggaggcaccccatgcgaggcggggtctgacagccaaaccctcttccccctctggctcttatgacccccatagcaaggggggaggcaccccccgcgaggcggggactagagccagcccctcttcccaccctggcttaggacccccatcgcggatcctaagatccttaggacccaactggaggactgtgggtattaggtgcccaagaagaaagctcagatctgccgacgttacttgggatttactatccgacaggtgtccgaacacagctcgagatcagaaagaaagcaggtcatttgcaatctaccggagccagcccctcttcccccgcttgctcttaggacccccatcgcagcagggcagacacacaccccaaggcgggaactgagagccagccccacttcccccctggctcttgggacccccatcgctgtgtggggaggctccccccgcgaagcggggactgagagcctgcccctcttccccccccaggctcttcggacccccatcgcagtgggttggaggcaccccctgagaggcggggactgagagccagcggctctttccccctggctcttaggacccccattgcagggggggggacgcaccccccgcgaggcggggagtgagagccagcccctcttcccccccaggctcttcggacccccatcgcagggggggaggcaccccccgcgaggcggggactgagagccagcccctcttccccccctggctaagacccccatcgcgaatcctaagatccttaggacccacctggaggaccctgggtattaggtgtccaagaagaaagctcagatctgccgaccgcaggtaccttacttgggatttactataccacaggggtccgaacgcagcccgggatcaggaagaaagcaggtcgtttgcaatctaccggagcctaagggcagaaggcaggtgagagaattcttaggagctgtggggttttgtagactgtggatcccaaactttgcagtattagccaagcctttgtatgaggtcacaaagggggcggggaccgggaagctttggaatggggatcccaacaacaggaaggctttcaggagttaaaggaaaaacttctggcagccccagccctggggctaccggatctgacaaagccttttccattgtatgcgtcagagagggaaaagatggcagctggacttttatcccaaactgtggggacctggctgaggccggtggcctaagtctctaaacaagtagacagggtttctacaggatggcccccctgtttgagggccttggcagcaactactctgctagtactagaagcaaataagctgactcttgggcaaaacctgaacataaaggcccccccaaactgtggtgactgagagccagcccctcttccccccctggctcttaggatccgcagtggactcacagcctgtttaccatattgtgagtaatatcatctccccctctggagacctctggagattatgaactgtttcacagacaggtgtacacccttggtgtacagagggtgtacacccgtctgtattgggagtaatatcatcctcttcctccctgaatattaagaacagtatcacaggggtgtttctactccctgcgatatcgcgtgtcatatcctcctctcccacgttgcaattagaaacaatatcagtggtggcatgtccaccttctgtcatattgaaagtaatatcattttcttccctccaggatcgtgggaacaatatcccaggggggtttccactttctgccatatatgtagtcacatcgcccactccgccttggaatattattaaggaccatctaacacgagggtgtatacgtcctgcgatattacgagtaatatcaacttcttggcctctgaatatgaggaagaatatcacagggtgggtgtatacctcgtgctctattatgcggagtcgtatctgtctattacggggagtaatatcattctctccctttcaggatattaataacaatttcacaggctgggtgaacacagccggcgatgctgaaattattatcatcctctccccctcttcccctcctggcccttaggacccccatcgcagggggctgaggcaccccccgcgaggcggggactgagagccagtccctcttacccccctggctcttaggacacccatcgcaggggggggaggcaccccccgcgagggggggactgagagccagcccctcttcccccccggcccttgggacccccatagcgggggggggaggcacacccctcgaggcggggactgagagtcagcccctctacccccccggctcttgggaaccccatcgaagtgtggggaggcaccgcccgcgaggcggggactgagagccagccactcttccccaccggctcttgggatccccaccgcagggggggtaggcaccccccgcgaggcagggactgagagacagcccctcttccccccctggctcttaggacccccatcgcagtgggggaggcaccccccgtgaggtggggattgagagccagcccctcttcccccctggctcttggaacccccatcgcagaggggggaggcaccccccgcgaggcggggactgagagccagcccctcttccccccctggctattacccccatcgtggatcctaagacccttaggacccaagtggaggactgtgggtattaggtgtccaagaagaaagctcagatctaccgatggcaggtaccttacttgggatttactgtccgacaggggtccgaatgcagcccgggatcacaaagaaagcaggtcgtttgcaatctaccagagcctaagggcagaaggcaggtgagagaattcttaggagctgtggggttatgaagacagtggatcccaaactttccagttattagccaagcctttgtatgaggtcacaaagggggcggggaccgggaagctttggaatggggatcccaacaacagcaaggttttcatgagttaaaggaaaaacttctggcagccccagccctggggctacccgatctgacaaaaccttttccattgtatgtgtcagagagagaaaagatggcagctggacttttaacccaaactgtggggccctggctgaggccggaggcctacgtctctaaacaactagacagggtttttaaaggatggcccccctgtttgagggccttggcagcatctaccctgctagtactagaagcaaataagctgactcttgggcaaaacctgaacataaaggccacccatgctgtggtgactgagagccagcccctcttccccccctggctcttaggatccgcggtggactcacagcctgtttaccatattgtgagtaatatcatctccccctctggagattatgaactgtttcacagacgggtgtacaaccttggtgtacagagggtgtacacccgtctgtattgggagtaatatcatcctcttcctccctgaatattaagaacagtatcacaggggtgtttctactccctgcgatatcgcgtgtcgcatcctcctctcccacgttgcaatgagaaacaatatcagtggggccgtgtccaccttctgtcatattgaaagtgatatcattttcttccctccaggatcgtgggaacaatatcccatgggggtgtaccctttctgccatatatgtagtcacatcacccactccgccttggaatattattaaggaccatctaacacgagggtgtatacgtcctgtgatattgggagtaatatcaacttctcggcctctgaatatgaggaagaatatcacagggtgggtgtatacctcgtgctctattatgcggagtcgtatctgtctattatggggagtaatatcattctctccctttcaggatattaataacaatttcacaggctgggtgaacacagccggcgatgctgaaattattatcatcctctccccctcttcccctcctggctctcagtccccgcctcacgggttatgtagcgggttatggcaagaagacaaactgcagtttcctgcacagaacagcacaaacaatgatccaagctcagttacaacacaatattggtcatcatttgaccatggacttcaatatcaacccttagaaaccttcctaaaacaggtcagcaaaacaccaagaagcaatatcctgaatgataggaaaatatccttgcttgtgcaaattgtttccacttaatttttttcaacaaatgttaattatatttttactttctaaaaatttttaataaaatatagcctacttggttaaaaatggtgtcaaagcttttctaaaagttaaggcattacataattcagtggcccctgtggctgccatggataattcttttttttctgttcatcttcaaagaagggaattcagaatcaggaaaagatctttggaaattcattagcatatggttttactccgaaactaagaccaaacacaaagagaaatgcagatttttctcatggaaataaaactgcttttttgcattttcaatttgtttccaagtaaggaaaaacatgtcattgtttctcataccccccatttctcctgttttccttcttttcatttgcttttcccagtgtatagcccacagaactagagcgaaagctttctttttggcccgtatataatttgaacagagtatcatcaggtgtctaatgtaccaccaagagtggtgcttacgacaaaaatgtcctctagacttattctatgttcgctgtgtgaatgaagatactaatggtcataaattcctggaacgggagacctcatttcattcatttctatttagaggcttcctagtagagtgcctcatacacaataactggccaataaataattgttgaggaaataaaataagattaataagataataagaatcttattaccaaagattcttcttctcagaaagggtttgttgtgatagctttactattaatatctcactcgtcatagagttacagcttctgcattaaacatattgctattaatatcaggcctacattaatcacctggttggaagaaaagcctccatgggaattcatctgttgggcaagccactgcacaatcttactagcataggtgaggtcaggaattttccgggaaatgacagccaacagcacatagcaactcttctcagtctgagcagaaggtgcccagggaataaaggatggaaattcttctgtcttgggtttcctttctctttcccagtagatgacattatctgagaaaaaggaagaattttcacatagtctgcataaaagtcatgggttacacataaagaaggatgaaaattccattcccgacctctgtttgtgctgaattgttcccctaaaattatatgttgaagccctaacaccaagtacctcaaaatgtggctgtatttggagataagactttttaaagaggtgattaagttaaaatgaagcttatgggccacaatccaatctgactggtgaccttatgagaagaaaaattttggacacacaaaagggagagcagggctgtgcacacacaaaagatcttgtgaagacaaaggaagaatgtggtcatctgcaggtgaagaaaccactttcaacaccttgaacttagacttctagcctccagaagcatgagaaaataaacttctattgctgcagtcatccagtatgtggtattttatgacagctatagcaaactactacagccttcaatagcaactttctaagtagcaggtgattaagcttccccagcagttttgatagcctatggcttggtcaccaggcttgattcccctgacatcactcatttgagaggaagctagcataaagcaaaagaggaaagtctagaatatgtagcgttcttgaaaggtataaaggccactgataaattccataagagaaacagaaacatactggtcaagagggagctcctatgtgactgcttagaacgcttcctcactgtgctccaagatcacctccattagcaacaatgaataataacgcttacttagttttgtggcagattgatccagggtttggagtaaagattccacttgcttctcttttccagctaaggcaaaagcataagctagaattgcatgattgtagccattagtgacaccactgtccaatgccgcttcaaggcaaaagagtgcgtttcgtagagcaggaaactgttggtcaggaagaagaatcatatattgtaaactgatacccgaacattccatgaacttgttgaacatttaaactaatcattgtttataatatatataatatatcctcaaagtatattttacatacaaatccatttatatacacacatatattttatccttcaaaaatatcattaaaataaatttataatgtcattattagtacctaagcaataattttttttgagatagggtctcgctctgttacccaggctggagtgcagtggcatgatctcagctcactgcaacctccacctcccaggttcaagcgattctcctgcctccatcttccgagtagctgggatcacaggcatgcaccaccaagcccagctaatttttgtatttttagtagagatagggtttcaccatgttggccaggctggtcttgaactcctgacctcaggtaatccacccacctcagcctcccaaagtgcttggattataagcatgaaccaccatgcccggcccaatgaaatttagtaagaaaatggcagtttttatatttgatcagtgatattttagttatgaatgtcttctatgcggcaaagcatccaaatttatcataggcctaagagttttttttttctaatgcctaaaatagaggcttacatttctgaagataattttcagggtatactaatgaccctgacaattcctagcatcttagttcaggaatagattttggaaatctaatctatggattgggaggtggctagggtgagccacacttaagttgaaaatgtttactcacttattgtttagagagaaacagaatactaggccacggctttacttagaacagtggttcttaatctgaaattcatggctgaacttcaggagagatgtgaatgcctgcaattgtgtgaataactcttttttgtgtgcatatgtgtattctccctagggagaaacccaatcctgtttttcaaagctgtctatgaatgaaaaacagtttgaacagcatgaatttaaagggtggtaataaactaaatgttatctcggggtttcatccagtcttagaatctcaagtgactctgactctacagtctattgaatgtgcattcagctgcctgaaatcagaaatgacgggaatccatacagtggaattgagcccagcttcaaagaacatcccaacaacatatgcagtgagtgaaatgtcctcttcatctccaccctgaaaacaaaggaacaatgagtcattcgggacagcagagcacaaaatagcaagtattcttttgaagtaaaactaggtatgaaaaaaatactggaacaaataccattattcataaaaacacccgaacatgtgtagtttttaaattagatggttaataaccatactatctaagcaagaattcattcagactctatgcaataattaaatcataattattaagttgttataacaattaatttcaatcatatttatgtggcctggtgttaagcatgcattctaaggaattcacaggactctatttgtctccgcttggtataaatctgaaaaaagccaacaaagaatttctaatgaggtgaagcagaaagttgccgtgaagattcctggaaattcctggaaaagcaccctaggagatcaccagaatcaagtctcagattcttagagtgtaaaatgagaaactcatttataaatcatgtggtttgcaaactgactgtgcataaaactcccctggggtatttaaatcaaccagtgtctacacagagattctggttcaaaaaacttgggaatacgacagcaaaatgcattttaatgggtgctctagtgactctgatgcaaatagcattcagaatggcatctgggatctactgatcttgtagaagcttcccattttatctatttaagcaaaggacaactcctgtcttcttcagaaaagaaatacttctgagaaaccaagtgtttaagatggaaataacagcatatggtagacactaacatgaggtacgaggactgtcagtacatctaaattacagcaagtgggatcaccattcctcagcagtgtaagctttgatttttcccttgcatttttatttctctcaactcaaaacacacacagacacccacccacacagatatttaattatagagaaaatactaggtaagatcagacaaactgtagcagtaatcagcaatgattcaccagtaatgaatccaataagaagaaagatgtgaagatgttttagaagagaacgtgggaaagtttttgatttttctatgaaggagtaagagctcttctccatcagggtcctcctgttgtaaggaataagtttggaatacattaaaaataccacaaagcaatttgaatacaatttgcatgcaaattaaatatcagagtgtctgttttcattcatattttgaggtggattagatatgcattctgggtttcaagaacaggagtgctgattatgaggaaggatgctgaagaaaagctcagggtatttcaggggccatcagagcatgctaaaatgccatgataggagattttgagcaaccacaggggaaaaaaggaggggaaaggagatagaagatgggctggagatggacaggtatctgcaaagaaaggaagttggaagggagggatttacgtaaatatggacaggaaaagggttggattttgccaaggatatacttcacctcatttgtactttggccccggggcaagcttggcctttgaatttttccttgagagggtcttagaaaaacttgcttcattgaaacaatatgaattactagatattctccccagaactttcttgccattcatggacaggaataaactttccttcctcatacactcacagccccctccctttatacattgactgtctccaaatttatgaaagtttcttttctaggttccctttctctcccctcccttctatttctagtttaatttctgaagaggactgactcgggaaggactagagactgaataaggcagacaagagactcagaaggagtcacatccaggctgtagttaaacatgcacaaagcaggaatggtgctgctgaccaacccaccacaggcccaggactgcagtgcctcagaaggtttcataggcacaggaagaatattcatattccagatcaggaaagccagaggcagggcaaggcaggcaatgcccaggaacaaggaaagcctggtgcttctcctctctcacctcccaggcgtggttgaaaagctggccatcattcttaaagcagccgcttgttttctgttggcttgaaagccagattaaggtctgtttttgaacattttcatcaatgaatacaaattttttcattctctccaatgtcttaaaagtaagagcactgagcctgtaatacaaatcaccaaagcaaaagttagataaagaggaagtgacaatgtcagcaattccacagtttcatcaccattgttccctttgagtaaaggatgcattcaactcatctactgtaaaccatctttattgttagtggccctttcctttgggtcaggaaaatattatgactagcaataagtggaaattagagtaggtaattttcagcatgtttgcacccaaaggtcctgttgtatatagcccattagattatctgcacatggagagagaaatgatgtaattaggtattttgggtccttctaatttcactttcccgaatctatatgggactctgagaagcacagagtaagacgtgccgtgccctcttcggtggagttaaccagcggtgcatgtctaggggctgtcatgaaaggatcagactgctaagcaaatcgtcatgagactgaaggaacattgttgcattagaattggaatcactaaatctttagttttatctatttctcttctgtaaattgactttgaaacccactttgcttctaaatccccactgaactctatcctccttcacctccttgcaagccctcctcaggtaattcctatattatataaaataaaatttttatgtctcaccatatgcttcctttctgattctgctgccaaaacacactataggaaccatcagagtttttgaaagataattgcctttgataacctaaaatagaacattgtaggaaattattttttaacctaagaaagttagaagagaaagaatagtgcagtgcaagccctaggtattggtgttagacacaaatcactaggatgatcatttccatttgaacttctgaaactcaggttctgtattcataagggagaaaaaataactcttactttataggattttgatcacaagataatacacatggatatgtctggctcagtaattgcctcgtcattggtacctactaactattcagtatatttcccctaaggtcattttatttcagtgttatctttctgagaagaaaaaccaaagaagattattttatgctcctggacttttccttaacctcacagttcacaacattggccctctttgtgtatacaaagccaatcacttcactgcaacagaccacagctgagcaaacaaatacagacgttgatagatgaaccactgacaacaactcctaacaaaaacaacaataataacaacaataaacaaggtagcttgcaaaataccagacattaaaaaaaaattaagtgcatagcttgaaaactttgcagctgtaaattatgacgctagctgaccacacagattttgaagtcagacggaaaacagcgctaggactgagagttcctcggttcaggttcacttttctttcaccagactactgcataaaaacagcttatgacatcttggtatgagtaacaattgctttcaaaaattatgggcagaaattacttaaatcttctcaccattagataagagaaagaaagccttagattgaacttcctctgtcagttgctcagtagatttcagatagtccagaacataagtatcagatgctagtagggcagcattctgctctccacctccatagggcatttggagaacaaccagattctgcatggcaagtcctagaatatcccctaaaaacaggaaaagcggaaagctgtattgtttatagttgccatctcagcattaataactatagacaaaagaggcatagtgaaataggtaacatttaaaattgagtctaaatggtggaaacaaagaaagttttatgaagcaatttgaaagaggagacagccatgaagggtgaagttaaactgctatgaaaaatatttctgaaaatctcattaccagagagaggaggaagttaggagaatgcatttgtttgcttgtttgctagttttttttaatcaatcaatcctatgaattacaaagtgtaatccatcccttccaagagatgttcatgttaataacagacaaagaagtttgccttttgtatcaacaacaaaaatttctccttttattgagaaaactcccaacatcattaacaggcaaagtcaattcgattctccaagaggtgaatttcatatttcagattaatgattataaagaacctcttgctttctgaacactagttaccatctacccaagctaaggtttcctgggaatataggtctggaaacggtactgtaatccctttagatcccatcaggaaacatagaggatgatctgatcaataattccctccaattgatagcttaggaaaatctctctattctattattttaaggatttttaaagaccacctcaaccaagattttcaaatcatagtgaaacacaaaatttgatcaacttacccacaacagtgaaaaagcctctggctgacccttctactacatcatttggcaagtccaaaactccctgcttggaggctttggcacctagaatgaaaatactgatttaaaaaatgtgatggcttctttatatcagcagatttgggggataaacatattggaaataagattccattacttatttttattttacaagttgtttattagaggagatgaatttggagttttgacccagtttaggataatagtacattcagaaaatggcatataaatctgtgtgttagattgtggcccccgttcttcactggtttagtgcctgaactatttatgtatgaaaaaatgtaaaaactacactgactgtaacacataaaacaacacacacaaaaggtaaagcttgaagactcagatgaaggagtataatcagatcaccatcaaccaggtaaaataatacccctcatggccataaaaccggagactgaggtgcaggggcagtgatgtatctatgggttattttctcctaagagtacaaaagccaagattatattatgtgctattgggcctcaatcctaatatctcattgtccaatattgtgtgacaaccatatcataagaggagctaagagtacacatgatggaaaaaaaaatagataggagcagaccagcctcagaaagtgaactaaaaaccacctcctgaatattctttttgatggctaaaattataccataaagataaagcatgaaacacaagaatcctccacgagttatttaaagtgaaatcacagggcacatggactcatgtggaaggagaggacatgaactgattcttttggtgaattttatttaggactaatttgactccctaaaagatcctcttaccttctgtacagataaggaaactctgggtcctttccttttcaataccttcaggctgtcaaagaataacacaaacaagcacagaagaatgagtctagatcctctgtccatgaaggaaaagtgattaagcaccagctcacttaagcatggctggtgcaagtttatccctgagagaagatccaactcatcttccccttttgttcatatctggaaggcacgggacatcaccggtacccattttagcctctgcgttctgtagcttggacaggcattatcttgatgtcactgtgggacactctcagctcctctgatcctgtatagcatctccagtaaacaactaaaagtgctttgtggagcagggattgccaagaggcaaatcaagagtgttcctctgacaagtgctgattcttgttgaggatgacgggaactgcatgggagtgtaggacaagtagatttgtctcttgaatttgagaatcagaaaaagagaaggaagagaaataggtgtacaggaaacatcttgactcagaaacaaacaaaaaattgtcaagtctatttcaaatgttaagttttactatcctgggtgaggtattaattaaagaaaggatgaactttatgctgttttaattcatttaaaatggcatgtcttgtgtcaaaagtaaatgttgtcaactaattaagtctcttcaatgagaagatcttttaatacaaaacctcttagatgtctgtttcttttcaggaaaagcttgactgtttgcatatccatacctctactaagaagcttttgaccacagtgtctttccagtttagcttttgctgctccattccttcatttgggcaagcactgctttgtttggactcagcaactacagtgatattcactttacctggaagacattcccaaatataaattaaattgatcattggtcccttctgtaatgagaaatgactagagtctgtgaaccatgtcttgaattggattaaccaaattctatcattaagttaatgcttagaacaaaataacttatttcttctccttcctaggtataatgtggtatcttccatttcacctgttccatgattttcatgattccttacattaaatgataaatttacttaattaaaacttaagaaattttaggaaaagtaacattttacaaagttgtctgagtcaatttcctgatattgattgtttataaaggttacttatgacaatataggctaataatgtcagcgaactagggctcctaacttcccaaaatcaagcaagcatagtaaaatatgatatagtagataggcactggattgaaataatgtcctagcaaggaatccattgtttttaaacttcctgatttcacattatgtaattagaactgatctccagtttccttgcttgtgaaaattacaggattgaaaacaatcattcattctttaaggttattattatttacgtgactatataccaatatacataaccaatatattgttctctttgttgttgttgttgttgttgttgtgttttagtgtttctctgtctcaggaagcttgctatttcactcttaaaactgtgtcttcgacttaatgtcataaaactatacaagttggtacagtattctgtctcaattgccaaggtaggattttgaagatcttgtgcagtagaaatattgagaaacttcaaatctaatagaaaaatagtctgagaacagcatcacaactgagctaaaataatctcatagatatattatttgctgttaaaataatacaatgaatatagtacattaaagaacatttgaatggccattttttaaaagtagtgattaaaagtgtcacgcacatcgtatctagcattccttgtttactagaattttaaactttttccattccatgtattttcaatatttcaataggagacaagtttatttttccatcttgcagatagcataggcactaagacaatattctcagttttttatctcaatccaatcatttagtgattttggtatccccatggcacatctagtaaatttacaaacctgacaattccctcattggtcattgtgatggagcagcaattttcttgaaggtggcctgggttcatgatggtaggtgaaggacccagcgagaagtcaaataattaaggtggcattaatgatagcatggccttcatttgggatatggcatatgccaaacatatagtccatgataggtcatgccagttagcatttatattgtattttaattacattatgctcttgtaaaaatgaatggtggttttgatctacacagcattaacaaccagaaattagattactatagattagaatttctaatggagaatttacaataagaattttaaaaatgtgagggagaaaatcacgtttgtatagacaatataaggaaagtaaatggagacaataaatatgggctggtttttccatgagtgactggtgtagacagatagctgcttacccaatttcttaggtataatagtccagatgtttgttttcctccctccagcttgaataacctcactgccattgattttccaggtattaatatttgcttcataattctgagactcctccacttgaacagaaatctaagaaaacaatcatggcaatgaggatagcactggaacacacatcactatgaaacaccatgctcaatacactgtttaaactgtcactgtgaatgaaagcaattgtatttgtttgaggaatatggacctaagtcttatacctttatagtagcattttgcacttgaggataaagagaatatggaaatattaagaatattttagctttgttagatttttgcctccagatcaaacagaacaacgcacctctacacatgtattcaggtagctgaaggcattgacaatcaaatcaaattgttcattttgaacaaccgaaaagggtgaggcaatttcaataaagaaaggttgggagacttctagagtggttgtagaggaaatgccaaatccaacgtcgccattcacacaaaagccacttgcctcccattgggttatcgtatcaggaatgaggaacgaaagattggcagagcctgaggaactggaagaagaggttatcggtaaaacacattctttgtctgaaccaagaacttaaaattaagtgcagagcaagcagaaaagtattgactgaagctcaaaagtgagttatattgtttggatggggcattagataaaaataatgagagctggatttttataaaatttgagtatagaaaggtcatttttctttaaacgccacttttttttttaattggggcaggttaaatctgtctgcataaaatgaatagaagagaaactcttggtgaagggaaaacaatgctagagaaaaaaataaaataaaatgtatgataagtacatgcaaatcaatgatatatattttacaaatatggtactgttttatatacccaggaataaacctgaagaaagaaaaagaaaatagaaataaagacacataggagagaaaatggttaaaactcactcgacactgacgaggtcccacatccatgtctctgggaagtttgttcttactgtttgaattatagcctgttctacatagtcagcattctcccctctgattccactagctaaaaaaaaaaaggaagaagtaccttattcagaccttggactctgcaaattatagtctatatattatcagggtgtaaggtctccataaaacacctcactttcctgtatcacagtcacttactatgactgttttcctgtatcaccatacattgcctgttcccctacacagtcaggtaccacataatgacactgtgatcaatgacagaccacttagactacagtggtcccataaagttagaatggagctgaaaaattcctaccacttattgacatcaaagccatcataacgttgtagtgcaatgcattggtcatgggtttgtggtaatgctggtgtaaacaaacctactgcactgccagtcctataaaaatatagcagacacaattttgtacagtacataatacttgataatgatgactatgttaccggtttttgtgcttactatactatactgtttactgtttagagtgtactgttcttacttatcaaaaaaattaactgcaaaacagcttcaggcaggtccttcaggagatgttccagaagaaggcattgctatcatagatgatgacagctccatgcatgttattgccccagaagaactttcagcggtacaagatgtggaggtagaagacagtgatattgatgatcctgaccttgtataggcctagattaatgtgtgtgtttgcatcttcgttttaaacaaaaaagtataaaagttaaagaaaatttaaaaataggaaaaagcttatagaataagaatgtaaacaaagaaaatatatttgtaccctgactcactcagagtaacttttaaccttgcaagctccattcatgggaagtgctctatataaaagtataacttttttttatcttgtataccacatgttcactgtgccttttccatgtttagcaatgattagatacacaaatagttatcatcgtggtacaactgcctacagtattcagtatagtcacatgctgcggaggtttgtagcctaggaaaaatgggctgtaccacatagcataggtgtgttgcaggctacagcatctaggtttgcgtaagtacactctatgatgttcgcacaacaatatcacctaacaatgcatttttcagaacaaattctccatcactaagtgaagcatgactgtatttctgacattgtattttatcaataaaaataaactacatctcacatctgaagctaatttcttgttatagccaaaagcatgtctagtctgtcttattctgctttatccaactataggatgtctaattgtagccaaaaacatggcataattcacacataaaattccaaaattgcatcatttatcccaaatacactaaattccacaaagcggtttggtcatcccccaacaaaaaaatgtaagattacctacatgcaattctagacggaacactatgcattggaccataattttctgtttctagataaagcggcttagggagtggcagccttctctccatcacacatacttctggttttcggtaatggagattggtaaagactttgagacccatgttctttaaagaaacaaacaacaaaaatattgttcattcttttcatgcaagaactataaaaggcctattatttatattgcaaagataaatggatcataagtatccatattttctgtgttaacaaaggtctgagaagttacaagtcaacttacctctatttgacttatggaaaatccctaatttagagaaaaaattataatcactatgatttatctagcacttattatgtgctagcatttttctaagtattttccattattctccatttcatcctaagtggaaaatacttatgagatcagcactatcattaccctaattaacatcaaacacacacacacacacacacacacacccggcacactcagtaaattaaagaactggaacctgataaagtctgtctgattcaataccccttttcttacacacttgtgatgttaattatagagattatttcatggaaggctcagcatgtctcattaatggcctagggatatctggagtccacactctcttagcctcttgatttgacaatctttgcataagatttattgtattaattggaggctgtcttatttttttaagtgaggttttgtaattatagctacatgatttattttcagcagaaaattttaaaatcaacaaaattaatatctcctttttataagacaatttctatgtactctattggcagattacagacacgaatctcaaagtataggaagaaaactacataattaagaaaacattaatatgcattatgaatactaaaaattgtgatgaaatattttccaaaatccttagtgatcttaccctgacaatattatagatatctccatccccatagttgcttacaggtgtgtaatataaaccattgtagaacatatccctctgaggaatgcaagggtcttccttgccatcatcaagattgaggccatggtagaaataaccatacggctctatacttggaaccatgttatacacctatgagaaaaaacatttcccaataattttaagcacttcttttaaaattacaaaattggcaaattgtctactgtaccatttattcttgttcttttctttaagagcacggccatcatatttaatccagtattttcacataagctcttcctttcaaaagagcaaaccagttttgttttaggcaactgatgtcatgttcacagaatttctcagcttgggcgcaggatttaagagagaatgtaagaaagcaatgcctgactattgattaatccaaggcccattgtacacacagtcaattataatgctagaatttctaagtctggagaataatcttagctgcctgattttaaatcttcttacataatcttctgaagaaaacataaaatcaacaaagagaacaagtaaggatactcatgactaatatctttaacattactacaatacagagaataccatgatcttcaaattatttcttagtagagaaacaaacaccaaatgccaagagagcttctactgctattgcagagggaaggcttaagagactgcagagaaaaagagagcagaatggcatggagaaatgagaagaaacacacaccaagtcaactccaggtaagagaaagtctagcattgttaaaaatacaaatcatagttttcggactcaacagttcccagtacagcacacagggaaagggcttggactgaatgggcctggaagtggaagcttccaaaaaacatggctaaggggaaataatcagatcacaagaagaggtatgcagatccttggagacagggaatttaaaaaaggaaaggatgtcataggataaaataactccctccaccctcatttccatcaccaacattttaaaaataatgcattttactaaaaaaaaaaaaatagaaagggcgctcttcacctatgaacaccctgcacaaaatatcaagaactagaaaaaatcaactccatacaaagcttctgtaagagaaaataggaaatgcaaaccaaaacacttcagctaatgaaacttctccactaaagtcactaagtaaataaataagtaaacaaagaaaagccatgccaaaataatttaacatgagtgaaatattctcaagcatgtatttgaggtatttaaaaggcaccatgagtcagaaattctattaagaaaatacagaaatggacaaaacccaagaagaaataaaatgaggctttattgaactcaggaaaactagacaaaattatatcataaataaactctaaagtacaaggacatcaagagaaaattgttcagagaaaactttaaaagcagcacagaggaaaaacaacagaacaaaactgaaaaagaatgaattaaaacaggtcacaaagtgattgaattggaaagcaggcaaggaagatccaacaaatgtacagagatttttttagaacaaaaaaaatggaaagaccaatatttacaattataattcaggggaactatctgaaaataaaagaagatttgagtttacatattgcatgactccactgtgtacctggcaaaacttctacagaataacattcttactgaaactgttagattaaagtataaaggggaaaaaaacattcaaggccttcagacatagagataaagtagcccataatggaaaatgaattaaactaatgtcagcactattaaaaggcatattcaaagcaagtcaatagtaaggtagcatttcaaaaaattttaaaatgtataaaccaaagatttaatatacaaatacctgtctttcatttattaaggctttagaaaaaataattctgaatatgaaaatgtcagagaattctatacttatgtgatgtcctgaggactctagtagagaatgcactttttaaaaattgttatttatttatttctgagacagggtctcattctcttgcccaggctgaagctcagtggtatgataatggctcacagcagcctcgatctcccaggctcaagcaatcttcccgccccagcctcctggagaatgagctttatgtaaccaaaagatgactcaggaaattagtaagacttgatgaataggagaaacaatacagaatgtaaacattatatattctgacaaaaaaggaaagatgcaacaataaaatgagagaagagggagagaaaagtggaaactagagattactgactgttgtgtaggtagcagttaagactcaaagattaaaaataactgactagattttttttttttaaatggagtctcgctctgtcgcccaggctggagtgcagtggcgcgatctcggctcactgcaagctctgcctcccaggttcatgccattctcctgcctcagtctcctgagtagctgggactacaggcacccgccaccacgcccagctaattttttaatatttttagtagagacgcggtttcaccgtgttagcgaggatggtctcgatctcctgacctcatgatccacccgccttggcctcccaaagtcctgggattacaggcgtgagccaccgcgcccggccataactgactagatattaaggttaagcaagaaaaaatgagattaggatattaggatattataaaatatgtaaatataaaaataaccactaaaataaaaattcaagctagcctgaatactcaaagaagctttaagcaagataacaacaaacaaacataaaagctaaagaaataaagtagctttaaatacaatacagaatcataagaaaaatagtatgatagagctgaggcctaacacatacatcatatcaatagagtgaatagactttattctcctttagaagacaaagatatgcatatttaaaacaaaacataatgctgtacttcatacaaaaaacaagtgaagtgcatatttcaaaaggtgaaatccaaaggaaaagtaaaggaaaataataagaatgcaaaggctgcaatcctcctgttatcggaaatcgtagaagtaaggccaaaagacatcaaacaagatagagaagaatacttactgctaaaagctgcaattcataataaaggcacaacagttatgattatctatgcagaaactacagaagatgcaagaagaaacagagcactatttgtagggtattttaacacatcactcagcagaagaaggttaaataaattttacaaaataagtaagaatacaaagaatcaaaataatccaacctcatggatagaaaacaaactgataatagagactatatcttctcaacacatgagatatattcgcaaaaactcattatatatttgggcacaaaaatataccggtggaaatattgctggccatgaagatatagaacttgaaatttaaaagaaaactctaaaataaattcctttttatatgaaaattataaagtactccagtaagtaaattttcagtgaaagggttaatacaaacagaaattacggaatttctgaaaaataaaaatggtgcaattgctatgtatcaggatctatgagatacttcaaaagtagaaatcatggaaaaacttataggcttaaaaacacctagcccaataaaataaattaatgaaaatgaagtaaatttctaagtgaaaaagctaaaaataacaacaaaatacagcaccagtaaggaaataataaagataaaaatagaaattaatgtgatggagtagcaaaaaacctcacatcatattacatcacattaataaattaaaattatatgtttttggaaaactcggcaaaataggtaaaccaccaactaatctaacaaggaagaaaaagtagctatctgcttaggaacaaaagaaaaacaacttcttccatgactcagttttcagcctcattttttgtccttttagcatcgtgaattggggtccggagttgtttgtatttttctttcacaatagactgatgtatgtaacctagtctcaaatgattcagaaaaaactgaaatggcataaactctgtgtgtgtgtgtgtgtgtgtgtgtatgtatgtgtgtgtgtgtaggggtggagagagtgagaaagagaaaacaagtacggtgaaatgttcacaaactggtgaatcaggccaagggtctacgggagttctctgtgtaattcttgcacttttaaaaattatttaaaactaaaaactaagcttacatagataatacaaaaaataacataaacttatagaatataaattggaattcactcatttatagaacttcacttgatttatactattaatatagctatcaataataaacaagggcaacctcttttggctctgatatattctgagacccctgaataatgcctctagaattttctttttgaggtcccttgatggtcttttcttgaggcagttttcctaagatattgccacctccaactgtagaaagaatgagcagaagctatttactctgaatccatgaaactctcaagggaaaaaaaaggagtgtgtgtgtgtgtacatatataaacatatatatgtacacacacacacacacacacacatatatatatacatattccttttttttctttgagacagggtctcgctctgtcacccaggatggagtgtagtggcacgatcttggttcactgcaacctctgcccccgccagggctcaagtgatcctcccatgtcaatctcccaagtttctgagatcacaggtgcacaccactgtgccctgctcattttttatattttcgggggagacagagtctcatcatgttgtgcaggctggtctcgacctcgtgagcacaaacgatctgcccgccttggcctcccaaagtgctgggattacaggcgtgagcacagcacatggccatattccatatttatagataaatttatcctttatttgttgatgtcccctcagattctgaaagcttctaactaaaagtatttttgctccctgtaatagaaaacttaaatgtatttatgttttgcattgagaaaaatgttttatataatgatctatagttattcaatattattactgaattctataattttatacttaaaactggacttactacagaatgttgaaagcaaaatacaaaactattttttggtgagatctcaagtttgtaaaatatatatgccttcagaaaagagacttgaaaaattacagcaaaactataaagatgcctaagtgttaggactataaatgattttaaagatttccttctttatgtctttgtatactttgcacaaagtacacaatttaaattagatttaaatatgatcataaatttcaatagttatttatatgtaattgtgttagaaataaacggaaaatatccaacaattgttaagcgaaataaattggatgtgaacttctggaattccaggtctggaaatgtttaagaaaatacaatatccatttatagataataactttacactgaatccaagcatatccttgaacatagagatttcattttattccaagtttccacttctgtgattacacctatgatttttaaaaatcacagttgtaaaattcctaaactgttataattatctatcaaattctgtattgttataagcatgctcttaggatagccaagaaaaatacgtatataatccacgaaggaacaaaggaagaaaacattcaatattttcaacatgttcaagacatcatctgaaggataagacttctggtagtccagagaaacatgaaaaacgaggaagtcagagagcttacactttcagctgacagctgttgttcagatttcagtagaaggacgttcccatccacagccccgagggcacagaataagacaggcgccgcttgaagatagagactagcattggaaccaggtaagccctgctcgttagagaactttatgttaacctaaagtagagaaaaaaaagagatgagagtagagaccattttatgtaaagatgatctgaatacatttaatctctcctgaataaatccttatagatttctatacggtatttcctttgcccactctcaccctcagctttctttgcaggagacccccttcaccacgtgctgccgtctcaggattggcactgctgccaaggatcatgcattgtgtttggtgattctcacatcccctaataattcaattatgccagcactgagtgtaagtttcccacgtgaaggtgatagcagtcaggcgagaagacagcagggagcaaactgttcccacttctcaggccagaaataggagaaacatcaccttgtgtttaaagcacttgtcaacctggaatctgacactgtcagccacaatttccccactggggtgaagggtgtagacaaacaggacggctgcaggagccagatcagcactgatgctgagtgggaacgagaagtttccattccaggctgtgtaaataggagacgaagagatacgatgctgaaagtttcctgaatcactggtacacttagataaaagagaatagctcatggacagaaagagtaaattgggccctgttttcaagacaaataaatcaaataataggaagtacatacacaaataaagaagactgcataatttagataataacaatactgggattttgtacaccacttttcttttttttattttttatttattattattattattctttaagttttagggtacatgtgcacaatgtgcaggttagttacatatgtatacatgtgccatgctggtgcgctgcacccactaactcgtcatctagcattaggtatatctcccaatgctatccctccaccatccccccaccccacaacagtcctcagagtatgatgttccccttcctgtgtccatgtgttctcaccgttcaattcccacctatgagtgagaatatgcggttgtacaccacttttctaatgtactcaatgatctgacaataaaagaaacagtagaactctccttcatcaggacatttagtagcttccctcaggctgtgctaactattcccttcatccacaaattgaaataagtgctcgttcttcttttcactatatatatatacacatacatatatacacacatatatatatacacacacacatatatgtttgactatatataaatatattttcttaatatatataatccccatatatataatgtctatatatccttaacaagaaaaaatgaagttagagcacatattttaaaatgaatacattatgtatacctttgtttctgatttccttttgtccactgagtaagatagctccttttaccatcatctgtgtggaacaaagaaaacataacatgcaatatattatctgatgtcatcatattctcatattgagattaggtaattcattacttaatggtaattctgttccataagatagggtagcttccacaagcaaatattaaaaatagactttgcgtaagttggaaaagagcagagaaagtgactaaaactgattgagattctatcatgtactggaaactttgtgaactatgtgcaatgcactgtgcaaagtggcacataaagctctgaaattgtcaaggctgtccggtttcaaatacgccttcacctgctcattaactttgtgacttaaaacatgatgttttacctgtttgcctctgttccattatctgtaaaatggagatatctataaggctaattaaatgagttaacacatatacaatctttataacagtgcctgacacagaacacttaccctaagaggtaagtcttataatctccaattacactgtacacctgaggaagccaagggttaaagagttcaaacaatccgtccaagatgcactaacttgcatgctaactaggagagggtgggggattcaagttaatgtcttaatttccaggtctgtgtcttatcactcttcaacaggccttagagcagaaggccccagtccccaggctgtgtaccggcaggtacgtatccatggcctgtcaggtactaggccacacagcaggaggtgagcagtgcggtgagcaagcattaccacctgagctcctgtcagatcagcagtggtattagattctcataggagcacaagccctggtgtgaactgcacgtgtgagggatctaggttgtgcgctccttatgagaatctaatgcctaaaaatctgtcactgtctcccatcaccaacagataggaccatctagctgcaggaaaacaagcacagggttcttactgattccacattatggtgagtatgtaataataatagaaataaagtgaacaataaatgtaatatgcttgaatcatcctgaagccatcccaccatccccaccccatctgtggaaaaattgtcttccatgaagccagtccctggtgccacaaaggttgggggctcctccttagaaagacaaaatggacagaaccaagagaataaagtccttttactgcttatcaacataagctttccaccttactttctggcatctgcccaatattttactattacaaagtgtcataaatacttgatatgagttacatttgaatgcttaaacaagtggactctgaacagcaagttcttcaaccttagggaaactttaattgccttagatcgttctatgtgtttgtttgttgttaatggatcgaacagtattcaccagcaaagtgagaaggctgcccttactctggtcaccgtggcatgactgatgcatgatttctaagctgtgctgggctaagcagacgtgcaattgaacaggattccaggaacccactgactgagacttaccaaatagaagaactttacattggaatcatcctcatatgcttcactgtttagggagtaatgcacagtaacaaccttctggtgattacattcaagctgctttggttctggaacaatcttcaggaagctgttcgttcgggagtaaaagcgtgagactaagaagtgagcatccaagtactgaggcgtcaaccagctgggaagatagcagctcttaggtcgaacatatgtggcctgagatgacaaaagaaagtgaagggtcttagtatcatgacatccgaagacagttgttactgagaatggaggcttctcaactctccagagtagggaggaatctcagcttgtggctgacgttttaatgttaagttattggaatcaaaataataatagcactctgctctttgtatacaaaacgtgaccatgaaagattgtgtaaatatttcattagactgatggtgaattgttatgttttttacactttaattgaagccacagaattgggtttcagttctgtttctttcagctacatgtgaacactgacaaattatttaactgcaaaattctgtttaagcagcggaaaataaacagaaagtataggatctcccctatctatgcatgaaatgatctgaggaagaaagtcaaatcatcctcatgagctacttcttgtttcctagaggaaaatattagttgttagcaaatttataacaatcgtgatagacttttagcttcccatccccttgaacaagtattctcatgtattatttagtgaacaagcaaatttataaaataagttacattttaaattttctttaaaatagattctgtatacaagctatcttttgagatattcctaatgtttaacatttctgatatccaaatcctctgtgggatgtctaatggtcttcttctgttctttgatgtcttacttttaggttgaactctggatcaaatatgtctgaagtgtcaatggaaaattgagcttcgccattctcgtccgtagtataatttcctataaattcatcattgagctccagttgcaacaacttgttcaccataggtacattattgggatccgaaaatttaagctgtacaagaaaagaataattaatatgacttaaaacacaaaatgtttacatttttacagagaaatagttttctactcataaatgtgatccctagtcattttcctaaattccaacagacagaaagatgctctattaaatacatagatatataatataaagtatggaaaaaatgatactgttatctattgcttctttcaatctaggacactttctagcacctcagacatagtagtgcttaaaatgtattacaaaagtaggaaaaaagtgaccagaaattttcaaagggcaatctatgatccaagaaaatgaaatggaagcatgtattctttagtcaaacctacagttccaaaataagaaatccctcttctgtagaaagtatccatgttctcaaagtttacagttccaagcaattgagtgataaaaactgaggtcttctcactgatctgcatacctgtaaggaatgatgaacacagcagagtgaaaatatctaagttaccatccacagcaatataaatgtgaccagcttgcccagtgtgaatagcatcatgatattgatcaagtatgcttatatagagcactttacaatggcataatcacaaactcctttttaaataacaagaaataattagtagttaaatctgattttcccactccaaattaaataatctctttctcccttctttctggtttttttttttttttttttttgagactgagtcttgatgtgtcacccaggctggaggctggagtgcaatagtgcaatctcagctcactgcaacctccgcctcccgggttcaagcgattctcctgcctcagcctcccgagtagctgggattacaggcattcaccatcatgcccagctaattttttgtatttttgtagagacagggtttcaccatgctggccaggctgattttgaactcctgacctcaggtgatccacctgccttggcctcccaaagtgctgggattacaggcgtgagccaccgtgcccggcctcttctttcattcttttaacaaatacttattgaacactcactttgtgcaatcttgtaaatttttcagtaataatttttgcacttgcaactattcccagttgtattaaattagaaataatctgaattttgtacttagtgctaactcaacaagcttctcccagtaagttgccatacatatatccccaggtcgtccaaaaaatacagtaatttcctgtcccaaattctgtaacaattacagcgacatgaaatgtcatgaacaatcccgaacggtagagttggaagacttttgtatttacaatttgagaaacacaaccattttccaactgaaaaataaagagaaggtataattaaaatgttagagatccaagaggtttttttaagtgtcttttaaaatatggtttttgcacaaatatattaacatccccaccccgtgccacggctctacctcataaacttgttgaaatggccaaagaattagaggaggagtaggaggaggcgaatatttacatcagcattttaaataacggaaggaggtaatctgtattttacagatttcaaggaaattctcctggaaacattgtagatgagaaaagattaaaggatggaaatgaagctgaatggtattgtgaaaggaaagtaaatctcaggagcccaacatccctaagctaaagggaaagggcaagctgggaacagctgggcaaatctgtctcccattttattcccaaataaggtagctacaaagataaaaactacatacctccctcacaatttgcccacaaggaaattctttgtgggcctcaagaacttttccttaaaacagttctttggaaattcaccctggcaatataaattcatagcttatctttacaggcgtgggacaaaagacagactcagtcatccctctgcttacctgagacaaatacatatctgatttatctgattgcttcctctgcctaatagtttatgtaaaaatgcagatttactgagccacactaaggcaggagtgactattcctctatcctcctctcacatgtaatttgtgtattcagtgaaaggctgatcaaagacaaagacttattcttttttttttttttttttttttttagatagagccttgctctgtcactcgggctggggtgaaatagcccaatcttgactcactgcaacctccgcctcccaggttcaagcgattctcctgcatcagtctctcaagtagctgggattacagacacctgccaccacgcctggctaatttttgtatttttagtagagatggggtttctccacgttggtcaggctggtctcgatctcctgacctcacgtgatctgcccgcctcggcctcccaaagtgctgggattacagctgtgaatcactgcacctggcctcaaagacttcttctttatgcaactgtttgtctcttatctacctatgacctggaaacccccttagtttggattgtcctgcctttctggaccgaaccaatgtacatcttacacatatttgttgatgtctcacatctccctgaaatgtataaaagcaagctgtagcccaaccaccttgggcacatgttggtaggacctctggaggctgtcataggtacatccttcaccttggcaacataagctttgcaaattgattgacatctgtctcagatacttttggttcacagtgttttaagaggaagaaattctaatcatctagaaaggcactaaaacagatggaacagaagcgctcagcacatgtgtaacaacaaaacaaacactttttaaggtatattgcttatttaaaataacaaaaaatctatagttaatctatcatcagtaataataattagagaaatataaatttagttatattttataacacagtgtttattccagatttaaaatgttataaggatatattagtttatttgatactcaaaactattacatgagctaggtactgttattatcttactatatagatgaagaaactaaactaggtccatcatgtaacctgtccaagatctcacagctaagagacggtggtgctgaggagctgctctggctccagagtatgtgcttctctatcttaaattaacagccattacatcaacaacaaaagcaattttattttgtctaatgataatatagtcaaattaaaatgaaatcatagaaagtgatcagaagaaccttaattatttcgaaaataagagaaaagccttttttcaggaatccttgaaacaaagagaatacataaagtaaaccaataagaatccagatattagagtaatgaaaaaatacttcgcatcaaagtcaatggtattcagctgcagttcagaagaaatgtaaaacagtgaatgtgcttattactaaaagaaacagctaatatattttttaaaccccaacaaaatcaactacaaatattaggaaaaagaattaataagatgaaagagaaaataaattatttaggaacacaaaataataaaagaaagaaaatagtaaaaataagaaccaataaaatagacgaaactttcgtgggcatgatttaggacaaagagtgagagagaacaaaattgtgagataggtgctaacacaacacagcccacatctggaagaaaaattcccattttagaacatcattggaagtgaactttatgtctattagaaaattgtaaacaatcttaagagcatacttagatagccacatgtacaacacaggggccagtgagattttttttctaaggctggaaacccaggaacataaggaaggtgggtatgtcaaaaatatgacaaagtaaatgagttgcctatttaaataacaggcttgaaaaaaaatgcttgtaggatggaaggcagtacttacctgaaagtttccatttcacatgaacagaaaaacatgggtaattaagagttctcaaatccaaattgataacaaaaatatgaaaagttgctcaaactaaatcgaaattagatagcacaagttaaaacaagctaaatttgtgtctatcaaaatgacaaaaacttttaaaacttctaaatatattgctgaaagtaatttggaaaatatagtattctcatgtacttctgacaggaatttgaatgcctaaaacttttaggagagcaatatgctaatatttattaaaattaaaattatctgtctatgaacattatctatatttcctttgactcaggaaactcactctaagaaatttatttcaagtaaataaagcctctcatatataaagatagttccaccggacagatttttttttttttctttttctgaggcaggtcttgctctgttgcccaggctcgagtacagtggtgcgaacacacttcactgcagccttgacctcctgggctccagtgattcttttgcctcagcctccctgtagctgggaccacagatgtgcaccactgtgcctggctaatttttgtagagaaggggctcactatgttgcgcaggctggtttcgatctcctggaatcaaacgatcctcccgcctcagccttccaacatgctcagattagaggtgtgagccactgctcctagcctctaccagattgtttattggtatttttttcacatggggaaaaaagtaaaccatttgctgagggaacacccatcactgtgtaaaacggttgactgaactctatcagaatgtactgctgacatggaaaaattccaccctagttttctttgcctgcatttcctatgtaaaggtaggattctgcttgtctttgtcaattattgatatttacctagaggatgttcactaaatttgatgagtaactttaggacaattggacttaaaatatgaactatgtggcatacacaagcttcactttggggagtcaaaagacaatttcaaagagataggaagagctgttcacttaaggttaggatgctgcagatagagcaaatgatgacttcacatatgaactgcaagtctaaagtaacatagtgggggtactctgaattgcagttgattgaaagtaagctgtttccactaaaaaaaatccaggtggcatggagagtaatatcacagactcatttaaaggatgattaacgattctccaaagaaaaatcaggaaggctacctaggcgatatataaaacaacaaagcccacgatacctttcatattctaaaaatcccatgaatctataggtggagaacaatttacatggtctatggaataaaaaactgctttaagcactgtattttcttctctttcttcactttatttagctgcaaactccattatcaataaaatgaaaatagtattgttaagctccccttataaatgaaatcaaagaaagaataagaatgaaaaatgagtgagaacttttttttggagtaaagatcatggtctgtacctgtgcaataaattgctcacatatttcattgtcatttttctcacaattgcttgaagaaaaatactctctgcacacccggatttgggttttcccttgcacaggttggccaaaggtgtacctcatgggggaaggtgtagttatgattacagataagcaatatcatagcaatattttatgatcttcttcagaaattatataggaagtctctaaactgtgagtaacccagtctaaccaaattgaattaggaattctccctattggtgagggtttaggttccccacagaattcaggttaaactgggcatttgatctcaggaggatttggctgcctttaaaaaattgaattcagggtaaggcagaatctaaaataatctaaaatctcattgaatatgatttaatgcttaaattgagttttttaaaaatatattttaatctgatagaaacatcataacattgcagcactttcccttttatcagaaaaatatatatgtatataaaacttggatgattcaggatcctgaaacatttccagatcaacattttaaacacgaatttttatttaccactcaataaatataaaggctatggggctggcatgaactggttatgctttgaccaaaaatataataccttacagggtgggtttgagtatctcattttctcctaaaacacaaaactacaacacaagattttaaaggttcaaccaaaggcaaatccagtcaattggagttttttgttttgttaatagacaacaaatgtaaaactagcatataataaaagtgaatattattttcacagattataatacttttttctaattgttggacactgatatatatcatttatttttcccagtgaccctgatttgtaaaatgaggtcaagtaacttctccacattgtaattaatgaaactaaaattcgaactcagatctacctcactccatagcccgtgcccttttctttccactcacctttttctctttctatttaaaaattcctaacacttttgagattctgagtcaaatcataccaataaaatcatgattatataaaggccagacttagatctggccacacatattatacctgaacatttcttcttatttctacttaatgtcttttatttatacaataaaagtcttattgtagtattatctgtaagctaacatatgcctataagacatgtagcttaaattttaaaaacaggacagaataatccctttgtgatttgaaaagctttcagtgaatgctaatgcagtgtattaaaatctctttgtctgtaggtaaattttcttccctcttaaaagcctaagtcatctctgactttgtttgctaaaataatccaatttttttcttgttttctctagtcattccaagctaaatcccagaaaagactaaagaaacacagacacagtatcatacaatttgagacacagtatacaactgacgtgaaccttctagaaacagtgctctcacaatctgcccagaaataactttgtagcaagcacagctccagtctagctgcctggtctcctggcaagatattattattgctgatactgatttactcctatgtaactctatccagaatacaatatcaaagaaatttcaagaaatcaggatcatggattgtaacctgacatactgctaaggaactaccagttccatgttagcatgtggtttgcaagtattttccaaaggccatgcttgagaaacatttttgttcttccaatgtgttgtgggttttgtttttagcatactatcgtgcagataaataaatgagatgttaatgccactgaaagctctggctttgcgtttggcttttctagtgaaacctgtttagtattctggatttcttccaacttgaatttatcacctcatcatttttaacatcagtgatctacacagtctctcatctattacgtatattaaattctggtattttcaactactcttcattaaaacttagaaaaaaatttataatcatttcctaaagtcaaaagaagatttgaaatgctactgaaaaaaaaaaaagaaggctgaaaactggtttgcaagattctctggggcatcaaaggcatcttaagaaccacgcttgcacgttcattagacagccctttaatcaatgtatctttaatagactgctggaaatactcaaaggcaagtaattttcatgtcataaattaaacaaagtgcttaacaaatatggcaaatattaatattgttaactgtttttataaagtatatgacagttattgattaggagagtagctttgaagctgaaaaacctaggtctaaatcctagttctgccatcaacaagctccattactgttgataagttattttaattctctgtgtcttattatctttctttataaaatacagatgacaatagctcctatctcatagcactgtggtaatgatatatgcagagcttaacaaactagttgacattcaaaaaacatttattttattttttattttattttatttttttctgagacagagtttcactcagttgcccaggctgcagtgaggtggcatgatctcggctcactgcaacctctgcttcctgggtgcaagcaattctcctgcctcagcctccccagtagctgagattactggtgcctgccaccatgcccgtctaattttttgtatttttagtagagacggggtttcgctatgttggccaggctggtctcgatctcctgacctcggatgatccctcccccaccttggcctcccaaaatgctggcattacaggtgtgagccaccgtgcctggccaattgtttataaattattattagaaattcgagaaaaggcactaaaaaagaaaaaaaaattaaaaataattttccaaaaacaaaatacaaatttctgaaatcgtgtattttttttacattaagagaattcaaataattcagattaacttgataagatgctttgtcttcactttgccatttcaatagctcatattctaattttaatgaaaatatgccatgatagtaaagattcaatgagaatttcacaccagctgctagaatcctacactggcacaacatgtttagtgaggagtatggcaatcagaagactaaaagaatgttacatattttgtcttggtaattccttttctggaaatctttcttaagtaaacaatttttcattcaaaagctacctattatatgttatacacaaagacatatactgcaaaattattaattaccaggaaaacaaaatgaaacagccaacatattatataataaaataattaaattgggtatagtcacataaaaatatgtgcagcagaaaattggaattcatgaaaagattggcataatacgtaggcatgttttcttaattattataaatagaaaagtatgattgcagtcatggaaaatattcattaaaattagaggaaacttacaatgttagtgacattacaatgttaatggcagttggtcaaattaataataggtaatgtcttgtgtttttctctatatttttcaaattttctacagtgaggattcattgcttctctaataacattaatgtaagcatataaataattaaagtttcatggttaatctcacttctcattctctctgagctttgtgttttcttgtgaaggtaaatctcctgaagaaatactcacttagcacatacatccacttggaattcatcatctgaaatagttactgtttgtggtgcattgaccgtaacttcaaacttgggcagcactggaaacgaagagaaatatacgttagcctgcacaatcacaggcaagcaaaccttattgcagtcatatagcttactatgattccttgtaccctccatctgtatgagctatgtatcatttgccccaaattgtgtggcaccattctacatggtggtgtctcactaatgattaattcttcctctttcttttcttttccctatcctcagaatttcacattttgtttctttttgtttgtttgtttgagacggagtttcactctgttgcccaggctggagtgcagtggtgcaatcttggctcactgcaacctctgcctacagggttcaagccattctcctgcctcagcctcccgagtagctgggattacaggcatgcacgaccacgctgggctaatttttgtatttttagtagagactgggtttcaccatgttggtgaggctggtctccaactcctgacctcatgatccactcacctcagtctctcaaagtgctgggattacaggcgtgagccaccacacccggcctcacattttctttctattgcaatctcttagatctctcctagaagactgtggggattctagaaaaaatgtatattttctagggggaaaaagaaggcaggaatcagaataaggatactggggaaggagtgaggagcagcaaagtgctgatgacaaagccaaccaggtcaaggaagggagacaaagaaaaccagttctagcttcacctactcctgcctaagtctaacacaaatgttgtgttggtccatcctttaaactcttcatctacataggacagctacaaatagcaactggttaccatatcttttaacagcaaattggtgtgtcactgtcttccttgagtttcttttcacaacaatccagtaatctccaaacattggttctgaaatcagttggaacgagagttgggtaatatttcggaaagaagtcacattttgccattgaaaaatccgattgttttgaggatcctagaaaataatgaaaaaaatataaacaatcagaatttgtatgagagtattaccctttgctgccatatttcggatagtttcggatagtttcacaagggttattttaggccaatattttctcttatgaaacaaacaagtagcttttggtagagcctgtgagggcttaagaaccctaatgtctataaatcttagaggattatacactatgctttggtcatacaaacttgtactgcctttattcttttttctttttttaaagtattgtaattgtacatacttaaaggatacaattggcggggcacagtggctcacacctgtaatcctagcactttgggatgccaaggtgggcagatcactagagccaaggagttcaagaccagcttgggtaatattgtgaaaccccatctctactaaaaatacaaaaattagttgggtatggtggcgtgtgcctctgtaatcccagctacttgggaggctgaggcaggagaatcgcttcaacgtgggaggtgaaggttgcagtgaaccgagatcataccactgcactccagcctgggtgacagagtgagactttgtctcaaaaataaaaaaaaaagtgggggggtacaatttgatgtttcaatacacacacacacacacagacacacacacatatctatatatttagtataatgatcatattggggcagtgttaccagtacttcattcatttatcttttttttttatggtgaagacattcaaaaacctctcatctagctattttgtaatttgctaaatcttactgtaaactattgtcatcctactgtgcaatagaacaccagaactcattccttcttcattcttttcagattaaataaaattttaaaacacttgtagagtgtcagatgtgttccaaggactgatccaagtgctcaaggcacaaaaatgtatatgacatgttcacagcccatattagcttaaaattttaagccactgtgctccttgttattatagtcatataattttcttgcattatggctgcaattcacattctgtaatcagggtatagatgtctaagtaaagtgttggcttaataattgttgttctaatcaaattgaattacacgttaacaaaacttacttaaattttccttgtatatttaattctatctcttcccaggccaagtcaaaaaaaatatgaacccttggaagaattacatctagaagtgaccagtcctagtctaaatatttaaatacataacatgaggaattcaggccaaaagtttattctgataggtctattttttgatgtactaataaaactggccatctctgctatagttttgctaacttgttgcagaagtaatctcaagaagaaaacagccctattagattatgtttaggatggatagttcaatatatattttgccaaaatgttatattgagtttacacaaataaacacacacaagctgtcataataagttcatttagcaactgttttaggatagatttttattctggaagatccataatgaattatattttatatgaagacagggctaccttttgcgtcaatattttgatattgaagagtgctggtacatcaataaagtacttgtatagtaaacaaattaaagatgttttgtgaactagctaggccttgaagactcacagggcttggtgtgtaatactgtcattcttagagataattagctccaggttgttctttctgctggaattgtgaattgcaaatccattcttatcagagtgaaatcagaacttcaaccctaatcaaaattgattggatgaattattgagtgttacaaaagtgatgcaatgaagggccctcatatttttgacattcatttttattagatccttcttatctggagattaggtatgtgagaagctcggagaaataatcttagaagagccaagcagaatttttatatctaaatccatgttacttacatagaatatattgttctttaaatataaaaatctataaatctgtacaagaccaatcgatacaagtaaaaaaaaatgtctgatcctgcttgaagtaaattatcaaagccatctacgttgagagatgaaatgtattacgtctctcctgctaacttgaggagtaaaggaatttactaaaaagttactaggatgtttttattccttttctttttttttcttgcagtgaagcctgtagatccttaagattctttaccagttgtgtggtcttaatttcacaaattgaggaatctgatccatagatggttccacttgaacgtggtgggagggtaacattctccttccatgaaatgtaaagactgcattgtgggacatggaggggctccatgagatccatttagttgcattcatcctcctgtccccaaagtatatcagtaaatgtactgtttcttgacagtttggctgtgttatcccagaggactggatgtgggaatctccaaatggccagataatactctcagcttccaattcagtgaaactattcttaagcatgttaatgaaaatatacttctttcctggatcctaaaaggtctaaatgaaaacaactcctattcctgaggatggaaaacaagtattctgcaaaagccactaccaatccgtaccttggttcccagacatatctctagaagagacagaaacaagccctttaatataatttcattcctcaacttccttggaattagtcccttaatgtgtcttgttctaaatccctgatcatcttgccacacatttgttaaggcttataaaagagtgtacatctttacctcaggccatttgtagacttgtcatatactttggtaatttcccaacatatgcgtttcacttccagtaaagaagttagaagactccattcccagattaccttgaatccagggggcaggtaaatgacaggctcgaccaatgagatgctctgttctgagactgggaatcagaagggagtgaaatggggaggccatggaagagtttattttcagggaactgtgagtataatggcaacttctagttcatttaggataagataggcagaaccttttcacatccactccaatgtgtttattccacacacgaggagccacagtgggaattctgatcattgctagacttgtcaattatacctacacatttggaaaatgaataaataaccagaagatggatctggtctctgttagtcctacaatgaagacaatttggccccaaattctggttattcctgatagtcataatctttgcctctcatctcagatgttattagtgaggtaatattcagtattttatagaatatttagatatttatctttccaggagctcatgtgctttggtaatgaggcagaatgtctttgagaaagataggagtgagaccttagggatgggtgtctgcctaactgaagtggactccaatgaaaattatataaatatcaaggcatgaaaattcagcactccctatcacgcactggtgaaaaagataatcaaataatctcctgttcaccattgacaaagtgcctattgacagcaagcatttggggaccacaaatttccactgctatggaacgataccaggctgatcacttctaagagttctgagaaaattaaagaaaagaaaaacaagctaggaactttaaattagcccttaccatccggagttctgtaacagaattatctctaagtctccaatacagctactgaatgtaatgaattaatattacatttattgatgcataaatagtaccattctctcctatgtatcctgaatggtactatttatgcatcaaatggtctctcgaaacattctctgtggagttaaacaataaagcaattttcttatataacagttgagaaaggttgctctaaatttttggttgaagatatacattgaaaagtgagtactttcaatttttatgttaaaactctcatttattgcagagcagttctgtaatcaaaatgcctcattattgtatgtgcttagatagaggctgataatttacctgtgagggattttttaaaaaattactgactgtggaggggaggagccaagatggccgaataggaacagctctggtctacagctcccagcttgagcgacacagaagacggtgatttctgcctttccatctgaggtaccgggttcatctcactagggagtgccagacagtgggcgcaggtcagtgggtgcgcgcaccgtgcgccagccaaagcagggcgaggcattgcctcacttgggaagcgcaaggggtcagggagttccctttccgagtcgaagaaaggggtgacggagggcacctggaaaatcgggtcactcccacccgaatactgggcttttccgacgggcttaaaaaacggtgcaccacgagattatatcccgcacctggcttggagggtcctaccccacggagtctcgctggttgctagcacagcagtctgagatcaaactgcaaggcggcagcgaggctgggggaggggcgcccgccattgcccaggcttgcttaggtaaacaaagcagccgggaagctcgaactgggtggagcccaccacagctcaaggaggcctgcctgcctctgtaggctccacctctgggggcagggcacagacaaacaaaaagacaacagtaacctctgcagacttaaatgtccctgtctgacagctttgaagagagcagtggttctcccagcatgcggctggagatctgagaacgggcagactgcctcctcaagtgggtccctgacccctgacccctgagcagcctaactgggaggcaccccccagcaggggcacactgacacctcacacggcagggtattccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaaacagaacagaaaaactggaaactctaaaaagcagagcgcctctcctcctccaaaggaatgcagttcctcaccggcaacggaacaaagctggatggagaatgactttgacgagctgagagaagaaggcttcagatgatcaaattactctgagctacaggaggacattcaaaccaaagggaaagaagttgaaaacttggaagaaaatttagaagaatgcataactagaataaccaatacagagaagtgcttaaaggagctgatggagctgaaaaccaaggctcgagatctacgtgaagaatgcagaagcctcaggagctgatgcgatcaactggaagaaagggtatcagcgatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgatggggaaaatagaaccaagttggaaaacactctgcaggatattatccaggagaacttccccaatctagcaaggcaggccaacgttcagattcaggaaatacagagaacgccacaaagatactccccgagaagagcaactccaagacacataattctcagattcaccaaagttgaaatgaaggaagaaatgttaagggcagccagagagaaaggtagggttaccctcaaagggaagcccatcagactaacagcggatctctcggcagaaaccctacaagccagaagagagtgggggccaatattcaacattcttaaagacaagaattttcaacccagaatttcatatccagccaaactaagcttcataagcaaaggagaaataaaatactttacagacaagcaaatgctgagagattttgtcaccaccaggcctgccctaaaagagctcctgaaggaagcgctaaacatggaaaggaacaaccggtaccagccgctgcaaaatcatgccaaaatgtaaagaccatcaagactaggaagaaactgcatcaactaacgagcaaaataaccagctaacatcataatgacaggatcaaattcacacataacaatattaactttaaatgtaaatggactaaatgctccaattaaaagacacacactggcaaattggataaagagtcaagacccatcagtgtgctgtattcaggaaacccatctcatgtgcagagacacacataggttcaaaataaaaggatggaggaagatctaccaagccaatggaaaacaaaaaaaggcaggggttgcaatactagtctctgataaaacagactttaaaccaacaaagatcaaaagagacaaagaaggccattacataatgggaaagggatcaattcaacatgaagagctaactatcctaaatatatatgcacccaatacaggagcaccaagattcataaagcaagtcctgagtgacctacaaagagacttagactcccacacattaataatgggagactttaacaccccactgtcaacattagacagatcaatgagacagaaagtcaacaaggatacccaggaattgaactcagctctgcacggacctaatagacatctacagaactctccaccccaaatcaacagaatatacatttttttcagcaccacaccacacctattccaaaattgaccacatacttagaagtaaagctctcctcagcaaatgtaaaagaacagaaattataacaaactatctctcagaccacagtgcaataaaactagaactcaggattaagaacttcactcaaaaccactcaactacatggaaactgaacaacctgctcctgaatgactactgggtacataacgaaatgaaggcagaaataaagatgttctttgaaaccaatgagaacaaagacacaacataccagaatctctgggacacattcaaagcagtgtgtacagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgatagaccgctagcaagactaataaagaaaaaaagagagaagaatcaaatagacgcaataaaaaatgataaaggggatatcaccaccgatcccacagaaatacaaactaccatcagagaatactacaaacacctctacgcaaataaactagaaaatctagaagaaatggataaattccttgacatatacactctcccaagactaaaccaggaagaatttgaatctctgaatagaccaataacaggagctgaaattgtggcaataatcaatagcttaccaacgaaaaagagtccaggaccagatggattcacagccgaattctaccagaggtacaaggaggaactggtaccattacttctgaaactattctaatcaatagaaaaagagggaatcctccctaactcattttatgaggccagcatcatcctgataccaaagccgggcagagacacaaccaaaaaagtgaattttagaccaacatccttgatgaacattgatgcaaaaatcctctataaaatactggcaaaccgaatccagcagcacatcaaaaagcttatccaccatgatcaagtgggcttcatccctgggatgcaaggctggttcaatatatgcaaatcaataaatgtaatccagcatataaacagaatcaaagacaaaaaccacatgattatctcaatagatgcagaaaaggcctttgacaaaattcaacaacccttcatgctaaaaactctcaataaatcaggtattgatgggacgtatctcaaaatcataagagctatctatgcaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagacgatatgattgtttatctagaaaaccccattgtctcagcccaaaatctccttaagctgataagcaacttcagcaaagtctcaggatacaaaatcaatgtacaaaaatcacaagcattcttatacaccaacaacagacaaacagccaaatcatgagtgaactcccattcacaattgcttcaaagagaataaaatacctaggaatccaacttccaagggatgtgaaggacctcttccaggagaactacaaaccactgctcaaggaaataaaagaggatacaaacaaatggaagaacattccatgctcatgggtaggaagaatcaatatcgtgaaaatggccatactgcccaaggtaatttacagattcaatgccatccccatcaagctaagaatgactttcttcacagaattggaaaaaacgactttaaagctcatatggaaccaaaaaagagcctgcatcgccaagtcaatcctgagccaaaagaacaaagctggaggcatcacactacctgacttcaaactatactacaaggctacagtaaccaaaacagcatggtactggtaccaaaacagagatatagaccaatggaacagaacagagccctcagaaataacaccgcatatctacaactatctgatctttgacaaacctgagaaaaacaagcaatggggaaaggattccctatttaataaatggtgctgggaaaactggctagccatatgtagaaagctgaaactggatcccctccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagccaaaattgacaaatgggacctaattaaactaaagagcttctgcacagcaaaagaaactaccatcagagtgaacaggcaacctacaaaatgggagaaaatttttgcaacctactcatctgacaaagggctaatatccagaatctacaatgaactccaacaaatttacaagaaaaaaacaaacaaccccaacaaaaagtgcgcaaaggacatgaacagacacttctcaaaagaagacatttatgcagccaaaaaacacatgaaaaaatgctcatcatcactggccatcagagaaatgccaatcaaaaccacaatgagataccatctcacaccagttagaatggcgatcattaaaaagtcaggaaacaacaggtgctggagaggatgtggagaaataggaacacttttacactgctggtgggactgtaaactagttcaaccattgtggaagtcagtgtggcgattcctcagggatctagaactagcaataacatttgacccagccatcccattactgggtatatacccaaaggactataaatcatgctgctataaagacacatgcacacgtatgtttattgcggcattattcacaatagcaaagacttggaaccaagccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcacaataacaaaaaaccaaacactgcatattctcactcgtaggtgggaactgaacaatgagaacacatggacacaggaaggggaacatcacactctggggactgttgtggggtcaggggcggggggagagatagcattgggagatatacctaatgctagatgacgagttagtgggtgcagtgcaccagcatggcacatgtatacatatgtaactaacctgcacattgtgcacatgtaccctaaaacttaaagtacaataataataaaaaaaaaataaaaataaaataaaatagcgtcctgatgttctgctcttttcctttatcttgttttattttccttacagtagttctttgagagatagtaactcacgatagagaaacatggtctttgggatcagaacgtctggattataatcccatctctgttatttagcatctgttgcattggacaagttacttaacctgcctaagcttcatttttctcattgataagttgcagttaatagcttccaatctatagactgtgatgaataaatgggttgacatttgtaaaatgcttagaatgttgcttggtatgtagcaataattcaggaaagattaactatcagagcacttaataccatctgaaattatgccattgatatagtttgaatatttgtcccctcaaatctcaggttgaactgttatccccagtgttggaggtggggcctggcaggaagtgtttgggtcatgggggcagacccttcattgcttggtgctgttcttgcaatggtgagtgacttcttgtgagatctgattgtttaaaagtatgtgatgcctctcctcttcttgctcccatactggccacgtgagacacttgctcccccttgtctttcaccacgactgtaagttttctgaggcctccccagaaaccgagcagatgccagcaccatgtttgctgcacagcctgcaaaaccgtgagccagtttaacctattttcttccttttttttttttttgaaaaggagtttcactcttgttgcccaagctggagtgcaatggcacaatcttggctcactgcaacctctgcctcctgggttcaagtgattcttctgcctcagcctcccgagtagctgggattagaggcatgcaccaccacgcctggctaattttttgtatttttagtagaaacagggtttcaacatgttacccgggcttgtctcaaactcctgacctcaggtgatctgcctgcctcagcctcccaaagtgctgggattataggtgtgagccaccgcacttggcccctattttctttgtaaattacccagcctcaagtatttctttacagcaacacaagaaatatacaaatgacaatatgcagccatttgtatattgtctgcatcccaaattcaatgtaaacttcacgaatataaagatttacctgcattattctcactgtatttctaacatctgacatgacaggcacattaaatgaattaaaagacaaagcaaaagaaaataatcacctcccctcttttcccaatcagtttaaaagcattaagagattataacctgtcacctgcccttcgcattatactgtgacttacctaagggtatgtaatcagtagattcaagatggttagaatccttgcacaatactggtttccggaggtgagagttggtaaaaatctttaatcctgttgcctttcaagataaaatcaattttagatcacataacaacatagactagcagtctggactggttttttgttctatgtatattttcaatttccacttatttatttctccatctctaattgtcatatatttagagatacttcactgacatttcctaaattccatgtctttgagttccttagtttctctaattctaatggcttttgctctattttcctaattaagagctgttgatgaaaacctttaaataagagaggacaaaaaaagacatctcatatcataccccactgtactttcactactttgaatttggcatttttgttgaactagggatattatctcacttataaacactttaaatatagtagaatactttaaaatagtagaaatcaaattcgagggtagacgtaggagcaaaatggggatttatattagacaccagtatataatgtacataatattatgtcaggaaagctgataattccctcacatattagttcttttcctaatattataatattattagttatttaaaatattattatagttttataatgaagttctaataaccttataacttaaccttattataacattataataaccttataactttataattataactttataacttttaaataaaattatattaatacaacttttaaaaatatattataactataatttattgtaactatatagaataactattatagctttataatattataactattatataattataactataagaactttattaagtctttttgctattataacattatttgagatattatttctcagacattagtactaattgtaaatttgtactctaagaattctgagattaaaaacccacaccatgaatatttctatttatttatatattgtcacatatattcaccattttaagacttagttgccttaccttcacaaggtcatagccatcttttccaaagtcagcccatgcaggtgtgtaataaattccattgtaaaggatatgtccatcttcaagacacggcactttaaggccatcttctaagttaagtcctctgaaataatagccatgtagttcgctggaatgtagctgactatacacctagatgttagaagagaatcaactgtattttttcatagaaaacaattcatttttccccacaagcagtatataaataacctatataatcctatgaatatcctgtgtagaactgtcatcatacctataccaaataaacacatattgagaaagtataggatcttagatctgtaaaaactttgaaatactatttaatcagttaaataactgctggctaaatcacattaaaactaacaaaaagtccatgaggctcaactggattttaatacattccagataaaggcactgctcaatactctttgaggactcattcaaggacattgttagagaatgttctcggttaatttactaaatctccctgagcctaagattagacattaatcaaaatgggaatactgcattagttctatagggttgattaatatgagaataaaattaaataatagatatgggaatactcagtagagcaagtgtcaaatagtagacctttagcaattgttatttatttttaaaagtgttgctcattttttccataagagaatcagtataattggagtagagtcattgtacatgatttctaacctaaaatattttttatgcctggaactctggacaatttttttctcctctagtttatttaaggtatcctgtttttatccaaaggtaaagacataaaactatactgtgggtggtaaacaaagatggttttaatcactcacagtttgtgctggcagctgaccataattccttagtagcaataccctctggtctaccgcccaaagagcataaagagagtttgaagcagccgagacttgaagatcgacattggatcctggtaaacttttttctttagaaaaatttaagttgacctgaaaatgaaaataaaagggcaaaaggatggcaagccatatgagaagaatcatcttttagactattcttaacttttttaaaaacacacataagttaaaagggctttctgtgctttacccacctaataatattattattaggaacaactggatttggaacaacatccaaagtgaatgctataatcctgctactcttcaatcatccaacatattaacttctccatagctttcttttatttttcattttgcaattctatgaaaaattgggagtttaaacccaacactctcttaagttctccttagttttcccccaaattaaaaaagaatcatttttggcacctacctgattttcgaagcatttctcaattggaattgggtgctatcagtgaccatttctcctccaggatgcaagctatagacaagcatatgtactgagggcgctaattcagggttaatgtctatagaaatggaaaatatgcccttcctccctgtgaaaagaaaatttcaaaccgaaaaagtgctttggtgagatagctgactgtcatcttgcagaaaccctccattgagtttctagccatcctacccactgccaaagagactgccccgacccaccaaatttaatttataaagcatttctaggaggagttcataacctattccataaattataaaagaaagaaatagttgaacatttcttattacgtcaaacttcagtctacttttgtttctttttaaaaatcccttcttgtttgaatgtaaaagtacttacctgtctttcttggaaaagaaagggaaggacaatgaccctttcccattatagtagtgtttggaatataattaatgcactattaattaagtaattattttttcatttggcattgtgcctattcacatgtctttacatgttccccaagggtagtttagggggcagtaaacagtcctaaaatgggaggattgtgacttttaaagaaaaatgtaaaatatatcccaattaaagcattctatttgtattaaattatatgctaaaattagaggcctcaccattttcgttgatctcaattttctgttgcccatgaagaatgattacaccttttgaaatcacctaggaaaatgaaaatataatcgtaaagtttagaggatagaaactaaatttcatttaattataaacgaatgtgatttacctccttttcttgtctgagcaatactattgacatgtttactagtaaactcaggttaccagtaaacaagcatatgactctaacagctatattcaagagaatttaggagtcacagataaacttgctataaagcaatttaatgttccacattccaaaacagttttctaagaccaataaacaactttttattcatatttgcaaatgctgaattacatctaaatttatttagttcagtgaaacaaagttacacaaaggcattaagagtctcccagtgcttgtctggttttctgaaaggtgtgtttgatatgcaaggtataagcaaggcctgttcatccatctccacccaaaatttaaagaaaagaaaataaagtagcaagctgggggtgctccagaaaaaagcttctctcacttcacctttatcagcaactgtgtgcaaatttgcatcagcagacttttgttatgatctctaaagtgcaaacaaaggctggagacttgaaatctagtacaaactccttgaatttttaaattacagttttagaatattattttaaaagatgctgagacttgcagaaaatttaaagcttccgtaagatcttgcagcttgaaattgcaggagctggtactcctagtccgtttaatatttcactgaatattaaaattgctttaaatctctgaagtgccaagtttgggttattagctcataaaaaaagaactgagcctcaactagctggaaaatattgttttgggaactagaacatttgcaaaaaggcataaagctcaaagtttaatgagcctgagaggtctcagcactgttggctgtagtagctcactgacttctcaaaatggaaagacagctctcgtaacagatgagtaaactgaagaggcacacagaggtactgatatttgtcaggtcacacaattaagaaaaaagcttaaaagactgagtatcaaattaattactgaaagcctgagaatcaaattaattcagcctctatccattcattctaaaatatgatattgagggttctctctgtgatgtgtaccctgctaggcagaattaaagtccacccagcctattatgaaagaatatgtagaagactggaattgtctaggagattagaaagtttcatttaagccaagagatgaatgctgaggaggaatcagctcggaaaatgaggtgcaggcaggttgggaactgtggtagcaaatgggaacgaagattgttatgggcagaagggaaaacctgtgggaggcttcggagccagaaaagcacatggcttgtccaagaaaatgaaagccctctgtgtctgcaataaagaaggctgaagtgtagaatgatgcaaaatgaagcgggcgagcttcacaggtgcagagcagatacagtgttgcaggcaaaagaaaggagtctggtatttgtttcaatagaaataggcagtcattaactgtatttcaattaggggagtgaaataaataatcctaattgctttttttaaaaatcactctagatttccagaataaagaaagaaagaagaaaaggagggaggaaggaagaagggagagaggaagaaaaaggctattagcagactcatttaaaatggaaatgaggtaaagtaattgtaaaggccttatcagatcagaggggggcaaacctacgctatttcaagagggaagctgatgacaagtagatcaattcacaccacagacctgcaaaatggctcagctctggattaggaagtattggatattaagtcgagcagaggtgtggccagaaaagaaggcaaaagtcaggggcatgtgggagtgtctttataaaaactagttaagaggttcagcttccctgtaatcccggtactttgggaggccgaggcgggcagatcacgaggtcaggagatcgcgaccatcctggctaacacggtgaaaccccgtctctactaaaaaaatacaaaaaaattagccgggcgtggtggcgggcgcctgtagtcccagctactcgggaggccgaggcaggagcatgccgtgaacccaggacgcggagctttcagtgagcggagatcgagccactgcactccagcctgggcgactgagcgaggctctgtctcaaaaaaaaaaaaaaaaaaaagaggttcagcttctcattcaaggatgcttggtatttctcacaccccagtatggcaatattattgttgacatgttgaaggatttctgtaccggttggtaaagagccacttccctgagctccccagagtcccctccctgcttccctagaacctctcctccacaaccagctcctcccactcccaccactttgcccccagtctaaatgagccatgcttggcttagctaagggcttcagtggaattatcactcataccttttctgatggtttggtgtccataccttgctggtttgaaatattttaatgtttgtggaaatgatgaaggaaagaaaaaatgcgagagataatataatgaaaaagtgatagaaattggtgatgcagtaaatagcacgaaaaaaagaagtatcaaaagactattccagaattctaagtttgcaaaatgtgagaaatcatgtggtactactttcattcttcacatagatagactcaaacacctttagttctcagaataatacacttcagacatctttgacctcttatattatttcctaaaataagcttaaatgtgtttctcatatcctctaatcatccagaaaactcctattcatcccacaaaatcctatttaggcatattctctttatgtattttttccttaaaaatatgtatatacatataaatgtaaatatataggcatatatctttttcctaaactagtggttgtcaaattttaatgtgcttcggaggacaagatttctaacttattcctatgttttttttttttttttttttttttttttttgagacagagtcttgctctgtcacccaggttggagtgcagtggcaccatcacggctcactgcaagctccgcctgctgggttcacaccattctcctgcctcagcctcctgagtagctgggactacaggcgcccgccaccatgccaggctgatttctttttgtatttttagtggagacgcggtttcaccgtgttagccaggatggtctggatctcctgacctcgtgatccgcccatctcggccccccaaagtgctgggattacaggcgtgagcccctgcgcctggccacttattcccagaatttctaaattattcctaggtgatgctgatactgctactctaggaaatatactctgataatcactgtcctaaactccagctagagttaatcattcatttttctgtaacacctcagtggccatacatgtttcgtttgtaacacttatgtaattctaatatatgttttgtccccagttatactttttctatttcttctattgttacaattgctaatacagcacctggaatatgaaaaacattcaataagtgttggctgattgaattaattcatgtttcattaattttatatcatcttcctaaatctcaatgaagtatcatgcacccatttagacagtgtaaaataatccataatagcaatatattaaaatcaaactaatacttaatatcttttgtgtgccagaagttgggcaaagggctttatatgtattattaaataattatcttgatgattagacaatatattacaaaaaactaagattctctagaggtttaagtggctttcaaaaagtaacacaaagctagtacatatcagaactctggtttgatcccagcaatgtccaaatagaaatgggtaactctgaagaaagggtctgagaatgacagagtgcatatgggttgtggtgtcatggccttttccctcctttcttaaaaatagataccagttatataagttttatcatttatgttaactttgagcttcctcgtggcatataggtacagggatttcattaggttcaaagaagttttaaagaaaagaagcaattttgattgtggaagaatattttcagctcataccaaataattgaagtctgctgtgtaggttttgtcttcaaagtcttccatattgagaatgcagtgcactagcaccctcttctgctggttgcatctcagttcttccatctcttggacaatctttaggaagctattcatcttggagtaaaatcgatatgcaaagtactcgggctgagggtattgaggcaacacccagccatgagcctggcaattttcattggccttgtaggctgcctagacaaaaaatcaaaattacgggtattttaggataaagagaaaggatgagtgaaagaatatttgataagatggtttatcatcatgctgctttatctctgcaagaaaattttatagccattctacattaaatctaacccaattccccattttctagttatactctagagcgaccactatggtttttacaatttagtctattcaagtcctacttcaataatattacattcaatattttactgtattctttactataattattacttttgctagcaagtagattgctatatctccctcactataatacgaagaacccatgagtgcaaacgtttaccttgctactgataacataatatgaagttttgctgaaagatgggaaagtttttatgaaatacagcaaggagtttactctgaccatagtaatttaccattatcaacacaaaaagtctgaggagtcctttaaaaatatctaggaaggattgatatttaattattacagatagtagtttacttctctcttgaatatatccagagaaattctttacattattccaaggtaatagattacagggtttctcaaatatttccttctataaaaacacaattctctttctatttccttaataaaagtgaagcgttgcttattttcagctaattctcctttatacaatttagtatgtatgctaaccttctgtcttttcccgggactcttaaaataatttttaacctacttttcatagggcctatattcttaatatttaactatttttcagtactctagattcacaccaaggtgtatcttttcatttctgttccataaatataatttcgcatagacctaaaccttagctagccagtgcagttttttgtttgcttgtttgtttttattttacttgcctttcgtttaacttactttcaaagtgatatttgggtatgtaaacgtatatgtgtccaagaaaaactgagcgatgccatttacatctgtggtgtagtttcccacgattttgtccttcagatgcaactgaacaacttcatttgggattggagagttgtctggattaagcaatttaatctgtacaagaggaagaaaatacatttcggaagcatgtagtaaatttgggcatccattttgatggcatttgccaagcttctatcatggggacccctgctctccttggtgcgtatgcacttcctgtgtggtttcatctattcctgttgagtgtatgacatgtaccattaatatactaatgagcctaaactctgtttctcctgcccacgaagatctctgaaaactcaggcccatagaattaaccatcctgagtattttttataataaaaatgctacagaaactctcaaattggaatgatttattactgtgcccaaccttcctttttttctatttctcttatttatctcaaagaatacctcaaccattcacttagtcactgaagtcaaatatctagagacatcttagactttttatttttcttctcccataattttcaattgttgatcaaatattttcaattgtatctttttaacattttctgtttccaactgatcacgtttgttcctgttgctattccttgtatcaatatcttatcttttttccctcatacgtcttctatttttttctatccagtctctctctcctgtattgcttttgcttgttctttctctatactggcatcaaaccaaattttctaaaatgcaaaatttagcattatcctccctaaaacattgtagtgactgctctgataggccatggttattcgctagaaatctctttctcattctcttactagtacaggcaatgattgctttaaaaagtcccttctgaaattgtatgatttgtagtagatacaatgcctgcatcagtatctatgccagtttgaagcctttaaaggcaccttcttaacaacatctaaggccacaacaaccagaagaactgtctgagccatcctttttttagctcagtcagtttctgcaaaacaacttctgctttgagcctttcatcttatttctgccacttatcattttcctgctggtccaagcaaacacaatccttttttcttgctcagcatctgtagactgatgcctcatttgcaccatctacacagattttgaacttagtttcatctcaaggcttgatcttctaagaaaaattcaacttgtctcagcaatccacaggccacagacacgtgacaccatgcctttatgatcacacagaggtttgccctaattttagtacacctagactagaaagatcctttgagtcccttccagtcacagaaagatgaacaagccatgtgatttctgggcactttcctttctttctttttttttttttttgttttatttttattttttttattgatcattcttgggtgtttctcgcagagggggatttggcagggtcacaggacaatagtggagggaaggtcagcagataaacaagtgaacaaaggtctctggttttcctaggcagaggaccctgcggccttccttagtgtttgtgtccctgggtacttgagattagggagtggtgatgactcttaaggagcacgctgccttcaagcatctgtttaacaaagcacatcttgcaccgcccttaatccattcaaccctgagtggatacagcacatgtttcagagagcacagggttgggggtaaggtcaccgatcaacaggatcccaaggcagaagaatttttcttagtacagaacaaaatgaaaagtctcccatgtctacctctttctacacagacatggcaaccatccgatttctcaatcttttccccacctttcccccctttctattctacaaaaccgccattgtcatcctggcccgttctcaatgagctgttgggtacacctcccagacggggtggtggccgggcagaggggctcctcacttcccagtaggggcggccgggcagaggcgcccctcacctcccggacggggctctgatgttagggcttaaattgatttatatttcaaagaattccctaatagattctatagtagcactgaagagtattctattgtaaaactcagaggaaagcaaatgtaattttctttgaacatgaaaaagaaagcaactttgagagtagtcatttagcagtagatgtgcattattatgagaaaacagttctataaattcagggttaattctattaattggaatgtcggtctctaatgtctagcttattatagggtagaaaagagctttctactcagctaatcattaatcattgatccaaaacttaaatacatctatcatttcctggggctattgtgagtactgtatatgtatttagcaaatatttaagacctagtaagtgctcaataaattgtagctgttactacaaaagaaaaaattactttttaaaaaaatatacaaccataatcacacatactagagaagaaaacttaaaactctaagtaattcttaggtaaaaataaaaataaaaataatgaaatcatcaaaaatgattttaattgaacttaaaaattgttaagatggtaaatttgatatgtgcattttttcataatttaaaaaataaaaatagtatagaaaaacacctgtgaggaggaaagaagtattcaggaaaaattgtataaatctgaaaacatggaagtttaacataagtatttataacaagatgctagaaaaaaaaaaccaaaagaggtagaagaaaaaatataataaaaataaatgatgtaatgaaaatcatttaaaataacattaaaaataaagataattaacaaatccaaaaactaatgggaaaaaaacacaaacacaactagtaataaaaaaggggaaataaattatgatagatttattttttcaaatcataagtgaacatattttatgccctctattttaaaacctaaatttaataagaaatatctagatacagaaactaacatattatagaaaattcttagtgaactaaaaaaggaaaattttttgactcgataaagtatgtctcacaaaatgctacagttacttagtaggtttacgcattacatttttaaaagcattccccaaaatatgcaaaatacaaccaggaagtccactatcatctctaatattcaaattggagatctttgccaatcgaataaaacaaactaataacaaaaacctcagaagattaagttcagaaaggaagctaaaatataacattttcacacaaaatgctctttacacagaaaacacttttaaattgcacagaaaagatacaagagacaaatgggaacccaagaaatcatcttgggtaacaacaacgtaagagggaggaaatggagaattctcaagtctagataaaattattttatattcagaaaaaattttatattctttgaagatatctctcagttttatatatttagtaacagaacatggaaatatataaagcaaaaatgtacaaagtgaagagaaaggttagaaaaaattatgttaacattatccaccactattcagtaagtgaagtgaacatatatcaaatttatctatctgccaaagctgtatttcaatctaaatttgttcattaaatgacttttactgaaatttgtttcagtaagtcctttaggtgatgctgatgccagtttgagaaactgctttgtaagatgtaagccaggctacccacttttgtatttcttttttagtgttcttgtgtcaacctaaatattacttcctcagggaaactttccatgatcatttagtccagattttagcaaacttcttttgtaaaacaccatggtctctctctcatatatttttttattttttaaataatcttttaaaaatgttaaaaccactcatagttcactggctgtatcaaggcaggcctctgtctgatttgcctatgggctgtggtttgtcagctcctgatgtagagtagttaaatggtcagtatttcactgacatagcacctatcacaactacaataattctttgtaaaattatctgtttaatgtttattatctctattacactataaactccataaaagcagtgataaaagtgcctctctacatcaccattttattcctaatactgatatagactatataatttattgtccaaacttggacacttttagagtgaagtggttgtaactattaacagttacaacttgataaaacatatacaccaggacagatctatgaaaatcaacagtgtaggtcaccctacagtgcttagcacagagattcctacatagtaatttcttagggaatagctgttggaagattagtagataaatgaaagaacaaatgaatgaatgaataaggtatgtaaaaaatgattgctttctaacctggccaaaataagggagtccctgtttgtaggacatatccatattctcaaaactaatcttcaccactgatgagtctatgtatacgtacttggagcctgtaagctgcacacctgcagtcaattaagtattattgagaaaatgtcacttccaaaaacagacaaacagagcttctgaaaaaaaccacaaaagctcaccattccttctaatagtttcccttccctttcctaagcagttttaatatgtaggtacttcagatgtcttttataaagaaagttaatcaagatggcacaaaatgcttgtgccaactggtgttgctgctttttataaaatatccaattcacttaccatttcttcatgatggattagtaaacgttgatttctcattattcctaagtgattgtttaacaacatttcttttactctctgcttgcctaaaacatatgctttaatttattaatagtaagaattgtaatatatgtgtattattaaaaatggaaatgcttaaaaaagaaaatacaaattaccaaatatcagatatctccaagagaaccaaaattagcattttaggctttttcccacaagttctatttctctttatatttatcatttatattaatatgtttgagattgtgtgtgtatatgtgtacatgcacacatacactcaatatgtgcaaatgtatatgtagttttacatgttttttatcattattttataaagtttttgtaaaaccttataaaaacttatttttaattgctacattatttctcatataaatatggacatatgttatcatgtagcaagcccttccctccttccttcctgccttccttcctttccttccttctctttcttccttccttcctttctttctttttctttctttctctctcttcctttctttctctctctttctctctctctctctttctctctctctttctttttcttttttttttcttgagatagggtctcattctgttgcccaggctggagtgcagtggtgcgatcatggctcactgcagccccaacctcctgggctcaagtgattctcccaccttagcctcctgagtagctgggattacagctgcatgacacaacacccagctaattttgtattgtttgtagagacggggtctcactatgttgccaccgaggatggtctcaaactcctaggctcaaataattcttctgcctcagcctccccaggtgctggggttataggtgtgagccactgtgcctggctattcttttattatttatttagttcagtatgacaaatatacctaattatcaattaaatgtttgtttaatacttgaatttcctctggatgtgacagatacctctaaaactttgaagactgatataagtacattagtaatttaatatttcaggaacagaaattttgctgaaatatcagttacatatgcgtaagtttaaaagtactacagtaacacaaagtggtcagcacagaaaaaagcatttcaaggattaagacttaccattttgtgctttaggaagaaggggtattaggtccaggagatacaagaaattagtcattagaaatattattggccgggcgaggtggctcacgactgtaatccacgcactttgggaggccgaggcgggaggatcacctgaggtcaggagtttgagactagcctggacaacatgatgaaaccccgtctctctactaaaaatgcaaaaacctagtcgggcgtgatggcgggcgcctgtaatcccagctactcgggaggctgaggcggaagaatcgcttgaacctggcgggcggaggtcgcagtgagctaagattacgccaccgcactctagcctgggcaacaagagcgaaactccgaaaaagaaaaagaaggaagggaggaagggagggagggagggagggagtggggagggagacagattttcctggatgagataaagatttttcactggatttattttcagaggcttagtaaaatattctccccaaactattttacttcccatgttctaattctatgctcaccaaaaaaattttataatcgacaactacatgtctcaattatatttatctgtggaatgattaaggaaaaggaatatgcttatatctaaaaccagatactcccattataaatcaataaattggcattcttacttctattgtagccttatttgaatgtaacacttgaccatccatcaacatgtgtgtgaaaattttggttgatatatgaaacattcagaatttgaatcagatgaacccaatgaaaagccctcagggaaaaaatgattgtattgacattgtatagttggcaatcaggtaacaattcgaatgagacagtgatatccattggggtctggcttcttagagagcattacctgttccgtcctctgtaacaagagcatgcactttgaggaaactccagtatccttcccgatttcactcaaaagcatctgtgttaataaacttggagacacagccatctttccccaactgaaaagaacaataaaaaaaagttatattgtaaaggaagactgtaagaaatagctataatagggaaaatgtgtgacctcactgaagcaactttaagaatattgtattacccaagttttagttttttaaaataatccattgtgtttctataattatattttcagttcatgtatttacctataactatttattttttaataaatattaactcttacaatattgtgttttaaaaaactcttcatggtgacattattttgttattatacaagataataaacacatccatcactagtcacgtattcacacatgatatttgcaattttggtaatttcagccatattcttttacagttttgaaactgagttttatattatttagttaccatgccttggacatttatgggactatttacacagcagttaggaacacaggctttacagtcaaacaccagaatttgaaccctggctttaccacttattacttcatacaaaatgaaatcttaataaagagcttgtagaactgtattacattagacaataactggaaagtgtttatttagcacagggcctggcacttagtaaacattcagtaggtagtagatttttaaattagattcctttacatttctctcagtgtctagtcaagtgacaatgtctcactaagtgaaatttttaaagtgtcacaattagtaaccaaaattaaacaggatgaattgtcaaatatttttaaaatgtgggataaattgtgctcataggttcctggactttaatattggggaaaaactgatttcttattctactccttcatcttatgatgatatgaggaaatctagtcctcaagatgtgggtgagatgtcaaaatcctgtgctacttcagggggtccttgaaactataagaaggtctagaaccatttccagaagcttaaagatctagaaaaatttccactatactaaaggtgaataatgagataaattatttagtccacactcctgctttacatgtgcatttgattattttaacttttattttaggttcaagggtgcctgtgcaggtttgttatataggtaaattgtgtgtcatgggggtttggtgtacagattatttcactatccaggtaataagcatagtatccaataggtagtttttttgatcctcaccccttcccaccctacatgtacattttaaatttccagagctctcaaatctcctgaagggcatcctataatatagccaccttcgataatgcattctgggatctacctaccctgtgcactcggcttatattggtttagtctcttctagagtgtgcatctttaaagattatgactgcttcataaagtgcaaaacccatgaggatagtacctgatctgtcttgctcaacaatgaagcttctaaataaaattattcttgcatattaaaagacctcaatatttatctgttgaatgaatttgtggagaaaatttttgtatccctgatatccctaaagatacagccccactagttatttaaatatttatatgacttggttggggtgcagtggctgacacctgtaaccccagcactttgggagaccgaagcgggcagatcacatgagatcaggagttcaagaccaggctggccaacatggtgaaaccccgtctctattaaaaatacaaaattagctgggcgtggtggtgcacgcctgtagtcccagcttcttgggaggttgaggcacgagaattgcttgaacccgggaggcagaggttgcggtaagccaatatcgcgccactgcactccagcatgggcgacacagtgagactgtctaaaaatatatatgtattgacatgtatttatgatctagttttgctgcacccatgatcttgagcaatgtatttaacctctttctgctttaatccactcatcggtaagggggcgataatagtaccccctcatagggtactatttgttttgagaatcaaatgcacataaactacttagctcagtgactgacacaaaataagcatccattaaatgttagcaattattattattataattgttactattgttagcgtttattgtccacattttttaaatttaagaattagaaggttcttaattatttccaacctaaagtattctctaaacaggacaggaatatgtgacactgtgtgtgtgcacctgtgtgtgtgtgtgcacacatgtgtgtggataaatggtatcacactgtagtatggggattgcagctggcagttgtatattagacagtcagatctggcatgattatagctgaaagccttgctacatcctagaccagcctgtttgtgtccgttttctgaatgttggttctcaaaccttccaagtagatcttttaggaaattcctcctttgtcagtttggaaaagttgattcttctctttagtggttaagaacctgactgatagggttcccatctggagctcctatatacacttatttccagtgagaataggttgagaggaaaataattatacatctaatactcttgaatatgcagaaacatcacatctccctgactaaattcacaaagtataaaataaagaacaggacatatgttcccagtaaattgatagggtgtagattttgatatgaaaccaaatgtatttttaattaagaatcgaaatttactactcagtttctgatactataatttgctttttgtcagtcaatagaaaatgaaacttagcatgacaaaagaggaatataaaatttacaaataggaatagaaatatagaataaaagtatatattttaactgtaaagaggaaaacaggaagaaaggaaggtaaatggaaggtgaggataaaaagttaatggaaacctatttataattttgctgatatacctcttacctgaatggtaaaatttttacagagtgaactgataagatgagcacatgaatgataagccgtagattctctgcacacactaagttggaccttcccgtccacaggttcaccataggtatatctaatagaagaatataacaacaacacaattacagaggtcaaggtcgtttttaatctgtatagggttttgaaacctttatttagtagctgaaaccagcactgtaacaacatttaaatagctagttaccataaattttattttctggaggaaatctaaaacaatggtacggactaaaattgagctgaatgctttaggcaaaaatatattttaattaaaaaggttgaaataggcatgtagacgttatatatctaagtcactaaaatacaatgtaaacaaaaaaacaaaaaaatacatcagtcattatttcattaaaaataatattttttgcatactgatagcaatggagtattgaaaaacaaaaaatgaaataaaataacattttgcttcttttagtttttttgtttttaaactgctattatgagcatattttatggtttttacttttaaaatgtaaattatatttatttatttattttttataaatgtcattttaagtcatcagattttggggtaatttctttttgtttgttttggaaagaagtaaaactgttcattttttattattatattttaagttctgggatatatgtgcagaaggtgcaggtttgttacataggtatacatgtgttatggtggtttgctgcacccatcaacccatcatctacattaagtatttctcttaatgctatccctccccttgcccccaacccccgacaggccccggtgtgtgatgttcccctccctgtgcccatatgttctcattgttcaactcctacttctgagtgagaacatgtggtgtttggttttctgttcctgtgatagtttgcagataatgatggtttccagtttcatccatgtccctgcaaaggacatgaactcattcttttttatggctgcatagtattccatggtgtgtatgtgccccattttctttacccagtctaacattgatgggcatttggattggttccaagtctttgttattgtgaatagtgctgcaataaacgtacgtgtgcaggtgtctttatagtagaatgatttataatcctttgggtatatacccactaatgcaattgctggtcaaatggtatttctggttctagatctttgaggaatggccactgtgtcttccacagtggttgaactaatttacactcccaacaacagtgtaaaagcgttcctatttctccacatcctctccagcatttgttgtttactgactttttaatgattgccattttaactggcatgagatggtatctcattgtggttttgatttggatttctctaatgaccagtgatgatgagctttttttcatatgtttgttggctgcataaatgtcttcttttaagcagtgtctgttcatatccttcacccactttttgatggggttgtttgctttttcttgtaaatttatttaagttccttatagattctggatattagccctttctcagatggatagattgcaaaatttttctcccattctgtatgttgcctgttcactctgattatagtttcttttgctatgcagaagctctttagtttaattagatcccatttgtcaatattggcttttggtgcaattgcttttggcgttttagtcataaagtatttgcccatgcctatgtcctaaatggtattgcctaggttttgttccagggtttttatggttttaggtctaacatttaaatctttaatccatcttgagttaatttttgtataaggtgtaaggaaggggtccagtttcagttttctgcatatggctagccagttttcccaacaccgtttattaaatagggaatcctttccccattgcttgttttcatcaggtttgtcataggtcaaatggttgtagatgtgtggtgctatttctgaggccactgctctgttccattggtctatatatctgtttttgtaccagtaccatgctgttttggttaccatagccttgtggtatagtttgaagtcaggaatccaacttccaagggatgtgaaggacctcttcaaggagaactacaaaccactgctcaaggaaataagagaggacacaaacaaatggaaagacaatccatgctcatggataggaagaatcaacatcgtgaaagtggccatgctgcccaaagtaacttatagatacaatgctattcccatcaaactaacattgactttcttcacagaattggaaaaagctactttaaagttcatatggaaccaaaaaaaagcccgcattgccaagacaatcctaagccaaaagaacaaagctggaggcatcactctacctgattcaaactatactacaaggctacagtaaccaaaacagcatggtactggtaccaaaacagagatatagaccaatggaacagaacagagccctcagaaataataccacacatctacaaccatctgacctttgacaaacctgacaaaaacaagaaatgcggaaaggattccctatttaataaatggtgctgggaaaactggctagccatatgtagaaagctgaaactggatcccttccttacaccttatacaaaaattaattcaagacagattattaaagacttaaatgttagacctaaagccataaaaaccctagaagaaaacctaggcaataccattcaggacataggcataggcaaggacttcatgtctaaaacaccaaaagcaatggcaacacaagccaaaattgacaaatgggatctaattaaactaaagagcttctgcacagcaaaagaaactaccatcagagtgaacaggcaactgacagaatgggagaaaatgtttacaatctacccatctgacaaagggctaatatccagaatctacaaagaacttaaacaaatttacaagaaaaaatcaaacaaccccatcagaaagtgggcgaaggatatgaacagacacttctcaaaagaaaacatttaagcagccaacagacacatgaaacaatgctcatcatcactggccattagagaaatgaaaatcaaaaccacagtgagataccatctcacaccagttagaatggcaatcattaaaaagtcaggaaacaacaggtgctggagaggatgtggagaaacaggaacatttttacactgttggtgggactgtaaattagttcaaccattgtggaagacagtgtggtgactcctcaaggatctagaactagaaataccatttgacccagctatctcattactgggtatatacccaaaggattataaatcatgctgctataaagacacatgcacacttatgtttattgcggcactattcacaatagcaaagacttggaaccaacccaaatgtccatcaatgatagatggacatatacaccatggaatactatgcagccatgaaaatggatgagttcatgtcctttgtagggacatggatgaagctggataccaacattctgagcaaactatcgcaaggacagaaaaccgaacaccgcatgttctcactcataggtgggaactgaacaatgagaacacttggacaccgggtggggaacatcccacactggggcctgtcgtggggtgggggcagtggggagggatagcattaggagatatacctaatgtaaatgacaagttaatgggtgcagcacagcaacgtggcacatgtatacatttgtaacaaacctgcatgttgtgcacatgtaccctagaacttaaagtataatttaaaaaattttaaataggtagaaagagcaaagaacaaaattgcttgtaaggaataacagtagattcctctgggctacgttttatgacaatttctcaatttcatcttccaaattactaattctctcttaagcatcatcgatccttctagtcagcctttctacacatatatttttaaattaataatatgcctacttccaaggtctttaattatttttaaagttacactattgactcatatctgagtatacacattttacttatttctaaatttttttctgattgatgttcaacagttttctcaggtatatattgctcttttttttgtttatataataccttgatttcaagtcattagaatcttcaaccatttagtgattcatgcttatgttttgggattcccagctggcttgtcctagagtgctttattttgcttatgcaatacttctccagtaaaaatgacacaggagccaacacacagccactgtgatagggaagtacctagacatttgggctttggggatttctgttactcaggggattttccagcaatgctggcaattccctgcctttatgacccaactacaatgagacttttcagtctctgccttttctgtattcttccaactctggaggtgaagcacaaggtagtgacatcaaaaagttagccatgcttcttcttgactcttaaagacttccagcctaaagtagacacaggaaggaggacaggcaaagctttcaccttaaagtttggcatggaattttagattactgtagtgaagctctcctaataactagaaatttccaggtcacttttttatttttaattatgcaaaattaaaaggaaaagtagtacacatgagtcagggaaaagtagtacacatcaggtctgaggagacaaagttttaatgtttgcaccctggctctctttgctggttatataaactctgtgaatgttgcttaacttagtgacaagaggggaaaacaacctgacctgcttcactgctactcctgccacacgttaatcctcactatttgcccctaagtccctgtctgcccttagtatcctccacactgtgccccgccattaccctagagccacttgtaactcttacagcagttttctctgtgatacatcttgagcttcagttttcttttataatcatgtaatacataaagattgaattgagaaatcatcataaacagaagatattgtccaatggaaatttctgggagatggaatgttctatgttttatgtctatgctctccaattcagtggccactagtcacatgtgacagcttgaaatgtggctaacgcaactgaatatttagttttaattaaaacttaaataaccacatgtggtcacggctactgtattggctggtgcaaaacaatatgttatcttatgatgtaagaaagacagtagtcagttgtcttaaactgttacataaaaccacgtgtcataacatgcattaaaagaattatagatgcatggaagaattcataaaatcagcaaaataatttaacaccttctttttcccttaccttctacacatttatattttacttctttttagccatctatcccattctaatatctttctatgaatacattattctattgtgtacaatttcaacttacaaggcacagacattcactttgaattcagagtccacaactaagatattttctggtgcatccacagtcatttgaaatttgggtaacactgccagtaaaaaaaatatatatatattatattataatgtgtatattatatattattaacataaatacatattaacataaatacattcatacaaaacaattgtttctcctttacaaaccatcaacctttgcttatgtttgccattaataaacagtgtgaggaggacgttgaagtgcctaagactggattttggaattggatagaaaaatgcatattttgaattccaaattcatcacttctcaggtgttgaacttgggaaagtgtttctcaatatcttcatctttaaaatagtaataaagatactacaatagaaattttatgaagattttaggagaaaatatgaagggactaatggctaacatatgactaatgttaattccattcttctcataagaagtgctttacatcccagaaactatcatataaaatagaatccagatactacaaaaggaagatagatagcctaggttaacagagaattgcaggaagattatgggctgaactaggagataaaaatcacagtagatggagaaccctaaaatagtaacagaggacaaggaaagaggaaaggaagagatactcacttgaaaattcattatttaataatcctgcccttgcaaaattggaaagattttataatttttttattaataggtaatattttcattgctattatttaccatattcttccacagagaaggagtgatatgttttcttctcattgagcatctccacggtgatttcataccatccgaggatgggctctgagattaactggaaggagagttgtagaatccctcccacagactcctcattcacccactgttgtattcgattgccttctggatcctgagaataagaaagtgtatttttgcatgctggatgtttttattcattataaagtttcagcaaggtgtttcctacttaggtttccaactgacttaggattcaaaacatgagtgtgtcctcacatcacccaaggagaattggttactctcctatctgaggtcacatagatgcatattacagtacttagtatattttagagctagctgtgatttttttacatttattttctgtgtcaatctctgatttcttaaaggcgagccatattttatccccagtgcataaaacattaagtgtacatttatatacattcaacaactaaacattaaattaaatacaatcatacttgcccgttgtctatattattattgtctgtattaatgggtgcatgctaatatgaatcacatggtggtgggggtggaaacctatttctgtcctcttgaggctgtctacatgaaattaataattctgcgacaatttaaatagacaatcttccctgtgagctgccttttgattttgaggtttagagagatgttcaaaaaatgagaaaacaattcttcaactattagttatcttacctgaagggtgatcactggatactgaaataaaaataaaaataatgttaatatatgaactcaaggtttttttttctagatgagtgaagaggttaattataaatctattattaagcaaagaaacataaacacatttaggacaacccaaacaaatactgatttctgactgaaagtttgaatatctattgattatattgaaactcatctgcctagttttcaagaattttcatttacttctctctctttcacaacatacaccctgcagtctcagtaagcaaccctgcccttgggtctctccaacataataaaaatgccctcttagatgaatcataacttccttatcaacaaattcgtggtcagtcttcactctgacagttgcaatgttttacactgctggttgcctctttttgaaatgcttcaattttgatttctgtatctagcactaattttttttgtcttagattattggccattcctatactccaccatttccttatcagacaagtaaataaacgtagacatttgcccaagtttcccttgcagagtttcctctccttcttccttctccttccacctctctgtatctcctctcagttctctccatgtttaccactcttgccccctctaaacctatagtcaacagtttgactttcatctcttagtgttttctctcaggaccttaaaactaacaagttgaaattaaagactcctaggccagaagccctcatgtgaataggctgatgagaattttaaaaatgagtacatagggtcctttgcccactccccaagttgctaagtgctccttcccactaattgcagcattcattcactaataaaacgtaatgtgtctggagataagaacaggattcataaaccttgtccagaattcttggaactgagaaatataacagttgaattaagggcctacttgttattctaaattcatggaattgaatcttgatgaaatattgagatggtattgaagaaagctactgctgcaacattaactcaagcattaagagaggtagagcttctcatgagatttcctcataggaagaaaatgaagaatatattacccaaaggtgccatgggaagacgttaaccatttggatgagattctaataatgagaaatgaacctagagtactatccctttttgtttgctatttgtaatacttccaatgcagatggcttcaactgtgttcaacaaatttagtttttattacttaatttgtcttttttttttagatttttttttaaactcagcttggtctatttcaaaaaactagtgaacaagaacctagtaaaatcacattttcattgttctaagctgcttgatttttctctaaaaacaattattaaaatgaggctgattctgctgtagtcactaatgactgtctgcactaaatcttgtataaaccagccaagaaccaatacaacaactccttcatgtccccttctggttcatactatctctccctgtccatacacagggcctctttttagaggactagtagttccaggtcttaagataagtttaaagaaagatctgaaacttcttgatgcaaatgaaactttctggaaaaagtatgtttgaatattctacaaaacactgacttaaaggaaaagaaaggcaccatcagcaatgaaattgcagaaaatgaaagaaaagaccgatgtaagatttgggcagaagaaactaggtatatgctctatatcttggctcatttgataatgagcccagttgcatcattactatatttttattatgtagtcaaatttattatgaatgcccaaatctcataggccagccatgcattgaatctatttatctaaatggaatactgaaccagataatgtccagcaattagaaacactggcttgcaaagataaaaccacataatctcttagctgccatcatttttggaaatgctacatcaatttccatctctatacataagcacatgcagtttgttgtgccatggaaactccttgccataaacatttggtacaaatgatcttcttatctatgacccatatttgagggaacagtccattaatcctgttcttatgcaaatgtagttattactaaagcagggagttggataatcatatttggcctaattgacaataataagtcaacattggggggtgagaactaataagggagttatgataatgctgcagctgctttgattttcaagaagacctttacttccccatggtgcttccaatcaaggatgattgtcaaaggattgcagtagaaattctcactgccttggttaaatagaggagttgcattcttagaaatagaagcttcaaccatgaaccaaggagaacaggaaccacatgctatcttacggaagtgatttcggatttagattactacaaggtctttggagcactaaaaattagattcctgctctggaaattaaaattaagcaacagtctagtgaatgtagcataactatagaagatggggaaaggaggtggattaaaagtgacgatgtcttaaggatgaagtacaatttggagggaggaaaaggcactaacagagaaaccatctgcacagcttctgtaagcttcagaagcttcttcgtaactgcgctcagttgatagattgatctgagagaccacaaaagaatgcttagttctaacaggtttctaaactacatgaaatgaaatttgtcaggtatcctgttgtaaagactgaagtccaggtcataattcgttgtcttttgacagttttcactgttgatcgccttggttctcagattgtcgctagctagattgtagtcttctgctgaaata

SEQ ID NO: 113 - DNA, 139247 bp, Homo sapiens
gccacaaccttctaaggcatctagatatgcaactaaaatattaaaaaaattccagcaaggtcaaaataatctcaggcctagatttgccaccagtgccctcttctgggcagctttattttacagtagtgtcacgaaacacttgtttgtcaatatatgtatttgtgcactaagtgtcaccagaaaatacatttatgtctgttggttacagcctaaaaagtttaagaaaccatgtttagatgttttcccagtcaggaaaggccaaactaaaaagggctgtgtgtgtgtgtgcgtgtgcgcgtgtgtgtgtgtgtgaaaaagagagatgggggcccccattccactaagaagatgacagaggctgtgcaggttttttctctgtgatctcccctcctcctacaaatcatgcccagaggagggatcttgaggacctgcccctgcctccccagacccatctccacacccaggccatcctgggcagaggacagcagagctcacatctctgtggagagcagactgggctcactgcaggcctctgtgtcattgttcatcttcacttcataagtctcattctgagacctctcctgacacaccatggctatctggctctcctgggaaaagcacttacaacattcaagatagagaaaatcatcagcagctgccaaccctcctcctcttccctcagcaagtaaggcatcacgcatgcacatatgcacacgtgcacaaacacatgaacttgtgtacacacacacaggcacacacacacatgaacatgcatgcaatttctgtggcctcattttcttgtgatggctgatgaagccatgacgccatggaagtgttaagattagggagagggttccatgtgggaggatgtctggtgtggatccaaggagatctgagtcctgactccaattcacttaccctctggcccaagtcacttagcccaccccatgcctcagtttctctttctatgaaataggagtgacatatgccctgcctgactcagaggcctgttgtgagttacaaataaagcaacagataagacggcgctttgagactgggaaaagtcagctttgacctaagggtcctgggctgtgccataaagggcagggtgggcctgtgaggaggcctacctgtgagggcctgccctcccacccctacctgcaatagctgagcctttgggcattagtttggcacagctgagatgtctgtggcatcctattttgatggtgcccttgattctgacacaagctccctgcagtaaaggcacagaaaggaaacctcacctaggagggtttgctctcccaagcagagggcagtgagccggagtccctactgagcctgaatccttcctgaactccagacctgcctgtaccagaacatgtctttccctatggggacacagtcctctgctcactgggtcctgtcttcttcagctctgagccatgagctcttccttttcctgtttgtgctcagctcagtgcctctctccatctttatcctcagaccccagaaggcattaagggaagatcccagtccatcttcttggagctgagagctggatcagtgcccctggctttgaggcagggtaggggcagttctctctcagggaggcctgcagatcgccacctgccccacggtgggaaggaaagatgacaggtgggagctccaggtggattgggaggggagggagatggagtgggctttggcaaggcatggggggataagcttgagatgcagagtggcagcaggcaggcaacaacatttctggagaccaccaggcacaggacatgctggcctgtcctcaggacaagcaatgccagggcctgagctgcccttacccttcaggacgaggcctgggaactggaatgtgggctatgcttttcttcaccaaactgaagcttggcaccctgagtgttgtttgtaccaactgcagtaggcagacggggaaccaacacttcatgagcactgactgtgtgctgtgcactgtattgcgtgctttctgtttgtttgtttcatggagagatgtatctctggggagagggaaatcccctgagaatcccccctctcctctaaagcccccgccaccccaggttctctaaaaatccctctccccttatgtcacagagaataaagcttcacaggaaaatgcccttagaaagggggatttaattcactctgagatgctaaagatggccacggagacctccttaagcagaggctttcaggagaccgacagagaagaaggcagtgcagggacccagcgtgtcctcaactttggctaaataaacctgtaatcgattgaaacatgtcgcagtcactttttggttaacaaggtcaacggaggcacaagcaccaaagtccacctgaagaagttgggtctatctacgaaccacttgtgagtcactgtgaatatttagaaccgggggctaaagcttattccagttgtctgtctggatgtcagtgaggccactccatagtagattctcccacctttggtttaatgggatggacaactttggattaggactaaggaggtagatttgatcttggaagataccttaggcttcttgtctcttatctccctaggaaactgttggctgtcagtatctatactaggggtaagcccaagtgacagaacagttctggaagcatctccttgagttttcaggaaaggtttcactgacacaagaagagagtagggtggcagagcagcatcgggtttggttttcaattcccttttctatctccacacgtgttgggtgaaattcacagggttgccacactctcgtgggtatatttggattacggatgagagcataggaaggtgggctgtgggatacatacagtggagtgctgctgactatagcccccgtcatgtaagaaagcacgtcagattgccatagaacaagttatgctattgttggaataactgaagttcattctaatttagtttttaaaatcattctgaaactttgtcccccctaccgcatagtagttgaagggtactccgttttccctttttctgtcctaaccaagaaacagagcgtgcctcaactgttctgtgaccccatcagctgcacaatttgcccggcaggctggaacccaaggttacgctttgaacactcccaggcacctacaaaggtgtttaggttgttgccccaaacactgagaggaactggccaggccctgagccaaatgccttaatctctcaccaactccattccctgatcctcatgctgcagacctcactaggtagagcacctctttccctaactgcctatctggaggaaatggtgaaacccagtttctacctaagttctcataataaatgctttgatctgatcaccctggcgtctagtgcttctttctttgggattccaactggtcccatcttgggatggcttggggtactcccttgtgggaactcccctgatgccagcagtggcaccccagatgccactgctgaggtgactccagctgtgaattcactggaaaagaacacaggtattcctgattagttctttatgctccctcaaaggtcagagctcaatttccttgcacctgatttctcatccacaaaatggtatttataacacctctgtggaactgtcctccaatacccttcttcctttttaaaaaaccatgcatttggccacctggaatggagaacatgttttccaccccccttgcagctaggtgtggccacgtaactaagttctgaccaagcagtggaaggtagagtcccatatggcactttcaagaagtattcttaaagagcaagggcacatgcatttctatcctgcctgtcttcttcgtgactagaatgaaacacgatgcctggggctaaacagtgatcttaaaccatcaggaggaagtgatatattaaaaggcggaagagccaaaagatagaaagaacctagatcacttatgctagcagagctattcatcattttgcacagtttaccttcagactttgttcataagggggcaagggagtgtgagttttctatcacaggcaaacccaatcctgagggattgacttaatctatcaacattgctgtgaggatttaaggagataatataaaatccttagcagtttttctggcatgaagtcagagggcaactttttcttttttctcaaaagtaatgaaatattaaggctattgaaacttggttctgagaacactgaaagatatggaaagaccatagaacctgtttccacattggccagaatggactgacattacatctttgaagtcggtcataatcagaatgtttttcactgcttctaaattgtatgcactattggataaaactggaacagtacatggccaggcacagtggctcatgcctgtaatcccagcactctgggaggccaaggcaggcggatcacgaggtcaggagatcgagaccatcctggctaacacagtgaaaccctgtttctactaaaaatacaaaaaaaaaatgagccgggcatgatggcgggtgcctgtagtcccagctactcgggaggctgaggtaaaagaatggcgtgaacccaggaggcagagcttgcagtgagcagagatcacgccactgcactccagcctgggcaacagagagagactctgaatcaaaaaaaaaaaaaaaaccaaaaaaacaaaaaactataacagtactgactccatgttagagaaaagcttgtttgcttgaatacagttattgcttttcctgagactgtagattattcattaaaaacagcctcagaaatacaggatcttcagcagacataaaagaaaaaacactgacaaacaactctgggaatgggctaagtggcttgataagaatagcctgatggtacctgcagaaggtcatacaacattgaccaagaaaacagtgattgcctgcctgcctgcctgagacttcacatgtttcataagaatgctctgatcagccaggtacagtggttcagactggtattcctagcacttcacgaagctgaggtaggaggattgctggaggccaggaggatgaaaccagcctgtgcagaaaagcgagaccctgcctatacacaaacaaaaataataataataataaataataataatagctaggtatggtggtgcatgcctgtcatcttatctactcaggaggatcacttgagtccaggaggtcaaggctgcactgagccaagataacatcactgcactccagcctgggtgacaaagtgagaccctgtgtctaaaaagagagagagaaaaaaagctaaggctattttcaggttaggtcaggcttagtaacaaaaactttttgtgaaatgcttcgatcattgtttgccctgctcctaatttcccttaaaacctcccggatcagacaggtggtctttgaagatgagttcacagcctccctcgagtttttggcttcctgaatgtagctaactttccctttcaccaacatttgtctctagacttttggctttcaagcaacaagtggcctagatctgggtttggttacaaattttggcaagcccagccagaagccgtgtgctctgggctgtttgcaccctgtcagctcccaacagacaaagcaattggtcacagcttcataccaggactaactcatccatattgttgggaggacttcttggttcccaagaggtggagcaattgatggcggcagcaggtcagggctaactcattcacattaccagaggttagcggcaaatgctctgtggcactggctactcatggcagaagggaactgcagagacagccccaaagtctgccaaagagaggctgccaaaactctttctacttcagggaaacttcctcctttcccccattcagtactgactgcctacttttgcttttagttggtgaaaggaaactagctttattttttttattttaattttttttgagatggagtctcgctctgtcacccaagctggtgtgcaggggcgcaatctcggctcactgcaagctctgcctcctgggttcatgccattctcctgcctcagcatcctaggagtagctgggactacaggcgcccgccaccatgcccggctaatttttgtattttcagtagagacggggtttcaccttgttagccaggatggtctccatctcctgacctcgtgatccgcccgccttggcctcccaaagtgctgggaaactagctttttggatgagctgatgagctgtacaaccaggtaagtctactggggtgcaaagtagtagtccactttctttaccatttgggcctttggaccatttgtggtaccactggtagaagaaatgactcatagtgactccataccagtctcttcctttgtgaaagcctgggttggaaaagtgcttcatttgttttggttgtgttttgtttgtgtccaccatgggaagtttttttcatcagtcccctctcagagcccactgtggttcatattggctgactggtaagcctacagtgataaccctacgacaaaaaagataatctactgcaataaggtgtggtcaatgtacgtgatacatgaggaagataggtggccattacatggttctttgaatttaatgttatacagcttgaacatttcaatctgagatcaggaaattgggactgcataccttatattcaagcttttatgttggtacataataagcacgcttcccagaaaggttgctggctgatggtgcaaacaggaccatatcaggtaaaatctcctcactctccattacctgaggaggaaaagaaggagataggataatcttgtcaactataaaccctccacaggcaaatgatgctgaggctttgcaggtgcctgtcccattgcagcctgctctggcacctgtgcaggctcccatggaggccccagctgcagtaccagcacagtaccctgagttgccccatctctgccccctccaccagaggattatccagataatacagacttacagggtgtggtggcccctcctcattttaaaggtagccaagaaataggctccccttttaagacctgacaaggcaactaaatttgaccacagcgtacaccctcatgcggcagaacaatttctgttatgcaaattccccgctggaggattaaatgcacagggccatactcctgggctattttggttattcaccattttctatctttgactaagtaaatggaaaaatattcaagtccatcctatagggatgatccataggagatgactgaaatattcaccagtattttttctattcatcattccacaatagcaggtgtacaagcattattaaattttatgatgaaagggggttatttttagacaagactaatgatggagccagaaggctataccaggaagaccctgctgggtcctccaacatcccagaggcaatttccttagtgaaacgcaaatgaaaccttaataatgaggttatatcttgactgtaggattactcctaagaaagggagtacctaagcagcaaagcctcaataaaaaacatccatgacctctggtaggaggccagtgaaaacccagcagcttggttgaaacaagtgtaacaggcttacagaaaatattcagatattgatccagaggctctggaacatgtttgggtcataaatataactttcatcagccaaagtgcttctgacattaacagaaaattagaaaagcaggaagggactgttggaatgaacccttcccagtttacagatattgcttacaaagacttcaatgctagagaaacaagaaaagctagacaggcaaccattttcatggagactgttcaaaaaggtggaagaatgaggggtgaaatagaaaggaatccctagacaaggaccagtgtgcctacagtggggaaatctggacatgagaagtatgcccccctaagctacagagaaaagatggtaataaaaaagacaagggagaggaaaagggaaatatacgccaaagaaggagatggtggagcaggattgtgactctgatgaagactgatggggcacagggactccgcctgatttaacagagcaacagtaatttccctacaggagccctgggtacaagcgacagtggggaacaaaatgactggcttattggttgatactgtagcaatgtttccagccaaggctggagtcactgggaagttacaacagagactctttcttaagccctaagaatataaattgagggatataagattgaggtatagctttctgtatatgccacattgccctattccattgttgggccaagatttgttatgtaaattaaatgcccaagtcacttttgctcctgagaaacaacatctaagaatccaggtatcacccaaacatgtcctatgcctacaggcactggtgattcagccagagaaaagaactcaagaaccattcctgctggaagtctacaacagagggagttgcactgtttgggaagacaagggaacctgaactagcagtcaaagctcagcctgtgcacgttgaatttaaaaaagcattaattccacataaaaacaacactgcttaaaaggtaaagaattagaagtcatacagggggattacacaggtttctaaagcacagacttattcaatcatgacagtctcaatacaataccactatcttgccagtgaagaaaccaaactccaattagtatcaatttgtgcaaatttgagagctattaatgacatcgttcaagatacccacccaatcgtggctaacccatataccccacttacagctaccccaggggattatggctggttctcagcataggaattaaaggatgcttttgttcagtgtctactaattgaggagaaagcccagttgtttttgcacttgaatggcaagatctggagactagggcaaacttccaaaactgctagactgtactgcccaaatatttaagtattcctttaccatttttgaaaaaaatcttactaaaagatttgagaagcttgcaattaaacaggggaatactattacaatgcatgggtaatttactcattgctagccccacttatgaagactgtttataccagtttttgtttgattgttttgaaacaaggtctcactctgccacccatgctagagtgcagtggtgtgatcatgggtcactgcagccttgccctcctaggctcaagcgagcttcccaccttagcctcccaagtagctgggactgcatgtgtgtgccactgcacatggctaatttttaaaatttatttgttgtagagatggagtctcacagtgttgtccaggctggccttgaacttttgtgcttaagcgatccttcaactgtggcctcccaaagtgtctggattacaggcgtgagccaccgcacctggccaatactagttttaaacagcctggtggaattggatcataaagtatctctttgcaaatatgcaaagagcaggtagtctattcaggggtttgcctgcaataaggtaagcagagtctgatgcctgacaggtaacaagcaatagccactatcaaggctctcaaaaatcagataactaaaaggagtcttaggtatagttggcttttgtcacctttgatccctaattttggtctcctagtaaaggacttatctgaggcatttaaaatgtcagagtcagaacctttatattagacagtggaatgccaacagtcattcaataacattaaagaaaaactaaggaaattctttatgggcccccaagatgtttaccctaagatagttacgttgaatttcaccctgaccatgtaaattgatggcttatcttcacaggcatggaacaagagacataagtcatccctcttctcacctgagacaaatgcatatctgattgctccccctgcctgtttatcttatgtaaaaatgcaggttcattgaactagatgaatgtttaagtgactgttcccctaccctcttacatgtgaaggctaatcaaagactcaaaagaatgcaactgcttgcctcttatctacccatacccttttaaaaatgtatcttcctctttcaatacctggccttttccctttaaatattgggatcccaagaccctctttggaaaaagcatgaaacacaatgtttcctgtggatctacgttctttcctggacatgtcctcaacctcagcaaataaacctaaaatgatcaggactcaccttggtcatttttctttagtttacatttcctaagctacagacctgtgcagcacatgactatactgaatactgtgggcaacttcaacatgatggtatctgtgtctccaaatgtctcaacaaagaaaaggtacagtaaacatatggtttgaaagataaaagtggtatgcctctaaagggcactaaagggcactatagcattatagtatttatatgtctttgtccagggttcctggctcataacttctatggccctcattatagtcttgttatagtgctgggacactttaggctcagaaaacagactctctctgtctctgactttctcctgccctcctttcacctgcccaaggcaggactctgcacatcataagatcctcattccagagagggtcctgcccatccttaggaggtgggaatgctgcacagagaggccaagaatctggataagccttggtgggttttcccatctcagacaactagtgttagatcatcccttctggtccagttgtatttgtacatggttgtcaatcatgtctacccaatgatgtctccattgaaggctcaagaggacagggctcagggagcttctggaaagctgaacacgtggaggctgacaaaactcttccctatgccaggagggtggccacaccccaactccacagaagctcctgggttagggacccctccagactcaccccatgtatctcttcatctggctgtttatttgtatcatgtaaaataccctttgtaataaaccagtaaacataagtgtttccctgagttgtgtgagcactctagcaaattaatcaaacacaaagaagaggtcataggaaccccaacttgaagctggtgggtcagatgttctacagacctggacttgctatcttgggaaggaggggacagtcttgggagaatgagcctacaacctgtgggatctgatgctatctccaggtaggcggtgtcacaattgaactggaggacacctagctggtgtcccctccagaactgcttgtttgcttggtgtgtggggagaaattcccctgtatgtcgtcatagaagtcttccatgttgatggttgctgtggtgtgagagcagaagaaaaacacattggaggtggtttttccacacacaggcacttactatgaatggagcttgcaggactggaagttgctctgggtgagtcagggagtgtgtgttgcgtgcaggtgaaagcctaggacattactgcacactgttgtggactttataaacagtggacacttaggctacactaaatttgttaaaatattgttctttcttcagtaaattaaccttaggtttctgtatctctttcactttataaacgttttaattttttaaactttttgactcttgtaataacgcttaatttaaaacacaactgtacagcttttctttataagcttttttctatttaaaaaaatttcttttaaacttttctgttaaaaattaagacacaaacacacacattagctcaggcctaaacagggtcaggatcatcaatatcactgtcttccacgtgttgtcccactggaaggtcttcaggggcagtaacgcgtatgaagctgccgcgtcttatggtaacaatgcttccttctgggatatttcctgaaggatcttggctgaatctgcttttcagtcagcttcgtttttggaaagcagaggccgggcatggtggctcacacctgtaatccccgtactttgggaggacaaggtagaaggatcacatatagccaggagttcaagacaagtttagacaacagagcaagaacctgtctctacaaaaagtaaagataaaaaaaattagtcgggtgtgatagtgtgcatctgttgtccagctacttgggggactgaggtgagaggatggcatgagcccagttcaacactttagtgagctatgattatgccgctgcagtccagcctaggcaacagagcgagactctgtctcaaaaacagaacaaaactagaaagagtacactctaaaataataataaaagtattgtaaacacataaaccagtaacagtcatttatgatcattatcaagtattgtgtactgtatgtaactctccaagctatactcttatacactggcaactcaggtttgcttataccaggaccaccacaaacatgtgagtcatgcgttgtgctaccatgttatgatagttactatgccactaggtcacagaaattgctcagctctgttataatctatggaaccaccttcctatatgcagtctgttgttggctgaaatatcgttatgcagcccgtgactgtgcattggcatttgtccacttggtcttcagcctagctttgtactttgtctttgacattttggcttccactgcaatttacttcaggcttggactccttgaggatctctccaaacctgccatggtctgtttcttgccaccagtccctagctgcacattcttagggcagctgccccagcttagtctgatttatggggccccttatctcgtaacttttagaatcttgaccaagtcaggctacccggcaggaggaaatgtcaaaggcagaggcaaaagtggccctctcactttatctgtatctccagggtcttcctttgcatggtctcctttccttccaccctcaagtccattcctctcctgtttctctccgcccctccaggtttcctcctttaaccgcatcacctagagtcatcttcaccgtgcaaagtggttttgttcaaactaatgtattaacactcaactcagtgcagttgccctttgaatgatcacacccaggagacttttttctaattagtgttcaccttgactgtactatatttcagtgttgatcattttgtcctttggctcagatagctgtaaactgccttctatttcactgattcatcattctctcatcttcctttcccatcttcaaatgtggatatttcctaaaggtcattctctgttcctcattttttttcaaaaacttttaataaaatatacataatcaaatgtaccttaaccctgttcaaatgtacacttcattcatgttgaacatactggcattgttgtgcgaccagtctccagaacttttcctcttgcaaaactgaaattcttacacccgtaaaacaactccctatttgcccttcccccagcccctgacaatcactcttctactttctgtctctatgaatctgactactctaacaacctcatgtaagtagaataatacagtatttgtcttttgactggctttttcactgagtataatgtgatggttaattttatgtgtcaacttggctgagccaccgtacccatacatttggccaacattattctgggtgtttctgtgaaggtgttttttggatgagattaacatttaaatcaatggactctaagtaaagcagattaccctccgtaatgtgggtggacctcatccaattaggtgaagaccttactagaacaaagactgacttcccctgaacaaggagttgtgccagcagactgcctttggccttgaaccataactcttccctaggtctccagcctgccagccaatacaatcagattttcactcaccagtcctccacaactgcatgagctaattctttaagcctctttttcgctctgtgtagacacacacacacacacacacacacacacacacaccctgctggttgtttctctggagaaccctaatacaaataatagcctcagggctcatccatgtcgtagcatgtgtcagaacttccttccaagactgaatcatattccattgtatgtatataccacactttatgcacttatctgtcaatagacacttgggttgcttctaccttttggctgttgcaaataatgttgttataaacacaggtgtgcaaaaatgtcaagacactgcttttacttctgttgtttacaaacccagatgtgaaattgttggatcatatggtaattctatttttaatttttttccatagtgactaccccattttacattcccaccagccatgtacaaaagttctaatttctctatatccttgccatcatttattttttgttttgctccttttgggttgaggttttttctttcttctttttttttgagacagggtcttgctctgtcacccaggctggagtgcagtggtgcaattatagctcactacagccttgaactcccgggctcacacaatcctcctacctcagccttttgggtagctgggactacaggtgtgtgccacgattcccccctaatatttttttaaattttttgcagagatctggtctcactatgttacacaggatggtcttgaacacctgccctcaagttatcctctcgcttcagcttcccaaagtgctggaattgcaagcataagccactgtgcctggctgtgtgtgtgtgtgtgtgtgtgtgtgtaatagtagccatccccatggattgcagtggtacctcatcgtggctttgagttgcattttcccagtgactgggatgtcgagcatcttttcatgtgcctgtgggccatttgcacatcttttacggagaaatatctatttaagtattttgccaatttttttaatcagattgttttcatgttgctgagatatagaagttctttatatattctggttattaaccccttatcagatagatgatttacaaatacttgctcccattctgtaggttgccttttcactctgttgatcctgcccttcaatgcacagaagttgtaacttttgttgttgtccaattcatctatttttatgttattttacaaatccctcaactcatcaccaattttttttgttgcctgtgctttttggtgtcatagccaaggaatcattgccaaatgcaatgtcataaagcttttcccctctgttttcttctaccagttttatagttttatagcttttaactttaatttttaattttaacttcattttaactttagaaaatccatcttaagttaatttggatatattgtataagacaaggatcctacttcattcttttatatgtggatacctccttccttttggaaacttttcctttcagtaatcttactacctccacagctttagtttagatgttttttgttgttgttgttgtttcccaggggtgatcaaatccatatatccagcttttaccaccttcctgagttctagtccccccattttcaaacaccactgaaaatttagtttgactaagtacatcaacctattatgtgaagaaacaccatgtcccacccccactacggtgtggcttaatgagctaaagtaatatatcaagatagacataataatccaagaaactggggttcagagaagtaaatattattagggtgcatcttgcgctgttccagagtgaggcatatagggttttggggacagaacaatctagtctctgataatgttttctcttatagcacaggcacatttcatgagcctttcccactacctaggtgttccagtttggatgtggtttgtttggcctaagtctcatgttgaaatctgatttccagtgttggaggtggcgtctggtgggcaatgtttggaccatgggggtacatccctcatgaaaggcttgctgcccttatggcagaagtgactcagttctcactcttagttcccaagagaattgcttgttgaaaacaaacttgtacctcctacatgctctccttctagaagaggatctaaggaaatttataataaaagcagaggaacgctgaaaccaaacccaattcatatcagtaatagctaccatttgttaagcttccacaatgacaagtaagatgttaagccctttatgttaccaggattatctcatttatctcataagaattctagaacataggtcctattattatctttattttattcgtgagaaaagcagagactcagaaggcttaagtcataggccaaggtcatccagccagttgaatggtggagtggggaatatctggatccaggcagtcagactgtttttttttgtttttttttttttgagacggagtctcgctctgtcacccaggctggagtgcagtgccgtgatctcggctcactgcaagctccgcctcccaggttcacgccattctcctgcctcagcctcccaagtagctgggactacaggcgcccaccaccacgcccggctaattttttttttttttgtatttttagtagagacggggtttcaccatgttagccaggatggtctcgatctccagacctcgtgatctgcccaccaggcagtcagactttattagaacatgcacttaaaattagcaagaaggaatgagaacaacaacaacaaaattaaaaaatgcttgccaaagaaaactaaaacaatgtgcaatatttagccctgagatcactagcagtgaaggcaaagaagaatgcataatgggtttctacagctctcactgtccggttatagaaaatatttctacattagtacaagcacttttcttcctaagccctgagttttgagagtttatcaagaaggcctctgagttcattcaattaatggcatcatctaaggctgtttaataacaaatgcagaggtagtccacataaggaacttttgcctttacctttgagacaaagcccagggcctcacgttaggagtacagctctctaaatataagcctccagggcagaagcgaggggaggatggagggacacaatgcagatttacagcctggtgggtacggcctttgtcctctccatgtctattgtcactcttgaggtccaagcctctactgcactgcctggtttactgcacaacccaacttggctgcttgcttctggtctctccccaccaaaccatccttcacactgcttccagcttaatatttccaagacactgcatttgcaaatccactcctctgtttaaaaatgtttcagtgacttgcaacttgtctacagtgtgaagtataaatttattagcttgttgtttaaagccttctacaaccagaccccgaccgaccttcacgtcctattgagaggtgacagcctgctggcagccctcgcagccctggctcgctcttggcgcctcctcggccttggcacccactctggccgcgcttgaggagcccctcagcccgcagctgcactgtaggagcccctttctgggctggccaaggccggagccagctccctcagcttgcagggaggtgtggagggagaggcgcaggcgggaaccggggctgcgctcggcgcttgcgggccagcgcgagttcccggtgggcgtgggctcggcgggccccgcaatcggagcagccggcccgccagccccgggcagtgaggggtttagtacctgggccagcagctgccgtgctccatttctcgccgggccttagctgcctccccgcggggcagggctcgggacctgcagcccaccatgactgagcagcccgccatgactgagccgcctgccggcgccccagccatgggctcctacgcggccggagcctccccgacgagcgccgccccctaatccgcggtgcccagtcccatcaacccccaaagggctgaggagtgccggtgcacagcgcgggattggcaggcagctccacctgctgcccgctgccgcatccacttggtgaagccagctgagttcctaagtctagtggggacttggagaacctttatgtctagctaagggattgtaaatacaccaatgggcactctgtatctagctcaaggtttgcaaacacaccaatcagcaccctgtgtctagctcagggtttgtgaatgaaccaatcggcactgtgtatctagttaatctggtggggacttggagaacctttgtctagctaagggattgtgaatgcaccaatcggcactctgtatctagctcaaagtttgtaaatgcaccaatcagcactctgtgtctagctcacggtttgtaaatacaccaatcgacactgtgtatctcgctaatctagtggtgacctggagaacttttgtgtctagctcagggattataaacgcaccaatcagcaccctgtcaaaacggctcaatcagctctctgtaaaacagaccaatcagctctctctaaaatggaccaatcagcaggatgtgggtggggccagagaagagaataaacacaggctgccctaagacagcagcagtaactcactaggattttcttaccacagtatggaagctttgttctttttgttttttaggtctgcactgcctttatgagctgtaacactcactgcaaatgtctgcagcttcactcctgaagctagtgagatacacgaacccaccggggtgaactagcaactccagtacatgccgtcttaaaagctgtaacactcaggcgaaggtctgcagcttcactcctgagccagcaagaccacaaacccaccagaaggaaaaaactccaaacccatcggaacatctgagggaacaaactccagacacaccgcctttaaaaactaacaccgcgagggtctgcagcttcagtcttgcgttagtgagaccaagaacccatcaattctggacacactatcaactttgtttctccaagggtgcttcttaaactggatgatgcacaccctaggagtgtgtgtgtaggatggggtttgaagcagtagggtaaaaaacctagcatacattctattccagaggtgtcaatttaccagacaacagttattttaaaacttttttatgcaaaaacatgttatagggtggaatgcaacatttttatgggcctgtgggccatttgtatacatctttggagaaatggctatttaagtactctgcccattaattctaaacttaaaactaagacttcaaagtccctctaaggattttgctgggccacatcccaagaccctgaagggtattacttactcgccctctccaaactgccgaagtcggaagcaggtgacaaaaaagctgaccctggaatcaccttttgtaaatttcccacctccaagcttttcgatagtttgtaacactggctcctctccccaaaagcctttccttcaagtcccagcaactctccctgaccctgctgggaaggcgcaccaattacctgtcattccaggaaagctcatagcataagatgatcccattggtcatctcccagaaccagactttctgaaaagtcctcaaggaccagctagtccaatccctcactgaataaaggagaagcaaagtctagggaggtgaggtgattcgttgtcctcctaattagcaggtgagctcctggcagggctggggtttcatcttctgggctctctgcaaggtcgtgcccggcacgggccaggaacaatttcataaactcgtcatctagacggcctttgactgacaccatctctccgtgtggaggagccgctggggtgcacggggcaggtgtcgtccgtttcaaaggtaaaataacccagctgcagacctccagaggccgactagagccggggtcagaaaacaggttttccctctcggggacagcgcccaggggaccggcattagaacatcggctgatgtttcatctggtcagggaaccatccagcgcttagtacacctggcgctaatcggcggggattaatctcacaccccgcagctggcggaaagcagcgggaggaggcacctagccctggggttgagatcccagttcccgcgtgcgcaaaccacgcccctgtagattctcgctgctgcgtgttcgcgcgcgtcccggagtgcgcatgcgcagcggcgggggttgttccggctgcctttcactgaggggacccgccagtttctaactcagtggcgtttgccctgattcccggggcctggctttcagcgtagcaattctgccggcgaagaaggtgagcgcagtgctgtgtggcagcagagctccttaggacgaggagcagcgggacgaggaagggcagactggtgaaatcgcaaactgggcgtctgttccggcgccggacccctatttgcaaaggtgggtggcccgtccggagcgggaaaacattccggaagtggagggccgggccagcgtgattgacaagcgggaacccctgtgtggggacgggtaggcctaggaaggttgtgcctgcggtggaactgggcggtgcgcagaagtgggcattaacagcagccgcgtgtctgggtcttagatttggcccagctgtgttgagcttttcatggattatcttacgtagataagacactgcaacagtgagtgagcgcttgtaacccacctgtctcttacggaaactgagccccagcgatgctaactttagcaaggatacagctgggatcctaaacttggcaatcagagcccagagccgataaagttagctgcatgagtctagcttcccccagggcgggaatcgaggcggagcagggtacagtacggaggccaggaatgagtgcacttgaccagattgttgacggaagtgtcataaaaatggacttaaatgctgataagcagctgtttgggttccacacagggtgcgagctcaggatgcacgttggaggggacacagggccagagcaaggtgggaatgcgggtattatgggccaggccatcctccagctggtggagcaccgcagtactgcagtgtgtggccctggcttaacagcagtgcggaaaagcttttttcttggggctgtggtgctttccaggtgtgtgaagttaaaacattttagggccatacggtagatagtacctgccacatagttgtcttggtcagccccggctgccatgacaaaataccataaactgggtggcttagacacagaaatgtgttttctcacagtcccagaggcttgggatgtccaagatcaatgtggggaggacacaactgagcccacaacaatagtctgtactcagtaatgagtgataattggggactgaagaaaatgaacacgttaagaactaatatgttcctgaagtgctttcacaactctaacctcgttttatgagcgtgagctttgctgtcctggtgtgtgccttggcactgggaggtgatggttgtcctccacacagccaacctgaagagggctgaacaagtcactgcaaatgtttttaatagggcttagtgaatccgttatactcagatttatctaaacctctatgatttagcctgtgctgcttctggaataatgagatccataattaccactgatggggaagtgaaataatacttacgtttcttctgtattgtttagtgttgtcattctagagtttggtaaccaagtctgtcttttttatcccacttatcctggtgggaggaaaagtgaggagatagaaagtttcaggtggcttgggggtctggcagatgtggttcaaatcctgagttcaagcacttgctgagtgaccttgggcaagtcatataagtttactgagtctcagtttctttctctataaaatagagcttataaaaataccacacagggtttttgtggggttatctgaaaacggtttgaaaccattaaagaactggccatttaactaataggtattcaagtcatgggacctccgttacccagcctcggaagagaaaccttcacttacagccccgatgtctggctggctactcattcgttcatcagatttttgttgaatgcctatgaggtgtcgaagcacctagttctgagtcctggagccagagaagagcaagacagacaaggttcctctatttatggaacgtatattccagtgaggaagaataaataggttcagatggtgctaagagctatgaataaattaaatacagagtaatgtgattttttaaaagtgacttagagcaagctagggggtgaggagtgggggtggtgtttgaccactgtccagcggccagacagccggagaggcttctctgaggaggtgagccaaagcctggatattgaggaggactccttctccaggccaaggggagcagcaagtgcaaggcccgagctgagtagatgaggctgggagcctgaccagtctcaggctgaccagtgctctgtcttgagaggagctgctggtcagctttttgtcttgggattcagaacgaggagacatgaagactttttacttggcagtgggagctgaagctgaaaggtccaggggctgatgaggccacgtgtaagcgaaagtttgggataagcagaaaccgagtgcgctgagggagtgagattgtggctgtatccggcacctggctgagcaggagagtgaaccccgtgggtgtgtgtttgctggtgacgttcctggagctgtcttgaagtccgagctgccttgcagcttgtagtctgcctctgtttttggctttcccagatagtttcaattcttactctcagtttgtgaacctcccttcagtgaacctcccttcacttatgctggatatctcttgcaaccggatgagcttcactaaagcagagtcatttggacctggattcgaatccctggttttccactttttagctgtgactttgagcaattatttaatttctgtaagcatcagtatccagtagctgtatccttatagtgttgtacagattaaatgagataataaaagcaaaagaccactgtagagtgtttaacacataggaggtactcaaaaatttgttaggtacctttcttcccctttccttcatgtgttaaagctttttcagtacatacccctctctcaggattgaattgtaaatcatgttttttgattacccttcttgtaataattcctctacctctgtagtcatgtttttcttttttcattttttcttgtccccagaatgtctaacaaaacagccaaatatacctctgtgaagacagagggtaaaataatgctagttctgtgagttctctcttcttgtgcaaatccataaactgccaccaatctgtagtcattttaattgcccctaaaccgaagagcatcgtggcaactacctttcccctcgtaaatagagtgacactatcactagtcttattgaggccaaagttataaagatgggctctcgatctactaatattagtaaaatgggtttgggacttactaacatttgtgcttagaagagacagacctggcaaagagcttggagaagtgagttccaaagagagaggtgtgggaaccaggatggaagagtcaggcctccagatagcgtttacttctcctttcttccttgaatcactgtctcagagataattaggttcaggagaggagaaaaaaaaagatgacgtcaacgtggagcagagtttttcttagaccttagcctagcaaggaaagagaaatgcctggtctcagtactgggaagctgttccagccagagccccgtggctgtgaagagagctctcctgtctggaaccaaacagaaagctcataggtctagaggccagaaaagttagtaggtggtggctctgttcggtgctggaaatggaggccaggatgaactaagaagcaaactaaagatacttgtaagataaggacgtgtaggccgggtgcggtggctcacgcctgtaatcccagcacttcgggaggccaaggcgggcggatcacgaggtcaggagatcgagaccatcctggctaacacggtgaaaccccgtctctaccaaaaaaaaaaattagctgggcgtggtggcgggcacctgtagtcccagctactcgggaggctgaggcaggagaatggtgtgaacccgggaggcggagcgtgcagtgagccgagattgcgccactgcactccagcctgggcgacagagtgagactctgtctcgaaaaaaaaaaaaaaaaagatagggacgtgtatgttaacttgcgctatccaaacaacaagctgtgcttatggtcctctgcctgtgcgtcatgattttccaggacttcacaacgggataaagtgaagtagcttcggcttgtgaatgtgcattgcagagacgtgggagaagaaagctgcaaaagtcattataagcaacacccttgatcttaggggtgctggtctgtgagaagagagctctaagccttttgtagaggcattagaaaggtatcggagccacggtgaaatgcaggggagattgggtttaggggctttcctggtctgcattctgctacagccgttaaatgccgctagatggagtgcgtgattctggtatggcctcacgtggacctgctgcgaaggatggagagaacatggtctctgcttcccagaaaaaaggagaaatttggtaataagtgtggagactgctcttaaataatgctccagatttcaagccacttcttcctggaccatgagagagctccctaatgttgtatttatttttcctaggtccatggctaatgaaacacagaaggttggtgccatccattttccttttcccttcacaccctattccatccaggaagacttcatggcagagctgtaccgggttttggaggctggcaagattgggatatttgagagtccaactggcactgtgagtatgaacagtgagagatactgaaaaggacaacttaacagcagccgtactagcttttcctgtttgcctatccagagattttcatagtttgaagttgggcagagtagtctctgtttatctgagtaatagtcacttcctctattaaagtcttttttttttttttttgagacggagtctcgctgtgtcgcccaggccagagtgcagtgggacgatctcggctcactgcaagctccgcctcccgggttcacgccattctcctgcctcagcctcttgagttgctgggactacaggtgcccgccgccacgcccggctaattttttgtagttttaatagagacagggtttcaccgtgttagccaggatgatctcagtcttctgacctcgtgatccgcccgcttcggcctcccaaagtgctaggattacaggcatgagtcaccgtgcccggcctaaagtcttaaacatagctctgtggtctgagaaaaattaggctgaagtcattggtgcctacctattacggtagatgagacggctttcttaccaactcttttccctcccgttccccatccttcaaatataattctaagttttagtctctgctgagtgaaccagtgtgttatgattatgttttgaacataattttgtcttgaacaatatgtcttaatattctgttttttctagttaataattgcccttttaaagttagtttagtttttaatatacctatgccagttcctcccacatcatccagtggcctctcaatatgattttccatacagataactcctgtcttagtcggccaggactgccatagtaaaataccatagactgggtgacttaacaggaatttattttctcaccattctggaggctggaaagttgaagatccagattctggcagggttctggttctggggagggggtctcttcctggcttgcagatggctgcgttcttactgtggagcaagaaaagacgaggaggagaaaaacaaatctttggtgtctctttctcttttatgaggacaagggctgctcccttatggctgctccgttatgacctcctttacccttgaaggccagatctgtagtagagtcacatggcggggttaggatttcaacatatgtttgtttgttaagatgggcagtctcactatgtggcccaggctggtctcgaactcaagcgatcctcccctctcagcctcccaagtacctggtggctggcaagatccaagattactggtgcacaccaccatacacagcttcttttgttttgtttttgttctttaaaaacatttttttaacatgcattttggtggggatacaattcagtccacagcagtgaccaattccatttttaccttggagccctcctggaatcctccatcctttccctgtcatttgaattagttgctcctcagactgacttgacagatttcagcatgagtgttaatggggacagacggccgcacccacaccacatcagggtatacgtccgtttggaggctttcctcaaacgtctggcagccctggactgcctgtgtatgctgaagaacagggcacagaaaggctgagtctgcagggcactggctgtggctgccaggctgggctcctttgttgggggcctccagttgccagcacatctgtgggattttccctagagtcttcagtctctccagagcaggtgcctctgagccctggcccagcaggtacagacgctgaagcccaatagccggtcttccgggaggtggtctggggaaggggatccaggtggagagtccccctcagtgcctgctttcagcctggccctcctccccctccctcttgcctcctcaatctgccggttgcctccagggctctcctagctcagcttccacttagagcccacttcctgtcttctgcaaggagcaggagcagggattgcaacctgagaatctaattgttcttaaaaagaatttcaacccgtccctttgttttcagtggcctgctgtgttcctaccacttcctgagtctttctgagaatgagtgggggagatctctggggacacttgggcttgagtgtctctgccgaaatcacttccatgtctctgccttctttccctctctcctaaaacatattactccttccactttctttttgtgggtgtaagcctccatattactttggttaattttagtgtgctttggaacacagatgagtgcatgttcattctgccttgtttaattttagagacagggtgttgctctgttgcccagggccgagtgcagtgttaagatcatggtttactgcagcctcaaccttctggcaacaagtgatcttcccacgtcagcctcctgagcagctgggactacaggtgtgcaccatcacacctagctaattttttaatttgtagaaatgagatctcactatgctgctcaggccggtggtcttaaacccctaggctcaagcaatcctccctccttggcctcccatagtgctgagattacaggcatgagccactgtacctgacccctttcaccttgtttagcctgacaacccatcttctccctctcaggtctttccatctcagtcttctgcactccaggcttctgcgtcttcttcctctgctcagcctttaattgtcgatgtttctggttctatagcttcatcttcttgtgtgcagtctctgtgaatgtaccctgtggctttattacctttgacattcttctgtcttctaaatcatctcctgaatagagtgttttctcctgtcctgggtgtcccgcagcccatagaagcagccatgctgtgggacaccctgagtggggtttgtgttacctgttgtgcctaccatgcccttccccgccgtggatgcacaggtgccccaccttagctgccccagatgctgtttatccttgatagtcaccttttaagccttatacaggtctatcaagttgagtcaccattaccacttggtgtgtgctgtgccttgtgtaatactgcagttccgggagtcatccaacctggaatgcatgctttgcggggatctatgatgccctcgaattgtatgttacatgtgaacctgtgagcattttctaggggctctgcacctttgtgtcctcagctctgagccccatgcttgctgcaaccagcaggtgttcagagtgaatgaatttgcttatcttggcataaatcatgtaactgttgatgataccccaggaaggtgagcctttggttataaatccttttaacattttccagtctaaaagttttgtggtcttattacacgatgtagaaaacagtgggcctcagttattcttttgctgttgtgccggagtataccacggttgtttttgaaagataactttgaccatacccttaggaacttcctcagctcactttcaaatggagggcactggctttctaaccattgtgtctcccagcccagtgacagctgaagctgactgcttccgatatcacagacagcacagaagagccgccctccaggtgctgctgggaaatgctgcctggaactctttgccatttactttctatcaaaagctgagggaaatggtacatatggggctttcctaaaaatatgggatccatccatttgtcaacaatgtcattctatcctatcccagggcctttcaagattttgatgaaaactaatagatcccatattccagaataatgctattaataattttattattattacttaatgatagcaaaaagttagctaactccaaccgctcacttgttatttgccaggtaatcctctaatccagaggatttggccttttgtgtgtgttaatgtcctgcttgcaccagctctatgaggaaggtgccgctgttgtcatttccatttctgcactcgtggaaacaagcgtagtgaggccagcctgagccacagagctgcaggtgggggagacagctggaaccctggcacctggctgtggagtttgagactctgactcctgcgccgcgctgctgccccaaccgtagtcatacgaggtgtttcaccccgccctggatactctgagatcccctctgggttcagcaggctcagagagctgactgcctggagcagaaggcatggggtcctccagagactcccctgagctgagttcccctgtggacaccagggccgcctccttgtggcgctccctgaagggtcctctctggaagaactgtattggttccctggggctgctagaggaaagcttcacaaactggggcttaaacaacagaaactgacatcccacagcgctggaggctggagtccgagatcaaggtgtcagcatgcttggtcccttctgagggtcgtgagggaaagatctcttcaggcccctttccttggcttataggtggcgtgttctccttgggtatcatcacatcgcctgccttctgtgcatgtctgcatccacgtgtcccctttccaataaggatattagccctttaggctgggtcccgtcctagtagtctcatcttaactaattacatttgcgacagtcctatttccagatcaggccacattctgagatgctgggggttaggatttcaacacaggaatttggaggaatacaactcaatcaggcttatggaaaattctggtcttaagtcaagggtagtgttctccagtctgtatatggaggcgcacacctatggtcccagccacttgggaggctgaggccagagaactgtgtgagcccaggagttccataccagcctgggcaacatagcaagacctcctctcaaaaacagacagagtggtgtcttccagagtgattagtttgcttaaaaaaaaaaaaacaaaacaaaacacaaaccgtaagcactggcgctcatgactgatcatcctgtatccacgcacgagctgcacgaaggccgcgcggtcactctggctccctgttggcgagtacctgggatttcttgctcagcattttggggccttaattcttttaggggactttttgtctaatgtctccccttcttctaattatgtgcgatatttacatagaatctgataaactgcttcaaatttgttttcagaacagtgagctggataattaaagaagctttttcctgcttcttgggcccagtttccatttctttcttttttctgtttttcctggctattctagtgctaatttccttcctttcctttcctaggctggtcttagagcatcctctcctatgtacagccagaccttctttcaagcttttattaaaatggggaaaggtcatttgggaggctttgttgttttcctgtttctaaagatcatttttcttcctgcaggggaagtccttaagtcttatttgtggggccctctcttggctccgtgactttgaacagaagaagcgtgaagaagaggcacgactccttgaaactggaactggccccttacatgatgagaaagatgaatccctgtgtctgtcttcttcctgcgaaggggctgcaggcaccccgaggcctgctggagaaccggcctgggttactcagtttgtgcagaagaaagaagagagggacctggtggaccgactaaaggtgagacctggggtatccggaagtgggagtactggaggaaacagggcttcagcgattgttctggggcgattccgagactcaggcagtgcatgctcccctgccgttgccgtgcctctcagctcttccctcagctccttgggtctatggtgctgccgctgtgctgtcttttttgagctggaggtcagcaggccttctccacataaggaactgttggtgcccatttattactcacctgggaaaggacctgatcattgccattggcagcatggttcaatggctgcaaatggatctgatggagagcgtgtggctttgggaggagtgtgccgccttccgcagtgagcagcgaggctgggaccggcagggatgaggtcccgggaggggatgcggcagcccttgagtgctggccggggaaggagagatgcccccagtgaggaggcgccgggctgagtggcccagactccttaggagaggcctggttttgggcttccttggtgattttccttcatgtctgcctcctgtaggcggagcaggccaggaggaagcagcgagaagaacgcctgcagcagctgcagcacagggtgcagctcaagtatgcagccaagcgcctggtgagcctcatttcttggggggcaggattatgtccaggcagggttgctctgcttggaggctcatgggtgcgtggtcagggccttggtctcccctccgtgaccctcactggctatgtgctcccgtacagaagctgggctgtgagtggttgaggcgtggatcctaggagtcgacctctctccagccaggcagccaggcctatgtgaatggggcgtggtgtgctttgtctctggcatgtggggaggtgggtactggtgctgagacttcttcctccctcaccacctccactacccctgtccagaggcaggaagaagaagaaagagagaatctcctccgcctcagcagggagatgctagagacaggcccggaggctgagcggctggagcagctggagtctggggaggaggagctggtcctcgccgaatacgagagtgatgaggagaaaaaggtggcgagcaggtgagacagaggcggtagcactaccctgccccaggccaggggacacccttgaagacagctctttccctcatgccacagatgccatgaagcacctggcaagaggcatggtggcctctgccctctgctctaagccgggtccttcctagggtccatgagtgccagtggcagtgaggacagtcaccggcctggcctgtgtcctctcagctgtcctcacggcagctcaggcagggcaggaacatttgtgtctgcgccttatacacaaggaggctgcagccccacaaggagagactccttggctgaggccacaagcctcggcagtggagagctgggctagaactcagctggcctggctctagatctcaggctctgaggcagctgactgcactgggtaacctgtgaggtgccaaccatcaaggcgtccttagcctgagctttccttctcccataaagcctctgttggtccagactcaaggtttccacttgatgagccatgagctgctgggtgacttagccctgagcaggccacccaggccatttcgggcccacaggatccctggtcacagccctgttcccattcacactggaacctcaccaccatccctgagtgtctgctctgagtatggcactgtccagatgctgtggacatagaagggaagaagacatggaggggacagttaatagacatgaaaacaaatagcacctatgtgaagtcagcatgtttgcctacaaggaaaacaaaatggtgatgtggatggggtggggggctgcacctgatgatgagtcccgtgtgtcctgtgacatcctggccaccacatctgtcggagggtaactgcaagaccagagaccctccatggatattcctgaaggttcatccccggccttcacagtctgtctgcagggcgccttctgatgccacctccagccgccatccaccagacgccagcttccccgctgccctgaacttcctccagcgcaccaggccttcctctgtcctgtctgaggatttgctcatgcaacgtgctgtggccaaacaccctgccctcctcccttggcagatgtcttcctctcctttaaggcctggctcaggtgtcgtcttggtggcttcgggtgtcagctgctctgttttgctcatgcacctgcttgtgcttctgttgttgcctcctctccctggctgggctcgagctgcttcagggcaggaaccacgtctttatagtttgatgttcccagagctgacccagtgtttggcataggggtgtgctcaataaaatcgagttgacatgaatgagcagatgctgcctcgttgcagtctggtagtgtaattccaggctgcgcatgtgaacttcgacttctgcccctgcccagggcagagaccaccgtgttgctttatgcctcgctggtgagagggggtcataaacagtttgtgctccatgaacccttcctgcccgcctccgaggtcatgtttctgctccctctcttctcccttagagcccgtggggacaaggcagagaacttgagtggagatggaggtggtgaatattaaaggaacaaagtgctccttcaggtctgggcaagagccatggatcctgtaggtcagcttctggggcttcccatgccctcacgtttcaggagataacgtgagcctcggaggacctgagttctgaatagaaaatttttgctcttcatttcttcacacacccagcctctcagtgagctcctgctggctttgtccagcatgcgacataagattgaatccaagccttttaagatagagccgcctgctctttagtgaccatgaagccaagcctgtaataattactcttctgatagcccaagacaattgtattctgttttgttagaaaggaatttcgaggtgaacaaaaatgttttctttttatgtgatgttgccataggtagcgtgtgcctgtcagatggttttgtgttttctgaggagcatagactagtagagctagctcagcttcaggccatgggatgcagggctggcttccctgccaacgcctggcgctgatggattcttcccgcattgctgggaagggcagactgaggcactgacacaagaagagttgtagctggtcataagtgacagcatcctctgttcactcgattggtcagttgtagcttcatccaggagatggtcatggggttcctgctgcataccaagctctaggtgaggccacggggactcagcagaaacaaggccgacctgggtcctcccttgtggacatgacagtctggggagatagaccgagaggaagcgattttgaatgagatgggtgtgaagagcaggggccatgaatctgtgtcagagcagccaggcctaccagggaaggtcaaagaaggcttcctggaggaggtgatgtttctgctgctatctcagagttgactgggagctggtgaggggagacaacattccaggcacagaacatccgaaggcctgagatgatgaagagcaaatatccgccctggggcctcagaggggtccagcttgctggagggagggcagagaggagagcagcctgccatgagtcccgaggcttccgactcaagacttgggttgggggtgctgagcccctttctcctttttacatttccctacccacagacctgagcggccatgggaggttggggttggcatttgcctgggggagtttctgagcgagcagcacctgctaccttggtggaacccattgctgggaatggccagggctcagcaccagcgctcagcagatgctcagtgcgttttgctgagtttgctgagggaagactgttttctgttctctctcacacacacagagtggatgaggatgaggatgacctggaggaagaacacataactaaggtaacacaagtgtcctcagctggtgctgtgctgggggtataggctgggctgtgcacccctggggaggaggctggagtcacttggctacttctcaccctcctctccacaaaggaggagcttccagcacttggactccgttgcttcttgcacacaaccctggtcctaagttgctcccttggccagctgcagtggaccctggagtcctctcctggggtcagggcctggggagtcctctcctggggagacctttcctgggaacagggacctgaggagacctctcttgagtttggggcctggggagacatctcctgggttcggggcctggggagacctctcctgggggcagggccatgcttgccaccccagggcatcgaggaacagctgttctgggctgaaatctgggtgttttctgtccctgctgggtggtacgggtaggacagacatgagtcccctgccctttgggtctctcatggtgtgcttctccctttgtctgtgttcccatttgcatggagggctatgggttgtgtatggtctgacatttcccatttggtttcattgatttatgacttgttttctgtcggaagtaggtattttctttgtattttctttttttctcccttcactcttgccttagaggagtagagagagggtattctggtcagccttcctttttccctttggggatgtgtgtgacacactccctcccctcccaccaacaacccaccctccccaagtggggaccctttgccacgggagatggtcacccatgtccaaagattggccaaccccccaaaagcggttgattagaggctggatatgactcgtggaaggagctgcctttggggcattcccttgaacttctggagctgtgggtgacttgggaatccctgggtccctcgatagatgcctgacatgggacattgctgtcctgcctcggctttgtgcattgggagccactccctttccctcagcctctcaggccctggcgtgccttgatgttagagaatgctgtgggatgttttggttctctctttgaagcgcctttctttctctctgctagatttattactgtagtcggacacactcccagctggcccagtttgtgcatgaggtgaagaagagcccctttggcaaggatgttcggctggtctcccttggctcccggcaggtaaacagtagccagtatttccaccaggggccatcctgctcctttcgccacaactttgtcctgctcgtccaggccttgggagacgctgggtctgtgacaggctgaaccgtgtgaggagcagccccctccctgacctggccggcccagcactggaaggcaaaggagaggtggcggggcaggtccacgtgtgttggtaggatgtcatttagctggcaccatctttttgcctctttctttctcctttgctgcagaacctttgtgtaaatgaagacgtgaaaagcctaggttctgtgcagcttatcaacgaccgctgtgtggacatgcagagaagcaggcacggtagccactgggaccatggtgtagccgcaggtggtctggagagagtgaggcaggggtggcagtgactgaagaccattaagtgtctttcatagaaagaatggcagaggagaccccagttccttcctgagtcccctctccttgggaaaaagtgttcctactctctgggtcagtgtctggtccgaatccttggcttggagatgattttacgggctctttctggagaacagaagtaaaaccttacagtgttccgatgagaccacagtaggcagtacttgggagggtcttatagaccctaccccatggaagtgggtctcaacattacacaaccccctcttgggcccgtggacagttgctgtcctctctgttttctctctttgtgcctgtgccaccctcagagaagaagaaaggagctgaggaggagaagccaaagaggaggaggcaggagaagcaggcagcctgccccttctacaaccacgagcagatgggccttctccgggatgaggccctggcagaggtgaaggacatggagcagctgctggcccttgggaaggaggcccgggcctgtccctattacgggagccgccttgccatccctgcagcccaggtgagggccctgcagggccagaaagccgctcttgactctcactgtggtctaggccatgaggggggtcctcatcacactgtagtttgggggatgccccccaccgtggtcaggttgatggcaccttaacccattctctcctgatgtgtgagttggaggaggcgcgtgggatcccttggggtctccaggcagcagggccagttggcattactggggatggtatttaggagccaggaaagccggtgcattcctagtgaaaccacagggagaggggggatgccaggagctgagaagagtgtgctgcatacatctatttacaaatggctttccaagtgatgctcccaacttccatgcctatgatgtgatggaggatgtcagtgatagaaccattcagttttccagtttttcctttttgtaatatcagtactcttaactggaaagctttccctaacttacacctacctgcagcacgtgagaatactgtcttctctgcctcaacttctcttgatttttaaacagaaggaagaactgctaatgtagcagatcaaaagtagtatctcactgttatttggtgggtgcagtttcactatttccttgctacttctttaatttgagtgactttggaaacgggatatcactagtggaaaattctgtataatccagaaaaaaatgtaaggttttaaaagattcagggaactaagtaaccatttgcacagcagctaaatgctcaccagcatacctgctgagctgtgtgggcactggcagagaaactgaggaaagctgccaggccccatggtgtcccaggccttccctcccgtctgtttgcctttagagcaagattagtgctataggcatttatacacaaataccataatatggcccaaaatctttacaatttttgaatttttaaagtactttgaccatattttgcttttatgttaatagtattccagtgaaattctgtgcatggggacactggagcccagaaaagttaagtgactcatattttctcaccaagcgtgggtgatggagccattcagttttccgatattttattttttatatgagtattcctttaactggaaactttcctaacaacaaacacctaaagatgtgcagagttgcttttatttttgttaccccagctccacgccttaaccctcactttgaaataggatgtatcaaccctattttgcagatgaggaaagcaagagtcagagaggttagacaactcttccagagtcacacagctggggagtagcagctccaggagtagaagctggggccgcttcctggtgcaccgatggtctgcaggtgtttgtggaaactcgggggcctccggggcgaccttgaggacatggacaaggctaagcaggggttcccttcacccagccctgcccttggtttactcaggagtcagaccagccctagtttcctgtgtttcatgtattggcttttcatgtgaaactcgaggagagcttgtccgttgccacaagctgtttttcgaatgtctctacacagtccaggcaggaaatagaagcactcacatcaggagctcagtgtcaggcaggcaaggctcctgcaggggagccccgccctgctcaggtggcctcatctcccctcccagctggtggtgctgccctatcagatgctgctgcatgcggccactcggcaggccgcgggcatccggctgcaggaccaggtggtgatcatcgacgaggcgcacaacctgatcgacaccatcacgggcatgcacagcgtggaggtcagcggctcccaggtgtgtgggcctcccctccccgggccagggcctgctgtgacgtaaagggacttggatggttcctccagacacctgggccaagagttcctccggaggtggggcttgatagagggtgcacgagtcaaggcggtgacctcatcggaggctgaccatggctttccagtgcatcgggggaccccgctatgacagagtgcctcatttccctgcacctcatctgcccccatgctcctgagtccctccagccctggatgccagcagccagttctgtaagccagggagatggcatgtgtgaggcagaagtcccctcaggattggattttgtcattactgaagttgtctggaggggactgaattgaggaatgctcaagatcagcgcaggctcctcctgctgccctatcatgcgccatgcatggcaccaggtgtctctggtcttcacgctgactctgccatgggtgtggtgttcctgttttacattggaaacttggagattcaaagatggtcaagctctgtcctgaggtcatgcagctcatgagtgtggagctggggtgtgcccactggtttctgactgtgaaaacccccacgacatcccaccagctctactgacctgtgcctgggctgaattgaggctgggatgtgatggtggccttgaaccatcactctttgtagactccaggtcttttcccaacccggtggaaacttagcagggagattccatacttgaggaattcagcctcttgctttttctctgacccacagtggacactggaggaaaacttcccttccttcccttttctcttagctcccaccagcctaagggctgtggaaacccgtaccttttgtctgcagccagccccctctcctccctttggtggcttcctgtgtgtccagggccagcatcttctaggtgaatctaagatgtcagtaccttagccctcagctgcttgctcagagcctggtttgtgttctttccccagctctgccaggcccattcccagctgctgcagtacgtggagcgatacgggtgagatgtgaccctctgaggtagtgggacagtcccttggtggccccctgcgtgggcctctgagaggcaggcagcactttggttcccacctctggcccgggctgtggcggggtggagctgcatgccattcatgtcctaggcacatcatggtgtgtgctgcacacagacctggaaggctggggactgaccgctggctctgaggcctggggccgtggccagcctgctctctgggaaaggatttgtagcttgtgacccagtttgagaggcaccgggcagcaaggcttccactggggtgggcggggcgagtcgccatcagggcaccaccacttaatgtccgttggcttcttctcaggaagcgtttgaaggccaagaacctgatgtacctgaagcagatcctgtatttgctggagaaattcgtggctgtgctagggggtgagagcctcgtccccctgctgaccccgggcctgcaaaactcgctgggctgctttttccttggatgcccatcaggacacctcagttctctgtgtttttaagaagggtcggccgggtgcggtggctcacgcctgtaatcccagcacttgggaggccgaggcaggtggttcacctgaggttaggagttttgagaccagcctggccaacatggtgaaatcccatctctactaaaaatacaaaaaaattagctgggagtgttgccgtggcctgtagtcccagctgctccagaggctgagacaagagaattgcttgctcaaacccgggaggcggaggttgcagtgagccgagattgtgccactgcagtccagtctgggcgacagagtgagaatcagtctcaaaaaaaaaaaaaaaaaaaaaaaagaagggtcttggtcattgatttagaaaattcttgttctttgtagcttagttgagttgtctgacttgagctttatttagacccatgggttctttgcccatgttctgaggactttttatttcaggccctgctctggggggatattaaggatacagcatcacatagacacacggtgtttccgtgataggcatagttctgtgggttgttcgaagcacttgcatatgcggttttgtgtgccctgtgagaacgcagtgctggtatttgaatccttgttgatagacgcataaactagagctcggagcaagggctgctcccagcacgggagcctgggatcttctgactccagctcccacgcctctttgcatgaccctgtcacgtccccttcttttatgatggggcacccccttggaaggcgtctgtggaagtggaagctgcagaaagcctgtgggagctcctggcgggagctggtctcgtgttgctgctctgagccaccagctctgctttgcctcaggctcaccagtggcctgggcagctcctctgtgctccggtgccctgcataccttggtctggctgctgtgtcccggcctcctggagaaggggtgaaaaacatgaacttacagggctttgggttccacgtgcaagcacgtgagtcagacatgggaggctcctggacccacctgccctctcagtgggtccgttgcatgctataaacagtgaaaagcaaaacaaagccatttaaatacagatgctcttcttacttgatgtgcagtgtggagggagagaagatagggaagggttgggggtcctgagaaccagcattgtgacctatttccattctcttttttagggaacattaagcaaaatcccaatacacagagtctgtcacagacaggtaagagagttgccctcagagggcccagagctgatctgagccacttccgagcttaaccctgggactgaaacctgaggcttagggtgaagctcccaaggcccttcatgtgtttgttctcagggacggagctgaagaccatcaacgactttctcttccagagccagatcgacaacatcaacctgttcaaggtagaggtttccacctttccacattccacatccaatttccttcctgtcaccacctgtgggtaaagtactatgttaagactgtagaaggaagaaaaagcaaaacagatgtgtaattacttaacccttaacgcaacatgcctgtgagacaaaagtcatcttcttttagagtgaaggccacagggatgagggatgggtgagaaagggacctttcttggtgccccatagaacagatagagactccaggtccttgctctctcactccgtcttctggcacagtctccctcaggcttatggacaggaataggacgttgatttgttctgtgcaacccctgtcacgtcttcccacttgggccttgggtctggttgcagcctcagacctctgctcactccaggtctgtgtacccagcgctccccagatgaaacacggccactgccgcctgaaccccaagctcgtaactcaaatcagcaacagtgactgcccccgggtacagggttctgcctctgttgtaggcggcatgccatgtgctgtgctctgagctaggatatccttttgccccagcaaggaaagcaaacaggcccgtggaggtgacttcaggagggtggcgagcacaggcttcccacaagtgagccaatagcaagtggcagagacagcgtccaaacctggctgcactgacttggggccccacattcttcccatcctgcctgccttttttttcttaaaaccagcttttcccctgaattacacatttgggtcactgtcactgccgccatccctgccagacaggctggatccaggtcatccttgatgcctttctccccttgtctcccacatgcctgtgacagccgccaggcctgacagcctgagacagtcctgccgtccctgcgcttctcccacagctgggacatgggtgcaggcactccttctctcgccttccctttgccctccttgctttccttctcccctcttcttcccatgggtctcgggtctcatcactcaccattgagggaatcctcatcgaaggacgtcgctctttttagaaaccggtttaaaggctccaaactcctcatctctgcatcccaagctaagatctggcaccaaaccacacacattggatgcaccgactgagtggcactgccccagcccctgagcaggtcccagccatcatctcctctgtggctttgctcatagaagttccttttttttttttaactctttgtcacctggaaggaaagccaaggggaactggattttactgagcactcttagacttgagagagacatttggaaagagggtctccaccctgaggaggacactgcgttgtgggcaggggcagtagaggagggggtggcctcggagaggagatgacaaggttggtggcaaggaggctccaggtgcctcagaaggtagcactgcgttgtgctgcctgggtggtagaagtggtgttttttgttttgtttttaagattatagcttgctcagtttgcactcatgcctacagctgggcttggtttttgcaggtgcagcgatactgtgagaagagcatgatcagcagaaaggtaactgctcccatcttgtggtcctgaacaagacccagctgtgccccaaccccctgcccttgccatgctttcctcccctgccctcagggaactccagagtccccttcgtctccactctccttggtgcagtgggccttgctggggtggtgggatgtgtgctgcaggtgtcttgggcctggcagagcctccgatccacccagcctctctctcatggctgtacctcgttcctctccactgctctctctcatcccacccagctctttggattcactgaacggtacggagcagtgttctcatcccgggagcagcccaaactggctgggtttcagcaattcctgcagagcctgcagcccaggacgactgaaggtgaggcaggagggtgggcaggcagagccggctgcacgcatgggcaaggacttctgttcctcatgtgtggacctgaccagagggaggcctcctccccgttctgctctgtgcagctcttgcagcccctgcagacgagagtcaggccagcaccctgcgaccagcttctccactgatgcacatccaaggcttcctggcagctctcactacggccaaccaggacggcagggtcatcctgagccgccaaggtaatcaggtggttcttggccaggttcagttcccaggaaggagccaagctgagcccgggagccgcagcgtgaaaggattctttccttccatcctgggaacttcctgggttaggaggaagcagtgcagtgggcactggcctgctgtgacctgggcaagcagtggaggtggatgggaggagatcgaagggctgggatgggggtcccgtgaccagggtaagcagtggaggtggacgggaggagatcgaggagctgggatgggggtcctctagggcaggggtcctagggaaacttctactgtggggtaggtgggctttggtttgggtcatgattttgtcatctatgagccttgtgatttggactattttctttctcaacttcagtttcttcatatgaaaatggagaggataggccgggcgcggtggctcacgcctataatcccagcactttgggaggctgagggggggcggatcgtgagttcaggagatcgagaccatcctggctaacacagtgaaaccccgtctctactaaaaatacaaaaaattagcagggtgtggtggtgggtgcctgtagtcccagctactcgggaggctgaggcaggaaaattgcttgaacccaggaggcggaggttgcagggagccgagattgagccactgcactccagcctgggcaacagatcgagactccatctcaaaaaaaaaaaaaaaaaaggatggagaggacagtgtggtccacctctgtgggctggttgtcctagagattaaatggtgtttaatttaaagagaaagcactagcacttgtgcctcagacctggactcacctgggggaccccctttgctgggacgacagaagtgtctgttgggcttgcactcacctcccaccgatctgtttttccaggcagcctcagtcagagcaccctgaagtttttgctcctgaatccagctgtgcactttgcccaagtggtgaaggaatgccgggcagtggtcattgcggggggtaccatgcagccggtaaggacacctttcccagcccctcgtgccccaggtgttgggatgagatgggggcttgggagagatgcattatcagtcctgttctctcctggggccccaagccagaaagggtcagctcgagcaggcccagtggtgtccgctgggtgacactgctattctctcactgctgtgccttttaggctgcaggagcagtggagactcctctgctgctccattctgtagccccaggatcacatgtctcccagagaaagctgttctgtggtttcaaactcaaggaaaaaaatcatgattccacttttaaaaggttcattttgatgtatatgaatataatagtctttgtaggcgtaatttttacttatgtgcatagctgttttaaaaacaaaagtacggctccctccatgtgctgtcactggaacttgctcttttcactcagcagccagagggtcataaaccctgtctccttgtcagcaagcatgcacgtatttcagtatcccagctgtgctggattccagttacacagatatatagcatttcatgtagctgcttctctcttgttaggtgtgcaagctatttgcagttttctgttttgagcatgactgtgataaatataaccgcatttctgcacagtggtgactcctacctagcgaagggcctcctggacaaaaagctgctgggaatcctgaagcagtgcttcccagccccagctgccttagcttttgatttttatatttttgtatggatagattcatagttttattcattcggcatattaaaagttgtttacagtaattattgtttctgacgttcacattgtgagagccccttcctgctagctcaggtcctccccgtggcccggtcagtctcgcctccagcacagcagaatgtcatgggatcaccatgggtgtcctttccccacactggattgattcatttctccaagctgctctggtttcttgtaatggggaatgacatttagaagtcaagctgtgggtgctagggtgtttgtcgtgctcctggggcgttttggtagacagatctaggaaatgttttcagaatgaatccatactggtatttctttctttctttctttttttttttttttttttttgagacacagtctcgctctgtctcccaggctggagcgcagtgacctgatcacggctctctgcaacctctgcctccggggttcaagcgattctcatgcctcaacctcctgagtagctgtgattacaggcatgtgccaccacacccagctaatttttgtattttagtagagatggggttttaccatgttggccaggctggtcttgaaatcaggtgatccgccagccttggcatcccaaagagctgggattacaggcatgagccaccacgcctggcccatattggtgtttctaagtaaaaatcaaaggatttgtttacttgaccttttattgtacctctttttctcttaagcctgaacatgtgtgctacattaacatacttatctgctctatcctataatatacttaaaagttttgaaatcatagtaccaatattacttctaacaatagatctgattgaaattgcctttcctctttgcctttagagtgtaacccactaaggatgcctggtcactaggctctaaagtcacgtggaaccaggcttctctccgtgtgcttctgttgtcagtttcatagataactaggctgtttttgtttcattttcttttcaattttagaatttgcttttttcttttctgacttgtagtttttaaatatgtaaatatttgtatggctcaaaagtcaaagcaatataaaaagatctattcaggaaagcctcactctcatccctttccagcccattccccacccccatagggaatccgttttactagcttatcctttcagtctttctttttcccctaaataagcaaaaacgtgtcttcatttttccctttcctgttttatttacacagaaggcatcttagtcagttgtctgaccatcgctcctctagtgggctgcgtggttctctgttggacagatgtagggagcttatccaaccagtaccctctggataggcaggcgcatgattacagggaaaggtccgggggcacatgctgtttggtatttgtgggctgtatcttctcactggactcctaaatatgggattcctgggttaaaaagtataaatatgtttaatttgttaactactgtgaaatttcatgagaattgtaccattctgtatcccaccagtactgtctaggaatgcctgtttctccagagtggttacttttggatttttgccagtctaacaggtgaaagcctggagattcttattcagtagtttgggctggggcctggccatgtgtatttttgaaaattttcgctggtgattttgctgcatggccagggttgataatgactgtgccagatttgctggatttcctttgctgttcctgcacatagtttaaacgagactgccagcactgggtatcagtcaccatttttctttttgttagtttgccatcagccttttctttgacctcttctttcagtttgtgtgtacttgctgtctcttagcccagacttctcgcttcctttctgctgggcctctgaggggtcatggggccgtgacgctgtggccttggtctacaggtgtctgacttccggcagcagctgctggcctgtgccggggtggaagctgagcgcgtggtggagttttcctgtggtgagaagctgtgcccagggtggggcaggctagaggtcaggttctggcccccgttttctgtgggtaatacctcatactgcgaccaggcacaggggcggaggagaccccggggtgggagcctcacccttcgtgcgctcgcccaggctctcctgctttgctccctgctgcctgctgcccagtgtgactggtgatggtgggcgggtgagcgctgtcagtcgctgttcctgtgctggatgatggggcagggaaatgccctctctgcagtgtcttgcagcacacctgcatctccagttttcggcccctccctggctcttaccaggtcacgtgatccctccagacaacatcctgcccctcgtcatctgcagcgggatctccaaccagccgctggaattcacgttccagaaaagagagctgcctcagatggtcagtcccagccagctcgccgcaccacagcctggcctcaggcagcaaagggttttctggggcaggggcgctctggcccaccctgagtgttttcagtgttggggaaattgcacagggacacccgcttagagccacacagaatgagcggcgtcgatctagatgcttatggaggaaggtctgagcttccccgcccctcacgccttaggctgcgaaatatgtattcataaaacctccaggcatcctctgaggacgcctcacacaggagaaagctgctagttccctttggctctcttgccctttggttatatctgcccctgccgggggtagggatgtggggcttgggggcatctcctgtggtgtgcctggggtgtgcagcccctgattgtcgttgtggtgcccatcaggaccctggacagaagaagggaggactcagtgccagggcaatagggaggccccctagggacgctagtgctgtgacatgtgtcagaaaggcgcagtcagcagcagcggctgggtgtgtttggtgggaggtggcacctaccaccccgtggttcccacccaggggagccaagtcctcttccttggctgtagtcctgccgagggtctctcctcagttttgagtctcaaggtgaagacgcggtttgtgggtggctgaggggttgctccatgggggctccctccctccctcctttccttccttagatggacgaggtgggtcgcattctctgtaacctgtgcggtgtggttcctggaggggtggtctgtttcttcccctcctacgagtacctgcgccaggtccatgcccactgggagaagggtggcctgctgggccgtctggctgccaggaagaaggtgagtggcctgtcggcagccttcccacttgtgaggacagtgccactgagtcctcctgggagctctcgtgctcatcgggtcaggacaggcttctggctcctcatccccaccgctcccagtccctgactacagaggatttcccccaaagtccctggctgtgaggttctccagtcccctggccagaaaacacaaggccacgagcagactcgagacctggcaccctgaacctgtctctgggaaatgtcctctgtctttctcagatattccaggaacctaagagcgcacaccaggtggagcaggtgctgctggcatattccaggtgcatccaggtgcgggcgtcatgctgggcttgggtctgagatcgtgtgggggtggcagctggaaacgttgtgggtgtcatccaagttttggctcagcaactcagcgtctgggtttctcctacaggcctgtggccaggagagaggccaggtgacaggggccctgctcctctctgtggttggaggaaagatgagtgaagggatcaacttctctgacaacctaggccggtaagtagtggttctgctcgtctcctgggccgtgatacatggccggccctcactcccagcagctgggcccctgcctgctctctgctgccattagagcccacagctgggctgcgactgctcagaccagccagctggagggaggggctcagcagctctgggtttggtcctgggagagcagttggattttaggctacccattgctgtatcaggacccagtcaattggcctagacgggatctctcagccgaacaagccctctccaggtggtaggtacagagtggagagaggctgagttttgatcacagtcggagaggctgagggaaggggtagaacggagcagctggtgacgtgggtgatgacccgggaggtcctgacgtccacctgctgggctcttgtctcccccgcccaggtgtgtggtgatggtgggcatgcccttccccaacatcaggtctgcagagctgcaggagaagatggcctacttggatcaaaccctcgtgagtgaccccagtgtcacagagggtgacaggagagtaggcagtgggtgggagtggcatcacccccagggctgatacagccaggccttccccgctgcgctggcgtctcctgccccctccggaagcttggatgcccctccacaccctcttgatcttccctgtgatgtcacctggacccctgctgctggcattggccacgaagcctcctggtctggctccaaagcctggcagggtcttttcccagggggagctgcaggcagggaacagtcctgatgggtcttccccttcactcccagcccagagcccccggccaggcacccccagggaaggctctggtggagaacctgtgcatgaaggccgtcaaccagtccataggtgagcctggctgcctccagctgggtggacagatgggggctggagaaagggagaacaggaaagaggggttgcctgccctgtttcctatataagtctgaggaaggggagggggtcgccgtgggaatgtgctgtaggggggaggcaggtgttgctcggagccccagcctctgttcctatgcaggcagggccatcaggcaccagaaggattttgccagcgtagtgctcctggaccagcgatatgcccggccccctgtcctggccaagctgccggcctggatccgagcccgtgtggaggtcaaagctacctttggccccgccattgctgctgtgcagaaggtcagtcctacctttttctttctgagagcctccccaccccgagatcacatttctcactgccttctgtctgcccagtttcaccgggagaagtcggcctcttcctgatgggcaaccacaccactgcctggcgccgtgcccttcctttgtcctgcccgctggagacagtgtttgtcgtgggcgtggtctgcggggatcctgttacaaaggtgaaacccaggaggagagtgtggagtccagagtgctgccaggacccaggcacaggcgttagctcccgtaggagaaaatgggggaatcctgaatgaacagtgggtcctggctgtccttggggcgttccagggcagctcccctcctggaatagaatctttctttccatcctgcatggctgagagccaggcttccttcctggtctccgcaggaggctgtggcagctgtggcatccactgtggcatctccgtcctgcccaccttcttaagaggcgagatggagcaggcccatctgcctctgccctttctagccaaggttatagctgccctggactgctcactctctggtctcaatttaaaatgatccatggccacagggctcctgcccaggggcttgtcaccttcccctcctccttcctgagtcactccttcagtagaaggccctgctccctatcctgtcccacagccctgcctggatttgtatccttggcttcgtgccagttcctccaagtctatggcacctccctccctctcaaccacttgagcaaactccaagacaccttctaccccaacaccagcaattatgccaagggccgttaggctctcaacatgactatagagaccccgtgtcatcacggagacctttgttcctgtgggaaaatatccctcccacctgcaacagctgcccctgctgactgcgcctgtcttctccctctgaccccagagaaaggggctgtggtcagctgggatcttctgccaccatcagggacaaacgggggcaggaggaaagtcactgatgcccagatgtttgcatcctgcacagctataggtccttaaataaaagtgtgctgttggtttctgctgagttttttattgatatgtgctgctgttttctctggaagcctctttagggaatcgaggagcgcactggtgcaggggctgggtggagccatcctccgatggagcacaggcagacggaagcccccaccccagctgcgtggcctcaagccagcctcccgctccccgaaggtggtctccacacagacctgggacagtttcatccccgccccttccagggcagcagggctgaggatcccattctggctgtgtccacgtccgggccatggctagagtctgggtttaggggaggaaggcatggcggcgcccgctaggatttccagttgtcctcttcttcctctgcctgtggctgctgggggttagcagagacggtttgttgtctgacatacgggctctctcctcccggcccctcaccagccccagaggtgaaaaggctggaggggaaagggtgagtgagggaggtctgtggggagcactggtttccccaggccccagagacttaaacacaggaagaaaaaggcaagagagaattaacgatgccacagcccatggcagacagcggccctgcctcctacccttgcgtctcaggaccagcttgttgaagagatcccacatcagttccctgccttggcttacggctctcactgcaataggaaagccacggagtggggtgtggggttcagtcacatttgacccccggctccgtgttcctgtcccctgtagtgtttttgttattagacccttttttctccttggtttaggaatgggggccccagggccacccttgtccaggctccctctaccgtagaggtgagaattccagggagctacaatttgaaaaccactattttatgagccaagtagaacaagaaatgacaactattaaaaaaaataagggatttctgaccagctaacaaccccacagaaaatccgccagggatccagaaatgagactgaggtggcctcagagagctccctcctgaaggggatgctgctgctgtcgtcctgcccggcgccttggactgcagtggccggggcctggggtggggatgagggtgcactgaccagcaccgcagcagctgggggaggttggggtgctgttaacgtgccatcttataggtaggaagtggaaatgggagaaagtgtggggtgcctagggaaggaggtgactgagcagggagcctggctgccatcctaacacccagctcactgggcttgagcgacttgagcctggtgccagggcagagtgggtgatgctggggcccaggctggcaccatacttgaggtctgccaggcaggtcaggtaggatggcacatcgaccttgggggacttggcccaggtctggcatgtagaagtagttctctgggacccatgggattaggtggggacatgtgagaggtgacagggacctgcaggagcagctagcgagacctcatgtgcaccctgcacagctgtggtggcataagggattcaatagagcctctcctagagaggagcctggcagggcccccagcccttgcacctgcccctccctctccaccttctgctccagctgctctctcactgatggacaaggggcactgaacagtttatctgtctctacccccagcatcacatgggtctttgttacagcaccagccagtccgtctgggaagacagacttcttgtatctacaggggcgacgtggaggtcaggcaagccggcacctgctgtcctgggaccatgttcctgacctacctctcccatgtcatcagggacactgcactgaggggtcccaggccactgagccaagccaccctggtcaccttctggctcccacctctgtgctgcacctgagtgtgatgccctaggaccccattaagtcaggctgagtcttgcacccacaccctgcgactccattttctgctacacaggatctctctgatgttgacgagcagcatggagacctggggagaccccccaagcgcctcctccatgtcatccttgggctccagcttggcgctcacacacacaggaaaggacttcagcttctcctgggagggctgggtggctgaggggtggtggatttcggagttggactagcagctggcctagaggctactggggaggagggagcagggagcacccactcctgatccagattcactgcttccctcgcatctgtcatgaccccaaagaagcagatcctgaacctgggctcttgtctttacctttgttctcttccactctggggtaattaagaatgatttgctggccaggcgcggtggctcatgcctgtaatcccagcactttgggaggctgaggcaggtggatcacaaggtcaggagatcaaaaccatcctggctaacacggtgaaatcctgtctctactaaaaataatacaaaaaaaattagccagtcgtggtggcacacatctgtagtctcagctactcgggaggctgaggcaggaggatggcgtgaacctaggaggcggagtttgcagtgagtggagattgcgccactgcactccagcctgggcgacagagtgagactccgtctcaaaaaagaaaaaaagaatgatttgctaattaattatgcaggcagctgatccagtgctgtgtaaccttgggggccaccagatgccaatcaatcagtagaatgggagagaaggatggaggaagtgaggacaaggggcaaggaggaaggtctgtccacctgtctcttctgtgcaggaggtgtccaagcaggaggagcacgtcacatccccactgaaaaagcccacagaaaatgaaaagcccacatgcttgtccattgctgcaggatgggggcaagtggagggggagaggtgtcggcgctcccaccttactcccagtcatggctgactcctccctttccttcgttcttgttcctaatctgtcaccatgtcctgtcgttttctttgtctcacccaaccctctctgcctgaaaatcccctgacggcagcctcatccctgtcacctcctgactgtagttggtgacagaagaggaggctgcactagtgaaggagcagggactccaggtctggcaacaaccagggatggggccgggtgggggtgacttggaccaggagaggggcctgagtcaggcagtcacatacttcatgctggggtcccccaagtgaagcacatttagcaagatctgaaatacagggaaacagtcttgtttcttcaataaataaattgcaaaggagaaacaattgatgaaaggagaaacctatagatccagaaatactaacaggcaaatcaaacaatcataaggagagactttatttggattttgattcaaacaaactaacaaaaaaatgaaattactggaaatttggagacagtagggtagttggtagtattaaagaatagtagtgtgcgatggttggtatgataatggtattgcaattttgctttttttttaaaagagttcttggctgggcacagtggctcatgcctgtaatcccagcattttgggatgctaaggcgggaggctcatttgaggccaggagttcatgaccagcttagccaacatggcaaaaccccatttctactaaaaaaaaaaaaaaaaaaaaaaaatacaaaaaattagcctgatgtggtggcacacacctgtaatcccagctactcatgcagctgaagtaggagaatcacttgaacccaggaggcggacgttgcagtgaactgagattccgccactgcattccagcatggatgacagagcaagactctgtctcaaaaataaataaataaataaataaataaatcataagttcttatcactgggtatggtgtctcatgcctataatcccagcacatttgggaagcacaatttgggaagaattgaagtctttattaagtatttctacccatggatccatgtatttcttcattgatttaggtcttctgtgattttgtttacagcattttgtacattttcagcatacagatcttatatagacttaatcattttttcagagatagtacaaatgcaattattttaaaatgttgattttctgttagttattgttagtatatacaaatgaaattgagttttgtattttgaacttgtgctacttctggaatgtgtgtgcgtgtgtgtgtgtgtgtgtgtgtgtgtgtgtgtgtgtgtgtgtgtgtgtatgtagtccttggaatacaccataaccaagtgggtttttcctgggaatgcaagactgcttcaatacttgaagatcagtcaatgtaatctgccatagtaataatctaacaagaaaatcaacatgatcacatcaattgatatagaaaaaaaatttacagaattcaacatattttcctattacagattttctgcaaactaggaatagaagcaagcttcttaacctgatgtatggcaccttcaaaaagcctacagcaaacatcttacttagtgatgaaaacctgattgccttccccataagatttgagaaccaggcaaggatgtttactctcatcatcactcctatccaacatggtactggaagtcctagccaatacaataagggaagaaaatgacacaaaataaaggtagtaagattagaaagaaagaaattgtctctattcacaaacaaggtgatttcttttcctttttcttcttttttttttttaagagacagggtccttctctgtcacccaggcttaagtgcgatcatggctcattgtatcctcaaactcctgggcacacacaaacagtcctcctgcctcagcctcccaagtagctaggactaccggtgcatgctgccaagcccagataattttttttattttttggagacacaggtagtctcattctggtttcagctctggaaggggtgaagaacaagtccccagagcccatcctgtccctcgtggatgacatactgagggctcaggaagactctccctcacagcctgccccagtttccaggctgagccacctgagcagctgcttcagaaagcctcttgtgccatagccatgcttaggaaaaagcatatcttccattcaattcaccaagaaacaccaagaaataactggatacaaagaataaaaaatactctgccacactggcagggcaggagggtgaaaattgtgccccctccaaaggtaatgtctataaaaggataactaaggccagcgccaaagtccacctacagaaggcgggtctgtctcaaccccagctgtcagtcactgtgaacttttagaactggggctgaagcttcttccagttgcttgctcagatgtcagtgagaccgctccacaacagataaggggagctgtgtgtcagggaagtcccagccactagcacaagctgcactccaggcagacgtttctgttcttgtgcaaagaacagcgcaatccattcaagttcacaggggcgggtggcacttgaaaatgtcagggtcaacttgcagggcagaagttagcagggaagtaagtcttcctgggggagtgggagagcccagcagagtttaggaggagggaggggcaacatcggggcaatcctctgagtctctctttcctcctcaggaactgtccaggaagaccctgcagtctctctgcaggctcatgggagctcccagaactgagacaacacacagatccaggcctgcttcgaagtcagtgggatgcggcccttgaaagtcgatgtattgggttcctagggctcttgtgaaaacatgccacacctggctggttttaaacaacaggagtttattctgtcagttgagaaggctagaagtgcaaaatcaaggtattgacgggatgagttccaactagaggctgtgaggcagatcaactccatggctctctcctggcttctgctggtttctggcaaccattcacttcccatgcctggtagacacatcactctaacctctgcctccctttttcacgggcacattcgcgtgtgtgtgtgtgtgtgtgtgtgtgtgtgtgtgtgtgtggatgtgtgtgttaaggacagcaatcattagactaggtggggcccactctaatccactgtgagcttctcttactttggtaacatatgcaaagacccaatttccaaacaaggtcacattccatgttctgggactgtcttctgtgagatgtctcccccaggatccttccaggttttctgcaaagccaggcagaaaaccaggatcagggcaggacaagaggatgctagcctgtgatggctcccactcaggtgggatgtgagaagtgcctgtggcctgggacacaccaacttgctcccaatacctcatctgagatggattgcacagtgtatgtccagggcccatcccggcacactgtgcctttgcaatgctgtctctgcgctttggaaattgactcagcccactgcgtggggtggtctgaggcgggccacaaccatttcttaaccatccctgagtacctgaccagtatcccccgggggtgacaactggctacatctggagcatgaggagcgtgtttacctggtgagtaaggatgcaagcataggacgtcctggccgatcctctgcacaagcaatgcctttgctccaacgggatgggcaacgttggattaggcctgaggcagatttgatcttggaagatacattcaagtctacgtgttttgtgcgtttattttcgtttccttgaattaacatggagtccatttcaactttcacttagtctccttctttctcttcccccacttctctctctctctttctttgtatatggaagaatttaactctgtgttccataatgtctaaatactcaaatttagagttgacagccatacagcaaattattcaagttgctgtcaaaaaaaaatccctgcgttttctaggattaaaactgtgaatagagtactggaagaaaaaaaagtcatagactcagatgcaaaatgacaacatttaatgggatgataaggaaataagacttgtcaagaaaccatagcccactgcagactgttcacgatgtcagatggttcatgatttttttccaggtttgatacagaagaatcagtttgttaaaagaaatgcttctccacctgggatttaaaacatcatttaaacaataaacacatttgtatgtatatataaatagatatttagaaataaaaacatgcatatataggcacatagacatgtatatacatatacacacatatgtacaaatatatatgcctaaatttttactgacctgtcaacttacaaaacaaaaatgagagatttataaaaggtacatatatagctgtgaattctttaaagctatttttaaagaaattaatataatcttaatgattatcagattactcatgcagtacacagctacacaagtctaatgaagtaccagagacttttctttcttcaactattgtcctatcttattcaggttttcattttcttactagatgtgttttcaatggtttatgacgtaataaaatttctttacttcttccagtaattgctttgtctcactcggaaactgaactactgttgatgtggtaaaaagctagggcatattcttctgaaaaaataaagggaacatgtatttttattaaatagatgatataagcacattagatctaatccttccaataattttgaaatagagacaattactttcccattttatacattatgcagaaatatgctaataatatttaagacacttgatgaaatatattctattagtaaatgatagagacagaattcaaacactccacaaacttcacacagcattcaacaagaaataaatagtaccaaccttccagggaacagttgtatggtctctacaacattttagtatatgttttagaaattaatctatcaaatttttaagttaacatttcagaatattccccactcctctttttaagtcaaagtccacagaagtagcttggaacagtcagtcttagcatgaacaacaatgacaataacaaaaagacctggaagcttagtgtggcttgtatttcaagttcaagtggagccctgtcaggttatattgcaaggattctggtgttgaaaaactctggtaactggaaaatgggttcagtcagaagacacatcatgggataaagaaaccagaacacaaagtaatgccatttattgtttactctgtgaagacagaggttgattttggaaagtttagtagctcagggaatgttagatataaacaccacattcaataaccttagggcatggctgttgcttgcctacctttttcgtactaatcgtagaccatgcctggggctggctgaatgttgaacacaaggttgctctgctcagcagaaaaagtgaaactgtctgctcgaccaaaaacctatcatgacacaaattataattacattgtagcaggtctgagaaaagataatcactgagaaaattatccgcagaagtttatgatctacataattaaatagatctagggtatgattaacttacatattggcaaaataatgagttgttaaccttaaatcatataaaatttcaagttcctttgcttacattgaggtgagaggaatttagctggaagtctcagaggaatgtaggcatttatgtgagtggtaacaatacacatagaaaggatgtctctaaagcgcatgccatagtttggcatttcctcagtaaaataaaaatagaactaccctatgatccagcaatcccatttctgggtatgcatccaaagaaaatgagatgaatattttgaagagacagctgcagtcccatgctaattctttcattaatcacaatagccaacataaggaatcaacctaagcgttcgaaacagatgaatggataatgaaactgaggcatatacacatacaaattattcggccttaaaagaagaaagaatttctgccatttgtaacaacactgaagaacttggaggacattatgtggaatgaaacaaaccagatacacacaaaaaacactgcaggatctcacctgtaagttaaatctaaagttgagttcatagatgcagacagtagaatggcagttatcagggatgggaaaatggggagatgctggtcaaaggatagaaagcttcagctgtgcaggatgaatacattctacaaatctcaggtacagcggtggcctacagttaacaatgctgtactgtatatgtaatattccctaagggagtagatcttaagtgctttgtcacaaaaaaagaagaggtaactgtgtgaagagagggatgtgttagccagctaattcacatatagtcacgctagatgataacaatcagctcactatatatatcaaaacatcacaccacataccttcaatacacaattgtaatttcaaaaaattatggcaaactttgtaagactttagtcaaattataaaataattacatatctactctgtgaccagactgtgtttgatagggagatgatgtttctaaaatggaaagctatctagtcacatagccagggcatatatgaaatagccttggaactagcaaggagaagatgatcagtgggataaaacactggtaatccttaacgtcccttattttttccttttacaaatcctatcatacatatctataagaaattgaagcatccaattatccttggaaggaaaaaagaaaaactttaaagaaaaaaaaatatggctaaacttacattttccaagtagaaaagaacatggtcattcttgacttcagtcttcatcacttggcccttgttttcaagctttgaagaaattgttagggaaggatagagaatagatattagaacaaatgacagcgccactgcagaactgaatgtccactcttttctacgtcacgttctgttttatggaacattccttggtgccatgatgttttcataaacacaggtagcaactaaagaaaaacatatgatgaaccatgggaaatactgactgctaattggtacaaatgaagtacaccagctctccagtgttagcgcaaaaatacaaaggtgaatgttgaagaagaattctatagttttgttttgctaaactacggctaaacaagtatttattttatctttatactctatgtagctgtctttgtgatgaaagattaggcttctattatttacctcttcaatggatgacatggttggagtaaatcctgatagcatttttacatctataaccaccatactggatttattgcgaattccagtgtatctgaaaattttaagaaaacactcgtttagatatcaattttaaaaagtgacttatctcataatgagagtgccaggtggataaatactaattggctagaaatctggaggacaggtaaaagctgaagagaaaatatcggaagaaagtcattttcaagcatctgtgaataggcacaaccagaatgataatgaaagagatgatacatagcaacagaaattggagcaaataatgaattatctggacatgaaatcttccccaaaccctgcttttaagcttacctgcagtctcaaagtttgaactgataaacagagcttctaaatcttttacatatacttaggttagtgttagagttgcgtaacacttagaggacatctttgcttaaaaggtggtatatgagcataattatagagtagatgtgtccccaggagaacttctagctcagtttcctgcttctggataagactattggggtatgaagttaagagttccatagttcatcagggcgtggttgctcacacctgtaatcccagcacttctggaggccaaggtgggtggatcacttgagggtcagagttcaagaccagcctggccaatatggcaaaactctgactctactaaaaatagaaaaattagccagatgtggtggtgcacgcctctaatcccagctactcaggaggctgagccgtaagaatcctttgaacccaggagctggaagttgcagtgagctgagattgtgccactgtgccactgtactgcagcctgggtgacaaagtaagactctgtctcaaaaaaaaaaaaaaaaaaaaaaaaccaaaaaagaaaaagagttccccaattcattgagttcttagccctggagctcaagcgatttttatttagaaattctaaaaaatatctcccaaactaattttactcaatgttttccacatattaactaaggctaaaagcctttagcatctataaatcatgcttgaattcaagaggatcatttcgtttttctattctgaaaagtaaaaatctaaaatgttactctttacagttacaaaataaacatttgtgggcttgctactatatgaccatgcatgcttgtcttgagaaagaaatatagaatctctgtttttcaaaactaggagtacttccatacaacagaataaaaagtatcattgaaacatcagtgcagtgaaagctttcaaatcctgctcacatagactgcatgttttcttgcctcattttagctctgatttagctgaagatgtactaaattgtggtgtccggacagacggctaaaaagtgactgtgctgtagaattgtcaccaccaacatgagaactcattaccatgatttatattttgttatttcactactgtttgaacttttaaaatattttaccatcttgttcacgtgggagttactgtcaaaatatgacacttacttgaggttcactgtgaggtcaaaaacagtcaaagagtagttctttactatttccaaggaaagagaaaatccagatgccttcttaggtaggagaacattgtacttaagggtggcctagaaaggatagcaaattataagaaaacccatcctgtattaagaattatacagtctgactatagtcagtagtaatgtgattttacattttaaaataactaagagtatacttcgatcatttgtaacacaatggataaatgcttgaggtgatgcataccccacttgccctgatgtgattcttacacattgcatgcctgtatcatgcacccggtaaatatttacacctactatgtacccacaaaaattaaaaataaaacatttttaaaaagaaagaacctattgtttatttctattactaatgcagtttacatctttatcatcagggaatcaggttaaattctttagttttcagaataacgtaatttaatgaagatagaatactttctaatagcaatattcctcaaacttctcttagacagctgagtagcttttcataaagtaacttgcaattttggctattgatcatgtaaatacacaaaacggtcaaataacacttcacgtagaactgaacagacagtctgactcttttactggcaaacactcatcaccctcttaggcagatttctgtaacctggataaatgtacaaccgcgtccttccacatctactgtgtattgtccaggtgcctgtgttacttctgaacgttggaccagtaggcggttatgaccgttaaactggatctcactggatccttcactgctaaaggtgacagtgttttgattcttagagaagagcccctcttccccgcctggctcttaggatccccattgcagggcggggaggcacccaccgcgagggggagactgagagccagtccctcccacccccggctcttaggactcgcatcgcaagcgggggaggcacgccacgcgaggcggggactgagagccagccccccttccccccgggcttaggacccccatcgcggttcctaagatccttaggacccacctggaggactgtgggtatggggtgtccaagaagaaagctcagatctgcccacggcaggtaccttacttgggatttacaatcgacaggggtccgaacgcagcccgggaaaagaaagaaagcaggtcatttacaatctaccggagccagcccgtcttcccctcgcttgctcttaggtcccccatcgcagtggggggaggcacccctcgtgaggcgggaactgagagccagccccacctcccccctggctcctgggacccccatcgcagtggagggaggcactccccgcgaggcgaggactgagaaccagcccctcttccctccctggttcttaggacccccatcgcagggacggaggcacccgcagcgaggcggggactgagagcctgcccctcttacccccctggctcttaggacccccatcgcaggagtcggaggcaccccccgcgaggcggggactgagagagagctcctcttcccccccaggatcttaggacccccatcgcggggggggaggcactcccgccaggcgaggactgagagccagccccttttcatcccctggctcttaggacccccatcgcagggggggaggcacacaccgcaaggcgggaactgagagccagccccacttcccccctggctcttgtgacccccatcgctgtgcggggaggcaacccccgcgaagcggggactgagagcctgcctctcttcccccccaggctcttcggacccccatcgcaggcgggggaggcaccccctgcgaggcggggactgagagccagccgctcactccccctgactcttaggacccccattgcaggggggggacgcacacccggagaggcggggactgagagccagcccctcttcccccccaggctcttgagacccccatcgcagggggggggcaacccccacgaggcggggactgagagccagcccctctacccccccatggctcttaggacccccaatgcaggcgcgtggcaccccccgcgaggcggggactgagagccagaacctcttccccccctgtgtcttagaacttccatcgcagcgggggaggcactcctcacgaggcggtgactgagagccagaccctcccacccccggctcttaggacccacatcgtagtggcgggaggcaccacccgagagacggggactgagagccagcccctcttccccccctggcccttgggaccccgatcgcaagggggggaggcaccccccgagaggcggggatcgagagcctgcccctattccccccccttggctcttaggacacccatctcatgggtgggaggcacttccagcgaggcgggcactgagagcccgcccctcttccccccctggctcttaggatccccatcgcaaggggggaagacaccgcccacgagtcggggactgagagccagcccctcttcccccgctggcttaggacccccaccgcggattctaagatccttagcacccacctggaggactgggggttttaggtgtccaagaagaaagctcagacctgccgaccgcaggtaccttacctgggatttactatccgacaggggtccgaacgcagctcgggatcagaaaaaaagcaggtcatttgcaatctaccagagccagcccctcttcccccccttgctcttaggacctccatcgcagcggggcaggcacacaccgcgaggcgggaactgagagccagcccctcccacctctggctcttaggactcacattgcaagtgggggaggcatcctccgcgaggcgcggactgagagccagcccctcttccccccctggctctagggacccccatcgcagggggtggaggcaccccacgcgattcggggactgagagccagcccctctccttccccctgctcttcggacccccatcgcagggcggggaggcacccaccgcgaggcggggactgagagccagcccctctaccccccgtggctcttaggagccccatcgcagggtgggaggccacccggcgaggcgaggattgagagccagcccgtcttccccccttggctcttaggagccccatcgcgggtggggaaggcaccccccgcgaggcagggactgagagccagcctctcttcctcccgtggctcttaggacccccatcgcagtggggggaggcaccccccgcgaggcggggactgagagcaagcccatttcccccccccccggctcttaggacacccaacgcagaggggggaggcaccccctgcgaggcaggaactgagagccagacccacttctccccggctcttgggatccccatcgcggggaggggaggcaccccacacgaggcggggactgagagccagcccctcttccccccctggctattaggacccccatcgcaggggggagaggcaccccccgagaggcagggacggagagcctgcacctcttcccccacgggctcttaggacccccatcgcaggcgcttcgcaccccacgcgaggcgggtactgagagccagctcctctttcccccgtctcttaggactgccatcgcagagggggaggtaacccccgccaggcagggactgacagccagcccctcttcacctctggctcttaggcccccatcgcagagtggggaggcaccacatgcgaggcggggactgcgagccagccccacttcccccctggctcttgggaccaccatcgcagtggggggaggtacaccccgcgaggcggggacggagagtcagcccctcttcccccactggctcttgggaaccccatcgcaagggggagaggcaccctccgcgacgcggggactgagagacagcccctcttccccccctggctctagggacccccatcgcagggggtggaggcaccccacgcgatgcggggactgagagccagcccctctccgccccccccgaccccgcccgggtcttcggacccccatcgcagtggggggaggcaccccatgcgaggcggggtctgacagccaaaccctcttccccctctggctcttatgacccccatagcaaggggggaggcaccccccgcgaggcggggactagagccagcccctcttcccaccctggcttaggacccccatcgcggatcctaagatccttaggacccaactggaggactgtgggtattaggtgcccaagaagaaagctcagatctgccgacgttacttgggatttactatccgacaggtgtccgaacacagctcgagatcagaaagaaagcaggtcatttgcaatctaccggagccagcccctcttcccccgcttgctcttaggacccccatcgcagcagggcagacacacaccccaaggcgggaactgagagccagccccacttcccccctggctcttgggacccccatcgctgtgtggggaggctccccccgcgaagcggggactgagagcctgcccctcttccccccccaggctcttcggacccccatcgcagtgggttggaggcaccccctgagaggcggggactgagagccagcggctctttccccctggctcttaggacccccattgcagggggggggacgcaccccccgcgaggcggggagtgagagccagcccctcttcccccccaggctcttcggacccccatcgcagggggggaggcaccccccgcgaggcggggactgagagccagcccctcttccccccctggctaagacccccatcgcgaatcctaagatccttaggacccacctggaggaccctgggtattaggtgtccaagaagaaagctcagatctgccgaccgcaggtaccttacttgggatttactataccacaggggtccgaacgcagcccgggatcaggaagaaagcaggtcgtttgcaatctaccggagcctaagggcagaaggcaggtgagagaattcttaggagctgtggggttttgtagactgtggatcccaaactttgcagtattagccaagcctttgtatgaggtcacaaagggggcggggaccgggaagctttggaatggggatcccaacaacaggaaggctttcaggagttaaaggaaaaacttctggcagccccagccctggggctaccggatctgacaaagccttttccattgtatgcgtcagagagggaaaagatggcagctggacttttatcccaaactgtggggacctggctgaggccggtggcctaagtctctaaacaagtagacagggtttctacaggatggcccccctgtttgagggccttggcagcaactactctgctagtactagaagcaaataagctgactcttgggcaaaacctgaacataaaggcccccccaaactgtggtgactgagagccagcccctcttccccccctggctcttaggatccgcagtggactcacagcctgtttaccatattgtgagtaatatcatctccccctctggagacctctggagattatgaactgtttcacagacaggtgtacacccttggtgtacagagggtgtacacccgtctgtattgggagtaatatcatcctcttcctccctgaatattaagaacagtatcacaggggtgtttctactccctgcgatatcgcgtgtcatatcctcctctcccacgttgcaattagaaacaatatcagtggtggcatgtccaccttctgtcatattgaaagtaatatcattttcttccctccaggatcgtgggaacaatatcccaggggggtttccactttctgccatatatgtagtcacatcgcccactccgccttggaatattattaaggaccatctaacacgagggtgtatacgtcctgcgatattacgagtaatatcaacttcttggcctctgaatatgaggaagaatatcacagggtgggtgtatacctcgtgctctattatgcggagtcgtatctgtctattacggggagtaatatcattctctccctttcaggatattaataacaatttcacaggctgggtgaacacagccggcgatgctgaaattattatcatcctctccccctcttcccctcctggcccttaggacccccatcgcagggggctgaggcaccccccgcgaggcggggactgagagccagtccctcttacccccctggctcttaggacacccatcgcaggggggggaggcaccccccgcgagggggggactgagagccagcccctcttcccccccggcccttgggacccccatagcgggggggggaggcacacccctcgaggcggggactgagagtcagcccctctacccccccggctcttgggaaccccatcgaagtgtggggaggcaccgcccgcgaggcggggactgagagccagccactcttccccaccggctcttgggatccccaccgcagggggggtaggcaccccccgcgaggcagggactgagagacagcccctcttccccccctggctcttaggacccccatcgcagtgggggaggcaccccccgtgaggtggggattgagagccagcccctcttcccccctggctcttggaacccccatcgcagaggggggaggcaccccccgcgaggcggggactgagagccagcccctcttccccccctggctattacccccatcgtggatcctaagacccttaggacccaagtggaggactgtgggtattaggtgtccaagaagaaagctcagatctaccgatggcaggtaccttacttgggatttactgtccgacaggggtccgaatgcagcccgggatcacaaagaaagcaggtcgtttgcaatctaccagagcctaagggcagaaggcaggtgagagaattcttaggagctgtggggttatgaagacagtggatcccaaactttccagttattagccaagcctttgtatgaggtcacaaagggggcggggaccgggaagctttggaatggggatcccaacaacagcaaggttttcatgagttaaaggaaaaacttctggcagccccagccctggggctacccgatctgacaaaaccttttccattgtatgtgtcagagagagaaaagatggcagctggacttttaacccaaactgtggggccctggctgaggccggaggcctacgtctctaaacaactagacagggtttttaaaggatggcccccctgtttgagggccttggcagcatctaccctgctagtactagaagcaaataagctgactcttgggcaaaacctgaacataaaggccacccatgctgtggtgactgagagccagcccctcttccccccctggctcttaggatccgcggtggactcacagcctgtttaccatattgtgagtaatatcatctccccctctggagattatgaactgtttcacagacgggtgtacaaccttggtgtacagagggtgtacacccgtctgtattgggagtaatatcatcctcttcctccctgaatattaagaacagtatcacaggggtgtttctactccctgcgatatcgcgtgtcgcatcctcctctcccacgttgcaatgagaaacaatatcagtggggccgtgtccaccttctgtcatattgaaagtgatatcattttcttccctccaggatcgtgggaacaatatcccatgggggtgtaccctttctgccatatatgtagtcacatcacccactccgccttggaatattattaaggaccatctaacacgagggtgtatacgtcctgtgatattgggagtaatatcaacttctcggcctctgaatatgaggaagaatatcacagggtgggtgtatacctcgtgctctattatgcggagtcgtatctgtctattatggggagtaatatcattctctccctttcaggatattaataacaatttcacaggctgggtgaacacagccggcgatgctgaaattattatcatcctctccccctcttcccctcctggctctcagtccccgcctcacgggttatgtagcgggttatggcaagaagacaaactgcagtttcctgcacagaacagcacaaacaatgatccaagctcagttacaacacaatattggtcatcatttgaccatggacttcaatatcaacccttagaaaccttcctaaaacaggtcagcaaaacaccaagaagcaatatcctgaatgataggaaaatatccttgcttgtgcaaattgtttccacttaatttttttcaacaaatgttaattatatttttactttctaaaaatttttaataaaatatagcctacttggttaaaaatggtgtcaaagcttttctaaaagttaaggcattacataattcagtggcccctgtggctgccatggataattcttttttttctgttcatcttcaaagaagggaattcagaatcaggaaaagatctttggaaattcattagcatatggttttactccgaaactaagaccaaacacaaagagaaatgcagatttttctcatggaaataaaactgcttttttgcattttcaatttgtttccaagtaaggaaaaacatgtcattgtttctcataccccccatttctcctgttttccttcttttcatttgcttttcccagtgtatagcccacagaactagagcgaaagctttctttttggcccgtatataatttgaacagagtatcatcaggtgtctaatgtaccaccaagagtggtgcttacgacaaaaatgtcctctagacttattctatgttcgctgtgtgaatgaagatactaatggtcataaattcctggaacgggagacctcatttcattcatttctatttagaggcttcctagtagagtgcctcatacacaataactggccaataaataattgttgaggaaataaaataagattaataagataataagaatcttattaccaaagattcttcttctcagaaagggtttgttgtgatagctttactattaatatctcactcgtcatagagttacagcttctgcattaaacatattgctattaatatcaggcctacattaatcacctggttggaagaaaagcctccatgggaattcatctgttgggcaagccactgcacaatcttactagcataggtgaggtcaggaattttccgggaaatgacagccaacagcacatagcaactcttctcagtctgagcagaaggtgcccagggaataaaggatggaaattcttctgtcttgggtttcctttctctttcccagtagatgacattatctgagaaaaaggaagaattttcacatagtctgcataaaagtcatgggttacacataaagaaggatgaaaattccattcccgacctctgtttgtgctgaattgttcccctaaaattatatgttgaagccctaacaccaagtacctcaaaatgtggctgtatttggagataagactttttaaagaggtgattaagttaaaatgaagcttatgggccacaatccaatctgactggtgaccttatgagaagaaaaattttggacacacaaaagggagagcagggctgtgcacacacaaaagatcttgtgaagacaaaggaagaatgtggtcatctgcaggtgaagaaaccactttcaacaccttgaacttagacttctagcctccagaagcatgagaaaataaacttctattgctgcagtcatccagtatgtggtattttatgacagctatagcaaactactacagccttcaatagcaactttctaagtagcaggtgattaagcttccccagcagttttgatagcctatggcttggtcaccaggcttgattcccctgacatcactcatttgagaggaagctagcataaagcaaaagaggaaagtctagaatatgtagcgttcttgaaaggtataaaggccactgataaattccataagagaaacagaaacatactggtcaagagggagctcctatgtgactgcttagaacgcttcctcactgtgctccaagatcacctccattagcaacaatgaataataacgcttacttagttttgtggcagattgatccagggtttggagtaaagattccacttgcttctcttttccagctaaggcaaaagcataagctagaattgcatgattgtagccattagtgacaccactgtccaatgccgcttcaaggcaaaagagtgcgtttcgtagagcaggaaactgttggtcaggaagaagaatcatatattgtaaactgatacccgaacattccatgaacttgttgaacatttaaactaatcattgtttataatatatataatatatcctcaaagtatattttacatacaaatccatttatatacacacatatattttatccttcaaaaatatcattaaaataaatttataatgtcattattagtacctaagcaataattttttttgagatagggtctcgctctgttacccaggctggagtgcagtggcatgatctcagctcactgcaacctccacctcccaggttcaagcgattctcctgcctccatcttccgagtagctgggatcacaggcatgcaccaccaagcccagctaatttttgtatttttagtagagatagggtttcaccatgttggccaggctggtcttgaactcctgacctcaggtaatccacccacctcagcctcccaaagtgcttggattataagcatgaaccaccatgcccggcccaatgaaatttagtaagaaaatggcagtttttatatttgatcagtgatattttagttatgaatgtcttctatgcggcaaagcatccaaatttatcataggcctaagagttttttttttctaatgcctaaaatagaggcttacatttctgaagataattttcagggtatactaatgaccctgacaattcctagcatcttagttcaggaatagattttggaaatctaatctatggattgggaggtggctagggtgagccacacttaagttgaaaatgtttactcacttattgtttagagagaaacagaatactaggccacggctttacttagaacagtggttcttaatctgaaattcatggctgaacttcaggagagatgtgaatgcctgcaattgtgtgaataactcttttttgtgtgcatatgtgtattctccctagggagaaacccaatcctgtttttcaaagctgtctatgaatgaaaaacagtttgaacagcatgaatttaaagggtggtaataaactaaatgttatctcggggtttcatccagtcttagaatctcaagtgactctgactctacagtctattgaatgtgcattcagctgcctgaaatcagaaatgacgggaatccatacagtggaattgagcccagcttcaaagaacatcccaacaacatatgcagtgagtgaaatgtcctcttcatctccaccctgaaaacaaaggaacaatgagtcattcgggacagcagagcacaaaatagcaagtattcttttgaagtaaaactaggtatgaaaaaaatactggaacaaataccattattcataaaaacacccgaacatgtgtagtttttaaattagatggttaataaccatactatctaagcaagaattcattcagactctatgcaataattaaatcataattattaagttgttataacaattaatttcaatcatatttatgtggcctggtgttaagcatgcattctaaggaattcacaggactctatttgtctccgcttggtataaatctgaaaaaagccaacaaagaatttctaatgaggtgaagcagaaagttgccgtgaagattcctggaaattcctggaaaagcaccctaggagatcaccagaatcaagtctcagattcttagagtgtaaaatgagaaactcatttataaatcatgtggtttgcaaactgactgtgcataaaactcccctggggtatttaaatcaaccagtgtctacacagagattctggttcaaaaaacttgggaatacgacagcaaaatgcattttaatgggtgctctagtgactctgatgcaaatagcattcagaatggcatctgggatctactgatcttgtagaagcttcccattttatctatttaagcaaaggacaactcctgtcttcttcagaaaagaaatacttctgagaaaccaagtgtttaagatggaaataacagcatatggtagacactaacatgaggtacgaggactgtcagtacatctaaattacagcaagtgggatcaccattcctcagcagtgtaagctttgatttttcccttgcatttttatttctctcaactcaaaacacacacagacacccacccacacagatatttaattatagagaaaatactaggtaagatcagacaaactgtagcagtaatcagcaatgattcaccagtaatgaatccaataagaagaaagatgtgaagatgttttagaagagaacgtgggaaagtttttgatttttctatgaaggagtaagagctcttctccatcagggtcctcctgttgtaaggaataagtttggaatacattaaaaataccacaaagcaatttgaatacaatttgcatgcaaattaaatatcagagtgtctgttttcattcatattttgaggtggattagatatgcattctgggtttcaagaacaggagtgctgattatgaggaaggatgctgaagaaaagctcagggtatttcaggggccatcagagcatgctaaaatgccatgataggagattttgagcaaccacaggggaaaaaaggaggggaaaggagatagaagatgggctggagatggacaggtatctgcaaagaaaggaagttggaagggagggatttacgtaaatatggacaggaaaagggttggattttgccaaggatatacttcacctcatttgtactttggccccggggcaagcttggcctttgaatttttccttgagagggtcttagaaaaacttgcttcattgaaacaatatgaattactagatattctccccagaactttcttgccattcatggacaggaataaactttccttcctcatacactcacagccccctccctttatacattgactgtctccaaatttatgaaagtttcttttctaggttccctttctctcccctcccttctatttctagtttaatttctgaagaggactgactcgggaaggactagagactgaataaggcagacaagagactcagaaggagtcacatccaggctgtagttaaacatgcacaaagcaggaatggtgctgctgaccaacccaccacaggcccaggactgcagtgcctcagaaggtttcataggcacaggaagaatattcatattccagatcaggaaagccagaggcagggcaaggcaggcaatgcccaggaacaaggaaagcctggtgcttctcctctctcacctcccaggcgtggttgaaaagctggccatcattcttaaagcagccgcttgttttctgttggcttgaaagccagattaaggtctgtttttgaacattttcatcaatgaatacaaattttttcattctctccaatgtcttaaaagtaagagcactgagcctgtaatacaaatcaccaaagcaaaagttagataaagaggaagtgacaatgtcagcaattccacagtttcatcaccattgttccctttgagtaaaggatgcattcaactcatctactgtaaaccatctttattgttagtggccctttcctttgggtcaggaaaatattatgactagcaataagtggaaattagagtaggtaattttcagcatgtttgcacccaaaggtcctgttgtatatagcccattagattatctgcacatggagagagaaatgatgtaattaggtattttgggtccttctaatttcactttcccgaatctatatgggactctgagaagcacagagtaagacgtgccgtgccctcttcggtggagttaaccagcggtgcatgtctaggggctgtcatgaaaggatcagactgctaagcaaatcgtcatgagactgaaggaacattgttgcattagaattggaatcactaaatctttagttttatctatttctcttctgtaaattgactttgaaacccactttgcttctaaatccccactgaactctatcctccttcacctccttgcaagccctcctcaggtaattcctatattatataaaataaaatttttatgtctcaccatatgcttcctttctgattctgctgccaaaacacactataggaaccatcagagtttttgaaagataattgcctttgataacctaaaatagaacattgtaggaaattattttttaacctaagaaagttagaagagaaagaatagtgcagtgcaagccctaggtattggtgttagacacaaatcactaggatgatcatttccatttgaacttctgaaactcaggttctgtattcataagggagaaaaaataactcttactttataggattttgatcacaagataatacacatggatatgtctggctcagtaattgcctcgtcattggtacctactaactattcagtatatttcccctaaggtcattttatttcagtgttatctttctgagaagaaaaaccaaagaagattattttatgctcctggacttttccttaacctcacagttcacaacattggccctctttgtgtatacaaagccaatcacttcactgcaacagaccacagctgagcaaacaaatacagacgttgatagatgaaccactgacaacaactcctaacaaaaacaacaataataacaacaataaacaaggtagcttgcaaaataccagacattaaaaaaaaattaagtgcatagcttgaaaactttgcagctgtaaattatgacgctagctgaccacacagattttgaagtcagacggaaaacagcgctaggactgagagttcctcggttcaggttcacttttctttcaccagactactgcataaaaacagcttatgacatcttggtatgagtaacaattgctttcaaaaattatgggcagaaattacttaaatcttctcaccattagataagagaaagaaagccttagattgaacttcctctgtcagttgctcagtagatttcagatagtccagaacataagtatcagatgctagtagggcagcattctgctctccacctccatagggcatttggagaacaaccagattctgcatggcaagtcctagaatatcccctaaaaacaggaaaagcggaaagctgtattgtttatagttgccatctcagcattaataactatagacaaaagaggcatagtgaaataggtaacatttaaaattgagtctaaatggtggaaacaaagaaagttttatgaagcaatttgaaagaggagacagccatgaagggtgaagttaaactgctatgaaaaatatttctgaaaatctcattaccagagagaggaggaagttaggagaatgcatttgtttgcttgtttgctagttttttttaatcaatcaatcctatgaattacaaagtgtaatccatcccttccaagagatgttcatgttaataacagacaaagaagtttgccttttgtatcaacaacaaaaatttctccttttattgagaaaactcccaacatcattaacaggcaaagtcaattcgattctccaagaggtgaatttcatatttcagattaatgattataaagaacctcttgctttctgaacactagttaccatctacccaagctaaggtttcctgggaatataggtctggaaacggtactgtaatccctttagatcccatcaggaaacatagaggatgatctgatcaataattccctccaattgatagcttaggaaaatctctctattctattattttaaggatttttaaagaccacctcaaccaagattttcaaatcatagtgaaacacaaaatttgatcaacttacccacaacagtgaaaaagcctctggctgacccttctactacatcatttggcaagtccaaaactccctgcttggaggctttggcacctagaatgaaaatactgatttaaaaaatgtgatggcttctttatatcagcagatttgggggataaacatattggaaataagattccattacttatttttattttacaagttgtttattagaggagatgaatttggagttttgacccagtttaggataatagtacattcagaaaatggcatataaatctgtgtgttagattgtggcccccgttcttcactggtttagtgcctgaactatttatgtatgaaaaaatgtaaaaactacactgactgtaacacataaaacaacacacacaaaaggtaaagcttgaagactcagatgaaggagtataatcagatcaccatcaaccaggtaaaataatacccctcatggccataaaaccggagactgaggtgcaggggcagtgatgtatctatgggttattttctcctaagagtacaaaagccaagattatattatgtgctattgggcctcaatcctaatatctcattgtccaatattgtgtgacaaccatatcataagaggagctaagagtacacatgatggaaaaaaaaatagataggagcagaccagcctcagaaagtgaactaaaaaccacctcctgaatattctttttgatggctaaaattataccataaagataaagcatgaaacacaagaatcctccacgagttatttaaagtgaaatcacagggcacatggactcatgtggaaggagaggacatgaactgattcttttggtgaattttatttaggactaatttgactccctaaaagatcctcttaccttctgtacagataaggaaactctgggtcctttccttttcaataccttcaggctgtcaaagaataacacaaacaagcacagaagaatgagtctagatcctctgtccatgaaggaaaagtgattaagcaccagctcacttaagcatggctggtgcaagtttatccctgagagaagatccaactcatcttccccttttgttcatatctggaaggcacgggacatcaccggtacccattttagcctctgcgttctgtagcttggacaggcattatcttgatgtcactgtgggacactctcagctcctctgatcctgtatagcatctccagtaaacaactaaaagtgctttgtggagcagggattgccaagaggcaaatcaagagtgttcctctgacaagtgctgattcttgttgaggatgacgggaactgcatgggagtgtaggacaagtagatttgtctcttgaatttgagaatcagaaaaagagaaggaagagaaataggtgtacaggaaacatcttgactcagaaacaaacaaaaaattgtcaagtctatttcaaatgttaagttttactatcctgggtgaggtattaattaaagaaaggatgaactttatgctgttttaattcatttaaaatggcatgtcttgtgtcaaaagtaaatgttgtcaactaattaagtctcttcaatgagaagatcttttaatacaaaacctcttagatgtctgtttcttttcaggaaaagcttgactgtttgcatatccatacctctactaagaagcttttgaccacagtgtctttccagtttagcttttgctgctccattccttcatttgggcaagcactgctttgtttggactcagcaactacagtgatattcactttacctggaagacattcccaaatataaattaaattgatcattggtcccttctgtaatgagaaatgactagagtctgtgaaccatgtcttgaattggattaaccaaattctatcattaagttaatgcttagaacaaaataacttatttcttctccttcctaggtataatgtggtatcttccatttcacctgttccatgattttcatgattccttacattaaatgataaatttacttaattaaaacttaagaaattttaggaaaagtaacattttacaaagttgtctgagtcaatttcctgatattgattgtttataaaggttacttatgacaatataggctaataatgtcagcgaactagggctcctaacttcccaaaatcaagcaagcatagtaaaatatgatatagtagataggcactggattgaaataatgtcctagcaaggaatccattgtttttaaacttcctgatttcacattatgtaattagaactgatctccagtttccttgcttgtgaaaattacaggattgaaaacaatcattcattctttaaggttattattatttacgtgactatataccaatatacataaccaatatattgttctctttgttgttgttgttgttgttgttgtgttttagtgtttctctgtctcaggaagcttgctatttcactcttaaaactgtgtcttcgacttaatgtcataaaactatacaagttggtacagtattctgtctcaattgccaaggtaggattttgaagatcttgtgcagtagaaatattgagaaacttcaaatctaatagaaaaatagtctgagaacagcatcacaactgagctaaaataatctcatagatatattatttgctgttaaaataatacaatgaatatagtacattaaagaacatttgaatggccattttttaaaagtagtgattaaaagtgtcacgcacatcgtatctagcattccttgtttactagaattttaaactttttccattccatgtattttcaatatttcaataggagacaagtttatttttccatcttgcagatagcataggcactaagacaatattctcagttttttatctcaatccaatcatttagtgattttggtatccccatggcacatctagtaaatttacaaacctgacaattccctcattggtcattgtgatggagcagcaattttcttgaaggtggcctgggttcatgatggtaggtgaaggacccagcgagaagtcaaataattaaggtggcattaatgatagcatggccttcatttgggatatggcatatgccaaacatatagtccatgataggtcatgccagttagcatttatattgtattttaattacattatgctcttgtaaaaatgaatggtggttttgatctacacagcattaacaaccagaaattagattactatagattagaatttctaatggagaatttacaataagaattttaaaaatgtgagggagaaaatcacgtttgtatagacaatataaggaaagtaaatggagacaataaatatgggctggtttttccatgagtgactggtgtagacagatagctgcttacccaatttcttaggtataatagtccagatgtttgttttcctccctccagcttgaataacctcactgccattgattttccaggtattaatatttgcttcataattctgagactcctccacttgaacagaaatctaagaaaacaatcatggcaatgaggatagcactggaacacacatcactatgaaacaccatgctcaatacactgtttaaactgtcactgtgaatgaaagcaattgtatttgtttgaggaatatggacctaagtcttatacctttatagtagcattttgcacttgaggataaagagaatatggaaatattaagaatattttagctttgttagatttttgcctccagatcaaacagaacaacgcacctctacacatgtattcaggtagctgaaggcattgacaatcaaatcaaattgttcattttgaacaaccgaaaagggtgaggcaatttcaataaagaaaggttgggagacttctagagtggttgtagaggaaatgccaaatccaacgtcgccattcacacaaaagccacttgcctcccattgggttatcgtatcaggaatgaggaacgaaagattggcagagcctgaggaactggaagaagaggttatcggtaaaacacattctttgtctgaaccaagaacttaaaattaagtgcagagcaagcagaaaagtattgactgaagctcaaaagtgagttatattgtttggatggggcattagataaaaataatgagagctggatttttataaaatttgagtatagaaaggtcatttttctttaaacgccacttttttttttaattggggcaggttaaatctgtctgcataaaatgaatagaagagaaactcttggtgaagggaaaacaatgctagagaaaaaaataaaataaaatgtatgataagtacatgcaaatcaatgatatatattttacaaatatggtactgttttatatacccaggaataaacctgaagaaagaaaaagaaaatagaaataaagacacataggagagaaaatggttaaaactcactcgacactgacgaggtcccacatccatgtctctgggaagtttgttcttactgtttgaattatagcctgttctacatagtcagcattctcccctctgattccactagctaaaaaaaaaaaggaagaagtaccttattcagaccttggactctgcaaattatagtctatatattatcagggtgtaaggtctccataaaacacctcactttcctgtatcacagtcacttactatgactgttttcctgtatcaccatacattgcctgttcccctacacagtcaggtaccacataatgacactgtgatcaatgacagaccacttagactacagtggtcccataaagttagaatggagctgaaaaattcctaccacttattgacatcaaagccatcataacgttgtagtgcaatgcattggtcatgggtttgtggtaatgctggtgtaaacaaacctactgcactgccagtcctataaaaatatagcagacacaattttgtacagtacataatacttgataatgatgactatgttaccggtttttgtgcttactatactatactgtttactgtttagagtgtactgttcttacttatcaaaaaaattaactgcaaaacagcttcaggcaggtccttcaggagatgttccagaagaaggcattgctatcatagatgatgacagctccatgcatgttattgccccagaagaactttcagcggtacaagatgtggaggtagaagacagtgatattgatgatcctgaccttgtataggcctagattaatgtgtgtgtttgcatcttcgttttaaacaaaaaagtataaaagttaaagaaaatttaaaaataggaaaaagcttatagaataagaatgtaaacaaagaaaatatatttgtaccctgactcactcagagtaacttttaaccttgcaagctccattcatgggaagtgctctatataaaagtataacttttttttatcttgtataccacatgttcactgtgccttttccatgtttagcaatgattagatacacaaatagttatcatcgtggtacaactgcctacagtattcagtatagtcacatgctgcggaggtttgtagcctaggaaaaatgggctgtaccacatagcataggtgtgttgcaggctacagcatctaggtttgcgtaagtacactctatgatgttcgcacaacaatatcacctaacaatgcatttttcagaacaaattctccatcactaagtgaagcatgactgtatttctgacattgtattttatcaataaaaataaactacatctcacatctgaagctaatttcttgttatagccaaaagcatgtctagtctgtcttattctgctttatccaactataggatgtctaattgtagccaaaaacatggcataattcacacataaaattccaaaattgcatcatttatcccaaatacactaaattccacaaagcggtttggtcatcccccaacaaaaaaatgtaagattacctacatgcaattctagacggaacactatgcattggaccataattttctgtttctagataaagcggcttagggagtggcagccttctctccatcacacatacttctggttttcggtaatggagattggtaaagactttgagacccatgttctttaaagaaacaaacaacaaaaatattgttcattcttttcatgcaagaactataaaaggcctattatttatattgcaaagataaatggatcataagtatccatattttctgtgttaacaaaggtctgagaagttacaagtcaacttacctctatttgacttatggaaaatccctaatttagagaaaaaattataatcactatgatttatctagcacttattatgtgctagcatttttctaagtattttccattattctccatttcatcctaagtggaaaatacttatgagatcagcactatcattaccctaattaacatcaaacacacacacacacacacacacacacccggcacactcagtaaattaaagaactggaacctgataaagtctgtctgattcaataccccttttcttacacacttgtgatgttaattatagagattatttcatggaaggctcagcatgtctcattaatggcctagggatatctggagtccacactctcttagcctcttgatttgacaatctttgcataagatttattgtattaattggaggctgtcttatttttttaagtgaggttttgtaattatagctacatgatttattttcagcagaaaattttaaaatcaacaaaattaatatctcctttttataagacaatttctatgtactctattggcagattacagacacgaatctcaaagtataggaagaaaactacataattaagaaaacattaatatgcattatgaatactaaaaattgtgatgaaatattttccaaaatccttagtgatcttaccctgacaatattatagatatctccatccccatagttgcttacaggtgtgtaatataaaccattgtagaacatatccctctgaggaatgcaagggtcttccttgccatcatcaagattgaggccatggtagaaataaccatacggctctatacttggaaccatgttatacacctatgagaaaaaacatttcccaataattttaagcacttcttttaaaattacaaaattggcaaattgtctactgtaccatttattcttgttcttttctttaagagcacggccatcatatttaatccagtattttcacataagctcttcctttcaaaagagcaaaccagttttgttttaggcaactgatgtcatgttcacagaatttctcagcttgggcgcaggatttaagagagaatgtaagaaagcaatgcctgactattgattaatccaaggcccattgtacacacagtcaattataatgctagaatttctaagtctggagaataatcttagctgcctgattttaaatcttcttacataatcttctgaagaaaacataaaatcaacaaagagaacaagtaaggatactcatgactaatatctttaacattactacaatacagagaataccatgatcttcaaattatttcttagtagagaaacaaacaccaaatgccaagagagcttctactgctattgcagagggaaggcttaagagactgcagagaaaaagagagcagaatggcatggagaaatgagaagaaacacacaccaagtcaactccaggtaagagaaagtctagcattgttaaaaatacaaatcatagttttcggactcaacagttcccagtacagcacacagggaaagggcttggactgaatgggcctggaagtggaagcttccaaaaaacatggctaaggggaaataatcagatcacaagaagaggtatgcagatccttggagacagggaatttaaaaaaggaaaggatgtcataggataaaataactccctccaccctcatttccatcaccaacattttaaaaataatgcattttactaaaaaaaaaaaaatagaaagggcgctcttcacctatgaacaccctgcacaaaatatcaagaactagaaaaaatcaactccatacaaagcttctgtaagagaaaataggaaatgcaaaccaaaacacttcagctaatgaaacttctccactaaagtcactaagtaaataaataagtaaacaaagaaaagccatgccaaaataatttaacatgagtgaaatattctcaagcatgtatttgaggtatttaaaaggcaccatgagtcagaaattctattaagaaaatacagaaatggacaaaacccaagaagaaataaaatgaggctttattgaactcaggaaaactagacaaaattatatcataaataaactctaaagtacaaggacatcaagagaaaattgttcagagaaaactttaaaagcagcacagaggaaaaacaacagaacaaaactgaaaaagaatgaattaaaacaggtcacaaagtgattgaattggaaagcaggcaaggaagatccaacaaatgtacagagatttttttagaacaaaaaaaatggaaagaccaatatttacaattataattcaggggaactatctgaaaataaaagaagatttgagtttacatattgcatgactccactgtgtacctggcaaaacttctacagaataacattcttactgaaactgttagattaaagtataaaggggaaaaaaacattcaaggccttcagacatagagataaagtagcccataatggaaaatgaattaaactaatgtcagcactattaaaaggcatattcaaagcaagtcaatagtaaggtagcatttcaaaaaattttaaaatgtataaaccaaagatttaatatacaaatacctgtctttcatttattaaggctttagaaaaaataattctgaatatgaaaatgtcagagaattctatacttatgtgatgtcctgaggactctagtagagaatgcactttttaaaaattgttatttatttatttctgagacagggtctcattctcttgcccaggctgaagctcagtggtatgataatggctcacagcagcctcgatctcccaggctcaagcaatcttcccgccccagcctcctggagaatgagctttatgtaaccaaaagatgactcaggaaattagtaagacttgatgaataggagaaacaatacagaatgtaaacattatatattctgacaaaaaaggaaagatgcaacaataaaatgagagaagagggagagaaaagtggaaactagagattactgactgttgtgtaggtagcagttaagactcaaagattaaaaataactgactagattttttttttttaaatggagtctcgctctgtcgcccaggctggagtgcagtggcgcgatctcggctcactgcaagctctgcctcccaggttcatgccattctcctgcctcagtctcctgagtagctgggactacaggcacccgccaccacgcccagctaattttttaatatttttagtagagacgcggtttcaccgtgttagcgaggatggtctcgatctcctgacctcatgatccacccgccttggcctcccaaagtcctgggattacaggcgtgagccaccgcgcccggccataactgactagatattaaggttaagcaagaaaaaatgagattaggatattaggatattataaaatatgtaaatataaaaataaccactaaaataaaaattcaagctagcctgaatactcaaagaagctttaagcaagataacaacaaacaaacataaaagctaaagaaataaagtagctttaaatacaatacagaatcataagaaaaatagtatgatagagctgaggcctaacacatacatcatatcaatagagtgaatagactttattctcctttagaagacaaagatatgcatatttaaaacaaaacataatgctgtacttcatacaaaaaacaagtgaagtgcatatttcaaaaggtgaaatccaaaggaaaagtaaaggaaaataataagaatgcaaaggctgcaatcctcctgttatcggaaatcgtagaagtaaggccaaaagacatcaaacaagatagagaagaatacttactgctaaaagctgcaattcataataaaggcacaacagttatgattatctatgcagaaactacagaagatgcaagaagaaacagagcactatttgtagggtattttaacacatcactcagcagaagaaggttaaataaattttacaaaataagtaagaatacaaagaatcaaaataatccaacctcatggatagaaaacaaactgataatagagactatatcttctcaacacatgagatatattcgcaaaaactcattatatatttgggcacaaaaatataccggtggaaatattgctggccatgaagatatagaacttgaaatttaaaagaaaactctaaaataaattcctttttatatgaaaattataaagtactccagtaagtaaattttcagtgaaagggttaatacaaacagaaattacggaatttctgaaaaataaaaatggtgcaattgctatgtatcaggatctatgagatacttcaaaagtagaaatcatggaaaaacttataggcttaaaaacacctagcccaataaaataaattaatgaaaatgaagtaaatttctaagtgaaaaagctaaaaataacaacaaaatacagcaccagtaaggaaataataaagataaaaatagaaattaatgtgatggagtagcaaaaaacctcacatcatattacatcacattaataaattaaaattatatgtttttggaaaactcggcaaaataggtaaaccaccaactaatctaacaaggaagaaaaagtagctatctgcttaggaacaaaagaaaaacaacttcttccatgactcagttttcagcctcattttttgtccttttagcatcgtgaattggggtccggagttgtttgtatttttctttcacaatagactgatgtatgtaacctagtctcaaatgattcagaaaaaactgaaatggcataaactctgtgtgtgtgtgtgtgtgtgtgtgtatgtatgtgtgtgtgtgtaggggtggagagagtgagaaagagaaaacaagtacggtgaaatgttcacaaactggtgaatcaggccaagggtctacgggagttctctgtgtaattcttgcacttttaaaaattatttaaaactaaaaactaagcttacatagataatacaaaaaataacataaacttatagaatataaattggaattcactcatttatagaacttcacttgatttatactattaatatagctatcaataataaacaagggcaacctcttttggctctgatatattctgagacccctgaataatgcctctagaattttctttttgaggtcccttgatggtcttttcttgaggcagttttcctaagatattgccacctccaactgtagaaagaatgagcagaagctatttactctgaatccatgaaactctcaagggaaaaaaaaggagtgtgtgtgtgtgtacatatataaacatatatatgtacacacacacacacacacacacatatatatatacatattccttttttttctttgagacagggtctcgctctgtcacccaggatggagtgtagtggcacgatcttggttcactgcaacctctgcccccgccagggctcaagtgatcctcccatgtcaatctcccaagtttctgagatcacaggtgcacaccactgtgccctgctcattttttatattttcgggggagacagagtctcatcatgttgtgcaggctggtctcgacctcgtgagcacaaacgatctgcccgccttggcctcccaaagtgctgggattacaggcgtgagcacagcacatggccatattccatatttatagataaatttatcctttatttgttgatgtcccctcagattctgaaagcttctaactaaaagtatttttgctccctgtaatagaaaacttaaatgtatttatgttttgcattgagaaaaatgttttatataatgatctatagttattcaatattattactgaattctataattttatacttaaaactggacttactacagaatgttgaaagcaaaatacaaaactattttttggtgagatctcaagtttgtaaaatatatatgccttcagaaaagagacttgaaaaattacagcaaaactataaagatgcctaagtgttaggactataaatgattttaaagatttccttctttatgtctttgtatactttgcacaaagtacacaatttaaattagatttaaatatgatcataaatttcaatagttatttatatgtaattgtgttagaaataaacggaaaatatccaacaattgttaagcgaaataaattggatgtgaacttctggaattccaggtctggaaatgtttaagaaaatacaatatccatttatagataataactttacactgaatccaagcatatccttgaacatagagatttcattttattccaagtttccacttctgtgattacacctatgatttttaaaaatcacagttgtaaaattcctaaactgttataattatctatcaaattctgtattgttataagcatgctcttaggatagccaagaaaaatacgtatataatccacgaaggaacaaaggaagaaaacattcaatattttcaacatgttcaagacatcatctgaaggataagacttctggtagtccagagaaacatgaaaaacgaggaagtcagagagcttacactttcagctgacagctgttgttcagatttcagtagaaggacgttcccatccacagccccgagggcacagaataagacaggcgccgcttgaagatagagactagcattggaaccaggtaagccctgctcgttagagaactttatgttaacctaaagtagagaaaaaaaagagatgagagtagagaccattttatgtaaagatgatctgaatacatttaatctctcctgaataaatccttatagatttctatacggtatttcctttgcccactctcaccctcagctttctttgcaggagacccccttcaccacgtgctgccgtctcaggattggcactgctgccaaggatcatgcattgtgtttggtgattctcacatcccctaataattcaattatgccagcactgagtgtaagtttcccacgtgaaggtgatagcagtcaggcgagaagacagcagggagcaaactgttcccacttctcaggccagaaataggagaaacatcaccttgtgtttaaagcacttgtcaacctggaatctgacactgtcagccacaatttccccactggggtgaagggtgtagacaaacaggacggctgcaggagccagatcagcactgatgctgagtgggaacgagaagtttccattccaggctgtgtaaataggagacgaagagatacgatgctgaaagtttcctgaatcactggtacacttagataaaagagaatagctcatggacagaaagagtaaattgggccctgttttcaagacaaataaatcaaataataggaagtacatacacaaataaagaagactgcataatttagataataacaatactgggattttgtacaccacttttcttttttttattttttatttattattattattattctttaagttttagggtacatgtgcacaatgtgcaggttagttacatatgtatacatgtgccatgctggtgcgctgcacccactaactcgtcatctagcattaggtatatctcccaatgctatccctccaccatccccccaccccacaacagtcctcagagtatgatgttccccttcctgtgtccatgtgttctcaccgttcaattcccacctatgagtgagaatatgcggttgtacaccacttttctaatgtactcaatgatctgacaataaaagaaacagtagaactctccttcatcaggacatttagtagcttccctcaggctgtgctaactattcccttcatccacaaattgaaataagtgctcgttcttcttttcactatatatatatacacatacatatatacacacatatatatatacacacacacatatatgtttgactatatataaatatattttcttaatatatataatccccatatatataatgtctatatatccttaacaagaaaaaatgaagttagagcacatattttaaaatgaatacattatgtatacctttgtttctgatttccttttgtccactgagtaagatagctccttttaccatcatctgtgtggaacaaagaaaacataacatgcaatatattatctgatgtcatcatattctcatattgagattaggtaattcattacttaatggtaattctgttccataagatagggtagcttccacaagcaaatattaaaaatagactttgcgtaagttggaaaagagcagagaaagtgactaaaactgattgagattctatcatgtactggaaactttgtgaactatgtgcaatgcactgtgcaaagtggcacataaagctctgaaattgtcaaggctgtccggtttcaaatacgccttcacctgctcattaactttgtgacttaaaacatgatgttttacctgtttgcctctgttccattatctgtaaaatggagatatctataaggctaattaaatgagttaacacatatacaatctttataacagtgcctgacacagaacacttaccctaagaggtaagtcttataatctccaattacactgtacacctgaggaagccaagggttaaagagttcaaacaatccgtccaagatgcactaacttgcatgctaactaggagagggtgggggattcaagttaatgtcttaatttccaggtctgtgtcttatcactcttcaacaggccttagagcagaaggccccagtccccaggctgtgtaccggcaggtacgtatccatggcctgtcaggtactaggccacacagcaggaggtgagcagtgcggtgagcaagcattaccacctgagctcctgtcagatcagcagtggtattagattctcataggagcacaagccctggtgtgaactgcacgtgtgagggatctaggttgtgcgctccttatgagaatctaatgcctaaaaatctgtcactgtctcccatcaccaacagataggaccatctagctgcaggaaaacaagcacagggttcttactgattccacattatggtgagtatgtaataataatagaaataaagtgaacaataaatgtaatatgcttgaatcatcctgaagccatcccaccatccccaccccatctgtggaaaaattgtcttccatgaagccagtccctggtgccacaaaggttgggggctcctccttagaaagacaaaatggacagaaccaagagaataaagtccttttactgcttatcaacataagctttccaccttactttctggcatctgcccaatattttactattacaaagtgtcataaatacttgatatgagttacatttgaatgcttaaacaagtggactctgaacagcaagttcttcaaccttagggaaactttaattgccttagatcgttctatgtgtttgtttgttgttaatggatcgaacagtattcaccagcaaagtgagaaggctgcccttactctggtcaccgtggcatgactgatgcatgatttctaagctgtgctgggctaagcagacgtgcaattgaacaggattccaggaacccactgactgagacttaccaaatagaagaactttacattggaatcatcctcatatgcttcactgtttagggagtaatgcacagtaacaaccttctggtgattacattcaagctgctttggttctggaacaatcttcaggaagctgttcgttcgggagtaaaagcgtgagactaagaagtgagcatccaagtactgaggcgtcaaccagctgggaagatagcagctcttaggtcgaacatatgtggcctgagatgacaaaagaaagtgaagggtcttagtatcatgacatccgaagacagttgttactgagaatggaggcttctcaactctccagagtagggaggaatctcagcttgtggctgacgttttaatgttaagttattggaatcaaaataataatagcactctgctctttgtatacaaaacgtgaccatgaaagattgtgtaaatatttcattagactgatggtgaattgttatgttttttacactttaattgaagccacagaattgggtttcagttctgtttctttcagctacatgtgaacactgacaaattatttaactgcaaaattctgtttaagcagcggaaaataaacagaaagtataggatctcccctatctatgcatgaaatgatctgaggaagaaagtcaaatcatcctcatgagctacttcttgtttcctagaggaaaatattagttgttagcaaatttataacaatcgtgatagacttttagcttcccatccccttgaacaagtattctcatgtattatttagtgaacaagcaaatttataaaataagttacattttaaattttctttaaaatagattctgtatacaagctatcttttgagatattcctaatgtttaacatttctgatatccaaatcctctgtgggatgtctaatggtcttcttctgttctttgatgtcttacttttaggttgaactctggatcaaatatgtctgaagtgtcaatggaaaattgagcttcgccattctcgtccgtagtataatttcctataaattcatcattgagctccagttgcaacaacttgttcaccataggtacattattgggatccgaaaatttaagctgtacaagaaaagaataattaatatgacttaaaacacaaaatgtttacatttttacagagaaatagttttctactcataaatgtgatccctagtcattttcctaaattccaacagacagaaagatgctctattaaatacatagatatataatataaagtatggaaaaaatgatactgttatctattgcttctttcaatctaggacactttctagcacctcagacatagtagtgcttaaaatgtattacaaaagtaggaaaaaagtgaccagaaattttcaaagggcaatctatgatccaagaaaatgaaatggaagcatgtattctttagtcaaacctacagttccaaaataagaaatccctcttctgtagaaagtatccatgttctcaaagtttacagttccaagcaattgagtgataaaaactgaggtcttctcactgatctgcatacctgtaaggaatgatgaacacagcagagtgaaaatatctaagttaccatccacagcaatataaatgtgaccagcttgcccagtgtgaatagcatcatgatattgatcaagtatgcttatatagagcactttacaatggcataatcacaaactcctttttaaataacaagaaataattagtagttaaatctgattttcccactccaaattaaataatctctttctcccttctttctggtttttttttttttttttttttgagactgagtcttgatgtgtcacccaggctggaggctggagtgcaatagtgcaatctcagctcactgcaacctccgcctcccgggttcaagcgattctcctgcctcagcctcccgagtagctgggattacaggcattcaccatcatgcccagctaattttttgtatttttgtagagacagggtttcaccatgctggccaggctgattttgaactcctgacctcaggtgatccacctgccttggcctcccaaagtgctgggattacaggcgtgagccaccgtgcccggcctcttctttcattcttttaacaaatacttattgaacactcactttgtgcaatcttgtaaatttttcagtaataatttttgcacttgcaactattcccagttgtattaaattagaaataatctgaattttgtacttagtgctaactcaacaagcttctcccagtaagttgccatacatatatccccaggtcgtccaaaaaatacagtaatttcctgtcccaaattctgtaacaattacagcgacatgaaatgtcatgaacaatcccgaacggtagagttggaagacttttgtatttacaatttgagaaacacaaccattttccaactgaaaaataaagagaaggtataattaaaatgttagagatccaagaggtttttttaagtgtcttttaaaatatggtttttgcacaaatatattaacatccccaccccgtgccacggctctacctcataaacttgttgaaatggccaaagaattagaggaggagtaggaggaggcgaatatttacatcagcattttaaataacggaaggaggtaatctgtattttacagatttcaaggaaattctcctggaaacattgtagatgagaaaagattaaaggatggaaatgaagctgaatggtattgtgaaaggaaagtaaatctcaggagcccaacatccctaagctaaagggaaagggcaagctgggaacagctgggcaaatctgtctcccattttattcccaaataaggtagctacaaagataaaaactacatacctccctcacaatttgcccacaaggaaattctttgtgggcctcaagaacttttccttaaaacagttctttggaaattcaccctggcaatataaattcatagcttatctttacaggcgtgggacaaaagacagactcagtcatccctctgcttacctgagacaaatacatatctgatttatctgattgcttcctctgcctaatagtttatgtaaaaatgcagatttactgagccacactaaggcaggagtgactattcctctatcctcctctcacatgtaatttgtgtattcagtgaaaggctgatcaaagacaaagacttattcttttttttttttttttttttttttagatagagccttgctctgtcactcgggctggggtgaaatagcccaatcttgactcactgcaacctccgcctcccaggttcaagcgattctcctgcatcagtctctcaagtagctgggattacagacacctgccaccacgcctggctaatttttgtatttttagtagagatggggtttctccacgttggtcaggctggtctcgatctcctgacctcacgtgatctgcccgcctcggcctcccaaagtgctgggattacagctgtgaatcactgcacctggcctcaaagacttcttctttatgcaactgtttgtctcttatctacctatgacctggaaacccccttagtttggattgtcctgcctttctggaccgaaccaatgtacatcttacacatatttgttgatgtctcacatctccctgaaatgtataaaagcaagctgtagcccaaccaccttgggcacatgttggtaggacctctggaggctgtcataggtacatccttcaccttggcaacataagctttgcaaattgattgacatctgtctcagatacttttggttcacagtgttttaagaggaagaaattctaatcatctagaaaggcactaaaacagatggaacagaagcgctcagcacatgtgtaacaacaaaacaaacactttttaaggtatattgcttatttaaaataacaaaaaatctatagttaatctatcatcagtaataataattagagaaatataaatttagttatattttataacacagtgtttattccagatttaaaatgttataaggatatattagtttatttgatactcaaaactattacatgagctaggtactgttattatcttactatatagatgaagaaactaaactaggtccatcatgtaacctgtccaagatctcacagctaagagacggtggtgctgaggagctgctctggctccagagtatgtgcttctctatcttaaattaacagccattacatcaacaacaaaagcaattttattttgtctaatgataatatagtcaaattaaaatgaaatcatagaaagtgatcagaagaaccttaattatttcgaaaataagagaaaagccttttttcaggaatccttgaaacaaagagaatacataaagtaaaccaataagaatccagatattagagtaatgaaaaaatacttcgcatcaaagtcaatggtattcagctgcagttcagaagaaatgtaaaacagtgaatgtgcttattactaaaagaaacagctaatatattttttaaaccccaacaaaatcaactacaaatattaggaaaaagaattaataagatgaaagagaaaataaattatttaggaacacaaaataataaaagaaagaaaatagtaaaaataagaaccaataaaatagacgaaactttcgtgggcatgatttaggacaaagagtgagagagaacaaaattgtgagataggtgctaacacaacacagcccacatctggaagaaaaattcccattttagaacatcattggaagtgaactttatgtctattagaaaattgtaaacaatcttaagagcatacttagatagccacatgtacaacacaggggccagtgagattttttttctaaggctggaaacccaggaacataaggaaggtgggtatgtcaaaaatatgacaaagtaaatgagttgcctatttaaataacaggcttgaaaaaaaatgcttgtaggatggaaggcagtacttacctgaaagtttccatttcacatgaacagaaaaacatgggtaattaagagttctcaaatccaaattgataacaaaaatatgaaaagttgctcaaactaaatcgaaattagatagcacaagttaaaacaagctaaatttgtgtctatcaaaatgacaaaaacttttaaaacttctaaatatattgctgaaagtaatttggaaaatatagtattctcatgtacttctgacaggaatttgaatgcctaaaacttttaggagagcaatatgctaatatttattaaaattaaaattatctgtctatgaacattatctatatttcctttgactcaggaaactcactctaagaaatttatttcaagtaaataaagcctctcatatataaagatagttccaccggacagatttttttttttttctttttctgaggcaggtcttgctctgttgcccaggctcgagtacagtggtgcgaacacacttcactgcagccttgacctcctgggctccagtgattcttttgcctcagcctccctgtagctgggaccacagatgtgcaccactgtgcctggctaatttttgtagagaaggggctcactatgttgcgcaggctggtttcgatctcctggaatcaaacgatcctcccgcctcagccttccaacatgctcagattagaggtgtgagccactgctcctagcctctaccagattgtttattggtatttttttcacatggggaaaaaagtaaaccatttgctgagggaacacccatcactgtgtaaaacggttgactgaactctatcagaatgtactgctgacatggaaaaattccaccctagttttctttgcctgcatttcctatgtaaaggtaggattctgcttgtctttgtcaattattgatatttacctagaggatgttcactaaatttgatgagtaactttaggacaattggacttaaaatatgaactatgtggcatacacaagcttcactttggggagtcaaaagacaatttcaaagagataggaagagctgttcacttaaggttaggatgctgcagatagagcaaatgatgacttcacatatgaactgcaagtctaaagtaacatagtgggggtactctgaattgcagttgattgaaagtaagctgtttccactaaaaaaaatccaggtggcatggagagtaatatcacagactcatttaaaggatgattaacgattctccaaagaaaaatcaggaaggctacctaggcgatatataaaacaacaaagcccacgatacctttcatattctaaaaatcccatgaatctataggtggagaacaatttacatggtctatggaataaaaaactgctttaagcactgtattttcttctctttcttcactttatttagctgcaaactccattatcaataaaatgaaaatagtattgttaagctccccttataaatgaaatcaaagaaagaataagaatgaaaaatgagtgagaacttttttttggagtaaagatcatggtctgtacctgtgcaataaattgctcacatatttcattgtcatttttctcacaattgcttgaagaaaaatactctctgcacacccggatttgggttttcccttgcacaggttggccaaaggtgtacctcatgggggaaggtgtagttatgattacagataagcaatatcatagcaatattttatgatcttcttcagaaattatataggaagtctctaaactgtgagtaacccagtctaaccaaattgaattaggaattctccctattggtgagggtttaggttccccacagaattcaggttaaactgggcatttgatctcaggaggatttggctgcctttaaaaaattgaattcagggtaaggcagaatctaaaataatctaaaatctcattgaatatgatttaatgcttaaattgagttttttaaaaatatattttaatctgatagaaacatcataacattgcagcactttcccttttatcagaaaaatatatatgtatataaaacttggatgattcaggatcctgaaacatttccagatcaacattttaaacacgaatttttatttaccactcaataaatataaaggctatggggctggcatgaactggttatgctttgaccaaaaatataataccttacagggtgggtttgagtatctcattttctcctaaaacacaaaactacaacacaagattttaaaggttcaaccaaaggcaaatccagtcaattggagttttttgttttgttaatagacaacaaatgtaaaactagcatataataaaagtgaatattattttcacagattataatacttttttctaattgttggacactgatatatatcatttatttttcccagtgaccctgatttgtaaaatgaggtcaagtaacttctccacattgtaattaatgaaactaaaattcgaactcagatctacctcactccatagcccgtgcccttttctttccactcacctttttctctttctatttaaaaattcctaacacttttgagattctgagtcaaatcataccaataaaatcatgattatataaaggccagacttagatctggccacacatattatacctgaacatttcttcttatttctacttaatgtcttttatttatacaataaaagtcttattgtagtattatctgtaagctaacatatgcctataagacatgtagcttaaattttaaaaacaggacagaataatccctttgtgatttgaaaagctttcagtgaatgctaatgcagtgtattaaaatctctttgtctgtaggtaaattttcttccctcttaaaagcctaagtcatctctgactttgtttgctaaaataatccaatttttttcttgttttctctagtcattccaagctaaatcccagaaaagactaaagaaacacagacacagtatcatacaatttgagacacagtatacaactgacgtgaaccttctagaaacagtgctctcacaatctgcccagaaataactttgtagcaagcacagctccagtctagctgcctggtctcctggcaagatattattattgctgatactgatttactcctatgtaactctatccagaatacaatatcaaagaaatttcaagaaatcaggatcatggattgtaacctgacatactgctaaggaactaccagttccatgttagcatgtggtttgcaagtattttccaaaggccatgcttgagaaacatttttgttcttccaatgtgttgtgggttttgtttttagcatactatcgtgcagataaataaatgagatgttaatgccactgaaagctctggctttgcgtttggcttttctagtgaaacctgtttagtattctggatttcttccaacttgaatttatcacctcatcatttttaacatcagtgatctacacagtctctcatctattacgtatattaaattctggtattttcaactactcttcattaaaacttagaaaaaaatttataatcatttcctaaagtcaaaagaagatttgaaatgctactgaaaaaaaaaaaagaaggctgaaaactggtttgcaagattctctggggcatcaaaggcatcttaagaaccacgcttgcacgttcattagacagccctttaatcaatgtatctttaatagactgctggaaatactcaaaggcaagtaattttcatgtcataaattaaacaaagtgcttaacaaatatggcaaatattaatattgttaactgtttttataaagtatatgacagttattgattaggagagtagctttgaagctgaaaaacctaggtctaaatcctagttctgccatcaacaagctccattactgttgataagttattttaattctctgtgtcttattatctttctttataaaatacagatgacaatagctcctatctcatagcactgtggtaatgatatatgcagagcttaacaaactagttgacattcaaaaaacatttattttattttttattttattttatttttttctgagacagagtttcactcagttgcccaggctgcagtgaggtggcatgatctcggctcactgcaacctctgcttcctgggtgcaagcaattctcctgcctcagcctccccagtagctgagattactggtgcctgccaccatgcccgtctaattttttgtatttttagtagagacggggtttcgctatgttggccaggctggtctcgatctcctgacctcggatgatccctcccccaccttggcctcccaaaatgctggcattacaggtgtgagccaccgtgcctggccaattgtttataaattattattagaaattcgagaaaaggcactaaaaaagaaaaaaaaattaaaaataattttccaaaaacaaaatacaaatttctgaaatcgtgtattttttttacattaagagaattcaaataattcagattaacttgataagatgctttgtcttcactttgccatttcaatagctcatattctaattttaatgaaaatatgccatgatagtaaagattcaatgagaatttcacaccagctgctagaatcctacactggcacaacatgtttagtgaggagtatggcaatcagaagactaaaagaatgttacatattttgtcttggtaattccttttctggaaatctttcttaagtaaacaatttttcattcaaaagctacctattatatgttatacacaaagacatatactgcaaaattattaattaccaggaaaacaaaatgaaacagccaacatattatataataaaataattaaattgggtatagtcacataaaaatatgtgcagcagaaaattggaattcatgaaaagattggcataatacgtaggcatgttttcttaattattataaatagaaaagtatgattgcagtcatggaaaatattcattaaaattagaggaaacttacaatgttagtgacattacaatgttaatggcagttggtcaaattaataataggtaatgtcttgtgtttttctctatatttttcaaattttctacagtgaggattcattgcttctctaataacattaatgtaagcatataaataattaaagtttcatggttaatctcacttctcattctctctgagctttgtgttttcttgtgaaggtaaatctcctgaagaaatactcacttagcacatacatccacttggaattcatcatctgaaatagttactgtttgtggtgcattgaccgtaacttcaaacttgggcagcactggaaacgaagagaaatatacgttagcctgcacaatcacaggcaagcaaaccttattgcagtcatatagcttactatgattccttgtaccctccatctgtatgagctatgtatcatttgccccaaattgtgtggcaccattctacatggtggtgtctcactaatgattaattcttcctctttcttttcttttccctatcctcagaatttcacattttgtttctttttgtttgtttgtttgagacggagtttcactctgttgcccaggctggagtgcagtggtgcaatcttggctcactgcaacctctgcctacagggttcaagccattctcctgcctcagcctcccgagtagctgggattacaggcatgcacgaccacgctgggctaatttttgtatttttagtagagactgggtttcaccatgttggtgaggctggtctccaactcctgacctcatgatccactcacctcagtctctcaaagtgctgggattacaggcgtgagccaccacacccggcctcacattttctttctattgcaatctcttagatctctcctagaagactgtggggattctagaaaaaatgtatattttctagggggaaaaagaaggcaggaatcagaataaggatactggggaaggagtgaggagcagcaaagtgctgatgacaaagccaaccaggtcaaggaagggagacaaagaaaaccagttctagcttcacctactcctgcctaagtctaacacaaatgttgtgttggtccatcctttaaactcttcatctacataggacagctacaaatagcaactggttaccatatcttttaacagcaaattggtgtgtcactgtcttccttgagtttcttttcacaacaatccagtaatctccaaacattggttctgaaatcagttggaacgagagttgggtaatatttcggaaagaagtcacattttgccattgaaaaatccgattgttttgaggatcctagaaaataatgaaaaaaatataaacaatcagaatttgtatgagagtattaccctttgctgccatatttcggatagtttcggatagtttcacaagggttattttaggccaatattttctcttatgaaacaaacaagtagcttttggtagagcctgtgagggcttaagaaccctaatgtctataaatcttagaggattatacactatgctttggtcatacaaacttgtactgcctttattcttttttctttttttaaagtattgtaattgtacatacttaaaggatacaattggcggggcacagtggctcacacctgtaatcctagcactttgggatgccaaggtgggcagatcactagagccaaggagttcaagaccagcttgggtaatattgtgaaaccccatctctactaaaaatacaaaaattagttgggtatggtggcgtgtgcctctgtaatcccagctacttgggaggctgaggcaggagaatcgcttcaacgtgggaggtgaaggttgcagtgaaccgagatcataccactgcactccagcctgggtgacagagtgagactttgtctcaaaaataaaaaaaaaagtgggggggtacaatttgatgtttcaatacacacacacacacacagacacacacacatatctatatatttagtataatgatcatattggggcagtgttaccagtacttcattcatttatcttttttttttatggtgaagacattcaaaaacctctcatctagctattttgtaatttgctaaatcttactgtaaactattgtcatcctactgtgcaatagaacaccagaactcattccttcttcattcttttcagattaaataaaattttaaaacacttgtagagtgtcagatgtgttccaaggactgatccaagtgctcaaggcacaaaaatgtatatgacatgttcacagcccatattagcttaaaattttaagccactgtgctccttgttattatagtcatataattttcttgcattatggctgcaattcacattctgtaatcagggtatagatgtctaagtaaagtgttggcttaataattgttgttctaatcaaattgaattacacgttaacaaaacttacttaaattttccttgtatatttaattctatctcttcccaggccaagtcaaaaaaaatatgaacccttggaagaattacatctagaagtgaccagtcctagtctaaatatttaaatacataacatgaggaattcaggccaaaagtttattctgataggtctattttttgatgtactaataaaactggccatctctgctatagttttgctaacttgttgcagaagtaatctcaagaagaaaacagccctattagattatgtttaggatggatagttcaatatatattttgccaaaatgttatattgagtttacacaaataaacacacacaagctgtcataataagttcatttagcaactgttttaggatagatttttattctggaagatccataatgaattatattttatatgaagacagggctaccttttgcgtcaatattttgatattgaagagtgctggtacatcaataaagtacttgtatagtaaacaaattaaagatgttttgtgaactagctaggccttgaagactcacagggcttggtgtgtaatactgtcattcttagagataattagctccaggttgttctttctgctggaattgtgaattgcaaatccattcttatcagagtgaaatcagaacttcaaccctaatcaaaattgattggatgaattattgagtgttacaaaagtgatgcaatgaagggccctcatatttttgacattcatttttattagatccttcttatctggagattaggtatgtgagaagctcggagaaataatcttagaagagccaagcagaatttttatatctaaatccatgttacttacatagaatatattgttctttaaatataaaaatctataaatctgtacaagaccaatcgatacaagtaaaaaaaaatgtctgatcctgcttgaagtaaattatcaaagccatctacgttgagagatgaaatgtattacgtctctcctgctaacttgaggagtaaaggaatttactaaaaagttactaggatgtttttattccttttctttttttttcttgcagtgaagcctgtagatccttaagattctttaccagttgtgtggtcttaatttcacaaattgaggaatctgatccatagatggttccacttgaacgtggtgggagggtaacattctccttccatgaaatgtaaagactgcattgtgggacatggaggggctccatgagatccatttagttgcattcatcctcctgtccccaaagtatatcagtaaatgtactgtttcttgacagtttggctgtgttatcccagaggactggatgtgggaatctccaaatggccagataatactctcagcttccaattcagtgaaactattcttaagcatgttaatgaaaatatacttctttcctggatcctaaaaggtctaaatgaaaacaactcctattcctgaggatggaaaacaagtattctgcaaaagccactaccaatccgtaccttggttcccagacatatctctagaagagacagaaacaagccctttaatataatttcattcctcaacttccttggaattagtcccttaatgtgtcttgttctaaatccctgatcatcttgccacacatttgttaaggcttataaaagagtgtacatctttacctcaggccatttgtagacttgtcatatactttggtaatttcccaacatatgcgtttcacttccagtaaagaagttagaagactccattcccagattaccttgaatccagggggcaggtaaatgacaggctcgaccaatgagatgctctgttctgagactgggaatcagaagggagtgaaatggggaggccatggaagagtttattttcagggaactgtgagtataatggcaacttctagttcatttaggataagataggcagaaccttttcacatccactccaatgtgtttattccacacacgaggagccacagtgggaattctgatcattgctagacttgtcaattatacctacacatttggaaaatgaataaataaccagaagatggatctggtctctgttagtcctacaatgaagacaatttggccccaaattctggttattcctgatagtcataatctttgcctctcatctcagatgttattagtgaggtaatattcagtattttatagaatatttagatatttatctttccaggagctcatgtgctttggtaatgaggcagaatgtctttgagaaagataggagtgagaccttagggatgggtgtctgcctaactgaagtggactccaatgaaaattatataaatatcaaggcatgaaaattcagcactccctatcacgcactggtgaaaaagataatcaaataatctcctgttcaccattgacaaagtgcctattgacagcaagcatttggggaccacaaatttccactgctatggaacgataccaggctgatcacttctaagagttctgagaaaattaaagaaaagaaaaacaagctaggaactttaaattagcccttaccatccggagttctgtaacagaattatctctaagtctccaatacagctactgaatgtaatgaattaatattacatttattgatgcataaatagtaccattctctcctatgtatcctgaatggtactatttatgcatcaaatggtctctcgaaacattctctgtggagttaaacaataaagcaattttcttatataacagttgagaaaggttgctctaaatttttggttgaagatatacattgaaaagtgagtactttcaatttttatgttaaaactctcatttattgcagagcagttctgtaatcaaaatgcctcattattgtatgtgcttagatagaggctgataatttacctgtgagggattttttaaaaaattactgactgtggaggggaggagccaagatggccgaataggaacagctctggtctacagctcccagcttgagcgacacagaagacggtgatttctgcctttccatctgaggtaccgggttcatctcactagggagtgccagacagtgggcgcaggtcagtgggtgcgcgcaccgtgcgccagccaaagcagggcgaggcattgcctcacttgggaagcgcaaggggtcagggagttccctttccgagtcgaagaaaggggtgacggagggcacctggaaaatcgggtcactcccacccgaatactgggcttttccgacgggcttaaaaaacggtgcaccacgagattatatcccgcacctggcttggagggtcctaccccacggagtctcgctggttgctagcacagcagtctgagatcaaactgcaaggcggcagcgaggctgggggaggggcgcccgccattgcccaggcttgcttaggtaaacaaagcagccgggaagctcgaactgggtggagcccaccacagctcaaggaggcctgcctgcctctgtaggctccacctctgggggcagggcacagacaaacaaaaagacaacagtaacctctgcagacttaaatgtccctgtctgacagctttgaagagagcagtggttctcccagcatgcggctggagatctgagaacgggcagactgcctcctcaagtgggtccctgacccctgacccctgagcagcctaactgggaggcaccccccagcaggggcacactgacacctcacacggcagggtattccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaaacagaacagaaaaactggaaactctaaaaagcagagcgcctctcctcctccaaaggaatgcagttcctcaccggcaacggaacaaagctggatggagaatgactttgacgagctgagagaagaaggcttcagatgatcaaattactctgagctacaggaggacattcaaaccaaagggaaagaagttgaaaacttggaagaaaatttagaagaatgcataactagaataaccaatacagagaagtgcttaaaggagctgatggagctgaaaaccaaggctcgagatctacgtgaagaatgcagaagcctcaggagctgatgcgatcaactggaagaaagggtatcagcgatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgatggggaaaatagaaccaagttggaaaacactctgcaggatattatccaggagaacttccccaatctagcaaggcaggccaacgttcagattcaggaaatacagagaacgccacaaagatactccccgagaagagcaactccaagacacataattctcagattcaccaaagttgaaatgaaggaagaaatgttaagggcagccagagagaaaggtagggttaccctcaaagggaagcccatcagactaacagcggatctctcggcagaaaccctacaagccagaagagagtgggggccaatattcaacattcttaaagacaagaattttcaacccagaatttcatatccagccaaactaagcttcataagcaaaggagaaataaaatactttacagacaagcaaatgctgagagattttgtcaccaccaggcctgccctaaaagagctcctgaaggaagcgctaaacatggaaaggaacaaccggtaccagccgctgcaaaatcatgccaaaatgtaaagaccatcaagactaggaagaaactgcatcaactaacgagcaaaataaccagctaacatcataatgacaggatcaaattcacacataacaatattaactttaaatgtaaatggactaaatgctccaattaaaagacacacactggcaaattggataaagagtcaagacccatcagtgtgctgtattcaggaaacccatctcatgtgcagagacacacataggttcaaaataaaaggatggaggaagatctaccaagccaatggaaaacaaaaaaaggcaggggttgcaatactagtctctgataaaacagactttaaaccaacaaagatcaaaagagacaaagaaggccattacataatgggaaagggatcaattcaacatgaagagctaactatcctaaatatatatgcacccaatacaggagcaccaagattcataaagcaagtcctgagtgacctacaaagagacttagactcccacacattaataatgggagactttaacaccccactgtcaacattagacagatcaatgagacagaaagtcaacaaggatacccaggaattgaactcagctctgcacggacctaatagacatctacagaactctccaccccaaatcaacagaatatacatttttttcagcaccacaccacacctattccaaaattgaccacatacttagaagtaaagctctcctcagcaaatgtaaaagaacagaaattataacaaactatctctcagaccacagtgcaataaaactagaactcaggattaagaacttcactcaaaaccactcaactacatggaaactgaacaacctgctcctgaatgactactgggtacataacgaaatgaaggcagaaataaagatgttctttgaaaccaatgagaacaaagacacaacataccagaatctctgggacacattcaaagcagtgtgtacagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgatagaccgctagcaagactaataaagaaaaaaagagagaagaatcaaatagacgcaataaaaaatgataaaggggatatcaccaccgatcccacagaaatacaaactaccatcagagaatactacaaacacctctacgcaaataaactagaaaatctagaagaaatggataaattccttgacatatacactctcccaagactaaaccaggaagaatttgaatctctgaatagaccaataacaggagctgaaattgtggcaataatcaatagcttaccaacgaaaaagagtccaggaccagatggattcacagccgaattctaccagaggtacaaggaggaactggtaccattacttctgaaactattctaatcaatagaaaaagagggaatcctccctaactcattttatgaggccagcatcatcctgataccaaagccgggcagagacacaaccaaaaaagtgaattttagaccaacatccttgatgaacattgatgcaaaaatcctctataaaatactggcaaaccgaatccagcagcacatcaaaaagcttatccaccatgatcaagtgggcttcatccctgggatgcaaggctggttcaatatatgcaaatcaataaatgtaatccagcatataaacagaatcaaagacaaaaaccacatgattatctcaatagatgcagaaaaggcctttgacaaaattcaacaacccttcatgctaaaaactctcaataaatcaggtattgatgggacgtatctcaaaatcataagagctatctatgcaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagacgatatgattgtttatctagaaaaccccattgtctcagcccaaaatctccttaagctgataagcaacttcagcaaagtctcaggatacaaaatcaatgtacaaaaatcacaagcattcttatacaccaacaacagacaaacagccaaatcatgagtgaactcccattcacaattgcttcaaagagaataaaatacctaggaatccaacttccaagggatgtgaaggacctcttccaggagaactacaaaccactgctcaaggaaataaaagaggatacaaacaaatggaagaacattccatgctcatgggtaggaagaatcaatatcgtgaaaatggccatactgcccaaggtaatttacagattcaatgccatccccatcaagctaagaatgactttcttcacagaattggaaaaaacgactttaaagctcatatggaaccaaaaaagagcctgcatcgccaagtcaatcctgagccaaaagaacaaagctggaggcatcacactacctgacttcaaactatactacaaggctacagtaaccaaaacagcatggtactggtaccaaaacagagatatagaccaatggaacagaacagagccctcagaaataacaccgcatatctacaactatctgatctttgacaaacctgagaaaaacaagcaatggggaaaggattccctatttaataaatggtgctgggaaaactggctagccatatgtagaaagctgaaactggatcccctccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagccaaaattgacaaatgggacctaattaaactaaagagcttctgcacagcaaaagaaactaccatcagagtgaacaggcaacctacaaaatgggagaaaatttttgcaacctactcatctgacaaagggctaatatccagaatctacaatgaactccaacaaatttacaagaaaaaaacaaacaaccccaacaaaaagtgcgcaaaggacatgaacagacacttctcaaaagaagacatttatgcagccaaaaaacacatgaaaaaatgctcatcatcactggccatcagagaaatgccaatcaaaaccacaatgagataccatctcacaccagttagaatggcgatcattaaaaagtcaggaaacaacaggtgctggagaggatgtggagaaataggaacacttttacactgctggtgggactgtaaactagttcaaccattgtggaagtcagtgtggcgattcctcagggatctagaactagcaataacatttgacccagccatcccattactgggtatatacccaaaggactataaatcatgctgctataaagacacatgcacacgtatgtttattgcggcattattcacaatagcaaagacttggaaccaagccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcacaataacaaaaaaccaaacactgcatattctcactcgtaggtgggaactgaacaatgagaacacatggacacaggaaggggaacatcacactctggggactgttgtggggtcaggggcggggggagagatagcattgggagatatacctaatgctagatgacgagttagtgggtgcagtgcaccagcatggcacatgtatacatatgtaactaacctgcacattgtgcacatgtaccctaaaacttaaagtacaataataataaaaaaaaaataaaaataaaataaaatagcgtcctgatgttctgctcttttcctttatcttgttttattttccttacagtagttctttgagagatagtaactcacgatagagaaacatggtctttgggatcagaacgtctggattataatcccatctctgttatttagcatctgttgcattggacaagttacttaacctgcctaagcttcatttttctcattgataagttgcagttaatagcttccaatctatagactgtgatgaataaatgggttgacatttgtaaaatgcttagaatgttgcttggtatgtagcaataattcaggaaagattaactatcagagcacttaataccatctgaaattatgccattgatatagtttgaatatttgtcccctcaaatctcaggttgaactgttatccccagtgttggaggtggggcctggcaggaagtgtttgggtcatgggggcagacccttcattgcttggtgctgttcttgcaatggtgagtgacttcttgtgagatctgattgtttaaaagtatgtgatgcctctcctcttcttgctcccatactggccacgtgagacacttgctcccccttgtctttcaccacgactgtaagttttctgaggcctccccagaaaccgagcagatgccagcaccatgtttgctgcacagcctgcaaaaccgtgagccagtttaacctattttcttccttttttttttttttgaaaaggagtttcactcttgttgcccaagctggagtgcaatggcacaatcttggctcactgcaacctctgcctcctgggttcaagtgattcttctgcctcagcctcccgagtagctgggattagaggcatgcaccaccacgcctggctaattttttgtatttttagtagaaacagggtttcaacatgttacccgggcttgtctcaaactcctgacctcaggtgatctgcctgcctcagcctcccaaagtgctgggattataggtgtgagccaccgcacttggcccctattttctttgtaaattacccagcctcaagtatttctttacagcaacacaagaaatatacaaatgacaatatgcagccatttgtatattgtctgcatcccaaattcaatgtaaacttcacgaatataaagatttacctgcattattctcactgtatttctaacatctgacatgacaggcacattaaatgaattaaaagacaaagcaaaagaaaataatcacctcccctcttttcccaatcagtttaaaagcattaagagattataacctgtcacctgcccttcgcattatactgtgacttacctaagggtatgtaatcagtagattcaagatggttagaatccttgcacaatactggtttccggaggtgagagttggtaaaaatctttaatcctgttgcctttcaagataaaatcaattttagatcacataacaacatagactagcagtctggactggttttttgttctatgtatattttcaatttccacttatttatttctccatctctaattgtcatatatttagagatacttcactgacatttcctaaattccatgtctttgagttccttagtttctctaattctaatggcttttgctctattttcctaattaagagctgttgatgaaaacctttaaataagagaggacaaaaaaagacatctcatatcataccccactgtactttcactactttgaatttggcatttttgttgaactagggatattatctcacttataaacactttaaatatagtagaatactttaaaatagtagaaatcaaattcgagggtagacgtaggagcaaaatggggatttatattagacaccagtatataatgtacataatattatgtcaggaaagctgataattccctcacatattagttcttttcctaatattataatattattagttatttaaaatattattatagttttataatgaagttctaataaccttataacttaaccttattataacattataataaccttataactttataattataactttataacttttaaataaaattatattaatacaacttttaaaaatatattataactataatttattgtaactatatagaataactattatagctttataatattataactattatataattataactataagaactttattaagtctttttgctattataacattatttgagatattatttctcagacattagtactaattgtaaatttgtactctaagaattctgagattaaaaacccacaccatgaatatttctatttatttatatattgtcacatatattcaccattttaagacttagttgccttaccttcacaaggtcatagccatcttttccaaagtcagcccatgcaggtgtgtaataaattccattgtaaaggatatgtccatcttcaagacacggcactttaaggccatcttctaagttaagtcctctgaaataatagccatgtagttcgctggaatgtagctgactatacacctagatgttagaagagaatcaactgtattttttcatagaaaacaattcatttttccccacaagcagtatataaataacctatataatcctatgaatatcctgtgtagaactgtcatcatacctataccaaataaacacatattgagaaagtataggatcttagatctgtaaaaactttgaaatactatttaatcagttaaataactgctggctaaatcacattaaaactaacaaaaagtccatgaggctcaactggattttaatacattccagataaaggcactgctcaatactctttgaggactcattcaaggacattgttagagaatgttctcggttaatttactaaatctccctgagcctaagattagacattaatcaaaatgggaatactgcattagttctatagggttgattaatatgagaataaaattaaataatagatatgggaatactcagtagagcaagtgtcaaatagtagacctttagcaattgttatttatttttaaaagtgttgctcattttttccataagagaatcagtataattggagtagagtcattgtacatgatttctaacctaaaatattttttatgcctggaactctggacaatttttttctcctctagtttatttaaggtatcctgtttttatccaaaggtaaagacataaaactatactgtgggtggtaaacaaagatggttttaatcactcacagtttgtgctggcagctgaccataattccttagtagcaataccctctggtctaccgcccaaagagcataaagagagtttgaagcagccgagacttgaagatcgacattggatcctggtaaacttttttctttagaaaaatttaagttgacctgaaaatgaaaataaaagggcaaaaggatggcaagccatatgagaagaatcatcttttagactattcttaacttttttaaaaacacacataagttaaaagggctttctgtgctttacccacctaataatattattattaggaacaactggatttggaacaacatccaaagtgaatgctataatcctgctactcttcaatcatccaacatattaacttctccatagctttcttttatttttcattttgcaattctatgaaaaattgggagtttaaacccaacactctcttaagttctccttagttttcccccaaattaaaaaagaatcatttttggcacctacctgattttcgaagcatttctcaattggaattgggtgctatcagtgaccatttctcctccaggatgcaagctatagacaagcatatgtactgagggcgctaattcagggttaatgtctatagaaatggaaaatatgcccttcctccctgtgaaaagaaaatttcaaaccgaaaaagtgctttggtgagatagctgactgtcatcttgcagaaaccctccattgagtttctagccatcctacccactgccaaagagactgccccgacccaccaaatttaatttataaagcatttctaggaggagttcataacctattccataaattataaaagaaagaaatagttgaacatttcttattacgtcaaacttcagtctacttttgtttctttttaaaaatcccttcttgtttgaatgtaaaagtacttacctgtctttcttggaaaagaaagggaaggacaatgaccctttcccattatagtagtgtttggaatataattaatgcactattaattaagtaattattttttcatttggcattgtgcctattcacatgtctttacatgttccccaagggtagtttagggggcagtaaacagtcctaaaatgggaggattgtgacttttaaagaaaaatgtaaaatatatcccaattaaagcattctatttgtattaaattatatgctaaaattagaggcctcaccattttcgttgatctcaattttctgttgcccatgaagaatgattacaccttttgaaatcacctaggaaaatgaaaatataatcgtaaagtttagaggatagaaactaaatttcatttaattataaacgaatgtgatttacctccttttcttgtctgagcaatactattgacatgtttactagtaaactcaggttaccagtaaacaagcatatgactctaacagctatattcaagagaatttaggagtcacagataaacttgctataaagcaatttaatgttccacattccaaaacagttttctaagaccaataaacaactttttattcatatttgcaaatgctgaattacatctaaatttatttagttcagtgaaacaaagttacacaaaggcattaagagtctcccagtgcttgtctggttttctgaaaggtgtgtttgatatgcaaggtataagcaaggcctgttcatccatctccacccaaaatttaaagaaaagaaaataaagtagcaagctgggggtgctccagaaaaaagcttctctcacttcacctttatcagcaactgtgtgcaaatttgcatcagcagacttttgttatgatctctaaagtgcaaacaaaggctggagacttgaaatctagtacaaactccttgaatttttaaattacagttttagaatattattttaaaagatgctgagacttgcagaaaatttaaagcttccgtaagatcttgcagcttgaaattgcaggagctggtactcctagtccgtttaatatttcactgaatattaaaattgctttaaatctctgaagtgccaagtttgggttattagctcataaaaaaagaactgagcctcaactagctggaaaatattgttttgggaactagaacatttgcaaaaaggcataaagctcaaagtttaatgagcctgagaggtctcagcactgttggctgtagtagctcactgacttctcaaaatggaaagacagctctcgtaacagatgagtaaactgaagaggcacacagaggtactgatatttgtcaggtcacacaattaagaaaaaagcttaaaagactgagtatcaaattaattactgaaagcctgagaatcaaattaattcagcctctatccattcattctaaaatatgatattgagggttctctctgtgatgtgtaccctgctaggcagaattaaagtccacccagcctattatgaaagaatatgtagaagactggaattgtctaggagattagaaagtttcatttaagccaagagatgaatgctgaggaggaatcagctcggaaaatgaggtgcaggcaggttgggaactgtggtagcaaatgggaacgaagattgttatgggcagaagggaaaacctgtgggaggcttcggagccagaaaagcacatggcttgtccaagaaaatgaaagccctctgtgtctgcaataaagaaggctgaagtgtagaatgatgcaaaatgaagcgggcgagcttcacaggtgcagagcagatacagtgttgcaggcaaaagaaaggagtctggtatttgtttcaatagaaataggcagtcattaactgtatttcaattaggggagtgaaataaataatcctaattgctttttttaaaaatcactctagatttccagaataaagaaagaaagaagaaaaggagggaggaaggaagaagggagagaggaagaaaaaggctattagcagactcatttaaaatggaaatgaggtaaagtaattgtaaaggccttatcagatcagaggggggcaaacctacgctatttcaagagggaagctgatgacaagtagatcaattcacaccacagacctgcaaaatggctcagctctggattaggaagtattggatattaagtcgagcagaggtgtggccagaaaagaaggcaaaagtcaggggcatgtgggagtgtctttataaaaactagttaagaggttcagcttccctgtaatcccggtactttgggaggccgaggcgggcagatcacgaggtcaggagatcgcgaccatcctggctaacacggtgaaaccccgtctctactaaaaaaatacaaaaaaattagccgggcgtggtggcgggcgcctgtagtcccagctactcgggaggccgaggcaggagcatgccgtgaacccaggacgcggagctttcagtgagcggagatcgagccactgcactccagcctgggcgactgagcgaggctctgtctcaaaaaaaaaaaaaaaaaaaagaggttcagcttctcattcaaggatgcttggtatttctcacaccccagtatggcaatattattgttgacatgttgaaggatttctgtaccggttggtaaagagccacttccctgagctccccagagtcccctccctgcttccctagaacctctcctccacaaccagctcctcccactcccaccactttgcccccagtctaaatgagccatgcttggcttagctaagggcttcagtggaattatcactcataccttttctgatggtttggtgtccataccttgctggtttgaaatattttaatgtttgtggaaatgatgaaggaaagaaaaaatgcgagagataatataatgaaaaagtgatagaaattggtgatgcagtaaatagcacgaaaaaaagaagtatcaaaagactattccagaattctaagtttgcaaaatgtgagaaatcatgtggtactactttcattcttcacatagatagactcaaacacctttagttctcagaataatacacttcagacatctttgacctcttatattatttcctaaaataagcttaaatgtgtttctcatatcctctaatcatccagaaaactcctattcatcccacaaaatcctatttaggcatattctctttatgtattttttccttaaaaatatgtatatacatataaatgtaaatatataggcatatatctttttcctaaactagtggttgtcaaattttaatgtgcttcggaggacaagatttctaacttattcctatgttttttttttttttttttttttttttttttgagacagagtcttgctctgtcacccaggttggagtgcagtggcaccatcacggctcactgcaagctccgcctgctgggttcacaccattctcctgcctcagcctcctgagtagctgggactacaggcgcccgccaccatgccaggctgatttctttttgtatttttagtggagacgcggtttcaccgtgttagccaggatggtctggatctcctgacctcgtgatccgcccatctcggccccccaaagtgctgggattacaggcgtgagcccctgcgcctggccacttattcccagaatttctaaattattcctaggtgatgctgatactgctactctaggaaatatactctgataatcactgtcctaaactccagctagagttaatcattcatttttctgtaacacctcagtggccatacatgtttcgtttgtaacacttatgtaattctaatatatgttttgtccccagttatactttttctatttcttctattgttacaattgctaatacagcacctggaatatgaaaaacattcaataagtgttggctgattgaattaattcatgtttcattaattttatatcatcttcctaaatctcaatgaagtatcatgcacccatttagacagtgtaaaataatccataatagcaatatattaaaatcaaactaatacttaatatcttttgtgtgccagaagttgggcaaagggctttatatgtattattaaataattatcttgatgattagacaatatattacaaaaaactaagattctctagaggtttaagtggctttcaaaaagtaacacaaagctagtacatatcagaactctggtttgatcccagcaatgtccaaatagaaatgggtaactctgaagaaagggtctgagaatgacagagtgcatatgggttgtggtgtcatggccttttccctcctttcttaaaaatagataccagttatataagttttatcatttatgttaactttgagcttcctcgtggcatataggtacagggatttcattaggttcaaagaagttttaaagaaaagaagcaattttgattgtggaagaatattttcagctcataccaaataattgaagtctgctgtgtaggttttgtcttcaaagtcttccatattgagaatgcagtgcactagcaccctcttctgctggttgcatctcagttcttccatctcttggacaatctttaggaagctattcatcttggagtaaaatcgatatgcaaagtactcgggctgagggtattgaggcaacacccagccatgagcctggcaattttcattggccttgtaggctgcctagacaaaaaatcaaaattacgggtattttaggataaagagaaaggatgagtgaaagaatatttgataagatggtttatcatcatgctgctttatctctgcaagaaaattttatagccattctacattaaatctaacccaattccccattttctagttatactctagagcgaccactatggtttttacaatttagtctattcaagtcctacttcaataatattacattcaatattttactgtattctttactataattattacttttgctagcaagtagattgctatatctccctcactataatacgaagaacccatgagtgcaaacgtttaccttgctactgataacataatatgaagttttgctgaaagatgggaaagtttttatgaaatacagcaaggagtttactctgaccatagtaatttaccattatcaacacaaaaagtctgaggagtcctttaaaaatatctaggaaggattgatatttaattattacagatagtagtttacttctctcttgaatatatccagagaaattctttacattattccaaggtaatagattacagggtttctcaaatatttccttctataaaaacacaattctctttctatttccttaataaaagtgaagcgttgcttattttcagctaattctcctttatacaatttagtatgtatgctaaccttctgtcttttcccgggactcttaaaataatttttaacctacttttcatagggcctatattcttaatatttaactatttttcagtactctagattcacaccaaggtgtatcttttcatttctgttccataaatataatttcgcatagacctaaaccttagctagccagtgcagttttttgtttgcttgtttgtttttattttacttgcctttcgtttaacttactttcaaagtgatatttgggtatgtaaacgtatatgtgtccaagaaaaactgagcgatgccatttacatctgtggtgtagtttcccacgattttgtccttcagatgcaactgaacaacttcatttgggattggagagttgtctggattaagcaatttaatctgtacaagaggaagaaaatacatttcggaagcatgtagtaaatttgggcatccattttgatggcatttgccaagcttctatcatggggacccctgctctccttggtgcgtatgcacttcctgtgtggtttcatctattcctgttgagtgtatgacatgtaccattaatatactaatgagcctaaactctgtttctcctgcccacgaagatctctgaaaactcaggcccatagaattaaccatcctgagtattttttataataaaaatgctacagaaactctcaaattggaatgatttattactgtgcccaaccttcctttttttctatttctcttatttatctcaaagaatacctcaaccattcacttagtcactgaagtcaaatatctagagacatcttagactttttatttttcttctcccataattttcaattgttgatcaaatattttcaattgtatctttttaacattttctgtttccaactgatcacgtttgttcctgttgctattccttgtatcaatatcttatcttttttccctcatacgtcttctatttttttctatccagtctctctctcctgtattgcttttgcttgttctttctctatactggcatcaaaccaaattttctaaaatgcaaaatttagcattatcctccctaaaacattgtagtgactgctctgataggccatggttattcgctagaaatctctttctcattctcttactagtacaggcaatgattgctttaaaaagtcccttctgaaattgtatgatttgtagtagatacaatgcctgcatcagtatctatgccagtttgaagcctttaaaggcaccttcttaacaacatctaaggccacaacaaccagaagaactgtctgagccatcctttttttagctcagtcagtttctgcaaaacaacttctgctttgagcctttcatcttatttctgccacttatcattttcctgctggtccaagcaaacacaatccttttttcttgctcagcatctgtagactgatgcctcatttgcaccatctacacagattttgaacttagtttcatctcaaggcttgatcttctaagaaaaattcaacttgtctcagcaatccacaggccacagacacgtgacaccatgcctttatgatcacacagaggtttgccctaattttagtacacctagactagaaagatcctttgagtcccttccagtcacagaaagatgaacaagccatgtgatttctgggcactttcctttctttctttttttttttttttgttttatttttattttttttattgatcattcttgggtgtttctcgcagagggggatttggcagggtcacaggacaatagtggagggaaggtcagcagataaacaagtgaacaaaggtctctggttttcctaggcagaggaccctgcggccttccttagtgtttgtgtccctgggtacttgagattagggagtggtgatgactcttaaggagcacgctgccttcaagcatctgtttaacaaagcacatcttgcaccgcccttaatccattcaaccctgagtggatacagcacatgtttcagagagcacagggttgggggtaaggtcaccgatcaacaggatcccaaggcagaagaatttttcttagtacagaacaaaatgaaaagtctcccatgtctacctctttctacacagacatggcaaccatccgatttctcaatcttttccccacctttcccccctttctattctacaaaaccgccattgtcatcctggcccgttctcaatgagctgttgggtacacctcccagacggggtggtggccgggcagaggggctcctcacttcccagtaggggcggccgggcagaggcgcccctcacctcccggacggggctctgatgttagggcttaaattgatttatatttcaaagaattccctaatagattctatagtagcactgaagagtattctattgtaaaactcagaggaaagcaaatgtaattttctttgaacatgaaaaagaaagcaactttgagagtagtcatttagcagtagatgtgcattattatgagaaaacagttctataaattcagggttaattctattaattggaatgtcggtctctaatgtctagcttattatagggtagaaaagagctttctactcagctaatcattaatcattgatccaaaacttaaatacatctatcatttcctggggctattgtgagtactgtatatgtatttagcaaatatttaagacctagtaagtgctcaataaattgtagctgttactacaaaagaaaaaattactttttaaaaaaatatacaaccataatcacacatactagagaagaaaacttaaaactctaagtaattcttaggtaaaaataaaaataaaaataatgaaatcatcaaaaatgattttaattgaacttaaaaattgttaagatggtaaatttgatatgtgcattttttcataatttaaaaaataaaaatagtatagaaaaacacctgtgaggaggaaagaagtattcaggaaaaattgtataaatctgaaaacatggaagtttaacataagtatttataacaagatgctagaaaaaaaaaaccaaaagaggtagaagaaaaaatataataaaaataaatgatgtaatgaaaatcatttaaaataacattaaaaataaagataattaacaaatccaaaaactaatgggaaaaaaacacaaacacaactagtaataaaaaaggggaaataaattatgatagatttattttttcaaatcataagtgaacatattttatgccctctattttaaaacctaaatttaataagaaatatctagatacagaaactaacatattatagaaaattcttagtgaactaaaaaaggaaaattttttgactcgataaagtatgtctcacaaaatgctacagttacttagtaggtttacgcattacatttttaaaagcattccccaaaatatgcaaaatacaaccaggaagtccactatcatctctaatattcaaattggagatctttgccaatcgaataaaacaaactaataacaaaaacctcagaagattaagttcagaaaggaagctaaaatataacattttcacacaaaatgctctttacacagaaaacacttttaaattgcacagaaaagatacaagagacaaatgggaacccaagaaatcatcttgggtaacaacaacgtaagagggaggaaatggagaattctcaagtctagataaaattattttatattcagaaaaaattttatattctttgaagatatctctcagttttatatatttagtaacagaacatggaaatatataaagcaaaaatgtacaaagtgaagagaaaggttagaaaaaattatgttaacattatccaccactattcagtaagtgaagtgaacatatatcaaatttatctatctgccaaagctgtatttcaatctaaatttgttcattaaatgacttttactgaaatttgtttcagtaagtcctttaggtgatgctgatgccagtttgagaaactgctttgtaagatgtaagccaggctacccacttttgtatttcttttttagtgttcttgtgtcaacctaaatattacttcctcagggaaactttccatgatcatttagtccagattttagcaaacttcttttgtaaaacaccatggtctctctctcatatatttttttattttttaaataatcttttaaaaatgttaaaaccactcatagttcactggctgtatcaaggcaggcctctgtctgatttgcctatgggctgtggtttgtcagctcctgatgtagagtagttaaatggtcagtatttcactgacatagcacctatcacaactacaataattctttgtaaaattatctgtttaatgtttattatctctattacactataaactccataaaagcagtgataaaagtgcctctctacatcaccattttattcctaatactgatatagactatataatttattgtccaaacttggacacttttagagtgaagtggttgtaactattaacagttacaacttgataaaacatatacaccaggacagatctatgaaaatcaacagtgtaggtcaccctacagtgcttagcacagagattcctacatagtaatttcttagggaatagctgttggaagattagtagataaatgaaagaacaaatgaatgaatgaataaggtatgtaaaaaatgattgctttctaacctggccaaaataagggagtccctgtttgtaggacatatccatattctcaaaactaatcttcaccactgatgagtctatgtatacgtacttggagcctgtaagctgcacacctgcagtcaattaagtattattgagaaaatgtcacttccaaaaacagacaaacagagcttctgaaaaaaaccacaaaagctcaccattccttctaatagtttcccttccctttcctaagcagttttaatatgtaggtacttcagatgtcttttataaagaaagttaatcaagatggcacaaaatgcttgtgccaactggtgttgctgctttttataaaatatccaattcacttaccatttcttcatgatggattagtaaacgttgatttctcattattcctaagtgattgtttaacaacatttcttttactctctgcttgcctaaaacatatgctttaatttattaatagtaagaattgtaatatatgtgtattattaaaaatggaaatgcttaaaaaagaaaatacaaattaccaaatatcagatatctccaagagaaccaaaattagcattttaggctttttcccacaagttctatttctctttatatttatcatttatattaatatgtttgagattgtgtgtgtatatgtgtacatgcacacatacactcaatatgtgcaaatgtatatgtagttttacatgttttttatcattattttataaagtttttgtaaaaccttataaaaacttatttttaattgctacattatttctcatataaatatggacatatgttatcatgtagcaagcccttccctccttccttcctgccttccttcctttccttccttctctttcttccttccttcctttctttctttttctttctttctctctcttcctttctttctctctctttctctctctctctctttctctctctctttctttttcttttttttttcttgagatagggtctcattctgttgcccaggctggagtgcagtggtgcgatcatggctcactgcagccccaacctcctgggctcaagtgattctcccaccttagcctcctgagtagctgggattacagctgcatgacacaacacccagctaattttgtattgtttgtagagacggggtctcactatgttgccaccgaggatggtctcaaactcctaggctcaaataattcttctgcctcagcctccccaggtgctggggttataggtgtgagccactgtgcctggctattcttttattatttatttagttcagtatgacaaatatacctaattatcaattaaatgtttgtttaatacttgaatttcctctggatgtgacagatacctctaaaactttgaagactgatataagtacattagtaatttaatatttcaggaacagaaattttgctgaaatatcagttacatatgcgtaagtttaaaagtactacagtaacacaaagtggtcagcacagaaaaaagcatttcaaggattaagacttaccattttgtgctttaggaagaaggggtattaggtccaggagatacaagaaattagtcattagaaatattattggccgggcgaggtggctcacgactgtaatccacgcactttgggaggccgaggcgggaggatcacctgaggtcaggagtttgagactagcctggacaacatgatgaaaccccgtctctctactaaaaatgcaaaaacctagtcgggcgtgatggcgggcgcctgtaatcccagctactcgggaggctgaggcggaagaatcgcttgaacctggcgggcggaggtcgcagtgagctaagattacgccaccgcactctagcctgggcaacaagagcgaaactccgaaaaagaaaaagaaggaagggaggaagggagggagggagggagggagtggggagggagacagattttcctggatgagataaagatttttcactggatttattttcagaggcttagtaaaatattctccccaaactattttacttcccatgttctaattctatgctcaccaaaaaaattttataatcgacaactacatgtctcaattatatttatctgtggaatgattaaggaaaaggaatatgcttatatctaaaaccagatactcccattataaatcaataaattggcattcttacttctattgtagccttatttgaatgtaacacttgaccatccatcaacatgtgtgtgaaaattttggttgatatatgaaacattcagaatttgaatcagatgaacccaatgaaaagccctcagggaaaaaatgattgtattgacattgtatagttggcaatcaggtaacaattcgaatgagacagtgatatccattggggtctggcttcttagagagcattacctgttccgtcctctgtaacaagagcatgcactttgaggaaactccagtatccttcccgatttcactcaaaagcatctgtgttaataaacttggagacacagccatctttccccaactgaaaagaacaataaaaaaaagttatattgtaaaggaagactgtaagaaatagctataatagggaaaatgtgtgacctcactgaagcaactttaagaatattgtattacccaagttttagttttttaaaataatccattgtgtttctataattatattttcagttcatgtatttacctataactatttattttttaataaatattaactcttacaatattgtgttttaaaaaactcttcatggtgacattattttgttattatacaagataataaacacatccatcactagtcacgtattcacacatgatatttgcaattttggtaatttcagccatattcttttacagttttgaaactgagttttatattatttagttaccatgccttggacatttatgggactatttacacagcagttaggaacacaggctttacagtcaaacaccagaatttgaaccctggctttaccacttattacttcatacaaaatgaaatcttaataaagagcttgtagaactgtattacattagacaataactggaaagtgtttatttagcacagggcctggcacttagtaaacattcagtaggtagtagatttttaaattagattcctttacatttctctcagtgtctagtcaagtgacaatgtctcactaagtgaaatttttaaagtgtcacaattagtaaccaaaattaaacaggatgaattgtcaaatatttttaaaatgtgggataaattgtgctcataggttcctggactttaatattggggaaaaactgatttcttattctactccttcatcttatgatgatatgaggaaatctagtcctcaagatgtgggtgagatgtcaaaatcctgtgctacttcagggggtccttgaaactataagaaggtctagaaccatttccagaagcttaaagatctagaaaaatttccactatactaaaggtgaataatgagataaattatttagtccacactcctgctttacatgtgcatttgattattttaacttttattttaggttcaagggtgcctgtgcaggtttgttatataggtaaattgtgtgtcatgggggtttggtgtacagattatttcactatccaggtaataagcatagtatccaataggtagtttttttgatcctcaccccttcccaccctacatgtacattttaaatttccagagctctcaaatctcctgaagggcatcctataatatagccaccttcgataatgcattctgggatctacctaccctgtgcactcggcttatattggtttagtctcttctagagtgtgcatctttaaagattatgactgcttcataaagtgcaaaacccatgaggatagtacctgatctgtcttgctcaacaatgaagcttctaaataaaattattcttgcatattaaaagacctcaatatttatctgttgaatgaatttgtggagaaaatttttgtatccctgatatccctaaagatacagccccactagttatttaaatatttatatgacttggttggggtgcagtggctgacacctgtaaccccagcactttgggagaccgaagcgggcagatcacatgagatcaggagttcaagaccaggctggccaacatggtgaaaccccgtctctattaaaaatacaaaattagctgggcgtggtggtgcacgcctgtagtcccagcttcttgggaggttgaggcacgagaattgcttgaacccgggaggcagaggttgcggtaagccaatatcgcgccactgcactccagcatgggcgacacagtgagactgtctaaaaatatatatgtattgacatgtatttatgatctagttttgctgcacccatgatcttgagcaatgtatttaacctctttctgctttaatccactcatcggtaagggggcgataatagtaccccctcatagggtactatttgttttgagaatcaaatgcacataaactacttagctcagtgactgacacaaaataagcatccattaaatgttagcaattattattattataattgttactattgttagcgtttattgtccacattttttaaatttaagaattagaaggttcttaattatttccaacctaaagtattctctaaacaggacaggaatatgtgacactgtgtgtgtgcacctgtgtgtgtgtgtgcacacatgtgtgtggataaatggtatcacactgtagtatggggattgcagctggcagttgtatattagacagtcagatctggcatgattatagctgaaagccttgctacatcctagaccagcctgtttgtgtccgttttctgaatgttggttctcaaaccttccaagtagatcttttaggaaattcctcctttgtcagtttggaaaagttgattcttctctttagtggttaagaacctgactgatagggttcccatctggagctcctatatacacttatttccagtgagaataggttgagaggaaaataattatacatctaatactcttgaatatgcagaaacatcacatctccctgactaaattcacaaagtataaaataaagaacaggacatatgttcccagtaaattgatagggtgtagattttgatatgaaaccaaatgtatttttaattaagaatcgaaatttactactcagtttctgatactataatttgctttttgtcagtcaatagaaaatgaaacttagcatgacaaaagaggaatataaaatttacaaataggaatagaaatatagaataaaagtatatattttaactgtaaagaggaaaacaggaagaaaggaaggtaaatggaaggtgaggataaaaagttaatggaaacctatttataattttgctgatatacctcttacctgaatggtaaaatttttacagagtgaactgataagatgagcacatgaatgataagccgtagattctctgcacacactaagttggaccttcccgtccacaggttcaccataggtatatctaatagaagaatataacaacaacacaattacagaggtcaaggtcgtttttaatctgtatagggttttgaaacctttatttagtagctgaaaccagcactgtaacaacatttaaatagctagttaccataaattttattttctggaggaaatctaaaacaatggtacggactaaaattgagctgaatgctttaggcaaaaatatattttaattaaaaaggttgaaataggcatgtagacgttatatatctaagtcactaaaatacaatgtaaacaaaaaaacaaaaaaatacatcagtcattatttcattaaaaataatattttttgcatactgatagcaatggagtattgaaaaacaaaaaatgaaataaaataacattttgcttcttttagtttttttgtttttaaactgctattatgagcatattttatggtttttacttttaaaatgtaaattatatttatttatttattttttataaatgtcattttaagtcatcagattttggggtaatttctttttgtttgttttggaaagaagtaaaactgttcattttttattattatattttaagttctgggatatatgtgcagaaggtgcaggtttgttacataggtatacatgtgttatggtggtttgctgcacccatcaacccatcatctacattaagtatttctcttaatgctatccctccccttgcccccaacccccgacaggccccggtgtgtgatgttcccctccctgtgcccatatgttctcattgttcaactcctacttctgagtgagaacatgtggtgtttggttttctgttcctgtgatagtttgcagataatgatggtttccagtttcatccatgtccctgcaaaggacatgaactcattcttttttatggctgcatagtattccatggtgtgtatgtgccccattttctttacccagtctaacattgatgggcatttggattggttccaagtctttgttattgtgaatagtgctgcaataaacgtacgtgtgcaggtgtctttatagtagaatgatttataatcctttgggtatatacccactaatgcaattgctggtcaaatggtatttctggttctagatctttgaggaatggccactgtgtcttccacagtggttgaactaatttacactcccaacaacagtgtaaaagcgttcctatttctccacatcctctccagcatttgttgtttactgactttttaatgattgccattttaactggcatgagatggtatctcattgtggttttgatttggatttctctaatgaccagtgatgatgagctttttttcatatgtttgttggctgcataaatgtcttcttttaagcagtgtctgttcatatccttcacccactttttgatggggttgtttgctttttcttgtaaatttatttaagttccttatagattctggatattagccctttctcagatggatagattgcaaaatttttctcccattctgtatgttgcctgttcactctgattatagtttcttttgctatgcagaagctctttagtttaattagatcccatttgtcaatattggcttttggtgcaattgcttttggcgttttagtcataaagtatttgcccatgcctatgtcctaaatggtattgcctaggttttgttccagggtttttatggttttaggtctaacatttaaatctttaatccatcttgagttaatttttgtataaggtgtaaggaaggggtccagtttcagttttctgcatatggctagccagttttcccaacaccgtttattaaatagggaatcctttccccattgcttgttttcatcaggtttgtcataggtcaaatggttgtagatgtgtggtgctatttctgaggccactgctctgttccattggtctatatatctgtttttgtaccagtaccatgctgttttggttaccatagccttgtggtatagtttgaagtcaggaatccaacttccaagggatgtgaaggacctcttcaaggagaactacaaaccactgctcaaggaaataagagaggacacaaacaaatggaaagacaatccatgctcatggataggaagaatcaacatcgtgaaagtggccatgctgcccaaagtaacttatagatacaatgctattcccatcaaactaacattgactttcttcacagaattggaaaaagctactttaaagttcatatggaaccaaaaaaaagcccgcattgccaagacaatcctaagccaaaagaacaaagctggaggcatcactctacctgattcaaactatactacaaggctacagtaaccaaaacagcatggtactggtaccaaaacagagatatagaccaatggaacagaacagagccctcagaaataataccacacatctacaaccatctgacctttgacaaacctgacaaaaacaagaaatgcggaaaggattccctatttaataaatggtgctgggaaaactggctagccatatgtagaaagctgaaactggatcccttccttacaccttatacaaaaattaattcaagacagattattaaagacttaaatgttagacctaaagccataaaaaccctagaagaaaacctaggcaataccattcaggacataggcataggcaaggacttcatgtctaaaacaccaaaagcaatggcaacacaagccaaaattgacaaatgggatctaattaaactaaagagcttctgcacagcaaaagaaactaccatcagagtgaacaggcaactgacagaatgggagaaaatgtttacaatctacccatctgacaaagggctaatatccagaatctacaaagaacttaaacaaatttacaagaaaaaatcaaacaaccccatcagaaagtgggcgaaggatatgaacagacacttctcaaaagaaaacatttaagcagccaacagacacatgaaacaatgctcatcatcactggccattagagaaatgaaaatcaaaaccacagtgagataccatctcacaccagttagaatggcaatcattaaaaagtcaggaaacaacaggtgctggagaggatgtggagaaacaggaacatttttacactgttggtgggactgtaaattagttcaaccattgtggaagacagtgtggtgactcctcaaggatctagaactagaaataccatttgacccagctatctcattactgggtatatacccaaaggattataaatcatgctgctataaagacacatgcacacttatgtttattgcggcactattcacaatagcaaagacttggaaccaacccaaatgtccatcaatgatagatggacatatacaccatggaatactatgcagccatgaaaatggatgagttcatgtcctttgtagggacatggatgaagctggataccaacattctgagcaaactatcgcaaggacagaaaaccgaacaccgcatgttctcactcataggtgggaactgaacaatgagaacacttggacaccgggtggggaacatcccacactggggcctgtcgtggggtgggggcagtggggagggatagcattaggagatatacctaatgtaaatgacaagttaatgggtgcagcacagcaacgtggcacatgtatacatttgtaacaaacctgcatgttgtgcacatgtaccctagaacttaaagtataatttaaaaaattttaaataggtagaaagagcaaagaacaaaattgcttgtaaggaataacagtagattcctctgggctacgttttatgacaatttctcaatttcatcttccaaattactaattctctcttaagcatcatcgatccttctagtcagcctttctacacatatatttttaaattaataatatgcctacttccaaggtctttaattatttttaaagttacactattgactcatatctgagtatacacattttacttatttctaaatttttttctgattgatgttcaacagttttctcaggtatatattgctcttttttttgtttatataataccttgatttcaagtcattagaatcttcaaccatttagtgattcatgcttatgttttgggattcccagctggcttgtcctagagtgctttattttgcttatgcaatacttctccagtaaaaatgacacaggagccaacacacagccactgtgatagggaagtacctagacatttgggctttggggatttctgttactcaggggattttccagcaatgctggcaattccctgcctttatgacccaactacaatgagacttttcagtctctgccttttctgtattcttccaactctggaggtgaagcacaaggtagtgacatcaaaaagttagccatgcttcttcttgactcttaaagacttccagcctaaagtagacacaggaaggaggacaggcaaagctttcaccttaaagtttggcatggaattttagattactgtagtgaagctctcctaataactagaaatttccaggtcacttttttatttttaattatgcaaaattaaaaggaaaagtagtacacatgagtcagggaaaagtagtacacatcaggtctgaggagacaaagttttaatgtttgcaccctggctctctttgctggt

SEQ ID NO: 114 - DNA, 144270 bp, Homo sapiens
gccacaaccttctaaggcatctagatatgcaactaaaatattaaaaaaattccagcaaggtcaaaataatctcaggcctagatttgccaccagtgccctcttctgggcagctttattttacagtagtgtcacgaaacacttgtttgtcaatatatgtatttgtgcactaagtgtcaccagaaaatacatttatgtctgttggttacagcctaaaaagtttaagaaaccatgtttagatgttttcccagtcaggaaaggccaaactaaaaagggctgtgtgtgtgtgtgcgtgtgcgcgtgtgtgtgtgtgtgaaaaagagagatgggggcccccattccactaagaagatgacagaggctgtgcaggttttttctctgtgatctcccctcctcctacaaatcatgcccagaggagggatcttgaggacctgcccctgcctccccagacccatctccacacccaggccatcctgggcagaggacagcagagctcacatctctgtggagagcagactgggctcactgcaggcctctgtgtcattgttcatcttcacttcataagtctcattctgagacctctcctgacacaccatggctatctggctctcctgggaaaagcacttacaacattcaagatagagaaaatcatcagcagctgccaaccctcctcctcttccctcagcaagtaaggcatcacgcatgcacatatgcacacgtgcacaaacacatgaacttgtgtacacacacacaggcacacacacacatgaacatgcatgcaatttctgtggcctcattttcttgtgatggctgatgaagccatgacgccatggaagtgttaagattagggagagggttccatgtgggaggatgtctggtgtggatccaaggagatctgagtcctgactccaattcacttaccctctggcccaagtcacttagcccaccccatgcctcagtttctctttctatgaaataggagtgacatatgccctgcctgactcagaggcctgttgtgagttacaaataaagcaacagataagacggcgctttgagactgggaaaagtcagctttgacctaagggtcctgggctgtgccataaagggcagggtgggcctgtgaggaggcctacctgtgagggcctgccctcccacccctacctgcaatagctgagcctttgggcattagtttggcacagctgagatgtctgtggcatcctattttgatggtgcccttgattctgacacaagctccctgcagtaaaggcacagaaaggaaacctcacctaggagggtttgctctcccaagcagagggcagtgagccggagtccctactgagcctgaatccttcctgaactccagacctgcctgtaccagaacatgtctttccctatggggacacagtcctctgctcactgggtcctgtcttcttcagctctgagccatgagctcttccttttcctgtttgtgctcagctcagtgcctctctccatctttatcctcagaccccagaaggcattaagggaagatcccagtccatcttcttggagctgagagctggatcagtgcccctggctttgaggcagggtaggggcagttctctctcagggaggcctgcagatcgccacctgccccacggtgggaaggaaagatgacaggtgggagctccaggtggattgggaggggagggagatggagtgggctttggcaaggcatggggggataagcttgagatgcagagtggcagcaggcaggcaacaacatttctggagaccaccaggcacaggacatgctggcctgtcctcaggacaagcaatgccagggcctgagctgcccttacccttcaggacgaggcctgggaactggaatgtgggctatgcttttcttcaccaaactgaagcttggcaccctgagtgttgtttgtaccaactgcagtaggcagacggggaaccaacacttcatgagcactgactgtgtgctgtgcactgtattgcgtgctttctgtttgtttgtttcatggagagatgtatctctggggagagggaaatcccctgagaatcccccctctcctctaaagcccccgccaccccaggttctctaaaaatccctctccccttatgtcacagagaataaagcttcacaggaaaatgcccttagaaagggggatttaattcactctgagatgctaaagatggccacggagacctccttaagcagaggctttcaggagaccgacagagaagaaggcagtgcagggacccagcgtgtcctcaactttggctaaataaacctgtaatcgattgaaacatgtcgcagtcactttttggttaacaaggtcaacggaggcacaagcaccaaagtccacctgaagaagttgggtctatctacgaaccacttgtgagtcactgtgaatatttagaaccgggggctaaagcttattccagttgtctgtctggatgtcagtgaggccactccatagtagattctcccacctttggtttaatgggatggacaactttggattaggactaaggaggtagatttgatcttggaagataccttaggcttcttgtctcttatctccctaggaaactgttggctgtcagtatctatactaggggtaagcccaagtgacagaacagttctggaagcatctccttgagttttcaggaaaggtttcactgacacaagaagagagtagggtggcagagcagcatcgggtttggttttcaattcccttttctatctccacacgtgttgggtgaaattcacagggttgccacactctcgtgggtatatttggattacggatgagagcataggaaggtgggctgtgggatacatacagtggagtgctgctgactatagcccccgtcatgtaagaaagcacgtcagattgccatagaacaagttatgctattgttggaataactgaagttcattctaatttagtttttaaaatcattctgaaactttgtcccccctaccgcatagtagttgaagggtactccgttttccctttttctgtcctaaccaagaaacagagcgtgcctcaactgttctgtgaccccatcagctgcacaatttgcccggcaggctggaacccaaggttacgctttgaacactcccaggcacctacaaaggtgtttaggttgttgccccaaacactgagaggaactggccaggccctgagccaaatgccttaatctctcaccaactccattccctgatcctcatgctgcagacctcactaggtagagcacctctttccctaactgcctatctggaggaaatggtgaaacccagtttctacctaagttctcataataaatgctttgatctgatcaccctggcgtctagtgcttctttctttgggattccaactggtcccatcttgggatggcttggggtactcccttgtgggaactcccctgatgccagcagtggcaccccagatgccactgctgaggtgactccagctgtgaattcactggaaaagaacacaggtattcctgattagttctttatgctccctcaaaggtcagagctcaatttccttgcacctgatttctcatccacaaaatggtatttataacacctctgtggaactgtcctccaatacccttcttcctttttaaaaaaccatgcatttggccacctggaatggagaacatgttttccaccccccttgcagctaggtgtggccacgtaactaagttctgaccaagcagtggaaggtagagtcccatatggcactttcaagaagtattcttaaagagcaagggcacatgcatttctatcctgcctgtcttcttcgtgactagaatgaaacacgatgcctggggctaaacagtgatcttaaaccatcaggaggaagtgatatattaaaaggcggaagagccaaaagatagaaagaacctagatcacttatgctagcagagctattcatcattttgcacagtttaccttcagactttgttcataagggggcaagggagtgtgagttttctatcacaggcaaacccaatcctgagggattgacttaatctatcaacattgctgtgaggatttaaggagataatataaaatccttagcagtttttctggcatgaagtcagagggcaactttttcttttttctcaaaagtaatgaaatattaaggctattgaaacttggttctgagaacactgaaagatatggaaagaccatagaacctgtttccacattggccagaatggactgacattacatctttgaagtcggtcataatcagaatgtttttcactgcttctaaattgtatgcactattggataaaactggaacagtacatggccaggcacagtggctcatgcctgtaatcccagcactctgggaggccaaggcaggcggatcacgaggtcaggagatcgagaccatcctggctaacacagtgaaaccctgtttctactaaaaatacaaaaaaaaaatgagccgggcatgatggcgggtgcctgtagtcccagctactcgggaggctgaggtaaaagaatggcgtgaacccaggaggcagagcttgcagtgagcagagatcacgccactgcactccagcctgggcaacagagagagactctgaatcaaaaaaaaaaaaaaaaccaaaaaaacaaaaaactataacagtactgactccatgttagagaaaagcttgtttgcttgaatacagttattgcttttcctgagactgtagattattcattaaaaacagcctcagaaatacaggatcttcagcagacataaaagaaaaaacactgacaaacaactctgggaatgggctaagtggcttgataagaatagcctgatggtacctgcagaaggtcatacaacattgaccaagaaaacagtgattgcctgcctgcctgcctgagacttcacatgtttcataagaatgctctgatcagccaggtacagtggttcagactggtattcctagcacttcacgaagctgaggtaggaggattgctggaggccaggaggatgaaaccagcctgtgcagaaaagcgagaccctgcctatacacaaacaaaaataataataataataaataataataatagctaggtatggtggtgcatgcctgtcatcttatctactcaggaggatcacttgagtccaggaggtcaaggctgcactgagccaagataacatcactgcactccagcctgggtgacaaagtgagaccctgtgtctaaaaagagagagagaaaaaaagctaaggctattttcaggttaggtcaggcttagtaacaaaaactttttgtgaaatgcttcgatcattgtttgccctgctcctaatttcccttaaaacctcccggatcagacaggtggtctttgaagatgagttcacagcctccctcgagtttttggcttcctgaatgtagctaactttccctttcaccaacatttgtctctagacttttggctttcaagcaacaagtggcctagatctgggtttggttacaaattttggcaagcccagccagaagccgtgtgctctgggctgtttgcaccctgtcagctcccaacagacaaagcaattggtcacagcttcataccaggactaactcatccatattgttgggaggacttcttggttcccaagaggtggagcaattgatggcggcagcaggtcagggctaactcattcacattaccagaggttagcggcaaatgctctgtggcactggctactcatggcagaagggaactgcagagacagccccaaagtctgccaaagagaggctgccaaaactctttctacttcagggaaacttcctcctttcccccattcagtactgactgcctacttttgcttttagttggtgaaaggaaactagctttattttttttattttaattttttttgagatggagtctcgctctgtcacccaagctggtgtgcaggggcgcaatctcggctcactgcaagctctgcctcctgggttcatgccattctcctgcctcagcatcctaggagtagctgggactacaggcgcccgccaccatgcccggctaatttttgtattttcagtagagacggggtttcaccttgttagccaggatggtctccatctcctgacctcgtgatccgcccgccttggcctcccaaagtgctgggaaactagctttttggatgagctgatgagctgtacaaccaggtaagtctactggggtgcaaagtagtagtccactttctttaccatttgggcctttggaccatttgtggtaccactggtagaagaaatgactcatagtgactccataccagtctcttcctttgtgaaagcctgggttggaaaagtgcttcatttgttttggttgtgttttgtttgtgtccaccatgggaagtttttttcatcagtcccctctcagagcccactgtggttcatattggctgactggtaagcctacagtgataaccctacgacaaaaaagataatctactgcaataaggtgtggtcaatgtacgtgatacatgaggaagataggtggccattacatggttctttgaatttaatgttatacagcttgaacatttcaatctgagatcaggaaattgggactgcataccttatattcaagcttttatgttggtacataataagcacgcttcccagaaaggttgctggctgatggtgcaaacaggaccatatcaggtaaaatctcctcactctccattacctgaggaggaaaagaaggagataggataatcttgtcaactataaaccctccacaggcaaatgatgctgaggctttgcaggtgcctgtcccattgcagcctgctctggcacctgtgcaggctcccatggaggccccagctgcagtaccagcacagtaccctgagttgccccatctctgccccctccaccagaggattatccagataatacagacttacagggtgtggtggcccctcctcattttaaaggtagccaagaaataggctccccttttaagacctgacaaggcaactaaatttgaccacagcgtacaccctcatgcggcagaacaatttctgttatgcaaattccccgctggaggattaaatgcacagggccatactcctgggctattttggttattcaccattttctatctttgactaagtaaatggaaaaatattcaagtccatcctatagggatgatccataggagatgactgaaatattcaccagtattttttctattcatcattccacaatagcaggtgtacaagcattattaaattttatgatgaaagggggttatttttagacaagactaatgatggagccagaaggctataccaggaagaccctgctgggtcctccaacatcccagaggcaatttccttagtgaaacgcaaatgaaaccttaataatgaggttatatcttgactgtaggattactcctaagaaagggagtacctaagcagcaaagcctcaataaaaaacatccatgacctctggtaggaggccagtgaaaacccagcagcttggttgaaacaagtgtaacaggcttacagaaaatattcagatattgatccagaggctctggaacatgtttgggtcataaatataactttcatcagccaaagtgcttctgacattaacagaaaattagaaaagcaggaagggactgttggaatgaacccttcccagtttacagatattgcttacaaagacttcaatgctagagaaacaagaaaagctagacaggcaaccattttcatggagactgttcaaaaaggtggaagaatgaggggtgaaatagaaaggaatccctagacaaggaccagtgtgcctacagtggggaaatctggacatgagaagtatgcccccctaagctacagagaaaagatggtaataaaaaagacaagggagaggaaaagggaaatatacgccaaagaaggagatggtggagcaggattgtgactctgatgaagactgatggggcacagggactccgcctgatttaacagagcaacagtaatttccctacaggagccctgggtacaagcgacagtggggaacaaaatgactggcttattggttgatactgtagcaatgtttccagccaaggctggagtcactgggaagttacaacagagactctttcttaagccctaagaatataaattgagggatataagattgaggtatagctttctgtatatgccacattgccctattccattgttgggccaagatttgttatgtaaattaaatgcccaagtcacttttgctcctgagaaacaacatctaagaatccaggtatcacccaaacatgtcctatgcctacaggcactggtgattcagccagagaaaagaactcaagaaccattcctgctggaagtctacaacagagggagttgcactgtttgggaagacaagggaacctgaactagcagtcaaagctcagcctgtgcacgttgaatttaaaaaagcattaattccacataaaaacaacactgcttaaaaggtaaagaattagaagtcatacagggggattacacaggtttctaaagcacagacttattcaatcatgacagtctcaatacaataccactatcttgccagtgaagaaaccaaactccaattagtatcaatttgtgcaaatttgagagctattaatgacatcgttcaagatacccacccaatcgtggctaacccatataccccacttacagctaccccaggggattatggctggttctcagcataggaattaaaggatgcttttgttcagtgtctactaattgaggagaaagcccagttgtttttgcacttgaatggcaagatctggagactagggcaaacttccaaaactgctagactgtactgcccaaatatttaagtattcctttaccatttttgaaaaaaatcttactaaaagatttgagaagcttgcaattaaacaggggaatactattacaatgcatgggtaatttactcattgctagccccacttatgaagactgtttataccagtttttgtttgattgttttgaaacaaggtctcactctgccacccatgctagagtgcagtggtgtgatcatgggtcactgcagccttgccctcctaggctcaagcgagcttcccaccttagcctcccaagtagctgggactgcatgtgtgtgccactgcacatggctaatttttaaaatttatttgttgtagagatggagtctcacagtgttgtccaggctggccttgaacttttgtgcttaagcgatccttcaactgtggcctcccaaagtgtctggattacaggcgtgagccaccgcacctggccaatactagttttaaacagcctggtggaattggatcataaagtatctctttgcaaatatgcaaagagcaggtagtctattcaggggtttgcctgcaataaggtaagcagagtctgatgcctgacaggtaacaagcaatagccactatcaaggctctcaaaaatcagataactaaaaggagtcttaggtatagttggcttttgtcacctttgatccctaattttggtctcctagtaaaggacttatctgaggcatttaaaatgtcagagtcagaacctttatattagacagtggaatgccaacagtcattcaataacattaaagaaaaactaaggaaattctttatgggcccccaagatgtttaccctaagatagttacgttgaatttcaccctgaccatgtaaattgatggcttatcttcacaggcatggaacaagagacataagtcatccctcttctcacctgagacaaatgcatatctgattgctccccctgcctgtttatcttatgtaaaaatgcaggttcattgaactagatgaatgtttaagtgactgttcccctaccctcttacatgtgaaggctaatcaaagactcaaaagaatgcaactgcttgcctcttatctacccatacccttttaaaaatgtatcttcctctttcaatacctggccttttccctttaaatattgggatcccaagaccctctttggaaaaagcatgaaacacaatgtttcctgtggatctacgttctttcctggacatgtcctcaacctcagcaaataaacctaaaatgatcaggactcaccttggtcatttttctttagtttacatttcctaagctacagacctgtgcagcacatgactatactgaatactgtgggcaacttcaacatgatggtatctgtgtctccaaatgtctcaacaaagaaaaggtacagtaaacatatggtttgaaagataaaagtggtatgcctctaaagggcactaaagggcactatagcattatagtatttatatgtctttgtccagggttcctggctcataacttctatggccctcattatagtcttgttatagtgctgggacactttaggctcagaaaacagactctctctgtctctgactttctcctgccctcctttcacctgcccaaggcaggactctgcacatcataagatcctcattccagagagggtcctgcccatccttaggaggtgggaatgctgcacagagaggccaagaatctggataagccttggtgggttttcccatctcagacaactagtgttagatcatcccttctggtccagttgtatttgtacatggttgtcaatcatgtctacccaatgatgtctccattgaaggctcaagaggacagggctcagggagcttctggaaagctgaacacgtggaggctgacaaaactcttccctatgccaggagggtggccacaccccaactccacagaagctcctgggttagggacccctccagactcaccccatgtatctcttcatctggctgtttatttgtatcatgtaaaataccctttgtaataaaccagtaaacataagtgtttccctgagttgtgtgagcactctagcaaattaatcaaacacaaagaagaggtcataggaaccccaacttgaagctggtgggtcagatgttctacagacctggacttgctatcttgggaaggaggggacagtcttgggagaatgagcctacaacctgtgggatctgatgctatctccaggtaggcggtgtcacaattgaactggaggacacctagctggtgtcccctccagaactgcttgtttgcttggtgtgtggggagaaattcccctgtatgtcgtcatagaagtcttccatgttgatggttgctgtggtgtgagagcagaagaaaaacacattggaggtggtttttccacacacaggcacttactatgaatggagcttgcaggactggaagttgctctgggtgagtcagggagtgtgtgttgcgtgcaggtgaaagcctaggacattactgcacactgttgtggactttataaacagtggacacttaggctacactaaatttgttaaaatattgttctttcttcagtaaattaaccttaggtttctgtatctctttcactttataaacgttttaattttttaaactttttgactcttgtaataacgcttaatttaaaacacaactgtacagcttttctttataagcttttttctatttaaaaaaatttcttttaaacttttctgttaaaaattaagacacaaacacacacattagctcaggcctaaacagggtcaggatcatcaatatcactgtcttccacgtgttgtcccactggaaggtcttcaggggcagtaacgcgtatgaagctgccgcgtcttatggtaacaatgcttccttctgggatatttcctgaaggatcttggctgaatctgcttttcagtcagcttcgtttttggaaagcagaggccgggcatggtggctcacacctgtaatccccgtactttgggaggacaaggtagaaggatcacatatagccaggagttcaagacaagtttagacaacagagcaagaacctgtctctacaaaaagtaaagataaaaaaaattagtcgggtgtgatagtgtgcatctgttgtccagctacttgggggactgaggtgagaggatggcatgagcccagttcaacactttagtgagctatgattatgccgctgcagtccagcctaggcaacagagcgagactctgtctcaaaaacagaacaaaactagaaagagtacactctaaaataataataaaagtattgtaaacacataaaccagtaacagtcatttatgatcattatcaagtattgtgtactgtatgtaactctccaagctatactcttatacactggcaactcaggtttgcttataccaggaccaccacaaacatgtgagtcatgcgttgtgctaccatgttatgatagttactatgccactaggtcacagaaattgctcagctctgttataatctatggaaccaccttcctatatgcagtctgttgttggctgaaatatcgttatgcagcccgtgactgtgcattggcatttgtccacttggtcttcagcctagctttgtactttgtctttgacattttggcttccactgcaatttacttcaggcttggactccttgaggatctctccaaacctgccatggtctgtttcttgccaccagtccctagctgcacattcttagggcagctgccccagcttagtctgatttatggggccccttatctcgtaacttttagaatcttgaccaagtcaggctacccggcaggaggaaatgtcaaaggcagaggcaaaagtggccctctcactttatctgtatctccagggtcttcctttgcatggtctcctttccttccaccctcaagtccattcctctcctgtttctctccgcccctccaggtttcctcctttaaccgcatcacctagagtcatcttcaccgtgcaaagtggttttgttcaaactaatgtattaacactcaactcagtgcagttgccctttgaatgatcacacccaggagacttttttctaattagtgttcaccttgactgtactatatttcagtgttgatcattttgtcctttggctcagatagctgtaaactgccttctatttcactgattcatcattctctcatcttcctttcccatcttcaaatgtggatatttcctaaaggtcattctctgttcctcattttttttcaaaaacttttaataaaatatacataatcaaatgtaccttaaccctgttcaaatgtacacttcattcatgttgaacatactggcattgttgtgcgaccagtctccagaacttttcctcttgcaaaactgaaattcttacacccgtaaaacaactccctatttgcccttcccccagcccctgacaatcactcttctactttctgtctctatgaatctgactactctaacaacctcatgtaagtagaataatacagtatttgtcttttgactggctttttcactgagtataatgtgatggttaattttatgtgtcaacttggctgagccaccgtacccatacatttggccaacattattctgggtgtttctgtgaaggtgttttttggatgagattaacatttaaatcaatggactctaagtaaagcagattaccctccgtaatgtgggtggacctcatccaattaggtgaagaccttactagaacaaagactgacttcccctgaacaaggagttgtgccagcagactgcctttggccttgaaccataactcttccctaggtctccagcctgccagccaatacaatcagattttcactcaccagtcctccacaactgcatgagctaattctttaagcctctttttcgctctgtgtagacacacacacacacacacacacacacacacacaccctgctggttgtttctctggagaaccctaatacaaataatagcctcagggctcatccatgtcgtagcatgtgtcagaacttccttccaagactgaatcatattccattgtatgtatataccacactttatgcacttatctgtcaatagacacttgggttgcttctaccttttggctgttgcaaataatgttgttataaacacaggtgtgcaaaaatgtcaagacactgcttttacttctgttgtttacaaacccagatgtgaaattgttggatcatatggtaattctatttttaatttttttccatagtgactaccccattttacattcccaccagccatgtacaaaagttctaatttctctatatccttgccatcatttattttttgttttgctccttttgggttgaggttttttctttcttctttttttttgagacagggtcttgctctgtcacccaggctggagtgcagtggtgcaattatagctcactacagccttgaactcccgggctcacacaatcctcctacctcagccttttgggtagctgggactacaggtgtgtgccacgattcccccctaatatttttttaaattttttgcagagatctggtctcactatgttacacaggatggtcttgaacacctgccctcaagttatcctctcgcttcagcttcccaaagtgctggaattgcaagcataagccactgtgcctggctgtgtgtgtgtgtgtgtgtgtgtgtgtaatagtagccatccccatggattgcagtggtacctcatcgtggctttgagttgcattttcccagtgactgggatgtcgagcatcttttcatgtgcctgtgggccatttgcacatcttttacggagaaatatctatttaagtattttgccaatttttttaatcagattgttttcatgttgctgagatatagaagttctttatatattctggttattaaccccttatcagatagatgatttacaaatacttgctcccattctgtaggttgccttttcactctgttgatcctgcccttcaatgcacagaagttgtaacttttgttgttgtccaattcatctatttttatgttattttacaaatccctcaactcatcaccaattttttttgttgcctgtgctttttggtgtcatagccaaggaatcattgccaaatgcaatgtcataaagcttttcccctctgttttcttctaccagttttatagttttatagcttttaactttaatttttaattttaacttcattttaactttagaaaatccatcttaagttaatttggatatattgtataagacaaggatcctacttcattcttttatatgtggatacctccttccttttggaaacttttcctttcagtaatcttactacctccacagctttagtttagatgttttttgttgttgttgttgtttcccaggggtgatcaaatccatatatccagcttttaccaccttcctgagttctagtccccccattttcaaacaccactgaaaatttagtttgactaagtacatcaacctattatgtgaagaaacaccatgtcccacccccactacggtgtggcttaatgagctaaagtaatatatcaagatagacataataatccaagaaactggggttcagagaagtaaatattattagggtgcatcttgcgctgttccagagtgaggcatatagggttttggggacagaacaatctagtctctgataatgttttctcttatagcacaggcacatttcatgagcctttcccactacctaggtgttccagtttggatgtggtttgtttggcctaagtctcatgttgaaatctgatttccagtgttggaggtggcgtctggtgggcaatgtttggaccatgggggtacatccctcatgaaaggcttgctgcccttatggcagaagtgactcagttctcactcttagttcccaagagaattgcttgttgaaaacaaacttgtacctcctacatgctctccttctagaagaggatctaaggaaatttataataaaagcagaggaacgctgaaaccaaacccaattcatatcagtaatagctaccatttgttaagcttccacaatgacaagtaagatgttaagccctttatgttaccaggattatctcatttatctcataagaattctagaacataggtcctattattatctttattttattcgtgagaaaagcagagactcagaaggcttaagtcataggccaaggtcatccagccagttgaatggtggagtggggaatatctggatccaggcagtcagactgtttttttttgtttttttttttttgagacggagtctcgctctgtcacccaggctggagtgcagtgccgtgatctcggctcactgcaagctccgcctcccaggttcacgccattctcctgcctcagcctcccaagtagctgggactacaggcgcccaccaccacgcccggctaattttttttttttttgtatttttagtagagacggggtttcaccatgttagccaggatggtctcgatctccagacctcgtgatctgcccaccaggcagtcagactttattagaacatgcacttaaaattagcaagaaggaatgagaacaacaacaacaaaattaaaaaatgcttgccaaagaaaactaaaacaatgtgcaatatttagccctgagatcactagcagtgaaggcaaagaagaatgcataatgggtttctacagctctcactgtccggttatagaaaatatttctacattagtacaagcacttttcttcctaagccctgagttttgagagtttatcaagaaggcctctgagttcattcaattaatggcatcatctaaggctgtttaataacaaatgcagaggtagtccacataaggaacttttgcctttacctttgagacaaagcccagggcctcacgttaggagtacagctctctaaatataagcctccagggcagaagcgaggggaggatggagggacacaatgcagatttacagcctggtgggtacggcctttgtcctctccatgtctattgtcactcttgaggtccaagcctctactgcactgcctggtttactgcacaacccaacttggctgcttgcttctggtctctccccaccaaaccatccttcacactgcttccagcttaatatttccaagacactgcatttgcaaatccactcctctgtttaaaaatgtttcagtgacttgcaacttgtctacagtgtgaagtataaatttattagcttgttgtttaaagccttctacaaccagaccccgaccgaccttcacgtcctattgagaggtgacagcctgctggcagccctcgcagccctggctcgctcttggcgcctcctcggccttggcacccactctggccgcgcttgaggagcccctcagcccgcagctgcactgtaggagcccctttctgggctggccaaggccggagccagctccctcagcttgcagggaggtgtggagggagaggcgcaggcgggaaccggggctgcgctcggcgcttgcgggccagcgcgagttcccggtgggcgtgggctcggcgggccccgcaatcggagcagccggcccgccagccccgggcagtgaggggtttagtacctgggccagcagctgccgtgctccatttctcgccgggccttagctgcctccccgcggggcagggctcgggacctgcagcccaccatgactgagcagcccgccatgactgagccgcctgccggcgccccagccatgggctcctacgcggccggagcctccccgacgagcgccgccccctaatccgcggtgcccagtcccatcaacccccaaagggctgaggagtgccggtgcacagcgcgggattggcaggcagctccacctgctgcccgctgccgcatccacttggtgaagccagctgagttcctaagtctagtggggacttggagaacctttatgtctagctaagggattgtaaatacaccaatgggcactctgtatctagctcaaggtttgcaaacacaccaatcagcaccctgtgtctagctcagggtttgtgaatgaaccaatcggcactgtgtatctagttaatctggtggggacttggagaacctttgtctagctaagggattgtgaatgcaccaatcggcactctgtatctagctcaaagtttgtaaatgcaccaatcagcactctgtgtctagctcacggtttgtaaatacaccaatcgacactgtgtatctcgctaatctagtggtgacctggagaacttttgtgtctagctcagggattataaacgcaccaatcagcaccctgtcaaaacggctcaatcagctctctgtaaaacagaccaatcagctctctctaaaatggaccaatcagcaggatgtgggtggggccagagaagagaataaacacaggctgccctaagacagcagcagtaactcactaggattttcttaccacagtatggaagctttgttctttttgttttttaggtctgcactgcctttatgagctgtaacactcactgcaaatgtctgcagcttcactcctgaagctagtgagatacacgaacccaccggggtgaactagcaactccagtacatgccgtcttaaaagctgtaacactcaggcgaaggtctgcagcttcactcctgagccagcaagaccacaaacccaccagaaggaaaaaactccaaacccatcggaacatctgagggaacaaactccagacacaccgcctttaaaaactaacaccgcgagggtctgcagcttcagtcttgcgttagtgagaccaagaacccatcaattctggacacactatcaactttgtttctccaagggtgcttcttaaactggatgatgcacaccctaggagtgtgtgtgtaggatggggtttgaagcagtagggtaaaaaacctagcatacattctattccagaggtgtcaatttaccagacaacagttattttaaaacttttttatgcaaaaacatgttatagggtggaatgcaacatttttatgggcctgtgggccatttgtatacatctttggagaaatggctatttaagtactctgcccattaattctaaacttaaaactaagacttcaaagtccctctaaggattttgctgggccacatcccaagaccctgaagggtattacttactcgccctctccaaactgccgaagtcggaagcaggtgacaaaaaagctgaccctggaatcaccttttgtaaatttcccacctccaagcttttcgatagtttgtaacactggctcctctccccaaaagcctttccttcaagtcccagcaactctccctgaccctgctgggaaggcgcaccaattacctgtcattccaggaaagctcatagcataagatgatcccattggtcatctcccagaaccagactttctgaaaagtcctcaaggaccagctagtccaatccctcactgaataaaggagaagcaaagtctagggaggtgaggtgattcgttgtcctcctaattagcaggtgagctcctggcagggctggggtttcatcttctgggctctctgcaaggtcgtgcccggcacgggccaggaacaatttcataaactcgtcatctagacggcctttgactgacaccatctctccgtgtggaggagccgctggggtgcacggggcaggtgtcgtccgtttcaaaggtaaaataacccagctgcagacctccagaggccgactagagccggggtcagaaaacaggttttccctctcggggacagcgcccaggggaccggcattagaacatcggctgatgtttcatctggtcagggaaccatccagcgcttagtacacctggcgctaatcggcggggattaatctcacaccccgcagctggcggaaagcagcgggaggaggcacctagccctggggttgagatcccagttcccgcgtgcgcaaaccacgcccctgtagattctcgctgctgcgtgttcgcgcgcgtcccggagtgcgcatgcgcagcggcgggggttgttccggctgcctttcactgaggggacccgccagtttctaactcagtggcgtttgccctgattcccggggcctggctttcagcgtagcaattctgccggcgaagaaggtgagcgcagtgctgtgtggcagcagagctccttaggacgaggagcagcgggacgaggaagggcagactggtgaaatcgcaaactgggcgtctgttccggcgccggacccctatttgcaaaggtgggtggcccgtccggagcgggaaaacattccggaagtggagggccgggccagcgtgattgacaagcgggaacccctgtgtggggacgggtaggcctaggaaggttgtgcctgcggtggaactgggcggtgcgcagaagtgggcattaacagcagccgcgtgtctgggtcttagatttggcccagctgtgttgagcttttcatggattatcttacgtagataagacactgcaacagtgagtgagcgcttgtaacccacctgtctcttacggaaactgagccccagcgatgctaactttagcaaggatacagctgggatcctaaacttggcaatcagagcccagagccgataaagttagctgcatgagtctagcttcccccagggcgggaatcgaggcggagcagggtacagtacggaggccaggaatgagtgcacttgaccagattgttgacggaagtgtcataaaaatggacttaaatgctgataagcagctgtttgggttccacacagggtgcgagctcaggatgcacgttggaggggacacagggccagagcaaggtgggaatgcgggtattatgggccaggccatcctccagctggtggagcaccgcagtactgcagtgtgtggccctggcttaacagcagtgcggaaaagcttttttcttggggctgtggtgctttccaggtgtgtgaagttaaaacattttagggccatacggtagatagtacctgccacatagttgtcttggtcagccccggctgccatgacaaaataccataaactgggtggcttagacacagaaatgtgttttctcacagtcccagaggcttgggatgtccaagatcaatgtggggaggacacaactgagcccacaacaatagtctgtactcagtaatgagtgataattggggactgaagaaaatgaacacgttaagaactaatatgttcctgaagtgctttcacaactctaacctcgttttatgagcgtgagctttgctgtcctggtgtgtgccttggcactgggaggtgatggttgtcctccacacagccaacctgaagagggctgaacaagtcactgcaaatgtttttaatagggcttagtgaatccgttatactcagatttatctaaacctctatgatttagcctgtgctgcttctggaataatgagatccataattaccactgatggggaagtgaaataatacttacgtttcttctgtattgtttagtgttgtcattctagagtttggtaaccaagtctgtcttttttatcccacttatcctggtgggaggaaaagtgaggagatagaaagtttcaggtggcttgggggtctggcagatgtggttcaaatcctgagttcaagcacttgctgagtgaccttgggcaagtcatataagtttactgagtctcagtttctttctctataaaatagagcttataaaaataccacacagggtttttgtggggttatctgaaaacggtttgaaaccattaaagaactggccatttaactaataggtattcaagtcatgggacctccgttacccagcctcggaagagaaaccttcacttacagccccgatgtctggctggctactcattcgttcatcagatttttgttgaatgcctatgaggtgtcgaagcacctagttctgagtcctggagccagagaagagcaagacagacaaggttcctctatttatggaacgtatattccagtgaggaagaataaataggttcagatggtgctaagagctatgaataaattaaatacagagtaatgtgattttttaaaagtgacttagagcaagctagggggtgaggagtgggggtggtgtttgaccactgtccagcggccagacagccggagaggcttctctgaggaggtgagccaaagcctggatattgaggaggactccttctccaggccaaggggagcagcaagtgcaaggcccgagctgagtagatgaggctgggagcctgaccagtctcaggctgaccagtgctctgtcttgagaggagctgctggtcagctttttgtcttgggattcagaacgaggagacatgaagactttttacttggcagtgggagctgaagctgaaaggtccaggggctgatgaggccacgtgtaagcgaaagtttgggataagcagaaaccgagtgcgctgagggagtgagattgtggctgtatccggcacctggctgagcaggagagtgaaccccgtgggtgtgtgtttgctggtgacgttcctggagctgtcttgaagtccgagctgccttgcagcttgtagtctgcctctgtttttggctttcccagatagtttcaattcttactctcagtttgtgaacctcccttcagtgaacctcccttcacttatgctggatatctcttgcaaccggatgagcttcactaaagcagagtcatttggacctggattcgaatccctggttttccactttttagctgtgactttgagcaattatttaatttctgtaagcatcagtatccagtagctgtatccttatagtgttgtacagattaaatgagataataaaagcaaaagaccactgtagagtgtttaacacataggaggtactcaaaaatttgttaggtacctttcttcccctttccttcatgtgttaaagctttttcagtacatacccctctctcaggattgaattgtaaatcatgttttttgattacccttcttgtaataattcctctacctctgtagtcatgtttttcttttttcattttttcttgtccccagaatgtctaacaaaacagccaaatatacctctgtgaagacagagggtaaaataatgctagttctgtgagttctctcttcttgtgcaaatccataaactgccaccaatctgtagtcattttaattgcccctaaaccgaagagcatcgtggcaactacctttcccctcgtaaatagagtgacactatcactagtcttattgaggccaaagttataaagatgggctctcgatctactaatattagtaaaatgggtttgggacttactaacatttgtgcttagaagagacagacctggcaaagagcttggagaagtgagttccaaagagagaggtgtgggaaccaggatggaagagtcaggcctccagatagcgtttacttctcctttcttccttgaatcactgtctcagagataattaggttcaggagaggagaaaaaaaaagatgacgtcaacgtggagcagagtttttcttagaccttagcctagcaaggaaagagaaatgcctggtctcagtactgggaagctgttccagccagagccccgtggctgtgaagagagctctcctgtctggaaccaaacagaaagctcataggtctagaggccagaaaagttagtaggtggtggctctgttcggtgctggaaatggaggccaggatgaactaagaagcaaactaaagatacttgtaagataaggacgtgtaggccgggtgcggtggctcacgcctgtaatcccagcacttcgggaggccaaggcgggcggatcacgaggtcaggagatcgagaccatcctggctaacacggtgaaaccccgtctctaccaaaaaaaaaaattagctgggcgtggtggcgggcacctgtagtcccagctactcgggaggctgaggcaggagaatggtgtgaacccgggaggcggagcgtgcagtgagccgagattgcgccactgcactccagcctgggcgacagagtgagactctgtctcgaaaaaaaaaaaaaaaaagatagggacgtgtatgttaacttgcgctatccaaacaacaagctgtgcttatggtcctctgcctgtgcgtcatgattttccaggacttcacaacgggataaagtgaagtagcttcggcttgtgaatgtgcattgcagagacgtgggagaagaaagctgcaaaagtcattataagcaacacccttgatcttaggggtgctggtctgtgagaagagagctctaagccttttgtagaggcattagaaaggtatcggagccacggtgaaatgcaggggagattgggtttaggggctttcctggtctgcattctgctacagccgttaaatgccgctagatggagtgcgtgattctggtatggcctcacgtggacctgctgcgaaggatggagagaacatggtctctgcttcccagaaaaaaggagaaatttggtaataagtgtggagactgctcttaaataatgctccagatttcaagccacttcttcctggaccatgagagagctccctaatgttgtatttatttttcctaggtccatggctaatgaaacacagaaggttggtgccatccattttccttttcccttcacaccctattccatccaggaagacttcatggcagagctgtaccgggttttggaggctggcaagattgggatatttgagagtccaactggcactgtgagtatgaacagtgagagatactgaaaaggacaacttaacagcagccgtactagcttttcctgtttgcctatccagagattttcatagtttgaagttgggcagagtagtctctgtttatctgagtaatagtcacttcctctattaaagtcttttttttttttttttgagacggagtctcgctgtgtcgcccaggccagagtgcagtgggacgatctcggctcactgcaagctccgcctcccgggttcacgccattctcctgcctcagcctcttgagttgctgggactacaggtgcccgccgccacgcccggctaattttttgtagttttaatagagacagggtttcaccgtgttagccaggatgatctcagtcttctgacctcgtgatccgcccgcttcggcctcccaaagtgctaggattacaggcatgagtcaccgtgcccggcctaaagtcttaaacatagctctgtggtctgagaaaaattaggctgaagtcattggtgcctacctattacggtagatgagacggctttcttaccaactcttttccctcccgttccccatccttcaaatataattctaagttttagtctctgctgagtgaaccagtgtgttatgattatgttttgaacataattttgtcttgaacaatatgtcttaatattctgttttttctagttaataattgcccttttaaagttagtttagtttttaatatacctatgccagttcctcccacatcatccagtggcctctcaatatgattttccatacagataactcctgtcttagtcggccaggactgccatagtaaaataccatagactgggtgacttaacaggaatttattttctcaccattctggaggctggaaagttgaagatccagattctggcagggttctggttctggggagggggtctcttcctggcttgcagatggctgcgttcttactgtggagcaagaaaagacgaggaggagaaaaacaaatctttggtgtctctttctcttttatgaggacaagggctgctcccttatggctgctccgttatgacctcctttacccttgaaggccagatctgtagtagagtcacatggcggggttaggatttcaacatatgtttgtttgttaagatgggcagtctcactatgtggcccaggctggtctcgaactcaagcgatcctcccctctcagcctcccaagtacctggtggctggcaagatccaagattactggtgcacaccaccatacacagcttcttttgttttgtttttgttctttaaaaacatttttttaacatgcattttggtggggatacaattcagtccacagcagtgaccaattccatttttaccttggagccctcctggaatcctccatcctttccctgtcatttgaattagttgctcctcagactgacttgacagatttcagcatgagtgttaatggggacagacggccgcacccacaccacatcagggtatacgtccgtttggaggctttcctcaaacgtctggcagccctggactgcctgtgtatgctgaagaacagggcacagaaaggctgagtctgcagggcactggctgtggctgccaggctgggctcctttgttgggggcctccagttgccagcacatctgtgggattttccctagagtcttcagtctctccagagcaggtgcctctgagccctggcccagcaggtacagacgctgaagcccaatagccggtcttccgggaggtggtctggggaaggggatccaggtggagagtccccctcagtgcctgctttcagcctggccctcctccccctccctcttgcctcctcaatctgccggttgcctccagggctctcctagctcagcttccacttagagcccacttcctgtcttctgcaaggagcaggagcagggattgcaacctgagaatctaattgttcttaaaaagaatttcaacccgtccctttgttttcagtggcctgctgtgttcctaccacttcctgagtctttctgagaatgagtgggggagatctctggggacacttgggcttgagtgtctctgccgaaatcacttccatgtctctgccttctttccctctctcctaaaacatattactccttccactttctttttgtgggtgtaagcctccatattactttggttaattttagtgtgctttggaacacagatgagtgcatgttcattctgccttgtttaattttagagacagggtgttgctctgttgcccagggccgagtgcagtgttaagatcatggtttactgcagcctcaaccttctggcaacaagtgatcttcccacgtcagcctcctgagcagctgggactacaggtgtgcaccatcacacctagctaattttttaatttgtagaaatgagatctcactatgctgctcaggccggtggtcttaaacccctaggctcaagcaatcctccctccttggcctcccatagtgctgagattacaggcatgagccactgtacctgacccctttcaccttgtttagcctgacaacccatcttctccctctcaggtctttccatctcagtcttctgcactccaggcttctgcgtcttcttcctctgctcagcctttaattgtcgatgtttctggttctatagcttcatcttcttgtgtgcagtctctgtgaatgtaccctgtggctttattacctttgacattcttctgtcttctaaatcatctcctgaatagagtgttttctcctgtcctgggtgtcccgcagcccatagaagcagccatgctgtgggacaccctgagtggggtttgtgttacctgttgtgcctaccatgcccttccccgccgtggatgcacaggtgccccaccttagctgccccagatgctgtttatccttgatagtcaccttttaagccttatacaggtctatcaagttgagtcaccattaccacttggtgtgtgctgtgccttgtgtaatactgcagttccgggagtcatccaacctggaatgcatgctttgcggggatctatgatgccctcgaattgtatgttacatgtgaacctgtgagcattttctaggggctctgcacctttgtgtcctcagctctgagccccatgcttgctgcaaccagcaggtgttcagagtgaatgaatttgcttatcttggcataaatcatgtaactgttgatgataccccaggaaggtgagcctttggttataaatccttttaacattttccagtctaaaagttttgtggtcttattacacgatgtagaaaacagtgggcctcagttattcttttgctgttgtgccggagtataccacggttgtttttgaaagataactttgaccatacccttaggaacttcctcagctcactttcaaatggagggcactggctttctaaccattgtgtctcccagcccagtgacagctgaagctgactgcttccgatatcacagacagcacagaagagccgccctccaggtgctgctgggaaatgctgcctggaactctttgccatttactttctatcaaaagctgagggaaatggtacatatggggctttcctaaaaatatgggatccatccatttgtcaacaatgtcattctatcctatcccagggcctttcaagattttgatgaaaactaatagatcccatattccagaataatgctattaataattttattattattacttaatgatagcaaaaagttagctaactccaaccgctcacttgttatttgccaggtaatcctctaatccagaggatttggccttttgtgtgtgttaatgtcctgcttgcaccagctctatgaggaaggtgccgctgttgtcatttccatttctgcactcgtggaaacaagcgtagtgaggccagcctgagccacagagctgcaggtgggggagacagctggaaccctggcacctggctgtggagtttgagactctgactcctgcgccgcgctgctgccccaaccgtagtcatacgaggtgtttcaccccgccctggatactctgagatcccctctgggttcagcaggctcagagagctgactgcctggagcagaaggcatggggtcctccagagactcccctgagctgagttcccctgtggacaccagggccgcctccttgtggcgctccctgaagggtcctctctggaagaactgtattggttccctggggctgctagaggaaagcttcacaaactggggcttaaacaacagaaactgacatcccacagcgctggaggctggagtccgagatcaaggtgtcagcatgcttggtcccttctgagggtcgtgagggaaagatctcttcaggcccctttccttggcttataggtggcgtgttctccttgggtatcatcacatcgcctgccttctgtgcatgtctgcatccacgtgtcccctttccaataaggatattagccctttaggctgggtcccgtcctagtagtctcatcttaactaattacatttgcgacagtcctatttccagatcaggccacattctgagatgctgggggttaggatttcaacacaggaatttggaggaatacaactcaatcaggcttatggaaaattctggtcttaagtcaagggtagtgttctccagtctgtatatggaggcgcacacctatggtcccagccacttgggaggctgaggccagagaactgtgtgagcccaggagttccataccagcctgggcaacatagcaagacctcctctcaaaaacagacagagtggtgtcttccagagtgattagtttgcttaaaaaaaaaaaaacaaaacaaaacacaaaccgtaagcactggcgctcatgactgatcatcctgtatccacgcacgagctgcacgaaggccgcgcggtcactctggctccctgttggcgagtacctgggatttcttgctcagcattttggggccttaattcttttaggggactttttgtctaatgtctccccttcttctaattatgtgcgatatttacatagaatctgataaactgcttcaaatttgttttcagaacagtgagctggataattaaagaagctttttcctgcttcttgggcccagtttccatttctttcttttttctgtttttcctggctattctagtgctaatttccttcctttcctttcctaggctggtcttagagcatcctctcctatgtacagccagaccttctttcaagcttttattaaaatggggaaaggtcatttgggaggctttgttgttttcctgtttctaaagatcatttttcttcctgcaggggaagtccttaagtcttatttgtggggccctctcttggctccgtgactttgaacagaagaagcgtgaagaagaggcacgactccttgaaactggaactggccccttacatgatgagaaagatgaatccctgtgtctgtcttcttcctgcgaaggggctgcaggcaccccgaggcctgctggagaaccggcctgggttactcagtttgtgcagaagaaagaagagagggacctggtggaccgactaaaggtgagacctggggtatccggaagtgggagtactggaggaaacagggcttcagcgattgttctggggcgattccgagactcaggcagtgcatgctcccctgccgttgccgtgcctctcagctcttccctcagctccttgggtctatggtgctgccgctgtgctgtcttttttgagctggaggtcagcaggccttctccacataaggaactgttggtgcccatttattactcacctgggaaaggacctgatcattgccattggcagcatggttcaatggctgcaaatggatctgatggagagcgtgtggctttgggaggagtgtgccgccttccgcagtgagcagcgaggctgggaccggcagggatgaggtcccgggaggggatgcggcagcccttgagtgctggccggggaaggagagatgcccccagtgaggaggcgccgggctgagtggcccagactccttaggagaggcctggttttgggcttccttggtgattttccttcatgtctgcctcctgtaggcggagcaggccaggaggaagcagcgagaagaacgcctgcagcagctgcagcacagggtgcagctcaagtatgcagccaagcgcctggtgagcctcatttcttggggggcaggattatgtccaggcagggttgctctgcttggaggctcatgggtgcgtggtcagggccttggtctcccctccgtgaccctcactggctatgtgctcccgtacagaagctgggctgtgagtggttgaggcgtggatcctaggagtcgacctctctccagccaggcagccaggcctatgtgaatggggcgtggtgtgctttgtctctggcatgtggggaggtgggtactggtgctgagacttcttcctccctcaccacctccactacccctgtccagaggcaggaagaagaagaaagagagaatctcctccgcctcagcagggagatgctagagacaggcccggaggctgagcggctggagcagctggagtctggggaggaggagctggtcctcgccgaatacgagagtgatgaggagaaaaaggtggcgagcaggtgagacagaggcggtagcactaccctgccccaggccaggggacacccttgaagacagctctttccctcatgccacagatgccatgaagcacctggcaagaggcatggtggcctctgccctctgctctaagccgggtccttcctagggtccatgagtgccagtggcagtgaggacagtcaccggcctggcctgtgtcctctcagctgtcctcacggcagctcaggcagggcaggaacatttgtgtctgcgccttatacacaaggaggctgcagccccacaaggagagactccttggctgaggccacaagcctcggcagtggagagctgggctagaactcagctggcctggctctagatctcaggctctgaggcagctgactgcactgggtaacctgtgaggtgccaaccatcaaggcgtccttagcctgagctttccttctcccataaagcctctgttggtccagactcaaggtttccacttgatgagccatgagctgctgggtgacttagccctgagcaggccacccaggccatttcgggcccacaggatccctggtcacagccctgttcccattcacactggaacctcaccaccatccctgagtgtctgctctgagtatggcactgtccagatgctgtggacatagaagggaagaagacatggaggggacagttaatagacatgaaaacaaatagcacctatgtgaagtcagcatgtttgcctacaaggaaaacaaaatggtgatgtggatggggtggggggctgcacctgatgatgagtcccgtgtgtcctgtgacatcctggccaccacatctgtcggagggtaactgcaagaccagagaccctccatggatattcctgaaggttcatccccggccttcacagtctgtctgcagggcgccttctgatgccacctccagccgccatccaccagacgccagcttccccgctgccctgaacttcctccagcgcaccaggccttcctctgtcctgtctgaggatttgctcatgcaacgtgctgtggccaaacaccctgccctcctcccttggcagatgtcttcctctcctttaaggcctggctcaggtgtcgtcttggtggcttcgggtgtcagctgctctgttttgctcatgcacctgcttgtgcttctgttgttgcctcctctccctggctgggctcgagctgcttcagggcaggaaccacgtctttatagtttgatgttcccagagctgacccagtgtttggcataggggtgtgctcaataaaatcgagttgacatgaatgagcagatgctgcctcgttgcagtctggtagtgtaattccaggctgcgcatgtgaacttcgacttctgcccctgcccagggcagagaccaccgtgttgctttatgcctcgctggtgagagggggtcataaacagtttgtgctccatgaacccttcctgcccgcctccgaggtcatgtttctgctccctctcttctcccttagagcccgtggggacaaggcagagaacttgagtggagatggaggtggtgaatattaaaggaacaaagtgctccttcaggtctgggcaagagccatggatcctgtaggtcagcttctggggcttcccatgccctcacgtttcaggagataacgtgagcctcggaggacctgagttctgaatagaaaatttttgctcttcatttcttcacacacccagcctctcagtgagctcctgctggctttgtccagcatgcgacataagattgaatccaagccttttaagatagagccgcctgctctttagtgaccatgaagccaagcctgtaataattactcttctgatagcccaagacaattgtattctgttttgttagaaaggaatttcgaggtgaacaaaaatgttttctttttatgtgatgttgccataggtagcgtgtgcctgtcagatggttttgtgttttctgaggagcatagactagtagagctagctcagcttcaggccatgggatgcagggctggcttccctgccaacgcctggcgctgatggattcttcccgcattgctgggaagggcagactgaggcactgacacaagaagagttgtagctggtcataagtgacagcatcctctgttcactcgattggtcagttgtagcttcatccaggagatggtcatggggttcctgctgcataccaagctctaggtgaggccacggggactcagcagaaacaaggccgacctgggtcctcccttgtggacatgacagtctggggagatagaccgagaggaagcgattttgaatgagatgggtgtgaagagcaggggccatgaatctgtgtcagagcagccaggcctaccagggaaggtcaaagaaggcttcctggaggaggtgatgtttctgctgctatctcagagttgactgggagctggtgaggggagacaacattccaggcacagaacatccgaaggcctgagatgatgaagagcaaatatccgccctggggcctcagaggggtccagcttgctggagggagggcagagaggagagcagcctgccatgagtcccgaggcttccgactcaagacttgggttgggggtgctgagcccctttctcctttttacatttccctacccacagacctgagcggccatgggaggttggggttggcatttgcctgggggagtttctgagcgagcagcacctgctaccttggtggaacccattgctgggaatggccagggctcagcaccagcgctcagcagatgctcagtgcgttttgctgagtttgctgagggaagactgttttctgttctctctcacacacacagagtggatgaggatgaggatgacctggaggaagaacacataactaaggtaacacaagtgtcctcagctggtgctgtgctgggggtataggctgggctgtgcacccctggggaggaggctggagtcacttggctacttctcaccctcctctccacaaaggaggagcttccagcacttggactccgttgcttcttgcacacaaccctggtcctaagttgctcccttggccagctgcagtggaccctggagtcctctcctggggtcagggcctggggagtcctctcctggggagacctttcctgggaacagggacctgaggagacctctcttgagtttggggcctggggagacatctcctgggttcggggcctggggagacctctcctgggggcagggccatgcttgccaccccagggcatcgaggaacagctgttctgggctgaaatctgggtgttttctgtccctgctgggtggtacgggtaggacagacatgagtcccctgccctttgggtctctcatggtgtgcttctccctttgtctgtgttcccatttgcatggagggctatgggttgtgtatggtctgacatttcccatttggtttcattgatttatgacttgttttctgtcggaagtaggtattttctttgtattttctttttttctcccttcactcttgccttagaggagtagagagagggtattctggtcagccttcctttttccctttggggatgtgtgtgacacactccctcccctcccaccaacaacccaccctccccaagtggggaccctttgccacgggagatggtcacccatgtccaaagattggccaaccccccaaaagcggttgattagaggctggatatgactcgtggaaggagctgcctttggggcattcccttgaacttctggagctgtgggtgacttgggaatccctgggtccctcgatagatgcctgacatgggacattgctgtcctgcctcggctttgtgcattgggagccactccctttccctcagcctctcaggccctggcgtgccttgatgttagagaatgctgtgggatgttttggttctctctttgaagcgcctttctttctctctgctagatttattactgtagtcggacacactcccagctggcccagtttgtgcatgaggtgaagaagagcccctttggcaaggatgttcggctggtctcccttggctcccggcaggtaaacagtagccagtatttccaccaggggccatcctgctcctttcgccacaactttgtcctgctcgtccaggccttgggagacgctgggtctgtgacaggctgaaccgtgtgaggagcagccccctccctgacctggccggcccagcactggaaggcaaaggagaggtggcggggcaggtccacgtgtgttggtaggatgtcatttagctggcaccatctttttgcctctttctttctcctttgctgcagaacctttgtgtaaatgaagacgtgaaaagcctaggttctgtgcagcttatcaacgaccgctgtgtggacatgcagagaagcaggcacggtagccactgggaccatggtgtagccgcaggtggtctggagagagtgaggcaggggtggcagtgactgaagaccattaagtgtctttcatagaaagaatggcagaggagaccccagttccttcctgagtcccctctccttgggaaaaagtgttcctactctctgggtcagtgtctggtccgaatccttggcttggagatgattttacgggctctttctggagaacagaagtaaaaccttacagtgttccgatgagaccacagtaggcagtacttgggagggtcttatagaccctaccccatggaagtgggtctcaacattacacaaccccctcttgggcccgtggacagttgctgtcctctctgttttctctctttgtgcctgtgccaccctcagagaagaagaaaggagctgaggaggagaagccaaagaggaggaggcaggagaagcaggcagcctgccccttctacaaccacgagcagatgggccttctccgggatgaggccctggcagaggtgaaggacatggagcagctgctggcccttgggaaggaggcccgggcctgtccctattacgggagccgccttgccatccctgcagcccaggtgagggccctgcagggccagaaagccgctcttgactctcactgtggtctaggccatgaggggggtcctcatcacactgtagtttgggggatgccccccaccgtggtcaggttgatggcaccttaacccattctctcctgatgtgtgagttggaggaggcgcgtgggatcccttggggtctccaggcagcagggccagttggcattactggggatggtatttaggagccaggaaagccggtgcattcctagtgaaaccacagggagaggggggatgccaggagctgagaagagtgtgctgcatacatctatttacaaatggctttccaagtgatgctcccaacttccatgcctatgatgtgatggaggatgtcagtgatagaaccattcagttttccagtttttcctttttgtaatatcagtactcttaactggaaagctttccctaacttacacctacctgcagcacgtgagaatactgtcttctctgcctcaacttctcttgatttttaaacagaaggaagaactgctaatgtagcagatcaaaagtagtatctcactgttatttggtgggtgcagtttcactatttccttgctacttctttaatttgagtgactttggaaacgggatatcactagtggaaaattctgtataatccagaaaaaaatgtaaggttttaaaagattcagggaactaagtaaccatttgcacagcagctaaatgctcaccagcatacctgctgagctgtgtgggcactggcagagaaactgaggaaagctgccaggccccatggtgtcccaggccttccctcccgtctgtttgcctttagagcaagattagtgctataggcatttatacacaaataccataatatggcccaaaatctttacaatttttgaatttttaaagtactttgaccatattttgcttttatgttaatagtattccagtgaaattctgtgcatggggacactggagcccagaaaagttaagtgactcatattttctcaccaagcgtgggtgatggagccattcagttttccgatattttattttttatatgagtattcctttaactggaaactttcctaacaacaaacacctaaagatgtgcagagttgcttttatttttgttaccccagctccacgccttaaccctcactttgaaataggatgtatcaaccctattttgcagatgaggaaagcaagagtcagagaggttagacaactcttccagagtcacacagctggggagtagcagctccaggagtagaagctggggccgcttcctggtgcaccgatggtctgcaggtgtttgtggaaactcgggggcctccggggcgaccttgaggacatggacaaggctaagcaggggttcccttcacccagccctgcccttggtttactcaggagtcagaccagccctagtttcctgtgtttcatgtattggcttttcatgtgaaactcgaggagagcttgtccgttgccacaagctgtttttcgaatgtctctacacagtccaggcaggaaatagaagcactcacatcaggagctcagtgtcaggcaggcaaggctcctgcaggggagccccgccctgctcaggtggcctcatctcccctcccagctggtggtgctgccctatcagatgctgctgcatgcggccactcggcaggccgcgggcatccggctgcaggaccaggtggtgatcatcgacgaggcgcacaacctgatcgacaccatcacgggcatgcacagcgtggaggtcagcggctcccaggtgtgtgggcctcccctccccgggccagggcctgctgtgacgtaaagggacttggatggttcctccagacacctgggccaagagttcctccggaggtggggcttgatagagggtgcacgagtcaaggcggtgacctcatcggaggctgaccatggctttccagtgcatcgggggaccccgctatgacagagtgcctcatttccctgcacctcatctgcccccatgctcctgagtccctccagccctggatgccagcagccagttctgtaagccagggagatggcatgtgtgaggcagaagtcccctcaggattggattttgtcattactgaagttgtctggaggggactgaattgaggaatgctcaagatcagcgcaggctcctcctgctgccctatcatgcgccatgcatggcaccaggtgtctctggtcttcacgctgactctgccatgggtgtggtgttcctgttttacattggaaacttggagattcaaagatggtcaagctctgtcctgaggtcatgcagctcatgagtgtggagctggggtgtgcccactggtttctgactgtgaaaacccccacgacatcccaccagctctactgacctgtgcctgggctgaattgaggctgggatgtgatggtggccttgaaccatcactctttgtagactccaggtcttttcccaacccggtggaaacttagcagggagattccatacttgaggaattcagcctcttgctttttctctgacccacagtggacactggaggaaaacttcccttccttcccttttctcttagctcccaccagcctaagggctgtggaaacccgtaccttttgtctgcagccagccccctctcctccctttggtggcttcctgtgtgtccagggccagcatcttctaggtgaatctaagatgtcagtaccttagccctcagctgcttgctcagagcctggtttgtgttctttccccagctctgccaggcccattcccagctgctgcagtacgtggagcgatacgggtgagatgtgaccctctgaggtagtgggacagtcccttggtggccccctgcgtgggcctctgagaggcaggcagcactttggttcccacctctggcccgggctgtggcggggtggagctgcatgccattcatgtcctaggcacatcatggtgtgtgctgcacacagacctggaaggctggggactgaccgctggctctgaggcctggggccgtggccagcctgctctctgggaaaggatttgtagcttgtgacccagtttgagaggcaccgggcagcaaggcttccactggggtgggcggggcgagtcgccatcagggcaccaccacttaatgtccgttggcttcttctcaggaagcgtttgaaggccaagaacctgatgtacctgaagcagatcctgtatttgctggagaaattcgtggctgtgctagggggtgagagcctcgtccccctgctgaccccgggcctgcaaaactcgctgggctgctttttccttggatgcccatcaggacacctcagttctctgtgtttttaagaagggtcggccgggtgcggtggctcacgcctgtaatcccagcacttgggaggccgaggcaggtggttcacctgaggttaggagttttgagaccagcctggccaacatggtgaaatcccatctctactaaaaatacaaaaaaattagctgggagtgttgccgtggcctgtagtcccagctgctccagaggctgagacaagagaattgcttgctcaaacccgggaggcggaggttgcagtgagccgagattgtgccactgcagtccagtctgggcgacagagtgagaatcagtctcaaaaaaaaaaaaaaaaaaaaaaaagaagggtcttggtcattgatttagaaaattcttgttctttgtagcttagttgagttgtctgacttgagctttatttagacccatgggttctttgcccatgttctgaggactttttatttcaggccctgctctggggggatattaaggatacagcatcacatagacacacggtgtttccgtgataggcatagttctgtgggttgttcgaagcacttgcatatgcggttttgtgtgccctgtgagaacgcagtgctggtatttgaatccttgttgatagacgcataaactagagctcggagcaagggctgctcccagcacgggagcctgggatcttctgactccagctcccacgcctctttgcatgaccctgtcacgtccccttcttttatgatggggcacccccttggaaggcgtctgtggaagtggaagctgcagaaagcctgtgggagctcctggcgggagctggtctcgtgttgctgctctgagccaccagctctgctttgcctcaggctcaccagtggcctgggcagctcctctgtgctccggtgccctgcataccttggtctggctgctgtgtcccggcctcctggagaaggggtgaaaaacatgaacttacagggctttgggttccacgtgcaagcacgtgagtcagacatgggaggctcctggacccacctgccctctcagtgggtccgttgcatgctataaacagtgaaaagcaaaacaaagccatttaaatacagatgctcttcttacttgatgtgcagtgtggagggagagaagatagggaagggttgggggtcctgagaaccagcattgtgacctatttccattctcttttttagggaacattaagcaaaatcccaatacacagagtctgtcacagacaggtaagagagttgccctcagagggcccagagctgatctgagccacttccgagcttaaccctgggactgaaacctgaggcttagggtgaagctcccaaggcccttcatgtgtttgttctcagggacggagctgaagaccatcaacgactttctcttccagagccagatcgacaacatcaacctgttcaaggtagaggtttccacctttccacattccacatccaatttccttcctgtcaccacctgtgggtaaagtactatgttaagactgtagaaggaagaaaaagcaaaacagatgtgtaattacttaacccttaacgcaacatgcctgtgagacaaaagtcatcttcttttagagtgaaggccacagggatgagggatgggtgagaaagggacctttcttggtgccccatagaacagatagagactccaggtccttgctctctcactccgtcttctggcacagtctccctcaggcttatggacaggaataggacgttgatttgttctgtgcaacccctgtcacgtcttcccacttgggccttgggtctggttgcagcctcagacctctgctcactccaggtctgtgtacccagcgctccccagatgaaacacggccactgccgcctgaaccccaagctcgtaactcaaatcagcaacagtgactgcccccgggtacagggttctgcctctgttgtaggcggcatgccatgtgctgtgctctgagctaggatatccttttgccccagcaaggaaagcaaacaggcccgtggaggtgacttcaggagggtggcgagcacaggcttcccacaagtgagccaatagcaagtggcagagacagcgtccaaacctggctgcactgacttggggccccacattcttcccatcctgcctgccttttttttcttaaaaccagcttttcccctgaattacacatttgggtcactgtcactgccgccatccctgccagacaggctggatccaggtcatccttgatgcctttctccccttgtctcccacatgcctgtgacagccgccaggcctgacagcctgagacagtcctgccgtccctgcgcttctcccacagctgggacatgggtgcaggcactccttctctcgccttccctttgccctccttgctttccttctcccctcttcttcccatgggtctcgggtctcatcactcaccattgagggaatcctcatcgaaggacgtcgctctttttagaaaccggtttaaaggctccaaactcctcatctctgcatcccaagctaagatctggcaccaaaccacacacattggatgcaccgactgagtggcactgccccagcccctgagcaggtcccagccatcatctcctctgtggctttgctcatagaagttccttttttttttttaactctttgtcacctggaaggaaagccaaggggaactggattttactgagcactcttagacttgagagagacatttggaaagagggtctccaccctgaggaggacactgcgttgtgggcaggggcagtagaggagggggtggcctcggagaggagatgacaaggttggtggcaaggaggctccaggtgcctcagaaggtagcactgcgttgtgctgcctgggtggtagaagtggtgttttttgttttgtttttaagattatagcttgctcagtttgcactcatgcctacagctgggcttggtttttgcaggtgcagcgatactgtgagaagagcatgatcagcagaaaggtaactgctcccatcttgtggtcctgaacaagacccagctgtgccccaaccccctgcccttgccatgctttcctcccctgccctcagggaactccagagtccccttcgtctccactctccttggtgcagtgggccttgctggggtggtgggatgtgtgctgcaggtgtcttgggcctggcagagcctccgatccacccagcctctctctcatggctgtacctcgttcctctccactgctctctctcatcccacccagctctttggattcactgaacggtacggagcagtgttctcatcccgggagcagcccaaactggctgggtttcagcaattcctgcagagcctgcagcccaggacgactgaaggtgaggcaggagggtgggcaggcagagccggctgcacgcatgggcaaggacttctgttcctcatgtgtggacctgaccagagggaggcctcctccccgttctgctctgtgcagctcttgcagcccctgcagacgagagtcaggccagcaccctgcgaccagcttctccactgatgcacatccaaggcttcctggcagctctcactacggccaaccaggacggcagggtcatcctgagccgccaaggtaatcaggtggttcttggccaggttcagttcccaggaaggagccaagctgagcccgggagccgcagcgtgaaaggattctttccttccatcctgggaacttcctgggttaggaggaagcagtgcagtgggcactggcctgctgtgacctgggcaagcagtggaggtggatgggaggagatcgaagggctgggatgggggtcccgtgaccagggtaagcagtggaggtggacgggaggagatcgaggagctgggatgggggtcctctagggcaggggtcctagggaaacttctactgtggggtaggtgggctttggtttgggtcatgattttgtcatctatgagccttgtgatttggactattttctttctcaacttcagtttcttcatatgaaaatggagaggataggccgggcgcggtggctcacgcctataatcccagcactttgggaggctgagggggggcggatcgtgagttcaggagatcgagaccatcctggctaacacagtgaaaccccgtctctactaaaaatacaaaaaattagcagggtgtggtggtgggtgcctgtagtcccagctactcgggaggctgaggcaggaaaattgcttgaacccaggaggcggaggttgcagggagccgagattgagccactgcactccagcctgggcaacagatcgagactccatctcaaaaaaaaaaaaaaaaaaggatggagaggacagtgtggtccacctctgtgggctggttgtcctagagattaaatggtgtttaatttaaagagaaagcactagcacttgtgcctcagacctggactcacctgggggaccccctttgctgggacgacagaagtgtctgttgggcttgcactcacctcccaccgatctgtttttccaggcagcctcagtcagagcaccctgaagtttttgctcctgaatccagctgtgcactttgcccaagtggtgaaggaatgccgggcagtggtcattgcggggggtaccatgcagccggtaaggacacctttcccagcccctcgtgccccaggtgttgggatgagatgggggcttgggagagatgcattatcagtcctgttctctcctggggccccaagccagaaagggtcagctcgagcaggcccagtggtgtccgctgggtgacactgctattctctcactgctgtgccttttaggctgcaggagcagtggagactcctctgctgctccattctgtagccccaggatcacatgtctcccagagaaagctgttctgtggtttcaaactcaaggaaaaaaatcatgattccacttttaaaaggttcattttgatgtatatgaatataatagtctttgtaggcgtaatttttacttatgtgcatagctgttttaaaaacaaaagtacggctccctccatgtgctgtcactggaacttgctcttttcactcagcagccagagggtcataaaccctgtctccttgtcagcaagcatgcacgtatttcagtatcccagctgtgctggattccagttacacagatatatagcatttcatgtagctgcttctctcttgttaggtgtgcaagctatttgcagttttctgttttgagcatgactgtgataaatataaccgcatttctgcacagtggtgactcctacctagcgaagggcctcctggacaaaaagctgctgggaatcctgaagcagtgcttcccagccccagctgccttagcttttgatttttatatttttgtatggatagattcatagttttattcattcggcatattaaaagttgtttacagtaattattgtttctgacgttcacattgtgagagccccttcctgctagctcaggtcctccccgtggcccggtcagtctcgcctccagcacagcagaatgtcatgggatcaccatgggtgtcctttccccacactggattgattcatttctccaagctgctctggtttcttgtaatggggaatgacatttagaagtcaagctgtgggtgctagggtgtttgtcgtgctcctggggcgttttggtagacagatctaggaaatgttttcagaatgaatccatactggtatttctttctttctttctttttttttttttttttttttgagacacagtctcgctctgtctcccaggctggagcgcagtgacctgatcacggctctctgcaacctctgcctccggggttcaagcgattctcatgcctcaacctcctgagtagctgtgattacaggcatgtgccaccacacccagctaatttttgtattttagtagagatggggttttaccatgttggccaggctggtcttgaaatcaggtgatccgccagccttggcatcccaaagagctgggattacaggcatgagccaccacgcctggcccatattggtgtttctaagtaaaaatcaaaggatttgtttacttgaccttttattgtacctctttttctcttaagcctgaacatgtgtgctacattaacatacttatctgctctatcctataatatacttaaaagttttgaaatcatagtaccaatattacttctaacaatagatctgattgaaattgcctttcctctttgcctttagagtgtaacccactaaggatgcctggtcactaggctctaaagtcacgtggaaccaggcttctctccgtgtgcttctgttgtcagtttcatagataactaggctgtttttgtttcattttcttttcaattttagaatttgcttttttcttttctgacttgtagtttttaaatatgtaaatatttgtatggctcaaaagtcaaagcaatataaaaagatctattcaggaaagcctcactctcatccctttccagcccattccccacccccatagggaatccgttttactagcttatcctttcagtctttctttttcccctaaataagcaaaaacgtgtcttcatttttccctttcctgttttatttacacagaaggcatcttagtcagttgtctgaccatcgctcctctagtgggctgcgtggttctctgttggacagatgtagggagcttatccaaccagtaccctctggataggcaggcgcatgattacagggaaaggtccgggggcacatgctgtttggtatttgtgggctgtatcttctcactggactcctaaatatgggattcctgggttaaaaagtataaatatgtttaatttgttaactactgtgaaatttcatgagaattgtaccattctgtatcccaccagtactgtctaggaatgcctgtttctccagagtggttacttttggatttttgccagtctaacaggtgaaagcctggagattcttattcagtagtttgggctggggcctggccatgtgtatttttgaaaattttcgctggtgattttgctgcatggccagggttgataatgactgtgccagatttgctggatttcctttgctgttcctgcacatagtttaaacgagactgccagcactgggtatcagtcaccatttttctttttgttagtttgccatcagccttttctttgacctcttctttcagtttgtgtgtacttgctgtctcttagcccagacttctcgcttcctttctgctgggcctctgaggggtcatggggccgtgacgctgtggccttggtctacaggtgtctgacttccggcagcagctgctggcctgtgccggggtggaagctgagcgcgtggtggagttttcctgtggtgagaagctgtgcccagggtggggcaggctagaggtcaggttctggcccccgttttctgtgggtaatacctcatactgcgaccaggcacaggggcggaggagaccccggggtgggagcctcacccttcgtgcgctcgcccaggctctcctgctttgctccctgctgcctgctgcccagtgtgactggtgatggtgggcgggtgagcgctgtcagtcgctgttcctgtgctggatgatggggcagggaaatgccctctctgcagtgtcttgcagcacacctgcatctccagttttcggcccctccctggctcttaccaggtcacgtgatccctccagacaacatcctgcccctcgtcatctgcagcgggatctccaaccagccgctggaattcacgttccagaaaagagagctgcctcagatggtcagtcccagccagctcgccgcaccacagcctggcctcaggcagcaaagggttttctggggcaggggcgctctggcccaccctgagtgttttcagtgttggggaaattgcacagggacacccgcttagagccacacagaatgagcggcgtcgatctagatgcttatggaggaaggtctgagcttccccgcccctcacgccttaggctgcgaaatatgtattcataaaacctccaggcatcctctgaggacgcctcacacaggagaaagctgctagttccctttggctctcttgccctttggttatatctgcccctgccgggggtagggatgtggggcttgggggcatctcctgtggtgtgcctggggtgtgcagcccctgattgtcgttgtggtgcccatcaggaccctggacagaagaagggaggactcagtgccagggcaatagggaggccccctagggacgctagtgctgtgacatgtgtcagaaaggcgcagtcagcagcagcggctgggtgtgtttggtgggaggtggcacctaccaccccgtggttcccacccaggggagccaagtcctcttccttggctgtagtcctgccgagggtctctcctcagttttgagtctcaaggtgaagacgcggtttgtgggtggctgaggggttgctccatgggggctccctccctccctcctttccttccttagatggacgaggtgggtcgcattctctgtaacctgtgcggtgtggttcctggaggggtggtctgtttcttcccctcctacgagtacctgcgccaggtccatgcccactgggagaagggtggcctgctgggccgtctggctgccaggaagaaggtgagtggcctgtcggcagccttcccacttgtgaggacagtgccactgagtcctcctgggagctctcgtgctcatcgggtcaggacaggcttctggctcctcatccccaccgctcccagtccctgactacagaggatttcccccaaagtccctggctgtgaggttctccagtcccctggccagaaaacacaaggccacgagcagactcgagacctggcaccctgaacctgtctctgggaaatgtcctctgtctttctcagatattccaggaacctaagagcgcacaccaggtggagcaggtgctgctggcatattccaggtgcatccaggtgcgggcgtcatgctgggcttgggtctgagatcgtgtgggggtggcagctggaaacgttgtgggtgtcatccaagttttggctcagcaactcagcgtctgggtttctcctacaggcctgtggccaggagagaggccaggtgacaggggccctgctcctctctgtggttggaggaaagatgagtgaagggatcaacttctctgacaacctaggccggtaagtagtggttctgctcgtctcctgggccgtgatacatggccggccctcactcccagcagctgggcccctgcctgctctctgctgccattagagcccacagctgggctgcgactgctcagaccagccagctggagggaggggctcagcagctctgggtttggtcctgggagagcagttggattttaggctacccattgctgtatcaggacccagtcaattggcctagacgggatctctcagccgaacaagccctctccaggtggtaggtacagagtggagagaggctgagttttgatcacagtcggagaggctgagggaaggggtagaacggagcagctggtgacgtgggtgatgacccgggaggtcctgacgtccacctgctgggctcttgtctcccccgcccaggtgtgtggtgatggtgggcatgcccttccccaacatcaggtctgcagagctgcaggagaagatggcctacttggatcaaaccctcgtgagtgaccccagtgtcacagagggtgacaggagagtaggcagtgggtgggagtggcatcacccccagggctgatacagccaggccttccccgctgcgctggcgtctcctgccccctccggaagcttggatgcccctccacaccctcttgatcttccctgtgatgtcacctggacccctgctgctggcattggccacgaagcctcctggtctggctccaaagcctggcagggtcttttcccagggggagctgcaggcagggaacagtcctgatgggtcttccccttcactcccagcccagagcccccggccaggcacccccagggaaggctctggtggagaacctgtgcatgaaggccgtcaaccagtccataggtgagcctggctgcctccagctgggtggacagatgggggctggagaaagggagaacaggaaagaggggttgcctgccctgtttcctatataagtctgaggaaggggagggggtcgccgtgggaatgtgctgtaggggggaggcaggtgttgctcggagccccagcctctgttcctatgcaggcagggccatcaggcaccagaaggattttgccagcgtagtgctcctggaccagcgatatgcccggccccctgtcctggccaagctgccggcctggatccgagcccgtgtggaggtcaaagctacctttggccccgccattgctgctgtgcagaaggtcagtcctacctttttctttctgagagcctccccaccccgagatcacatttctcactgccttctgtctgcccagtttcaccgggagaagtcggcctcttcctgatgggcaaccacaccactgcctggcgccgtgcccttcctttgtcctgcccgctggagacagtgtttgtcgtgggcgtggtctgcggggatcctgttacaaaggtgaaacccaggaggagagtgtggagtccagagtgctgccaggacccaggcacaggcgttagctcccgtaggagaaaatgggggaatcctgaatgaacagtgggtcctggctgtccttggggcgttccagggcagctcccctcctggaatagaatctttctttccatcctgcatggctgagagccaggcttccttcctggtctccgcaggaggctgtggcagctgtggcatccactgtggcatctccgtcctgcccaccttcttaagaggcgagatggagcaggcccatctgcctctgccctttctagccaaggttatagctgccctggactgctcactctctggtctcaatttaaaatgatccatggccacagggctcctgcccaggggcttgtcaccttcccctcctccttcctgagtcactccttcagtagaaggccctgctccctatcctgtcccacagccctgcctggatttgtatccttggcttcgtgccagttcctccaagtctatggcacctccctccctctcaaccacttgagcaaactccaagacaccttctaccccaacaccagcaattatgccaagggccgttaggctctcaacatgactatagagaccccgtgtcatcacggagacctttgttcctgtgggaaaatatccctcccacctgcaacagctgcccctgctgactgcgcctgtcttctccctctgaccccagagaaaggggctgtggtcagctgggatcttctgccaccatcagggacaaacgggggcaggaggaaagtcactgatgcccagatgtttgcatcctgcacagctataggtccttaaataaaagtgtgctgttggtttctgctgagttttttattgatatgtgctgctgttttctctggaagcctctttagggaatcgaggagcgcactggtgcaggggctgggtggagccatcctccgatggagcacaggcagacggaagcccccaccccagctgcgtggcctcaagccagcctcccgctccccgaaggtggtctccacacagacctgggacagtttcatccccgccccttccagggcagcagggctgaggatcccattctggctgtgtccacgtccgggccatggctagagtctgggtttaggggaggaaggcatggcggcgcccgctaggatttccagttgtcctcttcttcctctgcctgtggctgctgggggttagcagagacggtttgttgtctgacatacgggctctctcctcccggcccctcaccagccccagaggtgaaaaggctggaggggaaagggtgagtgagggaggtctgtggggagcactggtttccccaggccccagagacttaaacacaggaagaaaaaggcaagagagaattaacgatgccacagcccatggcagacagcggccctgcctcctacccttgcgtctcaggaccagcttgttgaagagatcccacatcagttccctgccttggcttacggctctcactgcaataggaaagccacggagtggggtgtggggttcagtcacatttgacccccggctccgtgttcctgtcccctgtagtgtttttgttattagacccttttttctccttggtttaggaatgggggccccagggccacccttgtccaggctccctctaccgtagaggtgagaattccagggagctacaatttgaaaaccactattttatgagccaagtagaacaagaaatgacaactattaaaaaaaataagggatttctgaccagctaacaaccccacagaaaatccgccagggatccagaaatgagactgaggtggcctcagagagctccctcctgaaggggatgctgctgctgtcgtcctgcccggcgccttggactgcagtggccggggcctggggtggggatgagggtgcactgaccagcaccgcagcagctgggggaggttggggtgctgttaacgtgccatcttataggtaggaagtggaaatgggagaaagtgtggggtgcctagggaaggaggtgactgagcagggagcctggctgccatcctaacacccagctcactgggcttgagcgacttgagcctggtgccagggcagagtgggtgatgctggggcccaggctggcaccatacttgaggtctgccaggcaggtcaggtaggatggcacatcgaccttgggggacttggcccaggtctggcatgtagaagtagttctctgggacccatgggattaggtggggacatgtgagaggtgacagggacctgcaggagcagctagcgagacctcatgtgcaccctgcacagctgtggtggcataagggattcaatagagcctctcctagagaggagcctggcagggcccccagcccttgcacctgcccctccctctccaccttctgctccagctgctctctcactgatggacaaggggcactgaacagtttatctgtctctacccccagcatcacatgggtctttgttacagcaccagccagtccgtctgggaagacagacttcttgtatctacaggggcgacgtggaggtcaggcaagccggcacctgctgtcctgggaccatgttcctgacctacctctcccatgtcatcagggacactgcactgaggggtcccaggccactgagccaagccaccctggtcaccttctggctcccacctctgtgctgcacctgagtgtgatgccctaggaccccattaagtcaggctgagtcttgcacccacaccctgcgactccattttctgctacacaggatctctctgatgttgacgagcagcatggagacctggggagaccccccaagcgcctcctccatgtcatccttgggctccagcttggcgctcacacacacaggaaaggacttcagcttctcctgggagggctgggtggctgaggggtggtggatttcggagttggactagcagctggcctagaggctactggggaggagggagcagggagcacccactcctgatccagattcactgcttccctcgcatctgtcatgaccccaaagaagcagatcctgaacctgggctcttgtctttacctttgttctcttccactctggggtaattaagaatgatttgctggccaggcgcggtggctcatgcctgtaatcccagcactttgggaggctgaggcaggtggatcacaaggtcaggagatcaaaaccatcctggctaacacggtgaaatcctgtctctactaaaaataatacaaaaaaaattagccagtcgtggtggcacacatctgtagtctcagctactcgggaggctgaggcaggaggatggcgtgaacctaggaggcggagtttgcagtgagtggagattgcgccactgcactccagcctgggcgacagagtgagactccgtctcaaaaaagaaaaaaagaatgatttgctaattaattatgcaggcagctgatccagtgctgtgtaaccttgggggccaccagatgccaatcaatcagtagaatgggagagaaggatggaggaagtgaggacaaggggcaaggaggaaggtctgtccacctgtctcttctgtgcaggaggtgtccaagcaggaggagcacgtcacatccccactgaaaaagcccacagaaaatgaaaagcccacatgcttgtccattgctgcaggatgggggcaagtggagggggagaggtgtcggcgctcccaccttactcccagtcatggctgactcctccctttccttcgttcttgttcctaatctgtcaccatgtcctgtcgttttctttgtctcacccaaccctctctgcctgaaaatcccctgacggcagcctcatccctgtcacctcctgactgtagttggtgacagaagaggaggctgcactagtgaaggagcagggactccaggtctggcaacaaccagggatggggccgggtgggggtgacttggaccaggagaggggcctgagtcaggcagtcacatacttcatgctggggtcccccaagtgaagcacatttagcaagatctgaaatacagggaaacagtcttgtttcttcaataaataaattgcaaaggagaaacaattgatgaaaggagaaacctatagatccagaaatactaacaggcaaatcaaacaatcataaggagagactttatttggattttgattcaaacaaactaacaaaaaaatgaaattactggaaatttggagacagtagggtagttggtagtattaaagaatagtagtgtgcgatggttggtatgataatggtattgcaattttgctttttttttaaaagagttcttggctgggcacagtggctcatgcctgtaatcccagcattttgggatgctaaggcgggaggctcatttgaggccaggagttcatgaccagcttagccaacatggcaaaaccccatttctactaaaaaaaaaaaaaaaaaaaaaaaatacaaaaaattagcctgatgtggtggcacacacctgtaatcccagctactcatgcagctgaagtaggagaatcacttgaacccaggaggcggacgttgcagtgaactgagattccgccactgcattccagcatggatgacagagcaagactctgtctcaaaaataaataaataaataaataaataaatcataagttcttatcactgggtatggtgtctcatgcctataatcccagcacatttgggaagcacaatttgggaagaattgaagtctttattaagtatttctacccatggatccatgtatttcttcattgatttaggtcttctgtgattttgtttacagcattttgtacattttcagcatacagatcttatatagacttaatcattttttcagagatagtacaaatgcaattattttaaaatgttgattttctgttagttattgttagtatatacaaatgaaattgagttttgtattttgaacttgtgctacttctggaatgtgtgtgcgtgtgtgtgtgtgtgtgtgtgtgtgtgtgtgtgtgtgtgtgtgtgtgtatgtagtccttggaatacaccataaccaagtgggtttttcctgggaatgcaagactgcttcaatacttgaagatcagtcaatgtaatctgccatagtaataatctaacaagaaaatcaacatgatcacatcaattgatatagaaaaaaaatttacagaattcaacatattttcctattacagattttctgcaaactaggaatagaagcaagcttcttaacctgatgtatggcaccttcaaaaagcctacagcaaacatcttacttagtgatgaaaacctgattgccttccccataagatttgagaaccaggcaaggatgtttactctcatcatcactcctatccaacatggtactggaagtcctagccaatacaataagggaagaaaatgacacaaaataaaggtagtaagattagaaagaaagaaattgtctctattcacaaacaaggtgatttcttttcctttttcttcttttttttttttaagagacagggtccttctctgtcacccaggcttaagtgcgatcatggctcattgtatcctcaaactcctgggcacacacaaacagtcctcctgcctcagcctcccaagtagctaggactaccggtgcatgctgccaagcccagataattttttttattttttggagacacaggtagtctcattctggtttcagctctggaaggggtgaagaacaagtccccagagcccatcctgtccctcgtggatgacatactgagggctcaggaagactctccctcacagcctgccccagtttccaggctgagccacctgagcagctgcttcagaaagcctcttgtgccatagccatgcttaggaaaaagcatatcttccattcaattcaccaagaaacaccaagaaataactggatacaaagaataaaaaatactctgccacactggcagggcaggagggtgaaaattgtgccccctccaaaggtaatgtctataaaaggataactaaggccagcgccaaagtccacctacagaaggcgggtctgtctcaaccccagctgtcagtcactgtgaacttttagaactggggctgaagcttcttccagttgcttgctcagatgtcagtgagaccgctccacaacagataaggggagctgtgtgtcagggaagtcccagccactagcacaagctgcactccaggcagacgtttctgttcttgtgcaaagaacagcgcaatccattcaagttcacaggggcgggtggcacttgaaaatgtcagggtcaacttgcagggcagaagttagcagggaagtaagtcttcctgggggagtgggagagcccagcagagtttaggaggagggaggggcaacatcggggcaatcctctgagtctctctttcctcctcaggaactgtccaggaagaccctgcagtctctctgcaggctcatgggagctcccagaactgagacaacacacagatccaggcctgcttcgaagtcagtgggatgcggcccttgaaagtcgatgtattgggttcctagggctcttgtgaaaacatgccacacctggctggttttaaacaacaggagtttattctgtcagttgagaaggctagaagtgcaaaatcaaggtattgacgggatgagttccaactagaggctgtgaggcagatcaactccatggctctctcctggcttctgctggtttctggcaaccattcacttcccatgcctggtagacacatcactctaacctctgcctccctttttcacgggcacattcgcgtgtgtgtgtgtgtgtgtgtgtgtgtgtgtgtgtgtgtggatgtgtgtgttaaggacagcaatcattagactaggtggggcccactctaatccactgtgagcttctcttactttggtaacatatgcaaagacccaatttccaaacaaggtcacattccatgttctgggactgtcttctgtgagatgtctcccccaggatccttccaggttttctgcaaagccaggcagaaaaccaggatcagggcaggacaagaggatgctagcctgtgatggctcccactcaggtgggatgtgagaagtgcctgtggcctgggacacaccaacttgctcccaatacctcatctgagatggattgcacagtgtatgtccagggcccatcccggcacactgtgcctttgcaatgctgtctctgcgctttggaaattgactcagcccactgcgtggggtggtctgaggcgggccacaaccatttcttaaccatccctgagtacctgaccagtatcccccgggggtgacaactggctacatctggagcatgaggagcgtgtttacctggtgagtaaggatgcaagcataggacgtcctggccgatcctctgcacaagcaatgcctttgctccaacgggatgggcaacgttggattaggcctgaggcagatttgatcttggaagatacattcaagtctacgtgttttgtgcgtttattttcgtttccttgaattaacatggagtccatttcaactttcacttagtctccttctttctcttcccccacttctctctctctctttctttgtatatggaagaatttaactctgtgttccataatgtctaaatactcaaatttagagttgacagccatacagcaaattattcaagttgctgtcaaaaaaaaatccctgcgttttctaggattaaaactgtgaatagagtactggaagaaaaaaaagtcatagactcagatgcaaaatgacaacatttaatgggatgataaggaaataagacttgtcaagaaaccatagcccactgcagactgttcacgatgtcagatggttcatgatttttttccaggtttgatacagaagaatcagtttgttaaaagaaatgcttctccacctgggatttaaaacatcatttaaacaataaacacatttgtatgtatatataaatagatatttagaaataaaaacatgcatatataggcacatagacatgtatatacatatacacacatatgtacaaatatatatgcctaaatttttactgacctgtcaacttacaaaacaaaaatgagagatttataaaaggtacatatatagctgtgaattctttaaagctatttttaaagaaattaatataatcttaatgattatcagattactcatgcagtacacagctacacaagtctaatgaagtaccagagacttttctttcttcaactattgtcctatcttattcaggttttcattttcttactagatgtgttttcaatggtttatgacgtaataaaatttctttacttcttccagtaattgctttgtctcactcggaaactgaactactgttgatgtggtaaaaagctagggcatattcttctgaaaaaataaagggaacatgtatttttattaaatagatgatataagcacattagatctaatccttccaataattttgaaatagagacaattactttcccattttatacattatgcagaaatatgctaataatatttaagacacttgatgaaatatattctattagtaaatgatagagacagaattcaaacactccacaaacttcacacagcattcaacaagaaataaatagtaccaaccttccagggaacagttgtatggtctctacaacattttagtatatgttttagaaattaatctatcaaatttttaagttaacatttcagaatattccccactcctctttttaagtcaaagtccacagaagtagcttggaacagtcagtcttagcatgaacaacaatgacaataacaaaaagacctggaagcttagtgtggcttgtatttcaagttcaagtggagccctgtcaggttatattgcaaggattctggtgttgaaaaactctggtaactggaaaatgggttcagtcagaagacacatcatgggataaagaaaccagaacacaaagtaatgccatttattgtttactctgtgaagacagaggttgattttggaaagtttagtagctcagggaatgttagatataaacaccacattcaataaccttagggcatggctgttgcttgcctacctttttcgtactaatcgtagaccatgcctggggctggctgaatgttgaacacaaggttgctctgctcagcagaaaaagtgaaactgtctgctcgaccaaaaacctatcatgacacaaattataattacattgtagcaggtctgagaaaagataatcactgagaaaattatccgcagaagtttatgatctacataattaaatagatctagggtatgattaacttacatattggcaaaataatgagttgttaaccttaaatcatataaaatttcaagttcctttgcttacattgaggtgagaggaatttagctggaagtctcagaggaatgtaggcatttatgtgagtggtaacaatacacatagaaaggatgtctctaaagcgcatgccatagtttggcatttcctcagtaaaataaaaatagaactaccctatgatccagcaatcccatttctgggtatgcatccaaagaaaatgagatgaatattttgaagagacagctgcagtcccatgctaattctttcattaatcacaatagccaacataaggaatcaacctaagcgttcgaaacagatgaatggataatgaaactgaggcatatacacatacaaattattcggccttaaaagaagaaagaatttctgccatttgtaacaacactgaagaacttggaggacattatgtggaatgaaacaaaccagatacacacaaaaaacactgcaggatctcacctgtaagttaaatctaaagttgagttcatagatgcagacagtagaatggcagttatcagggatgggaaaatggggagatgctggtcaaaggatagaaagcttcagctgtgcaggatgaatacattctacaaatctcaggtacagcggtggcctacagttaacaatgctgtactgtatatgtaatattccctaagggagtagatcttaagtgctttgtcacaaaaaaagaagaggtaactgtgtgaagagagggatgtgttagccagctaattcacatatagtcacgctagatgataacaatcagctcactatatatatcaaaacatcacaccacataccttcaatacacaattgtaatttcaaaaaattatggcaaactttgtaagactttagtcaaattataaaataattacatatctactctgtgaccagactgtgtttgatagggagatgatgtttctaaaatggaaagctatctagtcacatagccagggcatatatgaaatagccttggaactagcaaggagaagatgatcagtgggataaaacactggtaatccttaacgtcccttattttttccttttacaaatcctatcatacatatctataagaaattgaagcatccaattatccttggaaggaaaaaagaaaaactttaaagaaaaaaaaatatggctaaacttacattttccaagtagaaaagaacatggtcattcttgacttcagtcttcatcacttggcccttgttttcaagctttgaagaaattgttagggaaggatagagaatagatattagaacaaatgacagcgccactgcagaactgaatgtccactcttttctacgtcacgttctgttttatggaacattccttggtgccatgatgttttcataaacacaggtagcaactaaagaaaaacatatgatgaaccatgggaaatactgactgctaattggtacaaatgaagtacaccagctctccagtgttagcgcaaaaatacaaaggtgaatgttgaagaagaattctatagttttgttttgctaaactacggctaaacaagtatttattttatctttatactctatgtagctgtctttgtgatgaaagattaggcttctattatttacctcttcaatggatgacatggttggagtaaatcctgatagcatttttacatctataaccaccatactggatttattgcgaattccagtgtatctgaaaattttaagaaaacactcgtttagatatcaattttaaaaagtgacttatctcataatgagagtgccaggtggataaatactaattggctagaaatctggaggacaggtaaaagctgaagagaaaatatcggaagaaagtcattttcaagcatctgtgaataggcacaaccagaatgataatgaaagagatgatacatagcaacagaaattggagcaaataatgaattatctggacatgaaatcttccccaaaccctgcttttaagcttacctgcagtctcaaagtttgaactgataaacagagcttctaaatcttttacatatacttaggttagtgttagagttgcgtaacacttagaggacatctttgcttaaaaggtggtatatgagcataattatagagtagatgtgtccccaggagaacttctagctcagtttcctgcttctggataagactattggggtatgaagttaagagttccatagttcatcagggcgtggttgctcacacctgtaatcccagcacttctggaggccaaggtgggtggatcacttgagggtcagagttcaagaccagcctggccaatatggcaaaactctgactctactaaaaatagaaaaattagccagatgtggtggtgcacgcctctaatcccagctactcaggaggctgagccgtaagaatcctttgaacccaggagctggaagttgcagtgagctgagattgtgccactgtgccactgtactgcagcctgggtgacaaagtaagactctgtctcaaaaaaaaaaaaaaaaaaaaaaaaccaaaaaagaaaaagagttccccaattcattgagttcttagccctggagctcaagcgatttttatttagaaattctaaaaaatatctcccaaactaattttactcaatgttttccacatattaactaaggctaaaagcctttagcatctataaatcatgcttgaattcaagaggatcatttcgtttttctattctgaaaagtaaaaatctaaaatgttactctttacagttacaaaataaacatttgtgggcttgctactatatgaccatgcatgcttgtcttgagaaagaaatatagaatctctgtttttcaaaactaggagtacttccatacaacagaataaaaagtatcattgaaacatcagtgcagtgaaagctttcaaatcctgctcacatagactgcatgttttcttgcctcattttagctctgatttagctgaagatgtactaaattgtggtgtccggacagacggctaaaaagtgactgtgctgtagaattgtcaccaccaacatgagaactcattaccatgatttatattttgttatttcactactgtttgaacttttaaaatattttaccatcttgttcacgtgggagttactgtcaaaatatgacacttacttgaggttcactgtgaggtcaaaaacagtcaaagagtagttctttactatttccaaggaaagagaaaatccagatgccttcttaggtaggagaacattgtacttaagggtggcctagaaaggatagcaaattataagaaaacccatcctgtattaagaattatacagtctgactatagtcagtagtaatgtgattttacattttaaaataactaagagtatacttcgatcatttgtaacacaatggataaatgcttgaggtgatgcataccccacttgccctgatgtgattcttacacattgcatgcctgtatcatgcacccggtaaatatttacacctactatgtacccacaaaaattaaaaataaaacatttttaaaaagaaagaacctattgtttatttctattactaatgcagtttacatctttatcatcagggaatcaggttaaattctttagttttcagaataacgtaatttaatgaagatagaatactttctaatagcaatattcctcaaacttctcttagacagctgagtagcttttcataaagtaacttgcaattttggctattgatcatgtaaatacacaaaacggtcaaataacacttcacgtagaactgaacagacagtctgactcttttactggcaaacactcatcaccctcttaggcagatttctgtaacctggataaatgtacaaccgcgtccttccacatctactgtgtattgtccaggtgcctgtgttacttctgaacgttggaccagtaggcggttatgaccgttaaactggatctcactggatccttcactgctaaaggtgacagtgttttgattcttagagaagagcccctcttccccgcctggctcttaggatccccattgcagggcggggaggcacccaccgcgagggggagactgagagccagtccctcccacccccggctcttaggactcgcatcgcaagcgggggaggcacgccacgcgaggcggggactgagagccagccccccttccccccgggcttaggacccccatcgcggttcctaagatccttaggacccacctggaggactgtgggtatggggtgtccaagaagaaagctcagatctgcccacggcaggtaccttacttgggatttacaatcgacaggggtccgaacgcagcccgggaaaagaaagaaagcaggtcatttacaatctaccggagccagcccgtcttcccctcgcttgctcttaggtcccccatcgcagtggggggaggcacccctcgtgaggcgggaactgagagccagccccacctcccccctggctcctgggacccccatcgcagtggagggaggcactccccgcgaggcgaggactgagaaccagcccctcttccctccctggttcttaggacccccatcgcagggacggaggcacccgcagcgaggcggggactgagagcctgcccctcttacccccctggctcttaggacccccatcgcaggagtcggaggcaccccccgcgaggcggggactgagagagagctcctcttcccccccaggatcttaggacccccatcgcggggggggaggcactcccgccaggcgaggactgagagccagccccttttcatcccctggctcttaggacccccatcgcagggggggaggcacacaccgcaaggcgggaactgagagccagccccacttcccccctggctcttgtgacccccatcgctgtgcggggaggcaacccccgcgaagcggggactgagagcctgcctctcttcccccccaggctcttcggacccccatcgcaggcgggggaggcaccccctgcgaggcggggactgagagccagccgctcactccccctgactcttaggacccccattgcaggggggggacgcacacccggagaggcggggactgagagccagcccctcttcccccccaggctcttgagacccccatcgcagggggggggcaacccccacgaggcggggactgagagccagcccctctacccccccatggctcttaggacccccaatgcaggcgcgtggcaccccccgcgaggcggggactgagagccagaacctcttccccccctgtgtcttagaacttccatcgcagcgggggaggcactcctcacgaggcggtgactgagagccagaccctcccacccccggctcttaggacccacatcgtagtggcgggaggcaccacccgagagacggggactgagagccagcccctcttccccccctggcccttgggaccccgatcgcaagggggggaggcaccccccgagaggcggggatcgagagcctgcccctattccccccccttggctcttaggacacccatctcatgggtgggaggcacttccagcgaggcgggcactgagagcccgcccctcttccccccctggctcttaggatccccatcgcaaggggggaagacaccgcccacgagtcggggactgagagccagcccctcttcccccgctggcttaggacccccaccgcggattctaagatccttagcacccacctggaggactgggggttttaggtgtccaagaagaaagctcagacctgccgaccgcaggtaccttacctgggatttactatccgacaggggtccgaacgcagctcgggatcagaaaaaaagcaggtcatttgcaatctaccagagccagcccctcttcccccccttgctcttaggacctccatcgcagcggggcaggcacacaccgcgaggcgggaactgagagccagcccctcccacctctggctcttaggactcacattgcaagtgggggaggcatcctccgcgaggcgcggactgagagccagcccctcttccccccctggctctagggacccccatcgcagggggtggaggcaccccacgcgattcggggactgagagccagcccctctccttccccctgctcttcggacccccatcgcagggcggggaggcacccaccgcgaggcggggactgagagccagcccctctaccccccgtggctcttaggagccccatcgcagggtgggaggccacccggcgaggcgaggattgagagccagcccgtcttccccccttggctcttaggagccccatcgcgggtggggaaggcaccccccgcgaggcagggactgagagccagcctctcttcctcccgtggctcttaggacccccatcgcagtggggggaggcaccccccgcgaggcggggactgagagcaagcccatttcccccccccccggctcttaggacacccaacgcagaggggggaggcaccccctgcgaggcaggaactgagagccagacccacttctccccggctcttgggatccccatcgcggggaggggaggcaccccacacgaggcggggactgagagccagcccctcttccccccctggctattaggacccccatcgcaggggggagaggcaccccccgagaggcagggacggagagcctgcacctcttcccccacgggctcttaggacccccatcgcaggcgcttcgcaccccacgcgaggcgggtactgagagccagctcctctttcccccgtctcttaggactgccatcgcagagggggaggtaacccccgccaggcagggactgacagccagcccctcttcacctctggctcttaggcccccatcgcagagtggggaggcaccacatgcgaggcggggactgcgagccagccccacttcccccctggctcttgggaccaccatcgcagtggggggaggtacaccccgcgaggcggggacggagagtcagcccctcttcccccactggctcttgggaaccccatcgcaagggggagaggcaccctccgcgacgcggggactgagagacagcccctcttccccccctggctctagggacccccatcgcagggggtggaggcaccccacgcgatgcggggactgagagccagcccctctccgccccccccgaccccgcccgggtcttcggacccccatcgcagtggggggaggcaccccatgcgaggcggggtctgacagccaaaccctcttccccctctggctcttatgacccccatagcaaggggggaggcaccccccgcgaggcggggactagagccagcccctcttcccaccctggcttaggacccccatcgcggatcctaagatccttaggacccaactggaggactgtgggtattaggtgcccaagaagaaagctcagatctgccgacgttacttgggatttactatccgacaggtgtccgaacacagctcgagatcagaaagaaagcaggtcatttgcaatctaccggagccagcccctcttcccccgcttgctcttaggacccccatcgcagcagggcagacacacaccccaaggcgggaactgagagccagccccacttcccccctggctcttgggacccccatcgctgtgtggggaggctccccccgcgaagcggggactgagagcctgcccctcttccccccccaggctcttcggacccccatcgcagtgggttggaggcaccccctgagaggcggggactgagagccagcggctctttccccctggctcttaggacccccattgcagggggggggacgcaccccccgcgaggcggggagtgagagccagcccctcttcccccccaggctcttcggacccccatcgcagggggggaggcaccccccgcgaggcggggactgagagccagcccctcttccccccctggctaagacccccatcgcgaatcctaagatccttaggacccacctggaggaccctgggtattaggtgtccaagaagaaagctcagatctgccgaccgcaggtaccttacttgggatttactataccacaggggtccgaacgcagcccgggatcaggaagaaagcaggtcgtttgcaatctaccggagcctaagggcagaaggcaggtgagagaattcttaggagctgtggggttttgtagactgtggatcccaaactttgcagtattagccaagcctttgtatgaggtcacaaagggggcggggaccgggaagctttggaatggggatcccaacaacaggaaggctttcaggagttaaaggaaaaacttctggcagccccagccctggggctaccggatctgacaaagccttttccattgtatgcgtcagagagggaaaagatggcagctggacttttatcccaaactgtggggacctggctgaggccggtggcctaagtctctaaacaagtagacagggtttctacaggatggcccccctgtttgagggccttggcagcaactactctgctagtactagaagcaaataagctgactcttgggcaaaacctgaacataaaggcccccccaaactgtggtgactgagagccagcccctcttccccccctggctcttaggatccgcagtggactcacagcctgtttaccatattgtgagtaatatcatctccccctctggagacctctggagattatgaactgtttcacagacaggtgtacacccttggtgtacagagggtgtacacccgtctgtattgggagtaatatcatcctcttcctccctgaatattaagaacagtatcacaggggtgtttctactccctgcgatatcgcgtgtcatatcctcctctcccacgttgcaattagaaacaatatcagtggtggcatgtccaccttctgtcatattgaaagtaatatcattttcttccctccaggatcgtgggaacaatatcccaggggggtttccactttctgccatatatgtagtcacatcgcccactccgccttggaatattattaaggaccatctaacacgagggtgtatacgtcctgcgatattacgagtaatatcaacttcttggcctctgaatatgaggaagaatatcacagggtgggtgtatacctcgtgctctattatgcggagtcgtatctgtctattacggggagtaatatcattctctccctttcaggatattaataacaatttcacaggctgggtgaacacagccggcgatgctgaaattattatcatcctctccccctcttcccctcctggcccttaggacccccatcgcagggggctgaggcaccccccgcgaggcggggactgagagccagtccctcttacccccctggctcttaggacacccatcgcaggggggggaggcaccccccgcgagggggggactgagagccagcccctcttcccccccggcccttgggacccccatagcgggggggggaggcacacccctcgaggcggggactgagagtcagcccctctacccccccggctcttgggaaccccatcgaagtgtggggaggcaccgcccgcgaggcggggactgagagccagccactcttccccaccggctcttgggatccccaccgcagggggggtaggcaccccccgcgaggcagggactgagagacagcccctcttccccccctggctcttaggacccccatcgcagtgggggaggcaccccccgtgaggtggggattgagagccagcccctcttcccccctggctcttggaacccccatcgcagaggggggaggcaccccccgcgaggcggggactgagagccagcccctcttccccccctggctattacccccatcgtggatcctaagacccttaggacccaagtggaggactgtgggtattaggtgtccaagaagaaagctcagatctaccgatggcaggtaccttacttgggatttactgtccgacaggggtccgaatgcagcccgggatcacaaagaaagcaggtcgtttgcaatctaccagagcctaagggcagaaggcaggtgagagaattcttaggagctgtggggttatgaagacagtggatcccaaactttccagttattagccaagcctttgtatgaggtcacaaagggggcggggaccgggaagctttggaatggggatcccaacaacagcaaggttttcatgagttaaaggaaaaacttctggcagccccagccctggggctacccgatctgacaaaaccttttccattgtatgtgtcagagagagaaaagatggcagctggacttttaacccaaactgtggggccctggctgaggccggaggcctacgtctctaaacaactagacagggtttttaaaggatggcccccctgtttgagggccttggcagcatctaccctgctagtactagaagcaaataagctgactcttgggcaaaacctgaacataaaggccacccatgctgtggtgactgagagccagcccctcttccccccctggctcttaggatccgcggtggactcacagcctgtttaccatattgtgagtaatatcatctccccctctggagattatgaactgtttcacagacgggtgtacaaccttggtgtacagagggtgtacacccgtctgtattgggagtaatatcatcctcttcctccctgaatattaagaacagtatcacaggggtgtttctactccctgcgatatcgcgtgtcgcatcctcctctcccacgttgcaatgagaaacaatatcagtggggccgtgtccaccttctgtcatattgaaagtgatatcattttcttccctccaggatcgtgggaacaatatcccatgggggtgtaccctttctgccatatatgtagtcacatcacccactccgccttggaatattattaaggaccatctaacacgagggtgtatacgtcctgtgatattgggagtaatatcaacttctcggcctctgaatatgaggaagaatatcacagggtgggtgtatacctcgtgctctattatgcggagtcgtatctgtctattatggggagtaatatcattctctccctttcaggatattaataacaatttcacaggctgggtgaacacagccggcgatgctgaaattattatcatcctctccccctcttcccctcctggctctcagtccccgcctcacgggttatgtagcgggttatggcaagaagacaaactgcagtttcctgcacagaacagcacaaacaatgatccaagctcagttacaacacaatattggtcatcatttgaccatggacttcaatatcaacccttagaaaccttcctaaaacaggtcagcaaaacaccaagaagcaatatcctgaatgataggaaaatatccttgcttgtgcaaattgtttccacttaatttttttcaacaaatgttaattatatttttactttctaaaaatttttaataaaatatagcctacttggttaaaaatggtgtcaaagcttttctaaaagttaaggcattacataattcagtggcccctgtggctgccatggataattcttttttttctgttcatcttcaaagaagggaattcagaatcaggaaaagatctttggaaattcattagcatatggttttactccgaaactaagaccaaacacaaagagaaatgcagatttttctcatggaaataaaactgcttttttgcattttcaatttgtttccaagtaaggaaaaacatgtcattgtttctcataccccccatttctcctgttttccttcttttcatttgcttttcccagtgtatagcccacagaactagagcgaaagctttctttttggcccgtatataatttgaacagagtatcatcaggtgtctaatgtaccaccaagagtggtgcttacgacaaaaatgtcctctagacttattctatgttcgctgtgtgaatgaagatactaatggtcataaattcctggaacgggagacctcatttcattcatttctatttagaggcttcctagtagagtgcctcatacacaataactggccaataaataattgttgaggaaataaaataagattaataagataataagaatcttattaccaaagattcttcttctcagaaagggtttgttgtgatagctttactattaatatctcactcgtcatagagttacagcttctgcattaaacatattgctattaatatcaggcctacattaatcacctggttggaagaaaagcctccatgggaattcatctgttgggcaagccactgcacaatcttactagcataggtgaggtcaggaattttccgggaaatgacagccaacagcacatagcaactcttctcagtctgagcagaaggtgcccagggaataaaggatggaaattcttctgtcttgggtttcctttctctttcccagtagatgacattatctgagaaaaaggaagaattttcacatagtctgcataaaagtcatgggttacacataaagaaggatgaaaattccattcccgacctctgtttgtgctgaattgttcccctaaaattatatgttgaagccctaacaccaagtacctcaaaatgtggctgtatttggagataagactttttaaagaggtgattaagttaaaatgaagcttatgggccacaatccaatctgactggtgaccttatgagaagaaaaattttggacacacaaaagggagagcagggctgtgcacacacaaaagatcttgtgaagacaaaggaagaatgtggtcatctgcaggtgaagaaaccactttcaacaccttgaacttagacttctagcctccagaagcatgagaaaataaacttctattgctgcagtcatccagtatgtggtattttatgacagctatagcaaactactacagccttcaatagcaactttctaagtagcaggtgattaagcttccccagcagttttgatagcctatggcttggtcaccaggcttgattcccctgacatcactcatttgagaggaagctagcataaagcaaaagaggaaagtctagaatatgtagcgttcttgaaaggtataaaggccactgataaattccataagagaaacagaaacatactggtcaagagggagctcctatgtgactgcttagaacgcttcctcactgtgctccaagatcacctccattagcaacaatgaataataacgcttacttagttttgtggcagattgatccagggtttggagtaaagattccacttgcttctcttttccagctaaggcaaaagcataagctagaattgcatgattgtagccattagtgacaccactgtccaatgccgcttcaaggcaaaagagtgcgtttcgtagagcaggaaactgttggtcaggaagaagaatcatatattgtaaactgatacccgaacattccatgaacttgttgaacatttaaactaatcattgtttataatatatataatatatcctcaaagtatattttacatacaaatccatttatatacacacatatattttatccttcaaaaatatcattaaaataaatttataatgtcattattagtacctaagcaataattttttttgagatagggtctcgctctgttacccaggctggagtgcagtggcatgatctcagctcactgcaacctccacctcccaggttcaagcgattctcctgcctccatcttccgagtagctgggatcacaggcatgcaccaccaagcccagctaatttttgtatttttagtagagatagggtttcaccatgttggccaggctggtcttgaactcctgacctcaggtaatccacccacctcagcctcccaaagtgcttggattataagcatgaaccaccatgcccggcccaatgaaatttagtaagaaaatggcagtttttatatttgatcagtgatattttagttatgaatgtcttctatgcggcaaagcatccaaatttatcataggcctaagagttttttttttctaatgcctaaaatagaggcttacatttctgaagataattttcagggtatactaatgaccctgacaattcctagcatcttagttcaggaatagattttggaaatctaatctatggattgggaggtggctagggtgagccacacttaagttgaaaatgtttactcacttattgtttagagagaaacagaatactaggccacggctttacttagaacagtggttcttaatctgaaattcatggctgaacttcaggagagatgtgaatgcctgcaattgtgtgaataactcttttttgtgtgcatatgtgtattctccctagggagaaacccaatcctgtttttcaaagctgtctatgaatgaaaaacagtttgaacagcatgaatttaaagggtggtaataaactaaatgttatctcggggtttcatccagtcttagaatctcaagtgactctgactctacagtctattgaatgtgcattcagctgcctgaaatcagaaatgacgggaatccatacagtggaattgagcccagcttcaaagaacatcccaacaacatatgcagtgagtgaaatgtcctcttcatctccaccctgaaaacaaaggaacaatgagtcattcgggacagcagagcacaaaatagcaagtattcttttgaagtaaaactaggtatgaaaaaaatactggaacaaataccattattcataaaaacacccgaacatgtgtagtttttaaattagatggttaataaccatactatctaagcaagaattcattcagactctatgcaataattaaatcataattattaagttgttataacaattaatttcaatcatatttatgtggcctggtgttaagcatgcattctaaggaattcacaggactctatttgtctccgcttggtataaatctgaaaaaagccaacaaagaatttctaatgaggtgaagcagaaagttgccgtgaagattcctggaaattcctggaaaagcaccctaggagatcaccagaatcaagtctcagattcttagagtgtaaaatgagaaactcatttataaatcatgtggtttgcaaactgactgtgcataaaactcccctggggtatttaaatcaaccagtgtctacacagagattctggttcaaaaaacttgggaatacgacagcaaaatgcattttaatgggtgctctagtgactctgatgcaaatagcattcagaatggcatctgggatctactgatcttgtagaagcttcccattttatctatttaagcaaaggacaactcctgtcttcttcagaaaagaaatacttctgagaaaccaagtgtttaagatggaaataacagcatatggtagacactaacatgaggtacgaggactgtcagtacatctaaattacagcaagtgggatcaccattcctcagcagtgtaagctttgatttttcccttgcatttttatttctctcaactcaaaacacacacagacacccacccacacagatatttaattatagagaaaatactaggtaagatcagacaaactgtagcagtaatcagcaatgattcaccagtaatgaatccaataagaagaaagatgtgaagatgttttagaagagaacgtgggaaagtttttgatttttctatgaaggagtaagagctcttctccatcagggtcctcctgttgtaaggaataagtttggaatacattaaaaataccacaaagcaatttgaatacaatttgcatgcaaattaaatatcagagtgtctgttttcattcatattttgaggtggattagatatgcattctgggtttcaagaacaggagtgctgattatgaggaaggatgctgaagaaaagctcagggtatttcaggggccatcagagcatgctaaaatgccatgataggagattttgagcaaccacaggggaaaaaaggaggggaaaggagatagaagatgggctggagatggacaggtatctgcaaagaaaggaagttggaagggagggatttacgtaaatatggacaggaaaagggttggattttgccaaggatatacttcacctcatttgtactttggccccggggcaagcttggcctttgaatttttccttgagagggtcttagaaaaacttgcttcattgaaacaatatgaattactagatattctccccagaactttcttgccattcatggacaggaataaactttccttcctcatacactcacagccccctccctttatacattgactgtctccaaatttatgaaagtttcttttctaggttccctttctctcccctcccttctatttctagtttaatttctgaagaggactgactcgggaaggactagagactgaataaggcagacaagagactcagaaggagtcacatccaggctgtagttaaacatgcacaaagcaggaatggtgctgctgaccaacccaccacaggcccaggactgcagtgcctcagaaggtttcataggcacaggaagaatattcatattccagatcaggaaagccagaggcagggcaaggcaggcaatgcccaggaacaaggaaagcctggtgcttctcctctctcacctcccaggcgtggttgaaaagctggccatcattcttaaagcagccgcttgttttctgttggcttgaaagccagattaaggtctgtttttgaacattttcatcaatgaatacaaattttttcattctctccaatgtcttaaaagtaagagcactgagcctgtaatacaaatcaccaaagcaaaagttagataaagaggaagtgacaatgtcagcaattccacagtttcatcaccattgttccctttgagtaaaggatgcattcaactcatctactgtaaaccatctttattgttagtggccctttcctttgggtcaggaaaatattatgactagcaataagtggaaattagagtaggtaattttcagcatgtttgcacccaaaggtcctgttgtatatagcccattagattatctgcacatggagagagaaatgatgtaattaggtattttgggtccttctaatttcactttcccgaatctatatgggactctgagaagcacagagtaagacgtgccgtgccctcttcggtggagttaaccagcggtgcatgtctaggggctgtcatgaaaggatcagactgctaagcaaatcgtcatgagactgaaggaacattgttgcattagaattggaatcactaaatctttagttttatctatttctcttctgtaaattgactttgaaacccactttgcttctaaatccccactgaactctatcctccttcacctccttgcaagccctcctcaggtaattcctatattatataaaataaaatttttatgtctcaccatatgcttcctttctgattctgctgccaaaacacactataggaaccatcagagtttttgaaagataattgcctttgataacctaaaatagaacattgtaggaaattattttttaacctaagaaagttagaagagaaagaatagtgcagtgcaagccctaggtattggtgttagacacaaatcactaggatgatcatttccatttgaacttctgaaactcaggttctgtattcataagggagaaaaaataactcttactttataggattttgatcacaagataatacacatggatatgtctggctcagtaattgcctcgtcattggtacctactaactattcagtatatttcccctaaggtcattttatttcagtgttatctttctgagaagaaaaaccaaagaagattattttatgctcctggacttttccttaacctcacagttcacaacattggccctctttgtgtatacaaagccaatcacttcactgcaacagaccacagctgagcaaacaaatacagacgttgatagatgaaccactgacaacaactcctaacaaaaacaacaataataacaacaataaacaaggtagcttgcaaaataccagacattaaaaaaaaattaagtgcatagcttgaaaactttgcagctgtaaattatgacgctagctgaccacacagattttgaagtcagacggaaaacagcgctaggactgagagttcctcggttcaggttcacttttctttcaccagactactgcataaaaacagcttatgacatcttggtatgagtaacaattgctttcaaaaattatgggcagaaattacttaaatcttctcaccattagataagagaaagaaagccttagattgaacttcctctgtcagttgctcagtagatttcagatagtccagaacataagtatcagatgctagtagggcagcattctgctctccacctccatagggcatttggagaacaaccagattctgcatggcaagtcctagaatatcccctaaaaacaggaaaagcggaaagctgtattgtttatagttgccatctcagcattaataactatagacaaaagaggcatagtgaaataggtaacatttaaaattgagtctaaatggtggaaacaaagaaagttttatgaagcaatttgaaagaggagacagccatgaagggtgaagttaaactgctatgaaaaatatttctgaaaatctcattaccagagagaggaggaagttaggagaatgcatttgtttgcttgtttgctagttttttttaatcaatcaatcctatgaattacaaagtgtaatccatcccttccaagagatgttcatgttaataacagacaaagaagtttgccttttgtatcaacaacaaaaatttctccttttattgagaaaactcccaacatcattaacaggcaaagtcaattcgattctccaagaggtgaatttcatatttcagattaatgattataaagaacctcttgctttctgaacactagttaccatctacccaagctaaggtttcctgggaatataggtctggaaacggtactgtaatccctttagatcccatcaggaaacatagaggatgatctgatcaataattccctccaattgatagcttaggaaaatctctctattctattattttaaggatttttaaagaccacctcaaccaagattttcaaatcatagtgaaacacaaaatttgatcaacttacccacaacagtgaaaaagcctctggctgacccttctactacatcatttggcaagtccaaaactccctgcttggaggctttggcacctagaatgaaaatactgatttaaaaaatgtgatggcttctttatatcagcagatttgggggataaacatattggaaataagattccattacttatttttattttacaagttgtttattagaggagatgaatttggagttttgacccagtttaggataatagtacattcagaaaatggcatataaatctgtgtgttagattgtggcccccgttcttcactggtttagtgcctgaactatttatgtatgaaaaaatgtaaaaactacactgactgtaacacataaaacaacacacacaaaaggtaaagcttgaagactcagatgaaggagtataatcagatcaccatcaaccaggtaaaataatacccctcatggccataaaaccggagactgaggtgcaggggcagtgatgtatctatgggttattttctcctaagagtacaaaagccaagattatattatgtgctattgggcctcaatcctaatatctcattgtccaatattgtgtgacaaccatatcataagaggagctaagagtacacatgatggaaaaaaaaatagataggagcagaccagcctcagaaagtgaactaaaaaccacctcctgaatattctttttgatggctaaaattataccataaagataaagcatgaaacacaagaatcctccacgagttatttaaagtgaaatcacagggcacatggactcatgtggaaggagaggacatgaactgattcttttggtgaattttatttaggactaatttgactccctaaaagatcctcttaccttctgtacagataaggaaactctgggtcctttccttttcaataccttcaggctgtcaaagaataacacaaacaagcacagaagaatgagtctagatcctctgtccatgaaggaaaagtgattaagcaccagctcacttaagcatggctggtgcaagtttatccctgagagaagatccaactcatcttccccttttgttcatatctggaaggcacgggacatcaccggtacccattttagcctctgcgttctgtagcttggacaggcattatcttgatgtcactgtgggacactctcagctcctctgatcctgtatagcatctccagtaaacaactaaaagtgctttgtggagcagggattgccaagaggcaaatcaagagtgttcctctgacaagtgctgattcttgttgaggatgacgggaactgcatgggagtgtaggacaagtagatttgtctcttgaatttgagaatcagaaaaagagaaggaagagaaataggtgtacaggaaacatcttgactcagaaacaaacaaaaaattgtcaagtctatttcaaatgttaagttttactatcctgggtgaggtattaattaaagaaaggatgaactttatgctgttttaattcatttaaaatggcatgtcttgtgtcaaaagtaaatgttgtcaactaattaagtctcttcaatgagaagatcttttaatacaaaacctcttagatgtctgtttcttttcaggaaaagcttgactgtttgcatatccatacctctactaagaagcttttgaccacagtgtctttccagtttagcttttgctgctccattccttcatttgggcaagcactgctttgtttggactcagcaactacagtgatattcactttacctggaagacattcccaaatataaattaaattgatcattggtcccttctgtaatgagaaatgactagagtctgtgaaccatgtcttgaattggattaaccaaattctatcattaagttaatgcttagaacaaaataacttatttcttctccttcctaggtataatgtggtatcttccatttcacctgttccatgattttcatgattccttacattaaatgataaatttacttaattaaaacttaagaaattttaggaaaagtaacattttacaaagttgtctgagtcaatttcctgatattgattgtttataaaggttacttatgacaatataggctaataatgtcagcgaactagggctcctaacttcccaaaatcaagcaagcatagtaaaatatgatatagtagataggcactggattgaaataatgtcctagcaaggaatccattgtttttaaacttcctgatttcacattatgtaattagaactgatctccagtttccttgcttgtgaaaattacaggattgaaaacaatcattcattctttaaggttattattatttacgtgactatataccaatatacataaccaatatattgttctctttgttgttgttgttgttgttgttgtgttttagtgtttctctgtctcaggaagcttgctatttcactcttaaaactgtgtcttcgacttaatgtcataaaactatacaagttggtacagtattctgtctcaattgccaaggtaggattttgaagatcttgtgcagtagaaatattgagaaacttcaaatctaatagaaaaatagtctgagaacagcatcacaactgagctaaaataatctcatagatatattatttgctgttaaaataatacaatgaatatagtacattaaagaacatttgaatggccattttttaaaagtagtgattaaaagtgtcacgcacatcgtatctagcattccttgtttactagaattttaaactttttccattccatgtattttcaatatttcaataggagacaagtttatttttccatcttgcagatagcataggcactaagacaatattctcagttttttatctcaatccaatcatttagtgattttggtatccccatggcacatctagtaaatttacaaacctgacaattccctcattggtcattgtgatggagcagcaattttcttgaaggtggcctgggttcatgatggtaggtgaaggacccagcgagaagtcaaataattaaggtggcattaatgatagcatggccttcatttgggatatggcatatgccaaacatatagtccatgataggtcatgccagttagcatttatattgtattttaattacattatgctcttgtaaaaatgaatggtggttttgatctacacagcattaacaaccagaaattagattactatagattagaatttctaatggagaatttacaataagaattttaaaaatgtgagggagaaaatcacgtttgtatagacaatataaggaaagtaaatggagacaataaatatgggctggtttttccatgagtgactggtgtagacagatagctgcttacccaatttcttaggtataatagtccagatgtttgttttcctccctccagcttgaataacctcactgccattgattttccaggtattaatatttgcttcataattctgagactcctccacttgaacagaaatctaagaaaacaatcatggcaatgaggatagcactggaacacacatcactatgaaacaccatgctcaatacactgtttaaactgtcactgtgaatgaaagcaattgtatttgtttgaggaatatggacctaagtcttatacctttatagtagcattttgcacttgaggataaagagaatatggaaatattaagaatattttagctttgttagatttttgcctccagatcaaacagaacaacgcacctctacacatgtattcaggtagctgaaggcattgacaatcaaatcaaattgttcattttgaacaaccgaaaagggtgaggcaatttcaataaagaaaggttgggagacttctagagtggttgtagaggaaatgccaaatccaacgtcgccattcacacaaaagccacttgcctcccattgggttatcgtatcaggaatgaggaacgaaagattggcagagcctgaggaactggaagaagaggttatcggtaaaacacattctttgtctgaaccaagaacttaaaattaagtgcagagcaagcagaaaagtattgactgaagctcaaaagtgagttatattgtttggatggggcattagataaaaataatgagagctggatttttataaaatttgagtatagaaaggtcatttttctttaaacgccacttttttttttaattggggcaggttaaatctgtctgcataaaatgaatagaagagaaactcttggtgaagggaaaacaatgctagagaaaaaaataaaataaaatgtatgataagtacatgcaaatcaatgatatatattttacaaatatggtactgttttatatacccaggaataaacctgaagaaagaaaaagaaaatagaaataaagacacataggagagaaaatggttaaaactcactcgacactgacgaggtcccacatccatgtctctgggaagtttgttcttactgtttgaattatagcctgttctacatagtcagcattctcccctctgattccactagctaaaaaaaaaaaggaagaagtaccttattcagaccttggactctgcaaattatagtctatatattatcagggtgtaaggtctccataaaacacctcactttcctgtatcacagtcacttactatgactgttttcctgtatcaccatacattgcctgttcccctacacagtcaggtaccacataatgacactgtgatcaatgacagaccacttagactacagtggtcccataaagttagaatggagctgaaaaattcctaccacttattgacatcaaagccatcataacgttgtagtgcaatgcattggtcatgggtttgtggtaatgctggtgtaaacaaacctactgcactgccagtcctataaaaatatagcagacacaattttgtacagtacataatacttgataatgatgactatgttaccggtttttgtgcttactatactatactgtttactgtttagagtgtactgttcttacttatcaaaaaaattaactgcaaaacagcttcaggcaggtccttcaggagatgttccagaagaaggcattgctatcatagatgatgacagctccatgcatgttattgccccagaagaactttcagcggtacaagatgtggaggtagaagacagtgatattgatgatcctgaccttgtataggcctagattaatgtgtgtgtttgcatcttcgttttaaacaaaaaagtataaaagttaaagaaaatttaaaaataggaaaaagcttatagaataagaatgtaaacaaagaaaatatatttgtaccctgactcactcagagtaacttttaaccttgcaagctccattcatgggaagtgctctatataaaagtataacttttttttatcttgtataccacatgttcactgtgccttttccatgtttagcaatgattagatacacaaatagttatcatcgtggtacaactgcctacagtattcagtatagtcacatgctgcggaggtttgtagcctaggaaaaatgggctgtaccacatagcataggtgtgttgcaggctacagcatctaggtttgcgtaagtacactctatgatgttcgcacaacaatatcacctaacaatgcatttttcagaacaaattctccatcactaagtgaagcatgactgtatttctgacattgtattttatcaataaaaataaactacatctcacatctgaagctaatttcttgttatagccaaaagcatgtctagtctgtcttattctgctttatccaactataggatgtctaattgtagccaaaaacatggcataattcacacataaaattccaaaattgcatcatttatcccaaatacactaaattccacaaagcggtttggtcatcccccaacaaaaaaatgtaagattacctacatgcaattctagacggaacactatgcattggaccataattttctgtttctagataaagcggcttagggagtggcagccttctctccatcacacatacttctggttttcggtaatggagattggtaaagactttgagacccatgttctttaaagaaacaaacaacaaaaatattgttcattcttttcatgcaagaactataaaaggcctattatttatattgcaaagataaatggatcataagtatccatattttctgtgttaacaaaggtctgagaagttacaagtcaacttacctctatttgacttatggaaaatccctaatttagagaaaaaattataatcactatgatttatctagcacttattatgtgctagcatttttctaagtattttccattattctccatttcatcctaagtggaaaatacttatgagatcagcactatcattaccctaattaacatcaaacacacacacacacacacacacacacccggcacactcagtaaattaaagaactggaacctgataaagtctgtctgattcaataccccttttcttacacacttgtgatgttaattatagagattatttcatggaaggctcagcatgtctcattaatggcctagggatatctggagtccacactctcttagcctcttgatttgacaatctttgcataagatttattgtattaattggaggctgtcttatttttttaagtgaggttttgtaattatagctacatgatttattttcagcagaaaattttaaaatcaacaaaattaatatctcctttttataagacaatttctatgtactctattggcagattacagacacgaatctcaaagtataggaagaaaactacataattaagaaaacattaatatgcattatgaatactaaaaattgtgatgaaatattttccaaaatccttagtgatcttaccctgacaatattatagatatctccatccccatagttgcttacaggtgtgtaatataaaccattgtagaacatatccctctgaggaatgcaagggtcttccttgccatcatcaagattgaggccatggtagaaataaccatacggctctatacttggaaccatgttatacacctatgagaaaaaacatttcccaataattttaagcacttcttttaaaattacaaaattggcaaattgtctactgtaccatttattcttgttcttttctttaagagcacggccatcatatttaatccagtattttcacataagctcttcctttcaaaagagcaaaccagttttgttttaggcaactgatgtcatgttcacagaatttctcagcttgggcgcaggatttaagagagaatgtaagaaagcaatgcctgactattgattaatccaaggcccattgtacacacagtcaattataatgctagaatttctaagtctggagaataatcttagctgcctgattttaaatcttcttacataatcttctgaagaaaacataaaatcaacaaagagaacaagtaaggatactcatgactaatatctttaacattactacaatacagagaataccatgatcttcaaattatttcttagtagagaaacaaacaccaaatgccaagagagcttctactgctattgcagagggaaggcttaagagactgcagagaaaaagagagcagaatggcatggagaaatgagaagaaacacacaccaagtcaactccaggtaagagaaagtctagcattgttaaaaatacaaatcatagttttcggactcaacagttcccagtacagcacacagggaaagggcttggactgaatgggcctggaagtggaagcttccaaaaaacatggctaaggggaaataatcagatcacaagaagaggtatgcagatccttggagacagggaatttaaaaaaggaaaggatgtcataggataaaataactccctccaccctcatttccatcaccaacattttaaaaataatgcattttactaaaaaaaaaaaaatagaaagggcgctcttcacctatgaacaccctgcacaaaatatcaagaactagaaaaaatcaactccatacaaagcttctgtaagagaaaataggaaatgcaaaccaaaacacttcagctaatgaaacttctccactaaagtcactaagtaaataaataagtaaacaaagaaaagccatgccaaaataatttaacatgagtgaaatattctcaagcatgtatttgaggtatttaaaaggcaccatgagtcagaaattctattaagaaaatacagaaatggacaaaacccaagaagaaataaaatgaggctttattgaactcaggaaaactagacaaaattatatcataaataaactctaaagtacaaggacatcaagagaaaattgttcagagaaaactttaaaagcagcacagaggaaaaacaacagaacaaaactgaaaaagaatgaattaaaacaggtcacaaagtgattgaattggaaagcaggcaaggaagatccaacaaatgtacagagatttttttagaacaaaaaaaatggaaagaccaatatttacaattataattcaggggaactatctgaaaataaaagaagatttgagtttacatattgcatgactccactgtgtacctggcaaaacttctacagaataacattcttactgaaactgttagattaaagtataaaggggaaaaaaacattcaaggccttcagacatagagataaagtagcccataatggaaaatgaattaaactaatgtcagcactattaaaaggcatattcaaagcaagtcaatagtaaggtagcatttcaaaaaattttaaaatgtataaaccaaagatttaatatacaaatacctgtctttcatttattaaggctttagaaaaaataattctgaatatgaaaatgtcagagaattctatacttatgtgatgtcctgaggactctagtagagaatgcactttttaaaaattgttatttatttatttctgagacagggtctcattctcttgcccaggctgaagctcagtggtatgataatggctcacagcagcctcgatctcccaggctcaagcaatcttcccgccccagcctcctggagaatgagctttatgtaaccaaaagatgactcaggaaattagtaagacttgatgaataggagaaacaatacagaatgtaaacattatatattctgacaaaaaaggaaagatgcaacaataaaatgagagaagagggagagaaaagtggaaactagagattactgactgttgtgtaggtagcagttaagactcaaagattaaaaataactgactagattttttttttttaaatggagtctcgctctgtcgcccaggctggagtgcagtggcgcgatctcggctcactgcaagctctgcctcccaggttcatgccattctcctgcctcagtctcctgagtagctgggactacaggcacccgccaccacgcccagctaattttttaatatttttagtagagacgcggtttcaccgtgttagcgaggatggtctcgatctcctgacctcatgatccacccgccttggcctcccaaagtcctgggattacaggcgtgagccaccgcgcccggccataactgactagatattaaggttaagcaagaaaaaatgagattaggatattaggatattataaaatatgtaaatataaaaataaccactaaaataaaaattcaagctagcctgaatactcaaagaagctttaagcaagataacaacaaacaaacataaaagctaaagaaataaagtagctttaaatacaatacagaatcataagaaaaatagtatgatagagctgaggcctaacacatacatcatatcaatagagtgaatagactttattctcctttagaagacaaagatatgcatatttaaaacaaaacataatgctgtacttcatacaaaaaacaagtgaagtgcatatttcaaaaggtgaaatccaaaggaaaagtaaaggaaaataataagaatgcaaaggctgcaatcctcctgttatcggaaatcgtagaagtaaggccaaaagacatcaaacaagatagagaagaatacttactgctaaaagctgcaattcataataaaggcacaacagttatgattatctatgcagaaactacagaagatgcaagaagaaacagagcactatttgtagggtattttaacacatcactcagcagaagaaggttaaataaattttacaaaataagtaagaatacaaagaatcaaaataatccaacctcatggatagaaaacaaactgataatagagactatatcttctcaacacatgagatatattcgcaaaaactcattatatatttgggcacaaaaatataccggtggaaatattgctggccatgaagatatagaacttgaaatttaaaagaaaactctaaaataaattcctttttatatgaaaattataaagtactccagtaagtaaattttcagtgaaagggttaatacaaacagaaattacggaatttctgaaaaataaaaatggtgcaattgctatgtatcaggatctatgagatacttcaaaagtagaaatcatggaaaaacttataggcttaaaaacacctagcccaataaaataaattaatgaaaatgaagtaaatttctaagtgaaaaagctaaaaataacaacaaaatacagcaccagtaaggaaataataaagataaaaatagaaattaatgtgatggagtagcaaaaaacctcacatcatattacatcacattaataaattaaaattatatgtttttggaaaactcggcaaaataggtaaaccaccaactaatctaacaaggaagaaaaagtagctatctgcttaggaacaaaagaaaaacaacttcttccatgactcagttttcagcctcattttttgtccttttagcatcgtgaattggggtccggagttgtttgtatttttctttcacaatagactgatgtatgtaacctagtctcaaatgattcagaaaaaactgaaatggcataaactctgtgtgtgtgtgtgtgtgtgtgtgtatgtatgtgtgtgtgtgtaggggtggagagagtgagaaagagaaaacaagtacggtgaaatgttcacaaactggtgaatcaggccaagggtctacgggagttctctgtgtaattcttgcacttttaaaaattatttaaaactaaaaactaagcttacatagataatacaaaaaataacataaacttatagaatataaattggaattcactcatttatagaacttcacttgatttatactattaatatagctatcaataataaacaagggcaacctcttttggctctgatatattctgagacccctgaataatgcctctagaattttctttttgaggtcccttgatggtcttttcttgaggcagttttcctaagatattgccacctccaactgtagaaagaatgagcagaagctatttactctgaatccatgaaactctcaagggaaaaaaaaggagtgtgtgtgtgtgtacatatataaacatatatatgtacacacacacacacacacacacatatatatatacatattccttttttttctttgagacagggtctcgctctgtcacccaggatggagtgtagtggcacgatcttggttcactgcaacctctgcccccgccagggctcaagtgatcctcccatgtcaatctcccaagtttctgagatcacaggtgcacaccactgtgccctgctcattttttatattttcgggggagacagagtctcatcatgttgtgcaggctggtctcgacctcgtgagcacaaacgatctgcccgccttggcctcccaaagtgctgggattacaggcgtgagcacagcacatggccatattccatatttatagataaatttatcctttatttgttgatgtcccctcagattctgaaagcttctaactaaaagtatttttgctccctgtaatagaaaacttaaatgtatttatgttttgcattgagaaaaatgttttatataatgatctatagttattcaatattattactgaattctataattttatacttaaaactggacttactacagaatgttgaaagcaaaatacaaaactattttttggtgagatctcaagtttgtaaaatatatatgccttcagaaaagagacttgaaaaattacagcaaaactataaagatgcctaagtgttaggactataaatgattttaaagatttccttctttatgtctttgtatactttgcacaaagtacacaatttaaattagatttaaatatgatcataaatttcaatagttatttatatgtaattgtgttagaaataaacggaaaatatccaacaattgttaagcgaaataaattggatgtgaacttctggaattccaggtctggaaatgtttaagaaaatacaatatccatttatagataataactttacactgaatccaagcatatccttgaacatagagatttcattttattccaagtttccacttctgtgattacacctatgatttttaaaaatcacagttgtaaaattcctaaactgttataattatctatcaaattctgtattgttataagcatgctcttaggatagccaagaaaaatacgtatataatccacgaaggaacaaaggaagaaaacattcaatattttcaacatgttcaagacatcatctgaaggataagacttctggtagtccagagaaacatgaaaaacgaggaagtcagagagcttacactttcagctgacagctgttgttcagatttcagtagaaggacgttcccatccacagccccgagggcacagaataagacaggcgccgcttgaagatagagactagcattggaaccaggtaagccctgctcgttagagaactttatgttaacctaaagtagagaaaaaaaagagatgagagtagagaccattttatgtaaagatgatctgaatacatttaatctctcctgaataaatccttatagatttctatacggtatttcctttgcccactctcaccctcagctttctttgcaggagacccccttcaccacgtgctgccgtctcaggattggcactgctgccaaggatcatgcattgtgtttggtgattctcacatcccctaataattcaattatgccagcactgagtgtaagtttcccacgtgaaggtgatagcagtcaggcgagaagacagcagggagcaaactgttcccacttctcaggccagaaataggagaaacatcaccttgtgtttaaagcacttgtcaacctggaatctgacactgtcagccacaatttccccactggggtgaagggtgtagacaaacaggacggctgcaggagccagatcagcactgatgctgagtgggaacgagaagtttccattccaggctgtgtaaataggagacgaagagatacgatgctgaaagtttcctgaatcactggtacacttagataaaagagaatagctcatggacagaaagagtaaattgggccctgttttcaagacaaataaatcaaataataggaagtacatacacaaataaagaagactgcataatttagataataacaatactgggattttgtacaccacttttcttttttttattttttatttattattattattattctttaagttttagggtacatgtgcacaatgtgcaggttagttacatatgtatacatgtgccatgctggtgcgctgcacccactaactcgtcatctagcattaggtatatctcccaatgctatccctccaccatccccccaccccacaacagtcctcagagtatgatgttccccttcctgtgtccatgtgttctcaccgttcaattcccacctatgagtgagaatatgcggttgtacaccacttttctaatgtactcaatgatctgacaataaaagaaacagtagaactctccttcatcaggacatttagtagcttccctcaggctgtgctaactattcccttcatccacaaattgaaataagtgctcgttcttcttttcactatatatatatacacatacatatatacacacatatatatatacacacacacatatatgtttgactatatataaatatattttcttaatatatataatccccatatatataatgtctatatatccttaacaagaaaaaatgaagttagagcacatattttaaaatgaatacattatgtatacctttgtttctgatttccttttgtccactgagtaagatagctccttttaccatcatctgtgtggaacaaagaaaacataacatgcaatatattatctgatgtcatcatattctcatattgagattaggtaattcattacttaatggtaattctgttccataagatagggtagcttccacaagcaaatattaaaaatagactttgcgtaagttggaaaagagcagagaaagtgactaaaactgattgagattctatcatgtactggaaactttgtgaactatgtgcaatgcactgtgcaaagtggcacataaagctctgaaattgtcaaggctgtccggtttcaaatacgccttcacctgctcattaactttgtgacttaaaacatgatgttttacctgtttgcctctgttccattatctgtaaaatggagatatctataaggctaattaaatgagttaacacatatacaatctttataacagtgcctgacacagaacacttaccctaagaggtaagtcttataatctccaattacactgtacacctgaggaagccaagggttaaagagttcaaacaatccgtccaagatgcactaacttgcatgctaactaggagagggtgggggattcaagttaatgtcttaatttccaggtctgtgtcttatcactcttcaacaggccttagagcagaaggccccagtccccaggctgtgtaccggcaggtacgtatccatggcctgtcaggtactaggccacacagcaggaggtgagcagtgcggtgagcaagcattaccacctgagctcctgtcagatcagcagtggtattagattctcataggagcacaagccctggtgtgaactgcacgtgtgagggatctaggttgtgcgctccttatgagaatctaatgcctaaaaatctgtcactgtctcccatcaccaacagataggaccatctagctgcaggaaaacaagcacagggttcttactgattccacattatggtgagtatgtaataataatagaaataaagtgaacaataaatgtaatatgcttgaatcatcctgaagccatcccaccatccccaccccatctgtggaaaaattgtcttccatgaagccagtccctggtgccacaaaggttgggggctcctccttagaaagacaaaatggacagaaccaagagaataaagtccttttactgcttatcaacataagctttccaccttactttctggcatctgcccaatattttactattacaaagtgtcataaatacttgatatgagttacatttgaatgcttaaacaagtggactctgaacagcaagttcttcaaccttagggaaactttaattgccttagatcgttctatgtgtttgtttgttgttaatggatcgaacagtattcaccagcaaagtgagaaggctgcccttactctggtcaccgtggcatgactgatgcatgatttctaagctgtgctgggctaagcagacgtgcaattgaacaggattccaggaacccactgactgagacttaccaaatagaagaactttacattggaatcatcctcatatgcttcactgtttagggagtaatgcacagtaacaaccttctggtgattacattcaagctgctttggttctggaacaatcttcaggaagctgttcgttcgggagtaaaagcgtgagactaagaagtgagcatccaagtactgaggcgtcaaccagctgggaagatagcagctcttaggtcgaacatatgtggcctgagatgacaaaagaaagtgaagggtcttagtatcatgacatccgaagacagttgttactgagaatggaggcttctcaactctccagagtagggaggaatctcagcttgtggctgacgttttaatgttaagttattggaatcaaaataataatagcactctgctctttgtatacaaaacgtgaccatgaaagattgtgtaaatatttcattagactgatggtgaattgttatgttttttacactttaattgaagccacagaattgggtttcagttctgtttctttcagctacatgtgaacactgacaaattatttaactgcaaaattctgtttaagcagcggaaaataaacagaaagtataggatctcccctatctatgcatgaaatgatctgaggaagaaagtcaaatcatcctcatgagctacttcttgtttcctagaggaaaatattagttgttagcaaatttataacaatcgtgatagacttttagcttcccatccccttgaacaagtattctcatgtattatttagtgaacaagcaaatttataaaataagttacattttaaattttctttaaaatagattctgtatacaagctatcttttgagatattcctaatgtttaacatttctgatatccaaatcctctgtgggatgtctaatggtcttcttctgttctttgatgtcttacttttaggttgaactctggatcaaatatgtctgaagtgtcaatggaaaattgagcttcgccattctcgtccgtagtataatttcctataaattcatcattgagctccagttgcaacaacttgttcaccataggtacattattgggatccgaaaatttaagctgtacaagaaaagaataattaatatgacttaaaacacaaaatgtttacatttttacagagaaatagttttctactcataaatgtgatccctagtcattttcctaaattccaacagacagaaagatgctctattaaatacatagatatataatataaagtatggaaaaaatgatactgttatctattgcttctttcaatctaggacactttctagcacctcagacatagtagtgcttaaaatgtattacaaaagtaggaaaaaagtgaccagaaattttcaaagggcaatctatgatccaagaaaatgaaatggaagcatgtattctttagtcaaacctacagttccaaaataagaaatccctcttctgtagaaagtatccatgttctcaaagtttacagttccaagcaattgagtgataaaaactgaggtcttctcactgatctgcatacctgtaaggaatgatgaacacagcagagtgaaaatatctaagttaccatccacagcaatataaatgtgaccagcttgcccagtgtgaatagcatcatgatattgatcaagtatgcttatatagagcactttacaatggcataatcacaaactcctttttaaataacaagaaataattagtagttaaatctgattttcccactccaaattaaataatctctttctcccttctttctggtttttttttttttttttttttgagactgagtcttgatgtgtcacccaggctggaggctggagtgcaatagtgcaatctcagctcactgcaacctccgcctcccgggttcaagcgattctcctgcctcagcctcccgagtagctgggattacaggcattcaccatcatgcccagctaattttttgtatttttgtagagacagggtttcaccatgctggccaggctgattttgaactcctgacctcaggtgatccacctgccttggcctcccaaagtgctgggattacaggcgtgagccaccgtgcccggcctcttctttcattcttttaacaaatacttattgaacactcactttgtgcaatcttgtaaatttttcagtaataatttttgcacttgcaactattcccagttgtattaaattagaaataatctgaattttgtacttagtgctaactcaacaagcttctcccagtaagttgccatacatatatccccaggtcgtccaaaaaatacagtaatttcctgtcccaaattctgtaacaattacagcgacatgaaatgtcatgaacaatcccgaacggtagagttggaagacttttgtatttacaatttgagaaacacaaccattttccaactgaaaaataaagagaaggtataattaaaatgttagagatccaagaggtttttttaagtgtcttttaaaatatggtttttgcacaaatatattaacatccccaccccgtgccacggctctacctcataaacttgttgaaatggccaaagaattagaggaggagtaggaggaggcgaatatttacatcagcattttaaataacggaaggaggtaatctgtattttacagatttcaaggaaattctcctggaaacattgtagatgagaaaagattaaaggatggaaatgaagctgaatggtattgtgaaaggaaagtaaatctcaggagcccaacatccctaagctaaagggaaagggcaagctgggaacagctgggcaaatctgtctcccattttattcccaaataaggtagctacaaagataaaaactacatacctccctcacaatttgcccacaaggaaattctttgtgggcctcaagaacttttccttaaaacagttctttggaaattcaccctggcaatataaattcatagcttatctttacaggcgtgggacaaaagacagactcagtcatccctctgcttacctgagacaaatacatatctgatttatctgattgcttcctctgcctaatagtttatgtaaaaatgcagatttactgagccacactaaggcaggagtgactattcctctatcctcctctcacatgtaatttgtgtattcagtgaaaggctgatcaaagacaaagacttattcttttttttttttttttttttttttagatagagccttgctctgtcactcgggctggggtgaaatagcccaatcttgactcactgcaacctccgcctcccaggttcaagcgattctcctgcatcagtctctcaagtagctgggattacagacacctgccaccacgcctggctaatttttgtatttttagtagagatggggtttctccacgttggtcaggctggtctcgatctcctgacctcacgtgatctgcccgcctcggcctcccaaagtgctgggattacagctgtgaatcactgcacctggcctcaaagacttcttctttatgcaactgtttgtctcttatctacctatgacctggaaacccccttagtttggattgtcctgcctttctggaccgaaccaatgtacatcttacacatatttgttgatgtctcacatctccctgaaatgtataaaagcaagctgtagcccaaccaccttgggcacatgttggtaggacctctggaggctgtcataggtacatccttcaccttggcaacataagctttgcaaattgattgacatctgtctcagatacttttggttcacagtgttttaagaggaagaaattctaatcatctagaaaggcactaaaacagatggaacagaagcgctcagcacatgtgtaacaacaaaacaaacactttttaaggtatattgcttatttaaaataacaaaaaatctatagttaatctatcatcagtaataataattagagaaatataaatttagttatattttataacacagtgtttattccagatttaaaatgttataaggatatattagtttatttgatactcaaaactattacatgagctaggtactgttattatcttactatatagatgaagaaactaaactaggtccatcatgtaacctgtccaagatctcacagctaagagacggtggtgctgaggagctgctctggctccagagtatgtgcttctctatcttaaattaacagccattacatcaacaacaaaagcaattttattttgtctaatgataatatagtcaaattaaaatgaaatcatagaaagtgatcagaagaaccttaattatttcgaaaataagagaaaagccttttttcaggaatccttgaaacaaagagaatacataaagtaaaccaataagaatccagatattagagtaatgaaaaaatacttcgcatcaaagtcaatggtattcagctgcagttcagaagaaatgtaaaacagtgaatgtgcttattactaaaagaaacagctaatatattttttaaaccccaacaaaatcaactacaaatattaggaaaaagaattaataagatgaaagagaaaataaattatttaggaacacaaaataataaaagaaagaaaatagtaaaaataagaaccaataaaatagacgaaactttcgtgggcatgatttaggacaaagagtgagagagaacaaaattgtgagataggtgctaacacaacacagcccacatctggaagaaaaattcccattttagaacatcattggaagtgaactttatgtctattagaaaattgtaaacaatcttaagagcatacttagatagccacatgtacaacacaggggccagtgagattttttttctaaggctggaaacccaggaacataaggaaggtgggtatgtcaaaaatatgacaaagtaaatgagttgcctatttaaataacaggcttgaaaaaaaatgcttgtaggatggaaggcagtacttacctgaaagtttccatttcacatgaacagaaaaacatgggtaattaagagttctcaaatccaaattgataacaaaaatatgaaaagttgctcaaactaaatcgaaattagatagcacaagttaaaacaagctaaatttgtgtctatcaaaatgacaaaaacttttaaaacttctaaatatattgctgaaagtaatttggaaaatatagtattctcatgtacttctgacaggaatttgaatgcctaaaacttttaggagagcaatatgctaatatttattaaaattaaaattatctgtctatgaacattatctatatttcctttgactcaggaaactcactctaagaaatttatttcaagtaaataaagcctctcatatataaagatagttccaccggacagatttttttttttttctttttctgaggcaggtcttgctctgttgcccaggctcgagtacagtggtgcgaacacacttcactgcagccttgacctcctgggctccagtgattcttttgcctcagcctccctgtagctgggaccacagatgtgcaccactgtgcctggctaatttttgtagagaaggggctcactatgttgcgcaggctggtttcgatctcctggaatcaaacgatcctcccgcctcagccttccaacatgctcagattagaggtgtgagccactgctcctagcctctaccagattgtttattggtatttttttcacatggggaaaaaagtaaaccatttgctgagggaacacccatcactgtgtaaaacggttgactgaactctatcagaatgtactgctgacatggaaaaattccaccctagttttctttgcctgcatttcctatgtaaaggtaggattctgcttgtctttgtcaattattgatatttacctagaggatgttcactaaatttgatgagtaactttaggacaattggacttaaaatatgaactatgtggcatacacaagcttcactttggggagtcaaaagacaatttcaaagagataggaagagctgttcacttaaggttaggatgctgcagatagagcaaatgatgacttcacatatgaactgcaagtctaaagtaacatagtgggggtactctgaattgcagttgattgaaagtaagctgtttccactaaaaaaaatccaggtggcatggagagtaatatcacagactcatttaaaggatgattaacgattctccaaagaaaaatcaggaaggctacctaggcgatatataaaacaacaaagcccacgatacctttcatattctaaaaatcccatgaatctataggtggagaacaatttacatggtctatggaataaaaaactgctttaagcactgtattttcttctctttcttcactttatttagctgcaaactccattatcaataaaatgaaaatagtattgttaagctccccttataaatgaaatcaaagaaagaataagaatgaaaaatgagtgagaacttttttttggagtaaagatcatggtctgtacctgtgcaataaattgctcacatatttcattgtcatttttctcacaattgcttgaagaaaaatactctctgcacacccggatttgggttttcccttgcacaggttggccaaaggtgtacctcatgggggaaggtgtagttatgattacagataagcaatatcatagcaatattttatgatcttcttcagaaattatataggaagtctctaaactgtgagtaacccagtctaaccaaattgaattaggaattctccctattggtgagggtttaggttccccacagaattcaggttaaactgggcatttgatctcaggaggatttggctgcctttaaaaaattgaattcagggtaaggcagaatctaaaataatctaaaatctcattgaatatgatttaatgcttaaattgagttttttaaaaatatattttaatctgatagaaacatcataacattgcagcactttcccttttatcagaaaaatatatatgtatataaaacttggatgattcaggatcctgaaacatttccagatcaacattttaaacacgaatttttatttaccactcaataaatataaaggctatggggctggcatgaactggttatgctttgaccaaaaatataataccttacagggtgggtttgagtatctcattttctcctaaaacacaaaactacaacacaagattttaaaggttcaaccaaaggcaaatccagtcaattggagttttttgttttgttaatagacaacaaatgtaaaactagcatataataaaagtgaatattattttcacagattataatacttttttctaattgttggacactgatatatatcatttatttttcccagtgaccctgatttgtaaaatgaggtcaagtaacttctccacattgtaattaatgaaactaaaattcgaactcagatctacctcactccatagcccgtgcccttttctttccactcacctttttctctttctatttaaaaattcctaacacttttgagattctgagtcaaatcataccaataaaatcatgattatataaaggccagacttagatctggccacacatattatacctgaacatttcttcttatttctacttaatgtcttttatttatacaataaaagtcttattgtagtattatctgtaagctaacatatgcctataagacatgtagcttaaattttaaaaacaggacagaataatccctttgtgatttgaaaagctttcagtgaatgctaatgcagtgtattaaaatctctttgtctgtaggtaaattttcttccctcttaaaagcctaagtcatctctgactttgtttgctaaaataatccaatttttttcttgttttctctagtcattccaagctaaatcccagaaaagactaaagaaacacagacacagtatcatacaatttgagacacagtatacaactgacgtgaaccttctagaaacagtgctctcacaatctgcccagaaataactttgtagcaagcacagctccagtctagctgcctggtctcctggcaagatattattattgctgatactgatttactcctatgtaactctatccagaatacaatatcaaagaaatttcaagaaatcaggatcatggattgtaacctgacatactgctaaggaactaccagttccatgttagcatgtggtttgcaagtattttccaaaggccatgcttgagaaacatttttgttcttccaatgtgttgtgggttttgtttttagcatactatcgtgcagataaataaatgagatgttaatgccactgaaagctctggctttgcgtttggcttttctagtgaaacctgtttagtattctggatttcttccaacttgaatttatcacctcatcatttttaacatcagtgatctacacagtctctcatctattacgtatattaaattctggtattttcaactactcttcattaaaacttagaaaaaaatttataatcatttcctaaagtcaaaagaagatttgaaatgctactgaaaaaaaaaaaagaaggctgaaaactggtttgcaagattctctggggcatcaaaggcatcttaagaaccacgcttgcacgttcattagacagccctttaatcaatgtatctttaatagactgctggaaatactcaaaggcaagtaattttcatgtcataaattaaacaaagtgcttaacaaatatggcaaatattaatattgttaactgtttttataaagtatatgacagttattgattaggagagtagctttgaagctgaaaaacctaggtctaaatcctagttctgccatcaacaagctccattactgttgataagttattttaattctctgtgtcttattatctttctttataaaatacagatgacaatagctcctatctcatagcactgtggtaatgatatatgcagagcttaacaaactagttgacattcaaaaaacatttattttattttttattttattttatttttttctgagacagagtttcactcagttgcccaggctgcagtgaggtggcatgatctcggctcactgcaacctctgcttcctgggtgcaagcaattctcctgcctcagcctccccagtagctgagattactggtgcctgccaccatgcccgtctaattttttgtatttttagtagagacggggtttcgctatgttggccaggctggtctcgatctcctgacctcggatgatccctcccccaccttggcctcccaaaatgctggcattacaggtgtgagccaccgtgcctggccaattgtttataaattattattagaaattcgagaaaaggcactaaaaaagaaaaaaaaattaaaaataattttccaaaaacaaaatacaaatttctgaaatcgtgtattttttttacattaagagaattcaaataattcagattaacttgataagatgctttgtcttcactttgccatttcaatagctcatattctaattttaatgaaaatatgccatgatagtaaagattcaatgagaatttcacaccagctgctagaatcctacactggcacaacatgtttagtgaggagtatggcaatcagaagactaaaagaatgttacatattttgtcttggtaattccttttctggaaatctttcttaagtaaacaatttttcattcaaaagctacctattatatgttatacacaaagacatatactgcaaaattattaattaccaggaaaacaaaatgaaacagccaacatattatataataaaataattaaattgggtatagtcacataaaaatatgtgcagcagaaaattggaattcatgaaaagattggcataatacgtaggcatgttttcttaattattataaatagaaaagtatgattgcagtcatggaaaatattcattaaaattagaggaaacttacaatgttagtgacattacaatgttaatggcagttggtcaaattaataataggtaatgtcttgtgtttttctctatatttttcaaattttctacagtgaggattcattgcttctctaataacattaatgtaagcatataaataattaaagtttcatggttaatctcacttctcattctctctgagctttgtgttttcttgtgaaggtaaatctcctgaagaaatactcacttagcacatacatccacttggaattcatcatctgaaatagttactgtttgtggtgcattgaccgtaacttcaaacttgggcagcactggaaacgaagagaaatatacgttagcctgcacaatcacaggcaagcaaaccttattgcagtcatatagcttactatgattccttgtaccctccatctgtatgagctatgtatcatttgccccaaattgtgtggcaccattctacatggtggtgtctcactaatgattaattcttcctctttcttttcttttccctatcctcagaatttcacattttgtttctttttgtttgtttgtttgagacggagtttcactctgttgcccaggctggagtgcagtggtgcaatcttggctcactgcaacctctgcctacagggttcaagccattctcctgcctcagcctcccgagtagctgggattacaggcatgcacgaccacgctgggctaatttttgtatttttagtagagactgggtttcaccatgttggtgaggctggtctccaactcctgacctcatgatccactcacctcagtctctcaaagtgctgggattacaggcgtgagccaccacacccggcctcacattttctttctattgcaatctcttagatctctcctagaagactgtggggattctagaaaaaatgtatattttctagggggaaaaagaaggcaggaatcagaataaggatactggggaaggagtgaggagcagcaaagtgctgatgacaaagccaaccaggtcaaggaagggagacaaagaaaaccagttctagcttcacctactcctgcctaagtctaacacaaatgttgtgttggtccatcctttaaactcttcatctacataggacagctacaaatagcaactggttaccatatcttttaacagcaaattggtgtgtcactgtcttccttgagtttcttttcacaacaatccagtaatctccaaacattggttctgaaatcagttggaacgagagttgggtaatatttcggaaagaagtcacattttgccattgaaaaatccgattgttttgaggatcctagaaaataatgaaaaaaatataaacaatcagaatttgtatgagagtattaccctttgctgccatatttcggatagtttcggatagtttcacaagggttattttaggccaatattttctcttatgaaacaaacaagtagcttttggtagagcctgtgagggcttaagaaccctaatgtctataaatcttagaggattatacactatgctttggtcatacaaacttgtactgcctttattcttttttctttttttaaagtattgtaattgtacatacttaaaggatacaattggcggggcacagtggctcacacctgtaatcctagcactttgggatgccaaggtgggcagatcactagagccaaggagttcaagaccagcttgggtaatattgtgaaaccccatctctactaaaaatacaaaaattagttgggtatggtggcgtgtgcctctgtaatcccagctacttgggaggctgaggcaggagaatcgcttcaacgtgggaggtgaaggttgcagtgaaccgagatcataccactgcactccagcctgggtgacagagtgagactttgtctcaaaaataaaaaaaaaagtgggggggtacaatttgatgtttcaatacacacacacacacacagacacacacacatatctatatatttagtataatgatcatattggggcagtgttaccagtacttcattcatttatcttttttttttatggtgaagacattcaaaaacctctcatctagctattttgtaatttgctaaatcttactgtaaactattgtcatcctactgtgcaatagaacaccagaactcattccttcttcattcttttcagattaaataaaattttaaaacacttgtagagtgtcagatgtgttccaaggactgatccaagtgctcaaggcacaaaaatgtatatgacatgttcacagcccatattagcttaaaattttaagccactgtgctccttgttattatagtcatataattttcttgcattatggctgcaattcacattctgtaatcagggtatagatgtctaagtaaagtgttggcttaataattgttgttctaatcaaattgaattacacgttaacaaaacttacttaaattttccttgtatatttaattctatctcttcccaggccaagtcaaaaaaaatatgaacccttggaagaattacatctagaagtgaccagtcctagtctaaatatttaaatacataacatgaggaattcaggccaaaagtttattctgataggtctattttttgatgtactaataaaactggccatctctgctatagttttgctaacttgttgcagaagtaatctcaagaagaaaacagccctattagattatgtttaggatggatagttcaatatatattttgccaaaatgttatattgagtttacacaaataaacacacacaagctgtcataataagttcatttagcaactgttttaggatagatttttattctggaagatccataatgaattatattttatatgaagacagggctaccttttgcgtcaatattttgatattgaagagtgctggtacatcaataaagtacttgtatagtaaacaaattaaagatgttttgtgaactagctaggccttgaagactcacagggcttggtgtgtaatactgtcattcttagagataattagctccaggttgttctttctgctggaattgtgaattgcaaatccattcttatcagagtgaaatcagaacttcaaccctaatcaaaattgattggatgaattattgagtgttacaaaagtgatgcaatgaagggccctcatatttttgacattcatttttattagatccttcttatctggagattaggtatgtgagaagctcggagaaataatcttagaagagccaagcagaatttttatatctaaatccatgttacttacatagaatatattgttctttaaatataaaaatctataaatctgtacaagaccaatcgatacaagtaaaaaaaaatgtctgatcctgcttgaagtaaattatcaaagccatctacgttgagagatgaaatgtattacgtctctcctgctaacttgaggagtaaaggaatttactaaaaagttactaggatgtttttattccttttctttttttttcttgcagtgaagcctgtagatccttaagattctttaccagttgtgtggtcttaatttcacaaattgaggaatctgatccatagatggttccacttgaacgtggtgggagggtaacattctccttccatgaaatgtaaagactgcattgtgggacatggaggggctccatgagatccatttagttgcattcatcctcctgtccccaaagtatatcagtaaatgtactgtttcttgacagtttggctgtgttatcccagaggactggatgtgggaatctccaaatggccagataatactctcagcttccaattcagtgaaactattcttaagcatgttaatgaaaatatacttctttcctggatcctaaaaggtctaaatgaaaacaactcctattcctgaggatggaaaacaagtattctgcaaaagccactaccaatccgtaccttggttcccagacatatctctagaagagacagaaacaagccctttaatataatttcattcctcaacttccttggaattagtcccttaatgtgtcttgttctaaatccctgatcatcttgccacacatttgttaaggcttataaaagagtgtacatctttacctcaggccatttgtagacttgtcatatactttggtaatttcccaacatatgcgtttcacttccagtaaagaagttagaagactccattcccagattaccttgaatccagggggcaggtaaatgacaggctcgaccaatgagatgctctgttctgagactgggaatcagaagggagtgaaatggggaggccatggaagagtttattttcagggaactgtgagtataatggcaacttctagttcatttaggataagataggcagaaccttttcacatccactccaatgtgtttattccacacacgaggagccacagtgggaattctgatcattgctagacttgtcaattatacctacacatttggaaaatgaataaataaccagaagatggatctggtctctgttagtcctacaatgaagacaatttggccccaaattctggttattcctgatagtcataatctttgcctctcatctcagatgttattagtgaggtaatattcagtattttatagaatatttagatatttatctttccaggagctcatgtgctttggtaatgaggcagaatgtctttgagaaagataggagtgagaccttagggatgggtgtctgcctaactgaagtggactccaatgaaaattatataaatatcaaggcatgaaaattcagcactccctatcacgcactggtgaaaaagataatcaaataatctcctgttcaccattgacaaagtgcctattgacagcaagcatttggggaccacaaatttccactgctatggaacgataccaggctgatcacttctaagagttctgagaaaattaaagaaaagaaaaacaagctaggaactttaaattagcccttaccatccggagttctgtaacagaattatctctaagtctccaatacagctactgaatgtaatgaattaatattacatttattgatgcataaatagtaccattctctcctatgtatcctgaatggtactatttatgcatcaaatggtctctcgaaacattctctgtggagttaaacaataaagcaattttcttatataacagttgagaaaggttgctctaaatttttggttgaagatatacattgaaaagtgagtactttcaatttttatgttaaaactctcatttattgcagagcagttctgtaatcaaaatgcctcattattgtatgtgcttagatagaggctgataatttacctgtgagggattttttaaaaaattactgactgtggaggggaggagccaagatggccgaataggaacagctctggtctacagctcccagcttgagcgacacagaagacggtgatttctgcctttccatctgaggtaccgggttcatctcactagggagtgccagacagtgggcgcaggtcagtgggtgcgcgcaccgtgcgccagccaaagcagggcgaggcattgcctcacttgggaagcgcaaggggtcagggagttccctttccgagtcgaagaaaggggtgacggagggcacctggaaaatcgggtcactcccacccgaatactgggcttttccgacgggcttaaaaaacggtgcaccacgagattatatcccgcacctggcttggagggtcctaccccacggagtctcgctggttgctagcacagcagtctgagatcaaactgcaaggcggcagcgaggctgggggaggggcgcccgccattgcccaggcttgcttaggtaaacaaagcagccgggaagctcgaactgggtggagcccaccacagctcaaggaggcctgcctgcctctgtaggctccacctctgggggcagggcacagacaaacaaaaagacaacagtaacctctgcagacttaaatgtccctgtctgacagctttgaagagagcagtggttctcccagcatgcggctggagatctgagaacgggcagactgcctcctcaagtgggtccctgacccctgacccctgagcagcctaactgggaggcaccccccagcaggggcacactgacacctcacacggcagggtattccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaaacagaacagaaaaactggaaactctaaaaagcagagcgcctctcctcctccaaaggaatgcagttcctcaccggcaacggaacaaagctggatggagaatgactttgacgagctgagagaagaaggcttcagatgatcaaattactctgagctacaggaggacattcaaaccaaagggaaagaagttgaaaacttggaagaaaatttagaagaatgcataactagaataaccaatacagagaagtgcttaaaggagctgatggagctgaaaaccaaggctcgagatctacgtgaagaatgcagaagcctcaggagctgatgcgatcaactggaagaaagggtatcagcgatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgatggggaaaatagaaccaagttggaaaacactctgcaggatattatccaggagaacttccccaatctagcaaggcaggccaacgttcagattcaggaaatacagagaacgccacaaagatactccccgagaagagcaactccaagacacataattctcagattcaccaaagttgaaatgaaggaagaaatgttaagggcagccagagagaaaggtagggttaccctcaaagggaagcccatcagactaacagcggatctctcggcagaaaccctacaagccagaagagagtgggggccaatattcaacattcttaaagacaagaattttcaacccagaatttcatatccagccaaactaagcttcataagcaaaggagaaataaaatactttacagacaagcaaatgctgagagattttgtcaccaccaggcctgccctaaaagagctcctgaaggaagcgctaaacatggaaaggaacaaccggtaccagccgctgcaaaatcatgccaaaatgtaaagaccatcaagactaggaagaaactgcatcaactaacgagcaaaataaccagctaacatcataatgacaggatcaaattcacacataacaatattaactttaaatgtaaatggactaaatgctccaattaaaagacacacactggcaaattggataaagagtcaagacccatcagtgtgctgtattcaggaaacccatctcatgtgcagagacacacataggttcaaaataaaaggatggaggaagatctaccaagccaatggaaaacaaaaaaaggcaggggttgcaatactagtctctgataaaacagactttaaaccaacaaagatcaaaagagacaaagaaggccattacataatgggaaagggatcaattcaacatgaagagctaactatcctaaatatatatgcacccaatacaggagcaccaagattcataaagcaagtcctgagtgacctacaaagagacttagactcccacacattaataatgggagactttaacaccccactgtcaacattagacagatcaatgagacagaaagtcaacaaggatacccaggaattgaactcagctctgcacggacctaatagacatctacagaactctccaccccaaatcaacagaatatacatttttttcagcaccacaccacacctattccaaaattgaccacatacttagaagtaaagctctcctcagcaaatgtaaaagaacagaaattataacaaactatctctcagaccacagtgcaataaaactagaactcaggattaagaacttcactcaaaaccactcaactacatggaaactgaacaacctgctcctgaatgactactgggtacataacgaaatgaaggcagaaataaagatgttctttgaaaccaatgagaacaaagacacaacataccagaatctctgggacacattcaaagcagtgtgtacagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgatagaccgctagcaagactaataaagaaaaaaagagagaagaatcaaatagacgcaataaaaaatgataaaggggatatcaccaccgatcccacagaaatacaaactaccatcagagaatactacaaacacctctacgcaaataaactagaaaatctagaagaaatggataaattccttgacatatacactctcccaagactaaaccaggaagaatttgaatctctgaatagaccaataacaggagctgaaattgtggcaataatcaatagcttaccaacgaaaaagagtccaggaccagatggattcacagccgaattctaccagaggtacaaggaggaactggtaccattacttctgaaactattctaatcaatagaaaaagagggaatcctccctaactcattttatgaggccagcatcatcctgataccaaagccgggcagagacacaaccaaaaaagtgaattttagaccaacatccttgatgaacattgatgcaaaaatcctctataaaatactggcaaaccgaatccagcagcacatcaaaaagcttatccaccatgatcaagtgggcttcatccctgggatgcaaggctggttcaatatatgcaaatcaataaatgtaatccagcatataaacagaatcaaagacaaaaaccacatgattatctcaatagatgcagaaaaggcctttgacaaaattcaacaacccttcatgctaaaaactctcaataaatcaggtattgatgggacgtatctcaaaatcataagagctatctatgcaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagacgatatgattgtttatctagaaaaccccattgtctcagcccaaaatctccttaagctgataagcaacttcagcaaagtctcaggatacaaaatcaatgtacaaaaatcacaagcattcttatacaccaacaacagacaaacagccaaatcatgagtgaactcccattcacaattgcttcaaagagaataaaatacctaggaatccaacttccaagggatgtgaaggacctcttccaggagaactacaaaccactgctcaaggaaataaaagaggatacaaacaaatggaagaacattccatgctcatgggtaggaagaatcaatatcgtgaaaatggccatactgcccaaggtaatttacagattcaatgccatccccatcaagctaagaatgactttcttcacagaattggaaaaaacgactttaaagctcatatggaaccaaaaaagagcctgcatcgccaagtcaatcctgagccaaaagaacaaagctggaggcatcacactacctgacttcaaactatactacaaggctacagtaaccaaaacagcatggtactggtaccaaaacagagatatagaccaatggaacagaacagagccctcagaaataacaccgcatatctacaactatctgatctttgacaaacctgagaaaaacaagcaatggggaaaggattccctatttaataaatggtgctgggaaaactggctagccatatgtagaaagctgaaactggatcccctccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagccaaaattgacaaatgggacctaattaaactaaagagcttctgcacagcaaaagaaactaccatcagagtgaacaggcaacctacaaaatgggagaaaatttttgcaacctactcatctgacaaagggctaatatccagaatctacaatgaactccaacaaatttacaagaaaaaaacaaacaaccccaacaaaaagtgcgcaaaggacatgaacagacacttctcaaaagaagacatttatgcagccaaaaaacacatgaaaaaatgctcatcatcactggccatcagagaaatgccaatcaaaaccacaatgagataccatctcacaccagttagaatggcgatcattaaaaagtcaggaaacaacaggtgctggagaggatgtggagaaataggaacacttttacactgctggtgggactgtaaactagttcaaccattgtggaagtcagtgtggcgattcctcagggatctagaactagcaataacatttgacccagccatcccattactgggtatatacccaaaggactataaatcatgctgctataaagacacatgcacacgtatgtttattgcggcattattcacaatagcaaagacttggaaccaagccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcacaataacaaaaaaccaaacactgcatattctcactcgtaggtgggaactgaacaatgagaacacatggacacaggaaggggaacatcacactctggggactgttgtggggtcaggggcggggggagagatagcattgggagatatacctaatgctagatgacgagttagtgggtgcagtgcaccagcatggcacatgtatacatatgtaactaacctgcacattgtgcacatgtaccctaaaacttaaagtacaataataataaaaaaaaaataaaaataaaataaaatagcgtcctgatgttctgctcttttcctttatcttgttttattttccttacagtagttctttgagagatagtaactcacgatagagaaacatggtctttgggatcagaacgtctggattataatcccatctctgttatttagcatctgttgcattggacaagttacttaacctgcctaagcttcatttttctcattgataagttgcagttaatagcttccaatctatagactgtgatgaataaatgggttgacatttgtaaaatgcttagaatgttgcttggtatgtagcaataattcaggaaagattaactatcagagcacttaataccatctgaaattatgccattgatatagtttgaatatttgtcccctcaaatctcaggttgaactgttatccccagtgttggaggtggggcctggcaggaagtgtttgggtcatgggggcagacccttcattgcttggtgctgttcttgcaatggtgagtgacttcttgtgagatctgattgtttaaaagtatgtgatgcctctcctcttcttgctcccatactggccacgtgagacacttgctcccccttgtctttcaccacgactgtaagttttctgaggcctccccagaaaccgagcagatgccagcaccatgtttgctgcacagcctgcaaaaccgtgagccagtttaacctattttcttccttttttttttttttgaaaaggagtttcactcttgttgcccaagctggagtgcaatggcacaatcttggctcactgcaacctctgcctcctgggttcaagtgattcttctgcctcagcctcccgagtagctgggattagaggcatgcaccaccacgcctggctaattttttgtatttttagtagaaacagggtttcaacatgttacccgggcttgtctcaaactcctgacctcaggtgatctgcctgcctcagcctcccaaagtgctgggattataggtgtgagccaccgcacttggcccctattttctttgtaaattacccagcctcaagtatttctttacagcaacacaagaaatatacaaatgacaatatgcagccatttgtatattgtctgcatcccaaattcaatgtaaacttcacgaatataaagatttacctgcattattctcactgtatttctaacatctgacatgacaggcacattaaatgaattaaaagacaaagcaaaagaaaataatcacctcccctcttttcccaatcagtttaaaagcattaagagattataacctgtcacctgcccttcgcattatactgtgacttacctaagggtatgtaatcagtagattcaagatggttagaatccttgcacaatactggtttccggaggtgagagttggtaaaaatctttaatcctgttgcctttcaagataaaatcaattttagatcacataacaacatagactagcagtctggactggttttttgttctatgtatattttcaatttccacttatttatttctccatctctaattgtcatatatttagagatacttcactgacatttcctaaattccatgtctttgagttccttagtttctctaattctaatggcttttgctctattttcctaattaagagctgttgatgaaaacctttaaataagagaggacaaaaaaagacatctcatatcataccccactgtactttcactactttgaatttggcatttttgttgaactagggatattatctcacttataaacactttaaatatagtagaatactttaaaatagtagaaatcaaattcgagggtagacgtaggagcaaaatggggatttatattagacaccagtatataatgtacataatattatgtcaggaaagctgataattccctcacatattagttcttttcctaatattataatattattagttatttaaaatattattatagttttataatgaagttctaataaccttataacttaaccttattataacattataataaccttataactttataattataactttataacttttaaataaaattatattaatacaacttttaaaaatatattataactataatttattgtaactatatagaataactattatagctttataatattataactattatataattataactataagaactttattaagtctttttgctattataacattatttgagatattatttctcagacattagtactaattgtaaatttgtactctaagaattctgagattaaaaacccacaccatgaatatttctatttatttatatattgtcacatatattcaccattttaagacttagttgccttaccttcacaaggtcatagccatcttttccaaagtcagcccatgcaggtgtgtaataaattccattgtaaaggatatgtccatcttcaagacacggcactttaaggccatcttctaagttaagtcctctgaaataatagccatgtagttcgctggaatgtagctgactatacacctagatgttagaagagaatcaactgtattttttcatagaaaacaattcatttttccccacaagcagtatataaataacctatataatcctatgaatatcctgtgtagaactgtcatcatacctataccaaataaacacatattgagaaagtataggatcttagatctgtaaaaactttgaaatactatttaatcagttaaataactgctggctaaatcacattaaaactaacaaaaagtccatgaggctcaactggattttaatacattccagataaaggcactgctcaatactctttgaggactcattcaaggacattgttagagaatgttctcggttaatttactaaatctccctgagcctaagattagacattaatcaaaatgggaatactgcattagttctatagggttgattaatatgagaataaaattaaataatagatatgggaatactcagtagagcaagtgtcaaatagtagacctttagcaattgttatttatttttaaaagtgttgctcattttttccataagagaatcagtataattggagtagagtcattgtacatgatttctaacctaaaatattttttatgcctggaactctggacaatttttttctcctctagtttatttaaggtatcctgtttttatccaaaggtaaagacataaaactatactgtgggtggtaaacaaagatggttttaatcactcacagtttgtgctggcagctgaccataattccttagtagcaataccctctggtctaccgcccaaagagcataaagagagtttgaagcagccgagacttgaagatcgacattggatcctggtaaacttttttctttagaaaaatttaagttgacctgaaaatgaaaataaaagggcaaaaggatggcaagccatatgagaagaatcatcttttagactattcttaacttttttaaaaacacacataagttaaaagggctttctgtgctttacccacctaataatattattattaggaacaactggatttggaacaacatccaaagtgaatgctataatcctgctactcttcaatcatccaacatattaacttctccatagctttcttttatttttcattttgcaattctatgaaaaattgggagtttaaacccaacactctcttaagttctccttagttttcccccaaattaaaaaagaatcatttttggcacctacctgattttcgaagcatttctcaattggaattgggtgctatcagtgaccatttctcctccaggatgcaagctatagacaagcatatgtactgagggcgctaattcagggttaatgtctatagaaatggaaaatatgcccttcctccctgtgaaaagaaaatttcaaaccgaaaaagtgctttggtgagatagctgactgtcatcttgcagaaaccctccattgagtttctagccatcctacccactgccaaagagactgccccgacccaccaaatttaatttataaagcatttctaggaggagttcataacctattccataaattataaaagaaagaaatagttgaacatttcttattacgtcaaacttcagtctacttttgtttctttttaaaaatcccttcttgtttgaatgtaaaagtacttacctgtctttcttggaaaagaaagggaaggacaatgaccctttcccattatagtagtgtttggaatataattaatgcactattaattaagtaattattttttcatttggcattgtgcctattcacatgtctttacatgttccccaagggtagtttagggggcagtaaacagtcctaaaatgggaggattgtgacttttaaagaaaaatgtaaaatatatcccaattaaagcattctatttgtattaaattatatgctaaaattagaggcctcaccattttcgttgatctcaattttctgttgcccatgaagaatgattacaccttttgaaatcacctaggaaaatgaaaatataatcgtaaagtttagaggatagaaactaaatttcatttaattataaacgaatgtgatttacctccttttcttgtctgagcaatactattgacatgtttactagtaaactcaggttaccagtaaacaagcatatgactctaacagctatattcaagagaatttaggagtcacagataaacttgctataaagcaatttaatgttccacattccaaaacagttttctaagaccaataaacaactttttattcatatttgcaaatgctgaattacatctaaatttatttagttcagtgaaacaaagttacacaaaggcattaagagtctcccagtgcttgtctggttttctgaaaggtgtgtttgatatgcaaggtataagcaaggcctgttcatccatctccacccaaaatttaaagaaaagaaaataaagtagcaagctgggggtgctccagaaaaaagcttctctcacttcacctttatcagcaactgtgtgcaaatttgcatcagcagacttttgttatgatctctaaagtgcaaacaaaggctggagacttgaaatctagtacaaactccttgaatttttaaattacagttttagaatattattttaaaagatgctgagacttgcagaaaatttaaagcttccgtaagatcttgcagcttgaaattgcaggagctggtactcctagtccgtttaatatttcactgaatattaaaattgctttaaatctctgaagtgccaagtttgggttattagctcataaaaaaagaactgagcctcaactagctggaaaatattgttttgggaactagaacatttgcaaaaaggcataaagctcaaagtttaatgagcctgagaggtctcagcactgttggctgtagtagctcactgacttctcaaaatggaaagacagctctcgtaacagatgagtaaactgaagaggcacacagaggtactgatatttgtcaggtcacacaattaagaaaaaagcttaaaagactgagtatcaaattaattactgaaagcctgagaatcaaattaattcagcctctatccattcattctaaaatatgatattgagggttctctctgtgatgtgtaccctgctaggcagaattaaagtccacccagcctattatgaaagaatatgtagaagactggaattgtctaggagattagaaagtttcatttaagccaagagatgaatgctgaggaggaatcagctcggaaaatgaggtgcaggcaggttgggaactgtggtagcaaatgggaacgaagattgttatgggcagaagggaaaacctgtgggaggcttcggagccagaaaagcacatggcttgtccaagaaaatgaaagccctctgtgtctgcaataaagaaggctgaagtgtagaatgatgcaaaatgaagcgggcgagcttcacaggtgcagagcagatacagtgttgcaggcaaaagaaaggagtctggtatttgtttcaatagaaataggcagtcattaactgtatttcaattaggggagtgaaataaataatcctaattgctttttttaaaaatcactctagatttccagaataaagaaagaaagaagaaaaggagggaggaaggaagaagggagagaggaagaaaaaggctattagcagactcatttaaaatggaaatgaggtaaagtaattgtaaaggccttatcagatcagaggggggcaaacctacgctatttcaagagggaagctgatgacaagtagatcaattcacaccacagacctgcaaaatggctcagctctggattaggaagtattggatattaagtcgagcagaggtgtggccagaaaagaaggcaaaagtcaggggcatgtgggagtgtctttataaaaactagttaagaggttcagcttccctgtaatcccggtactttgggaggccgaggcgggcagatcacgaggtcaggagatcgcgaccatcctggctaacacggtgaaaccccgtctctactaaaaaaatacaaaaaaattagccgggcgtggtggcgggcgcctgtagtcccagctactcgggaggccgaggcaggagcatgccgtgaacccaggacgcggagctttcagtgagcggagatcgagccactgcactccagcctgggcgactgagcgaggctctgtctcaaaaaaaaaaaaaaaaaaaagaggttcagcttctcattcaaggatgcttggtatttctcacaccccagtatggcaatattattgttgacatgttgaaggatttctgtaccggttggtaaagagccacttccctgagctccccagagtcccctccctgcttccctagaacctctcctccacaaccagctcctcccactcccaccactttgcccccagtctaaatgagccatgcttggcttagctaagggcttcagtggaattatcactcataccttttctgatggtttggtgtccataccttgctggtttgaaatattttaatgtttgtggaaatgatgaaggaaagaaaaaatgcgagagataatataatgaaaaagtgatagaaattggtgatgcagtaaatagcacgaaaaaaagaagtatcaaaagactattccagaattctaagtttgcaaaatgtgagaaatcatgtggtactactttcattcttcacatagatagactcaaacacctttagttctcagaataatacacttcagacatctttgacctcttatattatttcctaaaataagcttaaatgtgtttctcatatcctctaatcatccagaaaactcctattcatcccacaaaatcctatttaggcatattctctttatgtattttttccttaaaaatatgtatatacatataaatgtaaatatataggcatatatctttttcctaaactagtggttgtcaaattttaatgtgcttcggaggacaagatttctaacttattcctatgttttttttttttttttttttttttttttttgagacagagtcttgctctgtcacccaggttggagtgcagtggcaccatcacggctcactgcaagctccgcctgctgggttcacaccattctcctgcctcagcctcctgagtagctgggactacaggcgcccgccaccatgccaggctgatttctttttgtatttttagtggagacgcggtttcaccgtgttagccaggatggtctggatctcctgacctcgtgatccgcccatctcggccccccaaagtgctgggattacaggcgtgagcccctgcgcctggccacttattcccagaatttctaaattattcctaggtgatgctgatactgctactctaggaaatatactctgataatcactgtcctaaactccagctagagttaatcattcatttttctgtaacacctcagtggccatacatgtttcgtttgtaacacttatgtaattctaatatatgttttgtccccagttatactttttctatttcttctattgttacaattgctaatacagcacctggaatatgaaaaacattcaataagtgttggctgattgaattaattcatgtttcattaattttatatcatcttcctaaatctcaatgaagtatcatgcacccatttagacagtgtaaaataatccataatagcaatatattaaaatcaaactaatacttaatatcttttgtgtgccagaagttgggcaaagggctttatatgtattattaaataattatcttgatgattagacaatatattacaaaaaactaagattctctagaggtttaagtggctttcaaaaagtaacacaaagctagtacatatcagaactctggtttgatcccagcaatgtccaaatagaaatgggtaactctgaagaaagggtctgagaatgacagagtgcatatgggttgtggtgtcatggccttttccctcctttcttaaaaatagataccagttatataagttttatcatttatgttaactttgagcttcctcgtggcatataggtacagggatttcattaggttcaaagaagttttaaagaaaagaagcaattttgattgtggaagaatattttcagctcataccaaataattgaagtctgctgtgtaggttttgtcttcaaagtcttccatattgagaatgcagtgcactagcaccctcttctgctggttgcatctcagttcttccatctcttggacaatctttaggaagctattcatcttggagtaaaatcgatatgcaaagtactcgggctgagggtattgaggcaacacccagccatgagcctggcaattttcattggccttgtaggctgcctagacaaaaaatcaaaattacgggtattttaggataaagagaaaggatgagtgaaagaatatttgataagatggtttatcatcatgctgctttatctctgcaagaaaattttatagccattctacattaaatctaacccaattccccattttctagttatactctagagcgaccactatggtttttacaatttagtctattcaagtcctacttcaataatattacattcaatattttactgtattctttactataattattacttttgctagcaagtagattgctatatctccctcactataatacgaagaacccatgagtgcaaacgtttaccttgctactgataacataatatgaagttttgctgaaagatgggaaagtttttatgaaatacagcaaggagtttactctgaccatagtaatttaccattatcaacacaaaaagtctgaggagtcctttaaaaatatctaggaaggattgatatttaattattacagatagtagtttacttctctcttgaatatatccagagaaattctttacattattccaaggtaatagattacagggtttctcaaatatttccttctataaaaacacaattctctttctatttccttaataaaagtgaagcgttgcttattttcagctaattctcctttatacaatttagtatgtatgctaaccttctgtcttttcccgggactcttaaaataatttttaacctacttttcatagggcctatattcttaatatttaactatttttcagtactctagattcacaccaaggtgtatcttttcatttctgttccataaatataatttcgcatagacctaaaccttagctagccagtgcagttttttgtttgcttgtttgtttttattttacttgcctttcgtttaacttactttcaaagtgatatttgggtatgtaaacgtatatgtgtccaagaaaaactgagcgatgccatttacatctgtggtgtagtttcccacgattttgtccttcagatgcaactgaacaacttcatttgggattggagagttgtctggattaagcaatttaatctgtacaagaggaagaaaatacatttcggaagcatgtagtaaatttgggcatccattttgatggcatttgccaagcttctatcatggggacccctgctctccttggtgcgtatgcacttcctgtgtggtttcatctattcctgttgagtgtatgacatgtaccattaatatactaatgagcctaaactctgtttctcctgcccacgaagatctctgaaaactcaggcccatagaattaaccatcctgagtattttttataataaaaatgctacagaaactctcaaattggaatgatttattactgtgcccaaccttcctttttttctatttctcttatttatctcaaagaatacctcaaccattcacttagtcactgaagtcaaatatctagagacatcttagactttttatttttcttctcccataattttcaattgttgatcaaatattttcaattgtatctttttaacattttctgtttccaactgatcacgtttgttcctgttgctattccttgtatcaatatcttatcttttttccctcatacgtcttctatttttttctatccagtctctctctcctgtattgcttttgcttgttctttctctatactggcatcaaaccaaattttctaaaatgcaaaatttagcattatcctccctaaaacattgtagtgactgctctgataggccatggttattcgctagaaatctctttctcattctcttactagtacaggcaatgattgctttaaaaagtcccttctgaaattgtatgatttgtagtagatacaatgcctgcatcagtatctatgccagtttgaagcctttaaaggcaccttcttaacaacatctaaggccacaacaaccagaagaactgtctgagccatcctttttttagctcagtcagtttctgcaaaacaacttctgctttgagcctttcatcttatttctgccacttatcattttcctgctggtccaagcaaacacaatccttttttcttgctcagcatctgtagactgatgcctcatttgcaccatctacacagattttgaacttagtttcatctcaaggcttgatcttctaagaaaaattcaacttgtctcagcaatccacaggccacagacacgtgacaccatgcctttatgatcacacagaggtttgccctaattttagtacacctagactagaaagatcctttgagtcccttccagtcacagaaagatgaacaagccatgtgatttctgggcactttcctttctttctttttttttttttttgttttatttttattttttttattgatcattcttgggtgtttctcgcagagggggatttggcagggtcacaggacaatagtggagggaaggtcagcagataaacaagtgaacaaaggtctctggttttcctaggcagaggaccctgcggccttccttagtgtttgtgtccctgggtacttgagattagggagtggtgatgactcttaaggagcacgctgccttcaagcatctgtttaacaaagcacatcttgcaccgcccttaatccattcaaccctgagtggatacagcacatgtttcagagagcacagggttgggggtaaggtcaccgatcaacaggatcccaaggcagaagaatttttcttagtacagaacaaaatgaaaagtctcccatgtctacctctttctacacagacatggcaaccatccgatttctcaatcttttccccacctttcccccctttctattctacaaaaccgccattgtcatcctggcccgttctcaatgagctgttgggtacacctcccagacggggtggtggccgggcagaggggctcctcacttcccagtaggggcggccgggcagaggcgcccctcacctcccggacggggctctgatgttagggcttaaattgatttatatttcaaagaattccctaatagattctatagtagcactgaagagtattctattgtaaaactcagaggaaagcaaatgtaattttctttgaacatgaaaaagaaagcaactttgagagtagtcatttagcagtagatgtgcattattatgagaaaacagttctataaattcagggttaattctattaattggaatgtcggtctctaatgtctagcttattatagggtagaaaagagctttctactcagctaatcattaatcattgatccaaaacttaaatacatctatcatttcctggggctattgtgagtactgtatatgtatttagcaaatatttaagacctagtaagtgctcaataaattgtagctgttactacaaaagaaaaaattactttttaaaaaaatatacaaccataatcacacatactagagaagaaaacttaaaactctaagtaattcttaggtaaaaataaaaataaaaataatgaaatcatcaaaaatgattttaattgaacttaaaaattgttaagatggtaaatttgatatgtgcattttttcataatttaaaaaataaaaatagtatagaaaaacacctgtgaggaggaaagaagtattcaggaaaaattgtataaatctgaaaacatggaagtttaacataagtatttataacaagatgctagaaaaaaaaaaccaaaagaggtagaagaaaaaatataataaaaataaatgatgtaatgaaaatcatttaaaataacattaaaaataaagataattaacaaatccaaaaactaatgggaaaaaaacacaaacacaactagtaataaaaaaggggaaataaattatgatagatttattttttcaaatcataagtgaacatattttatgccctctattttaaaacctaaatttaataagaaatatctagatacagaaactaacatattatagaaaattcttagtgaactaaaaaaggaaaattttttgactcgataaagtatgtctcacaaaatgctacagttacttagtaggtttacgcattacatttttaaaagcattccccaaaatatgcaaaatacaaccaggaagtccactatcatctctaatattcaaattggagatctttgccaatcgaataaaacaaactaataacaaaaacctcagaagattaagttcagaaaggaagctaaaatataacattttcacacaaaatgctctttacacagaaaacacttttaaattgcacagaaaagatacaagagacaaatgggaacccaagaaatcatcttgggtaacaacaacgtaagagggaggaaatggagaattctcaagtctagataaaattattttatattcagaaaaaattttatattctttgaagatatctctcagttttatatatttagtaacagaacatggaaatatataaagcaaaaatgtacaaagtgaagagaaaggttagaaaaaattatgttaacattatccaccactattcagtaagtgaagtgaacatatatcaaatttatctatctgccaaagctgtatttcaatctaaatttgttcattaaatgacttttactgaaatttgtttcagtaagtcctttaggtgatgctgatgccagtttgagaaactgctttgtaagatgtaagccaggctacccacttttgtatttcttttttagtgttcttgtgtcaacctaaatattacttcctcagggaaactttccatgatcatttagtccagattttagcaaacttcttttgtaaaacaccatggtctctctctcatatatttttttattttttaaataatcttttaaaaatgttaaaaccactcatagttcactggctgtatcaaggcaggcctctgtctgatttgcctatgggctgtggtttgtcagctcctgatgtagagtagttaaatggtcagtatttcactgacatagcacctatcacaactacaataattctttgtaaaattatctgtttaatgtttattatctctattacactataaactccataaaagcagtgataaaagtgcctctctacatcaccattttattcctaatactgatatagactatataatttattgtccaaacttggacacttttagagtgaagtggttgtaactattaacagttacaacttgataaaacatatacaccaggacagatctatgaaaatcaacagtgtaggtcaccctacagtgcttagcacagagattcctacatagtaatttcttagggaatagctgttggaagattagtagataaatgaaagaacaaatgaatgaatgaataaggtatgtaaaaaatgattgctttctaacctggccaaaataagggagtccctgtttgtaggacatatccatattctcaaaactaatcttcaccactgatgagtctatgtatacgtacttggagcctgtaagctgcacacctgcagtcaattaagtattattgagaaaatgtcacttccaaaaacagacaaacagagcttctgaaaaaaaccacaaaagctcaccattccttctaatagtttcccttccctttcctaagcagttttaatatgtaggtacttcagatgtcttttataaagaaagttaatcaagatggcacaaaatgcttgtgccaactggtgttgctgctttttataaaatatccaattcacttaccatttcttcatgatggattagtaaacgttgatttctcattattcctaagtgattgtttaacaacatttcttttactctctgcttgcctaaaacatatgctttaatttattaatagtaagaattgtaatatatgtgtattattaaaaatggaaatgcttaaaaaagaaaatacaaattaccaaatatcagatatctccaagagaaccaaaattagcattttaggctttttcccacaagttctatttctctttatatttatcatttatattaatatgtttgagattgtgtgtgtatatgtgtacatgcacacatacactcaatatgtgcaaatgtatatgtagttttacatgttttttatcattattttataaagtttttgtaaaaccttataaaaacttatttttaattgctacattatttctcatataaatatggacatatgttatcatgtagcaagcccttccctccttccttcctgccttccttcctttccttccttctctttcttccttccttcctttctttctttttctttctttctctctcttcctttctttctctctctttctctctctctctctttctctctctctttctttttcttttttttttcttgagatagggtctcattctgttgcccaggctggagtgcagtggtgcgatcatggctcactgcagccccaacctcctgggctcaagtgattctcccaccttagcctcctgagtagctgggattacagctgcatgacacaacacccagctaattttgtattgtttgtagagacggggtctcactatgttgccaccgaggatggtctcaaactcctaggctcaaataattcttctgcctcagcctccccaggtgctggggttataggtgtgagccactgtgcctggctattcttttattatttatttagttcagtatgacaaatatacctaattatcaattaaatgtttgtttaatacttgaatttcctctggatgtgacagatacctctaaaactttgaagactgatataagtacattagtaatttaatatttcaggaacagaaattttgctgaaatatcagttacatatgcgtaagtttaaaagtactacagtaacacaaagtggtcagcacagaaaaaagcatttcaaggattaagacttaccattttgtgctttaggaagaaggggtattaggtccaggagatacaagaaattagtcattagaaatattattggccgggcgaggtggctcacgactgtaatccacgcactttgggaggccgaggcgggaggatcacctgaggtcaggagtttgagactagcctggacaacatgatgaaaccccgtctctctactaaaaatgcaaaaacctagtcgggcgtgatggcgggcgcctgtaatcccagctactcgggaggctgaggcggaagaatcgcttgaacctggcgggcggaggtcgcagtgagctaagattacgccaccgcactctagcctgggcaacaagagcgaaactccgaaaaagaaaaagaaggaagggaggaagggagggagggagggagggagtggggagggagacagattttcctggatgagataaagatttttcactggatttattttcagaggcttagtaaaatattctccccaaactattttacttcccatgttctaattctatgctcaccaaaaaaattttataatcgacaactacatgtctcaattatatttatctgtggaatgattaaggaaaaggaatatgcttatatctaaaaccagatactcccattataaatcaataaattggcattcttacttctattgtagccttatttgaatgtaacacttgaccatccatcaacatgtgtgtgaaaattttggttgatatatgaaacattcagaatttgaatcagatgaacccaatgaaaagccctcagggaaaaaatgattgtattgacattgtatagttggcaatcaggtaacaattcgaatgagacagtgatatccattggggtctggcttcttagagagcattacctgttccgtcctctgtaacaagagcatgcactttgaggaaactccagtatccttcccgatttcactcaaaagcatctgtgttaataaacttggagacacagccatctttccccaactgaaaagaacaataaaaaaaagttatattgtaaaggaagactgtaagaaatagctataatagggaaaatgtgtgacctcactgaagcaactttaagaatattgtattacccaagttttagttttttaaaataatccattgtgtttctataattatattttcagttcatgtatttacctataactatttattttttaataaatattaactcttacaatattgtgttttaaaaaactcttcatggtgacattattttgttattatacaagataataaacacatccatcactagtcacgtattcacacatgatatttgcaattttggtaatttcagccatattcttttacagttttgaaactgagttttatattatttagttaccatgccttggacatttatgggactatttacacagcagttaggaacacaggctttacagtcaaacaccagaatttgaaccctggctttaccacttattacttcatacaaaatgaaatcttaataaagagcttgtagaactgtattacattagacaataactggaaagtgtttatttagcacagggcctggcacttagtaaacattcagtaggtagtagatttttaaattagattcctttacatttctctcagtgtctagtcaagtgacaatgtctcactaagtgaaatttttaaagtgtcacaattagtaaccaaaattaaacaggatgaattgtcaaatatttttaaaatgtgggataaattgtgctcataggttcctggactttaatattggggaaaaactgatttcttattctactccttcatcttatgatgatatgaggaaatctagtcctcaagatgtgggtgagatgtcaaaatcctgtgctacttcagggggtccttgaaactataagaaggtctagaaccatttccagaagcttaaagatctagaaaaatttccactatactaaaggtgaataatgagataaattatttagtccacactcctgctttacatgtgcatttgattattttaacttttattttaggttcaagggtgcctgtgcaggtttgttatataggtaaattgtgtgtcatgggggtttggtgtacagattatttcactatccaggtaataagcatagtatccaataggtagtttttttgatcctcaccccttcccaccctacatgtacattttaaatttccagagctctcaaatctcctgaagggcatcctataatatagccaccttcgataatgcattctgggatctacctaccctgtgcactcggcttatattggtttagtctcttctagagtgtgcatctttaaagattatgactgcttcataaagtgcaaaacccatgaggatagtacctgatctgtcttgctcaacaatgaagcttctaaataaaattattcttgcatattaaaagacctcaatatttatctgttgaatgaatttgtggagaaaatttttgtatccctgatatccctaaagatacagccccactagttatttaaatatttatatgacttggttggggtgcagtggctgacacctgtaaccccagcactttgggagaccgaagcgggcagatcacatgagatcaggagttcaagaccaggctggccaacatggtgaaaccccgtctctattaaaaatacaaaattagctgggcgtggtggtgcacgcctgtagtcccagcttcttgggaggttgaggcacgagaattgcttgaacccgggaggcagaggttgcggtaagccaatatcgcgccactgcactccagcatgggcgacacagtgagactgtctaaaaatatatatgtattgacatgtatttatgatctagttttgctgcacccatgatcttgagcaatgtatttaacctctttctgctttaatccactcatcggtaagggggcgataatagtaccccctcatagggtactatttgttttgagaatcaaatgcacataaactacttagctcagtgactgacacaaaataagcatccattaaatgttagcaattattattattataattgttactattgttagcgtttattgtccacattttttaaatttaagaattagaaggttcttaattatttccaacctaaagtattctctaaacaggacaggaatatgtgacactgtgtgtgtgcacctgtgtgtgtgtgtgcacacatgtgtgtggataaatggtatcacactgtagtatggggattgcagctggcagttgtatattagacagtcagatctggcatgattatagctgaaagccttgctacatcctagaccagcctgtttgtgtccgttttctgaatgttggttctcaaaccttccaagtagatcttttaggaaattcctcctttgtcagtttggaaaagttgattcttctctttagtggttaagaacctgactgatagggttcccatctggagctcctatatacacttatttccagtgagaataggttgagaggaaaataattatacatctaatactcttgaatatgcagaaacatcacatctccctgactaaattcacaaagtataaaataaagaacaggacatatgttcccagtaaattgatagggtgtagattttgatatgaaaccaaatgtatttttaattaagaatcgaaatttactactcagtttctgatactataatttgctttttgtcagtcaatagaaaatgaaacttagcatgacaaaagaggaatataaaatttacaaataggaatagaaatatagaataaaagtatatattttaactgtaaagaggaaaacaggaagaaaggaaggtaaatggaaggtgaggataaaaagttaatggaaacctatttataattttgctgatatacctcttacctgaatggtaaaatttttacagagtgaactgataagatgagcacatgaatgataagccgtagattctctgcacacactaagttggaccttcccgtccacaggttcaccataggtatatctaatagaagaatataacaacaacacaattacagaggtcaaggtcgtttttaatctgtatagggttttgaaacctttatttagtagctgaaaccagcactgtaacaacatttaaatagctagttaccataaattttattttctggaggaaatctaaaacaatggtacggactaaaattgagctgaatgctttaggcaaaaatatattttaattaaaaaggttgaaataggcatgtagacgttatatatctaagtcactaaaatacaatgtaaacaaaaaaacaaaaaaatacatcagtcattatttcattaaaaataatattttttgcatactgatagcaatggagtattgaaaaacaaaaaatgaaataaaataacattttgcttcttttagtttttttgtttttaaactgctattatgagcatattttatggtttttacttttaaaatgtaaattatatttatttatttattttttataaatgtcattttaagtcatcagattttggggtaatttctttttgtttgttttggaaagaagtaaaactgttcattttttattattatattttaagttctgggatatatgtgcagaaggtgcaggtttgttacataggtatacatgtgttatggtggtttgctgcacccatcaacccatcatctacattaagtatttctcttaatgctatccctccccttgcccccaacccccgacaggccccggtgtgtgatgttcccctccctgtgcccatatgttctcattgttcaactcctacttctgagtgagaacatgtggtgtttggttttctgttcctgtgatagtttgcagataatgatggtttccagtttcatccatgtccctgcaaaggacatgaactcattcttttttatggctgcatagtattccatggtgtgtatgtgccccattttctttacccagtctaacattgatgggcatttggattggttccaagtctttgttattgtgaatagtgctgcaataaacgtacgtgtgcaggtgtctttatagtagaatgatttataatcctttgggtatatacccactaatgcaattgctggtcaaatggtatttctggttctagatctttgaggaatggccactgtgtcttccacagtggttgaactaatttacactcccaacaacagtgtaaaagcgttcctatttctccacatcctctccagcatttgttgtttactgactttttaatgattgccattttaactggcatgagatggtatctcattgtggttttgatttggatttctctaatgaccagtgatgatgagctttttttcatatgtttgttggctgcataaatgtcttcttttaagcagtgtctgttcatatccttcacccactttttgatggggttgtttgctttttcttgtaaatttatttaagttccttatagattctggatattagccctttctcagatggatagattgcaaaatttttctcccattctgtatgttgcctgttcactctgattatagtttcttttgctatgcagaagctctttagtttaattagatcccatttgtcaatattggcttttggtgcaattgcttttggcgttttagtcataaagtatttgcccatgcctatgtcctaaatggtattgcctaggttttgttccagggtttttatggttttaggtctaacatttaaatctttaatccatcttgagttaatttttgtataaggtgtaaggaaggggtccagtttcagttttctgcatatggctagccagttttcccaacaccgtttattaaatagggaatcctttccccattgcttgttttcatcaggtttgtcataggtcaaatggttgtagatgtgtggtgctatttctgaggccactgctctgttccattggtctatatatctgtttttgtaccagtaccatgctgttttggttaccatagccttgtggtatagtttgaagtcaggaatccaacttccaagggatgtgaaggacctcttcaaggagaactacaaaccactgctcaaggaaataagagaggacacaaacaaatggaaagacaatccatgctcatggataggaagaatcaacatcgtgaaagtggccatgctgcccaaagtaacttatagatacaatgctattcccatcaaactaacattgactttcttcacagaattggaaaaagctactttaaagttcatatggaaccaaaaaaaagcccgcattgccaagacaatcctaagccaaaagaacaaagctggaggcatcactctacctgattcaaactatactacaaggctacagtaaccaaaacagcatggtactggtaccaaaacagagatatagaccaatggaacagaacagagccctcagaaataataccacacatctacaaccatctgacctttgacaaacctgacaaaaacaagaaatgcggaaaggattccctatttaataaatggtgctgggaaaactggctagccatatgtagaaagctgaaactggatcccttccttacaccttatacaaaaattaattcaagacagattattaaagacttaaatgttagacctaaagccataaaaaccctagaagaaaacctaggcaataccattcaggacataggcataggcaaggacttcatgtctaaaacaccaaaagcaatggcaacacaagccaaaattgacaaatgggatctaattaaactaaagagcttctgcacagcaaaagaaactaccatcagagtgaacaggcaactgacagaatgggagaaaatgtttacaatctacccatctgacaaagggctaatatccagaatctacaaagaacttaaacaaatttacaagaaaaaatcaaacaaccccatcagaaagtgggcgaaggatatgaacagacacttctcaaaagaaaacatttaagcagccaacagacacatgaaacaatgctcatcatcactggccattagagaaatgaaaatcaaaaccacagtgagataccatctcacaccagttagaatggcaatcattaaaaagtcaggaaacaacaggtgctggagaggatgtggagaaacaggaacatttttacactgttggtgggactgtaaattagttcaaccattgtggaagacagtgtggtgactcctcaaggatctagaactagaaataccatttgacccagctatctcattactgggtatatacccaaaggattataaatcatgctgctataaagacacatgcacacttatgtttattgcggcactattcacaatagcaaagacttggaaccaacccaaatgtccatcaatgatagatggacatatacaccatggaatactatgcagccatgaaaatggatgagttcatgtcctttgtagggacatggatgaagctggataccaacattctgagcaaactatcgcaaggacagaaaaccgaacaccgcatgttctcactcataggtgggaactgaacaatgagaacacttggacaccgggtggggaacatcccacactggggcctgtcgtggggtgggggcagtggggagggatagcattaggagatatacctaatgtaaatgacaagttaatgggtgcagcacagcaacgtggcacatgtatacatttgtaacaaacctgcatgttgtgcacatgtaccctagaacttaaagtataatttaaaaaattttaaataggtagaaagagcaaagaacaaaattgcttgtaaggaataacagtagattcctctgggctacgttttatgacaatttctcaatttcatcttccaaattactaattctctcttaagcatcatcgatccttctagtcagcctttctacacatatatttttaaattaataatatgcctacttccaaggtctttaattatttttaaagttacactattgactcatatctgagtatacacattttacttatttctaaatttttttctgattgatgttcaacagttttctcaggtatatattgctcttttttttgtttatataataccttgatttcaagtcattagaatcttcaaccatttagtgattcatgcttatgttttgggattcccagctggcttgtcctagagtgctttattttgcttatgcaatacttctccagtaaaaatgacacaggagccaacacacagccactgtgatagggaagtacctagacatttgggctttggggatttctgttactcaggggattttccagcaatgctggcaattccctgcctttatgacccaactacaatgagacttttcagtctctgccttttctgtattcttccaactctggaggtgaagcacaaggtagtgacatcaaaaagttagccatgcttcttcttgactcttaaagacttccagcctaaagtagacacaggaaggaggacaggcaaagctttcaccttaaagtttggcatggaattttagattactgtagtgaagctctcctaataactagaaatttccaggtcacttttttatttttaattatgcaaaattaaaaggaaaagtagtacacatgagtcagggaaaagtagtacacatcaggtctgaggagacaaagttttaatgtttgcaccctggctctctttgctggttatataaactctgtgaatgttgcttaacttagtgacaagaggggaaaacaacctgacctgcttcactgctactcctgccacacgttaatcctcactatttgcccctaagtccctgtctgcccttagtatcctccacactgtgccccgccattaccctagagccacttgtaactcttacagcagttttctctgtgatacatcttgagcttcagttttcttttataatcatgtaatacataaagattgaattgagaaatcatcataaacagaagatattgtccaatggaaatttctgggagatggaatgttctatgttttatgtctatgctctccaattcagtggccactagtcacatgtgacagcttgaaatgtggctaacgcaactgaatatttagttttaattaaaacttaaataaccacatgtggtcacggctactgtattggctggtgcaaaacaatatgttatcttatgatgtaagaaagacagtagtcagttgtcttaaactgttacataaaaccacgtgtcataacatgcattaaaagaattatagatgcatggaagaattcataaaatcagcaaaataatttaacaccttctttttcccttaccttctacacatttatattttacttctttttagccatctatcccattctaatatctttctatgaatacattattctattgtgtacaatttcaacttacaaggcacagacattcactttgaattcagagtccacaactaagatattttctggtgcatccacagtcatttgaaatttgggtaacactgccagtaaaaaaaatatatatatattatattataatgtgtatattatatattattaacataaatacatattaacataaatacattcatacaaaacaattgtttctcctttacaaaccatcaacctttgcttatgtttgccattaataaacagtgtgaggaggacgttgaagtgcctaagactggattttggaattggatagaaaaatgcatattttgaattccaaattcatcacttctcaggtgttgaacttgggaaagtgtttctcaatatcttcatctttaaaatagtaataaagatactacaatagaaattttatgaagattttaggagaaaatatgaagggactaatggctaacatatgactaatgttaattccattcttctcataagaagtgctttacatcccagaaactatcatataaaatagaatccagatactacaaaaggaagatagatagcctaggttaacagagaattgcaggaagattatgggctgaactaggagataaaaatcacagtagatggagaaccctaaaatagtaacagaggacaaggaaagaggaaaggaagagatactcacttgaaaattcattatttaataatcctgcccttgcaaaattggaaagattttataatttttttattaataggtaatattttcattgctattatttaccatattcttccacagagaaggagtgatatgttttcttctcattgagcatctccacggtgatttcataccatccgaggatgggctctgagattaactggaaggagagttgtagaatccctcccacagactcctcattcacccactgttgtattcgattgccttctggatcctgagaataagaaagtgtatttttgcatgctggatgtttttattcattataaagtttcagcaaggtgtttcctacttaggtttccaactgacttaggattcaaaacatgagtgtgtcctcacatcacccaaggagaattggttactctcctatctgaggtcacatagatgcatattacagtacttagtatattttagagctagctgtgatttttttacatttattttctgtgtcaatctctgatttcttaaaggcgagccatattttatccccagtgcataaaacattaagtgtacatttatatacattcaacaactaaacattaaattaaatacaatcatacttgcccgttgtctatattattattgtctgtattaatgggtgcatgctaatatgaatcacatggtggtgggggtggaaacctatttctgtcctcttgaggctgtctacatgaaattaataattctgcgacaatttaaatagacaatcttccctgtgagctgccttttgattttgaggtttagagagatgttcaaaaaatgagaaaacaattcttcaactattagttatcttacctgaagggtgatcactggatactgaaataaaaataaaaataatgttaatatatgaactcaaggtttttttttctagatgagtgaagaggttaattataaatctattattaagcaaagaaacataaacacatttaggacaacccaaacaaatactgatttctgactgaaagtttgaatatctattgattatattgaaactcatctgcctagttttcaagaattttcatttacttctctctctttcacaacatacaccctgcagtctcagtaagcaaccctgcccttgggtctctccaacataataaaaatgccctcttagatgaatcataacttccttatcaacaaattcgtggtcagtcttcactctgacagttgcaatgttttacactgctggttgcctctttttgaaatgcttcaattttgatttctgtatctagcactaattttttttgtcttagattattggccattcctatactccaccatttccttatcagacaagtaaataaacgtagacatttgcccaagtttcccttgcagagtttcctctccttcttccttctccttccacctctctgtatctcctctcagttctctccatgtttaccactcttgccccctctaaacctatagtcaacagtttgactttcatctcttagtgttttctctcaggaccttaaaactaacaagttgaaattaaagactcctaggccagaagccctcatgtgaataggctgatgagaattttaaaaatgagtacatagggtcctttgcccactccccaagttgctaagtgctccttcccactaattgcagcattcattcactaataaaacgtaatgtgtctggagataagaacaggattcataaaccttgtccagaattcttggaactgagaaatataacagttgaattaagggcctacttgttattctaaattcatggaattgaatcttgatgaaatattgagatggtattgaagaaagctactgctgcaacattaactcaagcattaagagaggtagagcttctcatgagatttcctcataggaagaaaatgaagaatatattacccaaaggtgccatgggaagacgttaaccatttggatgagattctaataatgagaaatgaacctagagtactatccctttttgtttgctatttgtaatacttccaatgcagatggcttcaactgtgttcaacaaatttagtttttattacttaatttgtcttttttttttagatttttttttaaactcagcttggtctatttcaaaaaactagtgaacaagaacctagtaaaatcacattttcattgttctaagctgcttgatttttctctaaaaacaattattaaaatgaggctgattctgctgtagtcactaatgactgtctgcactaaatcttgtataaaccagccaagaaccaatacaacaactccttcatgtccccttctggttcatactatctctccctgtccatacacagggcctctttttagaggactagtagttccaggtcttaagataagtttaaagaaagatctgaaacttcttgatgcaaatgaaactttctggaaaaagtatgtttgaatattctacaaaacactgacttaaaggaaaagaaaggcaccatcagcaatgaaattgcagaaaatgaaagaaaagaccgatgtaagatttgggcagaagaaactaggtatatgctctatatcttggctcatttgataatgagcccagttgcatcattactatatttttattatgtagtcaaatttattatgaatgcccaaatctcataggccagccatgcattgaatctatttatctaaatggaatactgaaccagataatgtccagcaattagaaacactggcttgcaaagataaaaccacataatctcttagctgccatcatttttggaaatgctacatcaatttccatctctatacataagcacatgcagtttgttgtgccatggaaactccttgccataaacatttggtacaaatgatcttcttatctatgacccatatttgagggaacagtccattaatcctgttcttatgcaaatgtagttattactaaagcagggagttggataatcatatttggcctaattgacaataataagtcaacattggggggtgagaactaataagggagttatgataatgctgcagctgctttgattttcaagaagacctttacttccccatggtgcttccaatcaaggatgattgtcaaaggattgcagtagaaattctcactgccttggttaaatagaggagttgcattcttagaaatagaagcttcaaccatgaaccaaggagaacaggaaccacatgctatcttacggaagtgatttcggatttagattactacaaggtctttggagcactaaaaattagattcctgctctggaaattaaaattaagcaacagtctagtgaatgtagcataactatagaagatggggaaaggaggtggattaaaagtgacgatgtcttaaggatgaagtacaatttggagggaggaaaaggcactaacagagaaaccatctgcacagcttctgtaagcttcagaagcttcttcgtaactgcgctcagttgatagattgatctgagagaccacaaaagaatgcttagttctaacaggtttctaaactacatgaaatgaaatttgtcaggtatcctgttgtaaagactgaagtccaggtcataattcgttgtcttttgacagttttcactgttgatcgccttggttctcagattgtcgctagctagattgtagtcttctgctgaaata

SEQ ID NO: 115 - DNA, 88155 bp, Homo sapiens
gacttacacttgtgcaacatattacaaaatggatggagccagtaatgtaacatgcattaatagcagatggacaggaaggccaacatgcagaggtactttggtgaattttcaaaatttatttatataatgtgtgggcccagcccagtggctggcgcctgtaatcccagcactttgggaggccgaggtgggcggatcacttgaggtcaggagttcgagaccagcctggccaacatggtgaaaacccgtctctactaaaaatacaaaaaaatagtggggcatggtgacatgcatctgaagtcccagctacttgggagactgaggcaggagaatcgcttgaaccagggagatgaagattgaagtgggccaagatcgtgccactgcactccacccagggtgacagagtgagattccgtctcaaaaaaataaataaacctgaaataaataaatatataagtacaatttatttatatagagtgttttgggaataaaatatagaattgtctctaacatcattaaaatggacataaattaagtttttacggcaggacaaagtagtcgtatgcctaaaaataaaaagatggaactgagtatttgatgattaatcttagctcaatagttctcaaagtgtggtcgctaaaccggtagcatcatcatcttcttggagattgtttgaaatgaaaataaaattccgtaagctcattctagacatccagaatcaaaagtctcaaagtaaaaccctgaaactgttttaccaacacctccagggaattctatttacacttccgagtgagaagcattgctatagtctattcactacacatggatatgaaactctctgatgaattttgcattgttcagcataatatccttaatcattggcaattaaattatctgaggttatttttattattataggctttttaaaaaaatttttccacatctccaatttggatcctttgattaaccattcttcctccttttaacttgggtaattttcaaaatgtgtttttaattctttgcttattcgctaagaaaatgcctatttgagtttatttttaagaggctaaaatgtataagcaggatgattgcaaacaaaaatctggtatcacataatctatttatgctgactttttgcattttataaattaatgttaaataaatagaactggtaatatttgtttactcaaactcaaagagagatatccaggaaaactttcgtttacactggcttccagaagggaaaaataaaggtctatcagtgttctagcgaaggatgaagaagaaatttaaaacatcaacgcttgtaccttacaaaaaatagtttcatgtcttttcctcaatattacatttaaatttattaaaatcaacaaaatatttgatgagattgtctacttattttaaattcgtcttgaaatatatttgtaactgttatcagttgatttgctactcaaaatgaacactaggtggaaccacttcttttttttctattcagacacctcctgtgtgaatccgcccacagtacaaaatgcttatatagtgtcgagacagatgagtaaatatccatctggtgagagagtacgttatcaatgtaggagcccttatgaaatgtttggggatgaagaagtgatgtgtttaaatggaaactggacggaaccacctcaatgcaaaggtagagtattatatttcttttaacattttgggggagtatagcagggttaaaatatgttgatttaaacaaaatgaagtcatttttattaatagatttttcaaatgcaaataaaatgactgatggtgcttaaaattcaattcttcctgtgaacagaacacaagtaatagggtatattattttccagaaagattcgaccaaattgagagttggaacctgaaaaacaatactttttaagcattacaacacttagttccttctcaggaatacgtgtaataaaagatacattatgtgcatttgacagccataagtgatgtgcattctaagatatggaataggcagttgaagagagatcatagactgtgatataaatgtgggcatcttcagtatatggattatatttaaaggtgtgtgactgactgtatttataaaaagaagtccgagcacatagtcctgggtcattctaatataaagagatgaaataagggaaaccaaaaaaggaaattgtatcttactcacctttatgttttaaaattaatgtttttctgtattttttttttcactattttacttagactctacctatgtttattattgaagtgagtttttgtagacagcatatagttgggtcatgtttacatatccattcatcctttcatggcctgttaactggtgcacttggaccatttacacttaaaataattattgatatataggacttaaatctctgtcgtttatttgtttctgcctgtttcctctgggtttcagtcctatttccctattcctccattccctgtagggaaattattaaggagattaatttcgattcatatgtattgttttccattctatctctttgtatagcttttctcctccttttaaaaagttgttgctctagctaatactatatatgtaataatatattactgtctactggcactgacatttaaatctacaactggaatatggaaaccttactttcatgtagatccatttacactctccacgttgtaagtataaatgccactagtattttctctgcatacattgagctccatattaaactcacttgcttcaaatatcgaacataattgaaaaaacttatgaggaaaaagatatcctgttatattgactcctctgtttatccattctatttttctattttttcaggatcctaaagtctcaagctctttcttttatctgttttattttaatttgaagaattcctttagttaatctttaggcataggtctactggagacaaattcccttggtatccctttctctgagaatgtctgtattgatccccttacttgtaaaagatcgtgtcactggatatcaaatttggagttgacagttctttgaacacttgaaaaccgtgccacatggttatagatgaaaaactcagcatcatttgaattgttgatcccctcgaggaaaagcatagtttttgtctagttgctttcaaggtatttttttctttttttaaagtagttttattttaatgtatattggtataaattccaatgtttttatcctctttggagttcactcagcttcttaaatataagtttataccttatggtcaaaatgggaagttttcaggcatcattttatttattcatttttccagcccaatatcctttctcttctttttctgcatcggcattatttgttgttgtatttttctgaatgtctcagttcagttttttgttttcagtttattttcagagtgggtaatttatattgctgtatgttcaagttcatggatttatttgtctgtcagctccccatgtattattaagtatattcagtgtttttaaaaaatttttgtcatacttttccattttataattcctatgggatttttcgaatatgaaataagaaacttcctttgtcatagttttctatgtttagcatgtattcattcggaaagacatttcttaatcctggtctaccataagcagcaatatttgttaatgttttatgtgttctttcagtacggagaaaagaacttaaatatattactttcagtttaaagggttaaaatttcttccaggactcatttctttcaccagaaatcacaaaactgttgatattatatacagtgctgtgtttgcgtttgccttatttgaacttgtattttgatttgctctcacaacaaatcaagtgatgaaatgatgttttttagattctacaggaaaatgtgggccccctccacctattgacaatggggacattacttcattcccgttgtcagtatatgctccagcttcatcagttgagtaccaatgccagaacttgtatcaacttgagggtaacaagcgaataacatgtagaaatggacaatggtcagaaccaccaaaatgcttacgtaagtactttaatattcacgtggctggaaaaatctctgtgatgagtctgatatttcactgtttgtaacaaaatactcacagattattgaacaaccattctgctgaatgcttgcctaccaaatatttctgtcagaaagtaaagtttagaaatttttctctttagggctgggtgcggtggctcacacctgtaatcccagcactttgggaggctgaggcgggcagatcacgaggtcaggagattgaggaccatcctggctaacacggtgaaaccccgtctctactaaaaatacaaaataataataataaccggcatggtgacgggcacctgtagtcccagctagtcgggagtctgaggcaggaaaatggcgggaacccgggaggcggaggttgcagtgagccgagttcgcgccactgcactccagcctgggtgacaaagcgagactccgtctcaataaaaacaacaaaaaaagtaatttttctctttatatttatattttattttaaagcatttagttgacaaataaaaatatattttgatgtttgacaatatgttgttttgatatatttatgctacaaagattaccacaaattaattagcacattcttcatcacctatgcttagcattgggtgtaggtgggtgtgtgagtatgtgtgtgtgtgtttgtggtgaggacacttaaaatctgctttcttaccaattttcaaataaacaatacaatattattagctctaaatatcactagatctctatgtttgattccaagttcttattcatattatagctgaaagtttgtactctttgaccaatatcttaatcaaaagcagcaatgataagttctaaaacgcagggatcctaaaatgacaactgatgtaatgaatcattgataatacacccctaattctcatacattaaacatcgaacctcattttcacatcgattaccattctaagtttattcaaatcaatatgatgtttctacatagttggtttggatagtgttttgagaaataattcctgaaccatcatataacattctacttgaaaacctgaaagtctatgaagatttgcatactacttaatgttttatgtttactgttttttattttcagatccgtgtgtaatatcccgagaaattatggaaaattataacatagcattaaggtggacagccaaacagaagctttattcgagaacaggtgaatcagttgaatttgtgtgtaaacggggatatcgtctttcatcacgttctcacacattgcgaacaacatgttgggatgggaaactggagtatccaacttgtgcaaaaagatagaatcaatcataaagtgcacacctttattcagaactttagtattaaatcagttctcaatttcattttttatgtattgttttactcctttttattcatacgtaaaattttggattaatttgtgaaaatgtaattataagctgagaccggtggctctcttcttaaaagcaccatattaaatcctggaaaactaacggttgtgtccagttcataaaatgtttgtggcaagaaattagacgcaatttttcagactttatttctgttcatcactcttaaatctcccaaagctttctccacagcttctgaggctcactgttttacagaaaatggaaagcatatcattgtctctgatttcaaaattatatcactttacaaagatgtaaaaaccaagtcaagtcttaactcatgttggtaatgagatataagtaattactatttatcaatacataaatgcaccaaaagtgatatcaatacataaatgcaccaaaactgatgaaatgtagatacttctacaagatgtcaatctagcacacgtgataatgcaaactaatcataaagaggagttaaaacgtaatagggtatataaatattacaacataaacatacaaaaaataaaaacacagtatcagttataacatgctcacttgcatgcactcacttgcaaacatagaaacatgatacttttgccctgatttaatgtttatagaaaaaacattgccaggaaattcaaaactatagataaatgtgtgtgtgtgtgtgtgtgtgtgtgtatacatgtatatgtatgtgagtgtgtgcgtgtgtgtgtgtgtgtatttagagatactaggggtaaaagttagggtttaattcttttgtatatatcggtatcctctgatttttctacctttaacatatatcactttggaaacaaaagcacaatttattttaaaataatgatgtctaacaagcaaggcggtgcatgttgagaatgataaagatttcatcagtaatgatcttaacatcaaatagcctcttaagtatttttggagtagaagagttttggaaatttcaatagtaaggttctgaaatgtaatttttatattcattctttttaatcagcactagttaggtaaaatcatttttgattaggaacattttaaactcataaaggaggtgaagccattatgtgaaaaataaagatatcaataatacaacacaaatattatttaatgataccttattacttcttactgtataaaatcaggtggcttatatactcaggctgtctccttgttagtgatcctgatttagataaattgcttgagttgaggaaagccagatttcaaaaatctaaaggacatttgttataattagcaacttatgttgatagtaatgttaacatttgggaatatacgtttattcctaaattgttttagtacatttgagccactataagaaattaccataaactggctagtttataaaaaatagaaatttatttcatacagttttagaggctgagattttccagcttaagataccaactgatttgatgtcttgtaagggcttgctccctgttttggtgccttcccactatggtgccttcctactatgtccttacaatgtggaaggggcaagggagttccatgactcttctttgtaaaaagactaatccaatgtattagggtggaatcctcatgacctaatcacctaaaaagtccttacttcctgatactatcaccatagtgatgaggacgtaacacacatattttgaaagggtactactatgcacaccatagcacagcatagggataaacaaatatgttccatgtaaatggaaaccaaaagaaagcaggggggctatactaacattaactaaaattgaattttaagtcaaatctgtaaaaagaaacaaggaaggtcattatacaaaggagtcaattcacaaatagattataactattgcaaatatgtatgcactcaacatgggagcaatgaaacttataaagcaagcattaatacatctaaaggaagaaatagacaaaaatgcagtaatagtaggggacttcaataacccacattcaacaatggatagacagtctatacagaaatcaataaaaacattggacttgaactctatattagaccaaatggacctatcagacctatatagaacattccatttgacaacagtagaataaacattcttctcaagcacacaaggtataatctccaatatagatcatatgtggggccacaaaacaagtcttaaaaaattttaaaaagattgaaattacataaatttttttaacattgtcatatgaaactagaaaacaatagcagaagaaatgttaggaaattcacaaatacatggaaattaaacaacatgatccggaacaaccaatggggcaatgaagaaattcaaagggaaatttaaaaatatcttgagaaaaacaaaaatggaaaagcaacattctaaaaaacatatggtatgcaacaaaagcagtataaagggatgtttagagatatgaatgactccatgaagatcctaataaagcaagtaactttgtatctcaggaaactagaaaatgaagaaaaaaattaacccaaagctactggaaagaaaaaaatagtaaggtacagaacagaaataaataaaacagactggaaaaataatagaggatccacaaaactagaagttggcttttgaaaatataaacaagattgacaaacctttagctgaactaaaaaagagagaaggaacaaataaaattagaaatgaaacaggaaacattgtaactgatagcacagaaatacaaaaaaccagaagagaccgctatgaacagttatatgccaacatataactgttggataacctaatggaaacaaatatattcatagacatctacaacctaccacgattactgaaacataatgaaatacaaaattaatacagaacagtaatgagtaagaaaaatgaacaagtaataaaaagtctctcatcaaaaaaacaaaacaaaacaaaaaaaactcatggcttcatgatggatggaatcctaccaaacatttaaagaatcaacactaatccttctcaaattctgtcaaaaatttaagagtgaactctcagttttattatatgaggtcaaaaatcatactgacaccaaagccacacatggacactacaaaaaacaattataggtcaatattcttcatgaatatagaggcaaaaatgctcaacaaaatacttccaaagtgaagacaacacattaaaggaatcattcgccataatgaaaagtaatgtatatctgggatgtaaagatagtatatatacaccaatcaattactgttccacaccgaattaaaagaatgaaaagcaaaaattgtatattcatctcaatagatacagaaaaagcatttaacaaaatcaacatcctttcatgataaaaagtctcaacaaattagccataaaagaaattaccccaagacaataaaggctacatatcacaggctcacatttaacattatactcaagagtgaaaagttgaaacatttttgtctatgatcagaaaaaaaaaaaaaaacaaggaggctcgctctcaccacttatgttcaacatagtgctggaaatcctggctagagctgttaggcatggaaattggaaaagaaaacagttgtctctgtttgcagatgccatgatctcattatatacatggaaaacccaaggacttcaccaaactttgctaaaagtaataaccaattcagtaaagttgcagggtacaagatctacagacagagccagttacatttctatacactaacagcaagctattgaaataagaaattgaaaacaaacatctaatttacaatagcatcaaaaataataaaatacttgagactaaatcaaagcaaggagatgagagttctgtactctgaaaactatgaaatattgatgaaagaaattgaagaaaacacaaataaatgaaaagatgtcctgtcttcaaggatcaaaagaatcaatattataaaattgtcttcaatacctaaaactccagattccatgcaatattgtcaatattctaaacacatctttcgcagaaatggaaaaaaaattctaaaattaatatagaacaagagacaccaaatagctaaagcagtcttacaagacaaaaaaggaagagacagcacactatcatgctctctggtttcaaattacactacaaatctataataatcagaacagtttagtcctgatacaaaaaagatacatagacagaattaaaagctccgaaataaaatcatgcatatataaaggcacttccaaatattcatggaaaattgaattaaaataagaaaattttaaaactacactttatttcttaacataagctccatcaagttcaacacacttttgaaaacagtgatacaagccatttagtccatccctaaagactcgatggttctggaactatatccatgttaagcagtctttttcacataattaactgaaacaatgggtaccctttgtaagattttttaaaattaggcaaaagaaagaagtcaggagaaggcaaaccaggactttaatgtaggaatgctcaaagatttcccataaaaattctcacaaaattgtttttgtctgttgagaggaatgagcaggagcattgttctggtggaggaggactctctgatgaagttttcctgggcatttttctgctaaagctttgaaaactttctcaaaacattctcttaagaagcaaatgtttctctttggccttccagaactcaactagtaaaatgccttggccatctcataaactgttgccatgatgttttctcctgactggcctgcttttgctttcattggaccacttccacctttggtatgccattgctttgattatgttttgtattcaggatcatactgataaactcatgtttcagctcttgttacaaatctttgaagaaatgtttcaggttcttattcccacttgtttaatacactttccgttaaaaactattcccttgctggccgggcgccgtggctcacgcctgtaatcccagcactttgggaggccgaagcgtgaggatcacgaggtcaggagatcgagactatcctggctaacacggtgaaaccccgtctctactaaaaataaaaaaaaatctgcgggcgaggtggtgggcgcctgtagtcccagctactggggaggctgaggcaggagaatggcctgaacccggcaggcggagcttccagtgaactgagattgccccacagcactccagcctgggcaacggagccagactcagtctcaaaaacaaaacactcttctcttgtctactacacctcatctgggtgcaatggtcttgggtctcactgaatggaaattttgctataacattgattttcccatcagaatttgtaagatgaactaattatggtgttgactattgattctgctcttagtcatcagtcatctttaatccagatgtgagcaaaattatttttttctcacaaattagtgtggctagtctgccgctgtgggcttcatccttaacattgtcttgcctctgcctaaaatgagttatctgtttctaaatggctgatttcttttggggtgttgtccccataaatttttcaataatttcactgaagctccatgacaagtgttggttaggatgtggaaaaaaggaaacacttgtacattatgggtgggaatgtagattgttacagccattgtagaaaactatatggaggttcctcaaaatattaaacatagaactatcgcatgactcagcaattccacttctgggtgtataaacaaagaaaacaaaatcagtatgtctaagaaatatctgcactctcatgttttttgcaggattgttcacaatagctatgatatggaaacaacttatgtttctgtcaaagatgattgaataaagaaaatgtggtgcatatatacagtggaatacattaaattctgcctttaaaaagaaggcaaatctgtcttttttaacaacattgataaacatggcagatattaagtaagtgaagtaaaccagacacagaaagacaaatgctgcatgatgtcatttatatttggaatctaaaaaacacctgagctcatagatatggagagtagaagtatagttaccaggggttgcacagtgggagaaatagagagatgtcagtcagaggatacaagttttaagacaaataatttctggagacctagtgtaaagcatgatgactatagttattaataatatattatatatttgaaattacaaagacaatagttcttaagtgttctgatgtcattcatacaaaaggtaacaaggtgagatattggatatttgattagcttcattatgataatcattataaaatgttatgtatatcaaaataatatgttgtataacgtgaatataaaaatttgtatttgccaatgatacttttataggggtgaaaaaattgattacattaatcagtaaaaatggaagttaatggaccaaaatattacttctaggttttgaaatataaatatgtctttttgtaaaaacagaaaggttttttgtttgttgtagttgtttgtatcaccttggagtcgtgtattttgatttattcaatctggatatctctggaaactggctcctcattgcttctcatgtgccctaattttatctgagtatttctctctttttttttcagcataacatgttctaagttcactttatatttcctctgcccaacattcaaaatcatacacctttcctagaaagtctgattatttttaaagcagaataaaatttagaactcaagaaccatgaagtattggtaatagatgggaatgtccaatactttggaaatataattattttcagggatttttggtggtaaaatctttgaaatataaataaaatataaaagtttgttgttctcactggattttacaattcaaatttaataatacatctgtgaaaacaactttagtatatacatgttttcatttttgtgagtatatggtacgtctatgtatgtatgaggtacataaaatattttgatacaggcatacaaggtgtaataatcacatcagggtaaatgaggtattcatcatctctagcatttatactttctttgtgttacaaacaatccaattatccctcttattttaaaatgtgcaataaattacttttgactatagtcaccctgttgtgctatcaaatactagatcttatttattctatctaactatatgtttatgctcattaaatatattcttctctcatttgtctttactgactcattcatgaaaatgtcaaaagtgtaatgaaacgttgctattagtagttaaactactaagtgaaaattaaaatttctttgtgtttattttgcccctagatagttgactctgagtgtgaatcttcttttcaaaaatgatttaaatacttcttatctctggttcaccctattaccgaatccatagagttgtatattaattttcacttgtgttcttcatgcttagattttgcttttttctttcttatatactaacaataaactgtctgaaaaagaaatttaaagatctattccttttctgataacaccaaaaaataaaattaggagtaaatttaaccaaggatctcaaaaatctatatattttaaacaatacaatattgatgaaacaaattgaagaagacacacataaacagaaaaatagcccatgttcagggactgcaagatttaatatggataaaatgttcatattacacaaaaagatgtaaggattcaatgcagtccccatcaaaattctaatgtcatttttcacagaaaaatgaaaaacagttcaaaaatatgtatgaaatgacaagagatcccgaaggtcaaagtaattttgattaaaaagaacaaagctggaggcattacacttctaaattttgaattatgatataatgctattataggcacgatagcatgacattggcataaaacaagacaccaataaaacagaatagaattcaatatattttcaataaagatgacaagaactcacatagggaaaataatagtctcttcaatacatcttgctgggaaaatcggatattcacacatagaagaatgtaattgatccactgtttcacactacataaaactactcagaatatatgtaagactgacatgtaaagcttgaaactataaaactgctagaggaaaataaaagagaaaaaaatacatgacattggtctgggctatgatttcttggattggttccccaagcataggcaacaaaaggaaaaatacacacattgtattacatcaaactaaaaagcttctgcacagcaaagtaaacaatgcccagagtgaagagacaactcatgagttggaaaaatatttgcaagccatatatctgataaagcgttaatattcaaaatatataaggaactcaactcaatggctaataaaaaggaattaaccaatttaaaaataggcaatgtacctgaatggacatttctcaaaagaagacgtaccaatggccaacaagtattattatcaacaatacaaaaaaacatcaagtgttatcaaacatgtggagaaaaggacacacttgcacattgttgatggaaatgtatattagtatagccattatggaaaatactatagagtttgtcaaaaatgaaaagcagaacatataatcaatccagtaatcctactactgaatatatgtacaaagaaaaaggaatcagtatgtcaaagagttatctgcattcccatcttcattacagcattatttataatagccaaaatatggaatcaacttaagtatccattacagatgaatagataaagaaaatgtggtctatatacacaatgtaatactattcagctttgaaaaaaggaaatcctgcattttcaagaacatagaataaacagggaggacattaagttaggtggaataagacagacaaaaccacatgattgcacttatacatgcaatccgttgtaaaatatggtgactttagttaacaataatatgttgtattcttgaaaactacttagtgtagattttaagcagtctcaccacacacaaaaatgagaagtatgtgaaggaaagcatatatttattagcttgatttagccactatctaatgtatacatatttcaacacaatatgttttacataataaatatatgcaattttatttgccaataaaaaataaatgaaaatgtttacaaaaagagaatatgtggtatagatacacagtagaatactatacaaactaaaaagaagacaattttgtcaatagggaaaacgtggatgaatctagtggacattatgctatctaaaataaagtcaacacaaagaaaaatcctgcatgatcttattgatatgtggaatctaagaaattcaaatttacagaaggtgagagtagagtggtggttaccagaagctgaagggatggcggtgtttctaggaggtgttggtcaaagggtataaattttcagttagactagaggaatacattttactatctatttcacagcatggtgttcacacttaataataataataataatagtgataatattatatatttcaatattgctgagtacatatattctatttaatatatttaagcctagcctttctaactactacagaaagagaagctaaatgtcttttgtaagtatgcttatcttacaaaaaataagttcatttgacattcatgtaataaatctaatctttgttttattgattttcagattaacaaagaccttatctgaatactctttacaacttttatgtaaatctaaaattattccataggagaaattttatgtaaaaaaagataaaagtatgaagcatgtttcagtttgggtatttcactttgtattcactgaatattgaaaaaattaaaatactatcaactaatacataaagtcatataaactcctaaataaccgctgaggaacctacttacttttgtgtgtcattttggatagtcaaggttttttgctatgctatactttaaaaagtaattaatgaaggggctgactctttttttgttaatagcacacttaacaatattagtggattcctggtgttcttcactaaggtccttggtcagtaatttctgattatattttatgcaaagaactttgaaaacaccttgtgctgtattttaaagtttattatcatccatatttctgaccaatcacagatgttgcaaaaggttgggacacttggaaaaataaaattattttcaaaaagattatttttttatagaatttcaaaaacaaccatctttaaaatactaacaatagttttaaaaattacaatacttttataaagtttttacgaacactacttacagatagagtaaaatttcattataactgaaaatgttttcagtaacctgttatacttggctaagtgtcattattcaactgaaattccacctctcttcaacatttacgtatatattttcctgaagatttttgtcttatgttttgcagttattttaaagttatggaggaggttttgcttattttactatatttactatatggtttgtctttagcattattgatagatctttttcttctaaatatgggccgtattttctgcttctttacatatctagtagtgttttattctactctggtcaatgccaataacacattgtgatgacagccatggaatataaaagttacctatgggtttgtcatatatgctatttatggtattggggtacttttcttctatacatatgtttttaaattttcctgtgcacatcataggtgtacagtaggtgtatgtattgatggagtacttagaatgttttgatacaggcatacaatgtgaaatgagcacatcatggggaatggggtatacatgccctcaagtatctttcctttgagttccaaccatccaataatactgtataagttattttaaaatgtacaagtaagttatcattgactatagccaaccgattgtgctgtcaaatagatggacttatttattttttctattttttttcgtacacattgaccatccccatctcccctctagccctataccacccttcacagtctctagtaaccatccttcaactttctatgtccaagagttcaattgttttgatttttagatgccacagataagtgagaacatgtgaggtttgtatttctgtgcctggctaatttcacttaaaataatgatctccagttccatccatgttgttgcaaatgattggatctcattctttattatggcaaagtagtactccattgtgtatgtgtgccacattttatttattcattcatctgttgatggacactttggtggcttccaaatcgtagctattgtatacagtgaggcaacaaacataggtgtgcagataccgcttccatacactgatttccgtacactgctgttgtatacacagcattaggatggctggatcataaggtagctcaatttttagttttctaagaaacctccaaactgttctccatagtggttgtattaatttacattcccaccaacagtgtacaagatttccctattctccacatcctcattagcatctgttattttctctcttttccatataagccattttcactggagtgagatgatatctcactgtagttctgatttgcatttctctgatgatcagttatgttgatcatcttttcacatgtctgttttccatttgaatgtatccttttaagaaatctatattcagatcttttgcccttttttgatctgattattagatgatttctgatagagttgtttgagctctttaattattctggttattaatcccttgtcagatgggtagtttgcaatattttgtcccactcagtgttatttcttcactttgttcattgtgtcctttgctgtgcagaacatttttaacttgatgtgatctcatttgtccatttctgctttgcttgcctgtgcttgtgagttattgctgaagaaatttttgcccagaacaaagtccttgagattttccccaatgttttctggtagaagtttcatagtttgaggtcttagacttaagtctttatccatttgatttgatttttggatatggtgaaacatagaggtctagtttcattcttctgcatatgaaaatccagttttcctagaaccgttaattgaagagactgtcttttccacaacgtccctttgtcaaaaatgcattcactgtagatgtgtaaatttgtttctgtgttctctattctgttccattagactgtatgtctgtttttatgccagtactatgctgttttagttactacaactctgtagtataatttgaagtcaggtaatgttattccttcagttttgtttttattgcttaggatagctttagctattttgggtacctttagcttttgtggtaccataaaaattttaggattgtttttctctattactgtgaagaatgtccctggtattttcatagtgatttcttgaatctgtagattgccttgggtagtatggacattataacaatattgatccttccagtccatgatcatgaaatatcttttttatttttggtgtcctcttcaacttctatttttagtgttttactgtttttcttatagagatctttgacttctttggttaatatctaattatttatttttatctgtggttactgtaaatgggattacctttaggatttttttcagattgtttgctgtcaacatatacaaatgctactggttttttatgttgatattatatcttgcacctttactggatttgtttatcagttctaatagttttctggtgattaccttacgtttatcgaaaaaaacttataccatctgcaaacaaagataatttggcttctttcttttcagtttggatacctttatatccctctcttgtctaactgctgtagccaggacttccagtattatgttgaataacagtggtgaagtgggtatccttgtcatgttccagtactttgaggaaattatttcagactttctccattcagtttgagagtagctgtgtgtctgtcaaatgcagctttgattatgtttgggtgtgttccttctatcttcagttttctttagtgttttatcatgaaggattttgaattttatcaaatgcctttttggaatcaattgaaataatcatgtggtttatatccttcattgtgttggtatgatgtattacattgattgagttgtatatgttgagccatctttgcatctcaaggataaatcccatttggtcatgttgaatgatctttctagtatgctgttaaatttgtttgctattcttttgttgagaatttttacaattacatttgtcagagatattgacctgtagtattctttttttaatgtgtctttgtctgattttcttttcagggtaatattagcctcacattggaagtatttgctcctcctcctcctctatttttcaaaatagttagagtagaattggtactagttcttctttaaatgttagggagaattcaacagtgaagccaatatgtcctgagcttttctttactatgagactttttattctggctttgatctcattacttgtattaataattgatctgttcaggttttggatttctttctgcttcaatcttagtaggttttatgtgtctaggaatttgtccatttcttctagattttccaatttattggaatatcattccacatagtggccaataatgattctttgaatttctccaggatcagatgtaatgtttccttttcatttctgattttatttatttgaattctcactctttttctcttagtctggataaaggttgatcagcatgtttaatattttaaaataacaacttatgtttcattgatctttgtattttattcatttcaatttcaagtttatctgctgtgatatttattatttattttcttctaataattttggatttggattgcccttccttttctagttctttaacataaatcaccaaattgtttatttgaagtttttcctttcttttttatgtagtcacttatagctataaatttttctcttggtactaaaactgctatatcccataggttttgtgtttccattatcatttgtttcacaaaatattttaatttcttcattgatccactgtgcattcaggggcatattctttaatttccagattctttaattttttgtttcaacttgccataaggattgcaaatactatcttataaccagaaaacaacttaacactgtttgcataaacaaacaagccaaagaaaactcataaatactctccaccttaattttcccttctgctttcaaactttttgttgtttctatttttatcttattgtacagactatgtcttgaaaatctgtagttattatgtttcattagttcattatttagtctttctacttaggatattagcttacacaacccagttgcagtgttttaatattctgtatttttctatgtacttactattaccagtgagatttgtgtcttcaggtgattattgttcatgaatttaattttttgattgaaatattccctttagcatttcttgtaggacaggtctggcataataaaattcctcaccttttgcttatctgagaatgtctttatttcttctttatgtttaagggatattttcaccagatattctactctaggataaacgttatttttctgtcagcatgtgtcatatcactcctgtaaggattcctctaaaaagcctgctaccagatgtattggtgctccattgtatgttatttatttctttgttcttactgattttagaatagtctctttatccttgaccttagagaatttgattattaaatgagttgaggtagtcttctttgggttaaatctgcttggcatcctataaccttctagtacctgatatagatatcattctctaggtttgggaagttctttgtgattatccatttgaataaactttctactcctatctcgttctctacttcttccttaaggtgaatactcttagatttgctttttggaggttattttttagatcctgtaggcatacttcattgtttttaattctttatttttttgtctcctctgactgtgtattttcacatagcttgtcttcaagctcaacaattctttcttctgcttgatctattctgctattaaagaatagcacgtgtaatatcttcttcagtatgtcaattgcatgtttcggctccagaatctctgcttgattttttaaaattatttcaatctctttgttcaatttatctgatagagttcagaattccttctctgtgttatcttgattttctttgagtttcttcaacaaaactattttgaattcgttgtttgaaaggtgacataactcagtttctctaggattgttccctggtgctttgtttagttcatttggtgaggtcgggttttcctggatggcgttaatgctagcagatattcttctgtgtctgggcactgaagagttaggtatttattgttttcttcactgtctgggcttaattgtaaccatccttcttggcaagatgttccacatgtttgaaaggacttgggtgttgtgacctaagctgtaacttctttacagggtgtcaaaatcccaccaatgcagtggttcttgcagacttctgggggtactctattgatggtcttgcacatgatctgagagaattcagagtgatgagggcccctggaccagggtggtttccaggggaccagtttcaaaaaccttagatgtctgcttgatgttatatggtactgtatctgggctggcagtcatattgcaagttaaaatgttgtggggtggggtggggggaggggggagggatagcatttggagatatacctaatgttaaatgacgagttactgggttcagcacaccaacatggcacatgtatacataggtaactaaccttcacgttgtgcacatgtaccctaaaccttaaagtataataataaaaaaaaatcctcctcactgttccctcccctttccaaagtcagaggagcctcaccctatggtctaacaccactccaggccatgaggagtactgccagacaactgctgatgttcccttaaggtttaggtgctcctaagtcagtttgtggtgaatgctggctagcctaggattcacccttctgggaactgggctcccatctggtccatggtatgtccaaaaatgccacccaccagtcaagtccaggaactggggaccctgggagcccaggtggttctctatcccctgtggccatgctggtacctgaagccagcaagtctcagaggctcacctaaggccctcaacatagtatctgggtatcactgcaggttattgagggccaagggctcttcagttaggctgggtgaatgctgccaggactgcatcatttccttcagggcattgggttcccttttggttcagggtatgtcaagaaatgtcatctgggagctagggcttaaagcaggggcctcattcctttgacagttgccctatcctgctttgtctgagctgatatccaagatgtaagacaaagtcttccccgttcttccctctcctctcctcaagcagaaggaaggggtttcttttggagctgtgaaatgtgaagcctggggttaggggttgggtgatgccagcatgctcttggctgcctcagctggtgcagttggtgtctctgaatattctgtgtcttcccccagtccatagtctctgagcctagttcagcactaagactcacatatgtgtgcagtccttatgtcctagactgtctttctagtttatttagagacacaatgcatggtaggtagccctaggtggcaagatttgtgggaacttgatttcagacccctgcggtcagcaataccgtcatggctagcattggtttaaatactccctccatgggaaggggttagctgagtttggtttggctttcctttctgctctaacagcacagcattttgttcaatgcctcacaattgctatgttctccctccctcagtgcctagagcaaggctctgtacatcatggcacagctgcaagtgtggggagaggggaaagggtagtgtcagtgactcaagattgtctgacctatctcttacgtgcctctttcagggatatgaagttaaaaccatgtactatgagtgctaatctgataatgttttcattttatgaaggtgtttttttttttttctgtgtacatagttgttaacttggtatctttgaaggggaatggttggtgtctcctattccaccatctggctctgctctgcctaatttgtggagactctttatcatgaagaaatgtcaaagtttctcaaatgtttttagtacttctatgaaaatgatcatatagttttgttgattctgttattgtgatatgttacatctattggtttgtgtatgtctgctcatctttattttatgcatagtttgaaaaaaaatactaccagttttttatactgtttggttgaattcagcagtgaagataacaggcgttgggcttttttgataggtgaattttattactgatttaatcaacttactcattatttgtttgttttgattttctatttattcctaatacgatctgtattaggaatttttattttaatttgtatttgtattttacaagctattttatttttagcttgtatttgtatttgtagctgtatttgtattttagcttgcttctcccttagattcccccatgagatgtacctaaagaaaacttggaccaagtgaaaggcaaggcattatctggtagcagctgctggtagcagctgagatcaccaacagtagctttccttgcttctggaagttttcctaagaaacatccactgcagtacaatggataattagtggggcatcactaagattcctgaacttcggaattttctggaaatagcatttatgacctttgttccctcagttcttccagtagttgcagaagcctttcgttccctttattgatactctctttactcaaaaaatgagagataaaataaattaatgttttatattacttttggattcagtccattactgtccctaaataatattttacaagtacatttcagggaatcaattccacagatggttgtgaaaccactaactggaattattgaagcattttgcaaaactctctgaactttgatatttactaagtgaccttaaaggcctagcttcgtggtagtttcctcaaattcggaatcacccttggtaactaataatgaaagatttcaaactccaaacagtacaactgaaacttttgcattactatactactgagaatatctaacatgttgttactaattaatgtcattctaaccttgtgggtttcctatgctaatggacaaggtaaattgaaagagatctaaacactcagctcccatcttaaatgtaacttcatgtaatatctagcttcctatgtctccatgtctacaattttttatgaaccaaagaggatttattcactatgctagtagaaatagcatattttgtaagactataacagaaattaattttatgaaatattatctcattttaacttaaacaatgaataatattttctttgttttataagttctacagtgtaaaagacatttaatattgattatggagatatgtgaatatactcatgaaactttaagtaggaaacatgtcactagacagattctaaccttaaaatgttcagaagtttcttatttgtaatgcaaggggagtgactgatattttcataatcttacagatggtgattttttatagattcatatatcaaaacatcaaataatacattttaaattctgcagtttcttttatttctataataccttaagaaagctgctaaaatgaattaacattaatatgaacttaatatttcaacaagattagcaacatgtaaatcacaacatgtaaatcacaacatgaatataatcaaaaagtagactatatgcttaacttacttttaaatgacagtaaattttgcatttctgagctcactagcaaatgttcaataaataaatacataattattttttatagctttatgttattgttcactgatttgttttctcctcaacagtcatatattttctatattaactacctttttgaatgcaggccttgcatattaaagaactatatcgtaacattagcagtggaaccacatgggtcaaatgtcatggacaatcaaaggtttgtggccattaatgaagaatacaaattttgtaattatccaaaacttcataatatttcaacaaatgtagtggagggtaatactggaaatccaattatcaatttatgagagtatcttttccctcagcctctcttctcaaagctatgccactttatttgattctaggtaaagagctttaggttttacagtattatctatcacatgatttgctagttttatttgttgtgcaaaatcaaacttgatctgtgctaaaatggaaaaaaaaggaaattctcctgttatttcctttgttaactgaactgatacaggtacatttttttcaaataaagattaaatagattaaagtagaatgaaaagaagaaaagtagtaccattctgaaatgactggaattagaaaagcatatgcactatactttcttacttactttcttaaaagcactatagaaaagaatgatgacaaattcttccttatctgatattccagttgaaaacttgtctcctccaatgaactctttgtaagagtaaacttgagcaaaatgtcttgtaaatttgggtcgcacctatatttctcaaaggagaaagtaactcattgggttactttcaaagtcttggttagagagaaacatctttgtgtattcagtagcattggctcaattgcatcccgccaaaattcatttgttaaagtccaaattcccaatacctgagaatgtgactgcatttggagaaggagtgcttaaagatgtaattaagttaaaggccaatgattcaggtgggtcctactccagtataactggtgtctatataggaagagaaaataagaacacaccatatagagaaagatcacgcaaggcatagaaagaatacaaccatttacaaggcaaaggaagaggtctcagaagaatccaatcctgttgacagctctatctcaaactattagcctccagaactgtgagaaaataaatttctatgaaatcagtggtactttgttatggtagctctagcagatgaataccatgatatttacacaatttattaaaagaacattaataactaaaaataattttttactttttactcaagaatatatatatatatatgtagccaccacacagattttagaggctattcatcagaatttggtaattacatcttgggtgtattttcctgctgatttttgtcttgttgaatactttatgtgtatatatatctgtattcatctatattcagaatctagtaaatcaaatctaagaaagatttttcatatcattaatgaaggacatactttgtgaattgcttatgctaataaaatttttttaatggtagttgatatttcagttctgaacaataaaatcggcacaccaattcttttggaaaccacgctatttgaaagacaaacttgacagaaaatttgtaattgtaacctattataatgttcattgaatttgtattggccattatttcttccatcaagtcataagttatttatacttatttaaaaataggttgtcaataacattatttttaattatgaatatcctttcagaattgtataaattttatattcatctactagagttgccataacaaagtgtcaagagtgacaattaacattgtagagcagggttgcttttaaatcccttttaaactgatcattacagtaccaaatgcattacagttaattgccattgtacttctttgggatgctgaaatttgtttcacatctcactaagaagatggcttctgtgtatatttcatgtgcccccattaagctttggcataacataagagcccatactttccttgacttttcctactacagactaagtttcaataatttctctatgaaattccagtgccttttagtgggaagaacgatttttagaaacaaacctaaaccatgaaaaactcacttcaggttcgaaattatcgttgactaagaaaaataatttttggccgagcaggatggctcacacattaatcccagcactttcgagggccaaggcgcgcagatcacttgaggccaggagttggccaacatgatgaaatgctgtctctactaaaagtttaaaaaaatagctggatgtggcggcacacacctgtaattccagcttcacaggagactgaggcaggagaatcacttgaacccgggagacagaggttgacgtgagccaatatagtgccactgcactctagctttggagacagagcaagactattaaaaataaaaataaaaatgaagaaaaaaagaaagatttaaatgatttcctttagtttatgtccctttctacctcggactaaatatcctgcaatcataagaaaatgtaagagtatctcaggaggttacacagggccgggaagtttcgattttccaatacggaggagacactcagcagaaaactgtgcatccatgcttgagggactgggtcagagaaggtgtcatgcgtcgcccaacaagcctctggatccagttctgtaactagcaaacgcttccctcaaagtaaagatgtcacttctctgaacttagtcttctcatctgcacactaaagctgttgtgccactagcgtctttctagttctctctggtttatgatgattcaaacttaacttttatttaattatattcttaagttttcataacaaatagaatgtaaatactattttctatcacttgttccataattatagagtaaacataaatgatatgctatttaaattgtgatgttgttcaacattctataggtatacatacctatagaatgtaagaatatatacatatttgtacattcgtctatgcacttattttttatgtcaataatatatcttatctgacacatgaattctaactatggtaagaatgcatgccatcgcatacaaacaaaatgccacaaaactaaacaaaatgttttatatctggagataatttgctacatatcagattttttatgttacagtcatatttcttgtctctcttttccaaaaaacaatcattgctaatgcgtgcaccctgaactggcagcttgagcttaacttggtatagttgtagataagctcagtttaaattaatgctgataaaacctccagaattgctgaagagaccatactatgttagtagaagtagagaaagtgaaatgaggttcttgtcctgttagctgacttgagatccattaaagattttaagtggagaaataaaatgaccagatgaaaggtcattaatttatacacagggaaatagattacaaagatgagaggtcaggatcaggaaactagttatgattgctgcaatctcagaagaaaatggttgagagacgatgtttatcaaaggttattgccagggtttttttgcgcctgtttgtttgttcgttttgacagaaaaaaattgagtgaaagggaacaccacaattgcagaagttcagttattattgagagaggtaatgagaatgattgacatgaatttcccccaaaaaatgttctgtcaataattactatattatgaacaaatagagcatggaatatttttatagctgactcagcgaaaatagctattacagcaaacctatgtctatactgaaattcacatatacattcaaagaatattactctataccatttatctcaagagaactaatcttcaaagcaaaagaaatcagcaacatgtttttaattaaaattttaacttccttcaaaaatgtctttttggccgggcacagtggctcacacctgtaatcccagcactttgggaggccgaggagggcggatcacgaggtcaggagatcaagaccatcctggctaacagggcgaaaccccgtctctactaaaaaatatacaaaaaaaattatctgggcgtggtggcgggcgtctgtagtcccagctactcgggaggctgaggcgggattattgcgtgaatccaggaggcagagcttgcagtgagcggagatcgagtcactgcactccagcctgggcaactgagcaagattctgtctcaaaaaaaaaaaaaagtcttttttatttatctgttaagaacagataaatcattcatgaggcattcaagtcaaaaaagaatttttatttttttgttggcagatttacttagtggaaacaacatttgtatttagctttaaaagtaaattaagtggaggaaaatgaagattttcattaataaccctaatattaatagacaatggtggtactgaggagaacatctatctctttcaggcttcatgaggaaatgatgtttttcagtgtcaacaaagtactctcaactgtgtggtttgcccaccaaatatcatgtctgtaataatataccgtacttagcctaccacgttttaaaatgattggtttccaactatcatggcatagaagagaatatatagatagttgaagagttaaagaaattatagcataagaagcatgcaaaaagatagagttatagcattataatgactgtcttgagatatttcaaaacatttatgagggggagtaagttagcttttgatgaggactgtcacagtcagtgaagcaggtaacagtattatccaacatcgaatcagaggtcaagtgattttctaaaagtgtgacctatacggatattgccctatgtcgggggtgggggtagaagagttgatctcttctgagccctccacgttttaagttgtatgattcaacattgtacatacaaaccttgttttaattatactctatttttaaaaactgcagttagcttttgagttagctgggtgtgttgacccaggcctatagtcccagctactctggaggatgaggtgaaaggattgcttgagcccaagaggtcgaggatagagccagccaggatggcacccctgcgttccaaccgggctgacagagagagacctcttctcaaaaacaaacaaacaaaggaacagaaattcacttttttgtgtattttattaagaattttaacacctctgttcaacagggacatcagcctgtagttttctttttgtgttgtttccttgtttggttttggtatcagggcaatgctggcatgctacaataagttggaaaaattccattttctttgcttttggcatagtttgagaaaaattactctgagtttttttttttttaatatttggtagaattcagcagtgacgataacaggttttgggcttttttgatgggtgaattttattactgatttaatcaacttactcattatttgtctgtttagatttctatttattcctaattcaatcttggtatgttgtatgtgtccaaaaatttgtccatttcttccaggtataccaatttattggcaaacaattgttccttatagtttttatgatcctttgtgtttctgtagaaccagatgtaatgtctcccttttcctctctgattttatttatttggatcgtctcccttatttttcttagtctaagaaaatgtttgtcaattttttttaaaatctttgctttactgattttgtcatacttacatttagtctctgcgttgtttgtttctgctctgatctttattatttctttttcgacttgtttttagtaatgttgttcttaaatttttagctccttaaggtgcaatgtttggttgtttatttgagagatttattctttttgataaggcatttattgttataaaatttcctcttagaactggttttgctgtatctcatctattatagtatgctgtgcttccattgtcatttgtctcaaaaactttccaaattttttttagttccttcattgagccattggttttaaatgtacatgttgtttaatttccaagtgtttgtaaagtttccaagttttattctgatgttaattgttgtataccattatgatcagaaaagattcttgatataattactatttttttcaacctgttacaacttgctttatgacctaacttatgatctattctggagaatattctatgtgcagttaaggagaatgtgttctgcagcagtcgaatgaagtattccgaaaatgtctgttagatctatttggtctagaatgttctttaagtccaatgtctttttgttgattttctgtgggaattatttttccattgctgaaagtggggagttgaaaactcctactatcattgtattgcaatctctctctctctttagagctattaatatttactctctctctctctctctctctctatatatatatatatataggtgctctaatgttgagtatatatatatatatatatgtttacaattcccatgggtatatgctgatttgatgcctttatcattatataatgactttcattgtttctttttctgtttttagttaaagtccattttatctcatttacatatttctgctcctgctcttcttttccaacagcatggaatatctctttctctccttttactttcagactatgagtccttagaggtatcatgtgtctcttgtagcaagcatagagttgagtgttttctttttaatccactaaccgactctatgtcttttaattgaataattcaatccattgacattcaaggtaattattgatagataaagattaactattgccatttggtaattatattctagtcatttggcagattttttttcttcctttcttcttcactcttttgtggttaaatgatttttttctatcagtgttgtttgactcttctctttttacttgtagtgcaattattatggatttgtgctgtggttattctgaggcccacaaaattcttatatttataacagcttattttaccagataacaacttgtgattcactttttaaaagaaaaaaacaactctacatttttactctaccttatcacacattttgaatttttgatgttacaactcacaactttttaaattgcatactctctaaccaattttgtagctattatttttaattgtttgctatattatagcttcatttctaagttctaggatattcagggtggtaatcttggctctcagtggttgcttttaagtttctgtaggagggagagaagctggagaactcctacactgcagttttgctgatgttattctctccatgattctcttattttaatgaacagtatcttaaaccacggcaagtatagtaatgtaaaataaagaataaacagaagaagtcaatgagagaacatgtgtggacttgagttatattcttccaacaaaacagaaaattttatatatatatatatatatatacatatatatatatatatatatatatgaatgtattgtactaaaaataaaagataccccaaaacacaactttaaaaacatttaaatatcaagaatatgctgaaacttttgtactcagtatgatctattgtgagttctgaaaatcagtatgctactctaaacacataaaaatacagagagtggaatgggatccagacacaccggtttgttttcatacaaccttatgtaattaagttgggtactggaaagcaaaggacaacagaaaattttagagacatggaccctgagagttactcattaatgattcatctgtatgtggaagaaactcacctattttccagtgtttaattttaaaattagtgttctcattttaagaagagtatgtgggataagagtattttgaccatttgtggggggggggaaaaaaaccttgccatgccaaacagcaggattttcacgagatgagtgtgccagatgtttattttcaacttgaaatcaacccagttcctatcttcattttcttctgcattgcagaagatcagcctgaaactacagtttctgaagttcctttctccatagcttgcttctcccttagattcccccatgagatgtacttaaagaagacttggaagaagagaaagacaagggattatctggtagcagctgctggtagcagctgagatcaccaacagtagctttctttgattctggacgttttgctgagaaacatccactgcagcaccatagataattagtgagggcatcactaagactcttgaacatcagaattttctggaaatagcatttttgacctttgttccctcagttcttccaatagttgcagaagcctttcgttccctttatggaaactctctttactcaaaaaatgagaaataaagtaaattaatgttttatgttacttttgcattcagtccattactgtgcctaaataaaattgtaccagtacatatcaggcaatcaaatccacagatgattgtgaaaccactaactggaattattgaagcattttgtaaaactctctgaactttgatatttactaaatgaccttaaagcccctagcttcatggtagtgcacttaaattcagaaccacacttggtaactaataatgaaagatttcaaaccccaaacagtgcaactgaaacttttgtattagcatactactgagaatatctaacatgttgttactaatcaatgtcattctgaccttgtgggtttcctgtgctaatggacaaggtaagttaaaagagatctaaacactcagcttccctcttaaatgtaacttcatgtaatatctagctttgtatgtctataattattttatgaatcaaagaggatttattcactatgctagtagaagtgacatattttgtgagagtataacagaaattaattttataaaaaattatctcattttaacttaaagaaaaaatgaataatgttttatttgttttctaagttctacagtgtaaaaggcatttaatattgattatggagatatgtgaatatactcatgaaactttaagtaggaaacatgtcattagacagattctaagcttaaaatgttcagaattttcctatacgtaatacaaggggaacattgggagtgactgatgttttcataatcttacatatggtgatttttatagatttatatatcaaaaaatcaaataatacattttaaattatgcagtttcttatatttctattatagcttaagaaagctgctaaaactaattaacattaatatcaacttactacgtcaacaaaattagcaacatacatatataatgaaaaaatagaatataaacttacattggaaagatagtaagttttgattggcatttctgagttcactagcaaatgttcaataagtaaatatacagaaaatacttttcatagcgttatgtcattgttcactgatttctcctagatagtcatatattttctgtattaattatctttttgaatgcaggccttgcatattaaagaactatatggtaacattagcagtggaaccacatgggtcaaaaatcatggacaatcaagggtgtgtgtccattaatgaagaatacaaattttgtaattatccaaaacttcatatttcagccaatgtaatggagggtaatactggaaatcccattatcaatttatgagactatcttttccctcaaccactcttcgcgaagctatgccactttatttgattctagggaaagagctttaagttttatagtattatctatcacatgatttgctagttttatttgttgcgcaaaatcaaacttgatctgtgccaaaatggaaaaaaaaaggaatttcaccagttatttccttttttaactgaactgttacaggtacatttcttcaaataaagactaaatagattaaagtagaatgcaaagaagaaaatactactattttgaaatgactggaattagagaagcatatgcactatattttcttacttactttcttaaaagcactatagaaaagaatgatgacaaattctttcttatctgatattccagtggaaaacttgcctcctccaatgaactctttgtaagagtaaacttgagcaaaatgtcttgtaaatttgggttgcacctatatttctcaaaggagaaagtaactcatttagtggaataacatcttgggtagagagaaacatctttgtgaattcagtagcattggctcaactgcatcccgccaaaattcatttgttaaagtccaaattcccaatacctgagaatgtgactgcatttggagaaggagtgcttagcgatgtaattaagttaaaggtcaatgattcaggtgggtcctactccaatataactggtgtccatataagaagagaaaataagaacacaccgtatagggaaagatcacgcaaggcatagagagaaaacaaccatttacaaggcaaaggaggaggtctcagaagcatccaatcctgttgacagctatatctcaaactagtagcctccagaactgtgagaaaataaatttctatgaaatcagtagtactttgttatggtagctctagcagatgaatactatgatatttacacaatgtattaaaagaatattaataattaaaaataactttttactttttactcaaggatatatatatatatatacccaccaacacagattttagagggtattcatcagaattgggtaattatatcttgggtgtattgtccttgctgatttttgtcttgttgaatactttgtgtttacatattatctgtattcatctatattcagaatctagtaaatcgaatcagcaaatatttttcatatgattaatgaaggatatactttgtgagttgcttatgctaagaatttttttttaatggtggttgatgtttcagttctgaacaataaaatcagcacaccaattcttttggaagccacgctatttgaaagataaacttgacagaaaatttgtaattgcaacctattataatgttcattgaatttgtattgaccaatatttcttccatcaactcataagttatttacacttatttaaaaacaggttgtcaggaaaattatttttaatcatgaatatcctttcagaattgtataaactttatattcatctactagagttgccataacaaagtgtcaagggtgacaattagtaatgtagagtagggttgcctctaaattccttttaaactgatcattttcagtacccaatgcattacagttaattgccattgtacttctttgggacgctcaaatttatttcaagtttaactaagaagctggcttctgtgtatatttcacgtgtccccattacactttggcataacaaaaggtcccaggatttccttgacttttcctactacagaccaagttccaataatttccctatgaaattccagtgccttttagtgggagaaacgattttcagaaacaaacctaaactatgaaaaactcactacagtttcgaaattatcactgactaagaaaagtaatttttggtcgagccggggggctcctgccttaatcccagcactttcgggggccaaggcgcgcggatcacttgaggtcaggagttggagaccagcccggccaacatgatggaacgctgtctctactaacaattcaaaaaattagccggagtggcggcacacacctgcaatcccagctactcaggagactgaggcaggagaataacttgaacctgggaggcagaggttgcagtgagccgagatggtgccactgtactctagccttggtgacagaacaagactgttaaaaaaaaaaaaaaaaaaaagaaaagaaagaaaaattaaaatgatttcctttaatatatgtccctttcttcttcagactaaatagcctgcaatcataagaaaatgtaagagtatctcaggaggttacacagtgcagggagatttagattttccaatatggaggagacactcagcagaaaactgtgcatccatgcttgagggactgggtcagagaagctgtcatgcgtcacccaacaagcctctggagccagttctgtaactagcaaacacttcccacaaagtaaagatgtcacttctctgaacttagtcttctcatctgcacactaaagctgttgtgccgctagcctccttcccgttctctctgatttatgatgattcaaacttaaagatttttccttagtgatattcttaagttttcccaataaataggctgtaaatattattttctatcacttgttccagaattatagaagaaacataaattatatgctatttaaattatggtattggtcaacattctatatgtctacatacatatagaatgtaagaatatatatatatttgaacattcgtgtatgcacctatttttttatgtcaataatatatctcatccgatacatgaattctaactatggtaagaatgcatgccatcgaatacaaacaaaatgccacaaaactcaagaaaatgttttatttctggagataattggtacatttctgattttttttaatgtttagagtcatatttcttgtttctcttttccaaaaaacaattattggtaatgtgtgcaccctgaactgacagctttagcataacttggtatagttctagataagctcagttcaaattaatgttgataaaacctccagaattgctaaagagaccatactacattagtagaagtagagaaagtagaatgaggttcttcttgtcctgttagctgatttgggatccattaaggattttaagtgtagaaataaaatgaccagatgaagggttattaatttatacccaggaaaacagattatacagatgagaggtcaggatcaggaaactagttatggttgctgtaattccacaagaaaatgtttgagagaaggtgatatcaaaatttatctctaatatgatttattacagtaaaaattatttatacttttttgtttgttttttattgcaagtgaaaccttgtgattttccagacattaaacatggaggtctatttcatgagaatatgcgtagaccatactttccagtagctgtaggaaaatattactcctattactgtgatgaacattttgagactccttcaggaagttactgggattacattcattgcacacaaaatgggtggtcaccagcagtaccatgtctcagtaagtaatcctctgaactgctacacatgtataaaactttaaaagattaaagagaggagagcacataattgattactcttgtcttatgtaacagaaatagggccaagaaatgagttgttcaagcaaaatgaccaaaatagatcttttctattatgaggagttcttgaaaatcatatgaaaaataaatatagagactttatgagaatatctatatagtttatacatattttaattatgaaaactaaagagaagtaatattaaatattgacatttcctcttgtacaacctttgttagtaattttggttcatactaagttgtacattatttttggatgtttatgcgatcttatttaaatatggtaacaataattttaatatactttttgtgcaaatttatgtttctcatttactttatttatttatcattgctatgtccttaggaaaatgttattttccttatttggaaaatggatataatcaaaattatggaagaaagtttgtacagggtaactctacagaagttgcctgccatcctggctacggtcttccaaaagcgcagaccacagttacatgtacggagaaaggctggtctcctactcccagatgcatccgtgtcagtaagtacaccgctctgagatcccagcatgttcatgtctttctaagtaacacggacgacagtctcagacttgtctatattaactgtggcaaaatgtttttgtcaacttgttttgccaacggacctatttagttttacttttttaattgtgtgaatatacaaatttcttgataagtacatagcaaaataaatgctcctattaatgggcattagtcaagaatacagtaaaagaattagaacacaatacttgttggctaaataaagtcatattgaagcggcattaatgtctcgggtaaatacccgaggttcgtcatcttgcaccaagaagattaagtacaaatgggtattctgggatcttgtacatattctactctagaaggtttcctacagtatttattcaaatatacatttatataaacagttccttcttttttcacatgttgctaatgattggtgatgtcacattttaatatttacaagttgagtggctataaaatggtatagcattgtaatgtaaatttgcatttcttttactaccagctggatttagaatacatgttcacagtttaattggtatttaatgattctaaaatttggaaatgcagtttgatttcttttatttatctttttgggagttttggttgttattagttggaatcatcttaataattctgaaggtaaaatctcttttaattatatgtaatgcaaatgcattctctttgtggctagtattgttctttccttttttctgcattatgaacaagttgctcattttactaaataattgtcaatcttttttcatgatgaatgttttttggttctttttttatattttattattattatattttaagttttagggtacatgtgcacaatgtgcaggttagttacatatgtatacatgtgccatgctggtgtgctgcacccattaactcatcatttagcattaggtatatctcctaatactatccctcccccctccccccaccccacaacagtccccagagtgtgatgttccccttcctgtgtccatgtgttctcgttgttcagttcccacctatgagtgagaacacgtggtgtttggtgttttgtccttgtgatagtttactgagaatggtgatttccagtttcatccatgtccctacaaagaacatgaactcatcattttttatggctgcatagaattccatggtgtatatgtgccacattttcttaatccagtctatcattgttggacatttgggttggttccaagtctttgctattgtgaataatgccgcaataagcatacgtgtgcatgtgtctttatagcagcatgatttatagtcctttgggtatatacccattaatgggatggctgggtcaaatggtatttctagttctagatccctgaggaatcaccacactgtcttccacaatggttgaactagtttacagtcccaccaatggtgtaaaagtgttcctatttcttcacatcctctccagcacctgttgtttcctgactttttaatgattgccattctaactggtgtgagatggtatctcattgtggttttgatttgcatttctctgatggccagtgatggtgagcattttttcatgtgttttttggctgcgtaaatgtcttcttttgagaagcatctgttcatgtcctttgcccactttttgatggggttgtttgtttttttcttgtaaatttgtttgagttcattgtagattctggatattagccctttgtcagatgagtaggttgcaaaaattttctcccattttgtaggttgcctgttcactctgatggtagtttcttttgctgtgcggaagctctttagtttaattagatcccatttgtcaattttggcttttgttgccattgcttttggtgttttagacatgaagtccttgcccatgcctatgtcctgaatggtaatgcctaggttttcttttagggtttttatggtgttaggtctatcatttaagtctttaatccatcttgaattaatttttgtataaggtgtaaggaagggatccagtttcagctttctacatatggctagcctgttttcccagcaacatttattaaatagggaatcctttccccattacttgtttttctcaggtttgtcaaagatcagatagttgtagatatgcagcgttatttctgagggctctgttctgttccattgatctatatctctgttttggtagcagtaccatgctgttttggttactgtagccttgtagtatagtttgaagtcacgtagtgtgatgcctccagctttgttcttttggcttaggattgacttggtgatgcgggctcttttttggttccatatgaactttaaagtacttttttccactttggtgaagaaagtcattggtagcttgatggggatggcattgaatctataaattaccttgggcagtatggccattttcatgatattgattcctcctacccatgagcatggaatgttcttccatttgtttgtatcctcttttatttccttgagcagtggtttgtggttctccttgaagaggtccttcgcgtcccttgtaagttggattcctaggtattttattctctttgaagcaattgtgaatgggagttcactcatgatttggctctctgtttgtctgttattggtgtataagaatgcttgtgatttttgtacattgattttgtatcctgagactttgctgaagttgctaatcagctttaggagattttgggctgagacaatggggttttctagatatacaatcatgtcacctgcaaacaaggacaatttgacttcctcttttcctaattgaataccctttatttctttctcctgaaggagatccctggccagaacttccaacactatgttgaataggagtggtgagagagggcatccctgtcttgtgctgattttcaaaggaatgcttccagtttttgcccattcagtatgatattggctgtgggtttgtcatagatagttcttgttattttgagatatgtcccatcaatatctaatttattgagagtttttagcatgaagcgttgttgaattttgtcaaaggccttttctgcatctattgagataatcatgtggtttttgtctttggttctgtctatatgctggattacatttattgatttgcgtatattgaactagccttgcatccccgggatgaagaccacttgatcatggtggataagctttttgatgtgctgttggattcggtttgccagtattttattgaggatttttgtatcaatattaatcaaggatattggtctaaaattatcttttttggttgtgtctctgcctggctttggtatcaggatgatgctggcctcataaaatgagttagggaggattccctctttttctattgattggaatagtttcagaaggaatggtaccagttgctccttgtacctctggtagaattcggctgtgaatccatctggtcctggactctttttggttggtaagctattgattattgccacaatttcagagcctgttattggtctattcagagattcaacttcttcctggtttagtcttgggagagtgtatgtgtcaaggaatttatccatttcttctagattttctagtttatttgcgcagaggtgtttgtagtattctctgatggtagtttgtatttctgtgggattggtggtgatatcccctttatcattttttattgtgtctatttgattcatctctctttttttctttattactcttgctagcagtctatcgattttgttgatcctttcaaaaaaccagctcctggattcattaattttttgacaggctttttgtgcctctatttccttcagttctcctctgattttagttatttcttgccttctgctagctttgaatgtgtttgctcttgcttttctagttcttttaattgtgatgttagggtgtcaattttggatctttcctgctttctcttgtgggcatttagtgctataaatttccctctacacactgctttgaatgtgtcccatagattctggtatgttgtgtctttgttctcgttggtttcaaagaacatctttatttctgccttcatttctttatgtacccagtagtcattcaggagcagtttgttcagtttccatgtagttgagcagttttgagtgagtttcttaatcctgagttctagtttgattgcactgtggtctgagagacagtttgttataatttctgttcttttacatttgctgaggagagctttacttccaactatgtggtcaattttggaattggtgtggtgtggtgctgaaaaaaatgtatattctgtcgatttggggtggagagttctgtaaatgtctattaggtccgcttggtgcagagctgagttcaattcctgggtatccttgttgactttccatctcgttgatctgtctaatgttgacagtggtgtgttaaagtctcccattattattgtgtgggagtctaagtctctttgtaggtcactccagacttgctttatgaatctgggtgctcctgtattgggtgcatatatatctaggatagttagctcttcttgttgaattgatccctttaccattatgtaatggccttctttgtctcttttgatctttgttggtttaaagtttgtttcatcagagactaggattgcaacccctgcctttttttgttttccatttgcttggtagatcttcctccatccttttattttgagcctatgtgtgtctctgcacatgagatgggtttcctgaatacagcacactgatgggtcttgactctttatccaatttgccagtctgtgtcttttaattggagcatttagtccatttacatttaaagttaatattgttaaatgtgaatttgatcctgtcattatgatgttagctggttattttgcttgttagttgatgcagtttcttcctagtctcgatggtctttacattttggcatgattttgcagtggctggtaccagttgttcctttccatgtttagtgcttccttcaggagctcttttagggcaggcctggtggtgacaaaatctctcagcatttgcttatctgtaaaggattttatttctccttcacttatgaagcttagtttggctggatatgaaattctgggttgaaaattcttctctttaagaatgttgaatattggcccccactctcttctggcttgtagagtttctgctgagagatctgctattagtctgatgggcttccctttgtgggtaacccgacctttctctctggctgcccttaacattttttccttcatttcaactttggtgaatctgacaattatgtgtcttggagttgctcttctctaggagtatctttgtggcgttctctgtatttcctgaatctgaatgttggcctgccttgctagattggggaagttctcctggataatatcctgcagagtgttttccaacttggttccattctccccgtcactttcaggtacaccaatcagatgtagatttggtcttttcacatagtcccatatttcttggaggttttgttcatttctttttggtcttttttctctaaacttcccttctcgcttcatttcattcatttcatcttccatcactgataccctttcttccagatgatcacatcggctcctgaggcttctgtattcttcacgtagttctcgagccttggctttcagctccaccagctcctttaagcacttctctgtattggttattctacttatacatttgtctaaatttttttcaaatttttaacttctttgcctttggtttgaatttcctcctgtagcttggagtagtttgattgtctgaagccttcttttctcaactcgtcaaagtcattctccgtccagctttgttccgttgctggtgaggaactttgttcctttggaggaggagaggtgctctgcttttagagtttccagtttttctgctctgttttttccccatctttgtggttttatctacttttggtctttgatgatggtgatgtacagatgggtttttggtgtggatgtcctttctgtttgttagttttccttctaacagacaggaccctcagctgcaggtctgttggagtttgctagaggtccactctagaccctgtttgcctgggtatctgcagcagtggctgcagaacagcggattttcatgaaccgcgaatgctgctgtatgatggttcctctggaagttttgtctcagaggagtacccggccgtgtgaggtgtcagtctgcccctactgggtggtgcctcccagttaggctgctcgggggttggggtcagcgaccaacttgaggaggcagtctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcctggctgctttgtttacctaagcaagcctgggcaatggcaggcccccctcccccagcctcgctgccgccttgcagtttgatctcagactgctatgctagcaatcagagagactccgtgggcataggaccctctgagccaggtgagcgatataatctcctggtgtgccgttttttaagcccgtgggaaaagcgcagtattagggtgggagtgacccgattttccaggtgccgtgtgtcacccctttctttgactaggaaagggaactccctgaccccttgtgcctcccaagtgaggcaatgccttcccctgctttggctcacgcacggtgcgctgcacccattgtcctgcacccactgtctggcactccctagtgagatgaacccagaacctcagatggaaatgcagaaatcacccgtcttctgcgtcgctcacgctgggagctgtagaccagagctgttccgatttggccatcttggctgccctctatgatatctattttttagttagtgctctgttgctttaaattaaggctcatcttcagttacagctgacttttactttttaagtaaaggggactctgaaaattgtttgtgtgtattgtttgcaatttacaaaacattccattatagaaaccgcataataattatggaataattgagacgaaagataatgggaatcttcctacaccattataggagcaactgtcctcaacaatagcctaagcccctgaaagaaaagtccctttttctcctgccataagcaccaactctatcattaatccacctaataaatattgttgtgtgtcaagcactttgtaggtattgaaaataaagctgtttacaatagaaactgaacattgtagtttagaggctggaggagattaataggaaagtaggcaagaatagatcagaaaactcatgattatgacaaatgctatattataaatatgcatcatctttaacatgatttctttttctttcagatagtaaaattggtccatttacatttgtttttgaattactaattagaaaagaacatatacattactaatatcttaaaacatatgcgttactaaaataattactaccttgtacatatacccattagtaatgtatagaacacatacattactaatatataaagaacaaatacattgctaatatattagaacttatttttgctatcttgcttgctttcttttttctgcttacatttccacatgcctctcaaacaccacgtctatatgggtttaagcacccacttaagatgacaaccattttaaattcttggagacaaaggatttacaaaattactttcttgcctatggtagcagggtgtaccgtatctttgcctgggaaatggcatttgacttaatgaggtttaagaccccttaatagtaccaaaaatactcaggttgttgcaaagtagccagaaagtcttccaaaatttcattagggactggagagtctcctagatctgcactcctcaaggactgccagagctctgttgacagtctcaaggattctttgctttcattctgcccttccctgtgttcaacatttccttcagaaattcgtggtttcctttaagaacacggatgtctaggaaacttccagttttgctgttttcaattcattaacaaatgtttcattgtttcgccatattgccatgtttttacttgttccctcctataaaagaactattcaactaatatttacttttttcttgactttttctattttaggaacatgctcaaaatcagatatagaaattgaaaatggattcatttccgaatcttcctctatttatattttaaataaagaaatacaatataaatgtaaaccaggatatgcaacagcagatggaaattcttcaggatcaattacatgtttgcaaaatggatggtcagcacaaccaatttgcattagtaagtgatttacatattcccattcagtttctgtcaacttcgttcctctctttgagatgatagtgttttacttaaaaatatagaaaacaattttaggagtaaagagatacaaatacttctaaaaccattcaacattctgtgccaaattaagtcttttgcatgtttagagtaatggctacttgggaagatgatcatttcatctcttacaactcaatctgcctttacataaaagcaatcttatcatgtacagactagttagggagctgcatgagagtatcagcaaaatatgttagttgccaataaaaactttgttgtcttccctttctttgtatttcaaaattatcagctgcttgtattgcattccgtgctcacgctcagaaaagttgtacatgtcgggggagaaatgagtgcttaattctgaatttctgctagcgtcaggagaatcagaccttaataatttgtatcaatgatgctactgaggatatccaatcaaaaaattatctctaccctattgtttactacagagaaaacaagtaaaggaaaagggtaagtgggtgggctgaatgtttacaaacctcatacttgccaatggattctttacatgtaaagttctctgaacgtgctcgacctttacttagtatgataaagagaatgcataatgaacaaaggaaatctttcagtggcaaaagttgattttttttctttcctctttatatattcacaaagagttttaaagataaattgctgaatgtatttttaacccaaatactgttgtataatttacatactcccaaatccacttcattttcaagggtacaattcaactatttttagtcatgagataatatggaaccttgatacataatacaacatggaagactctcaaaaatattaagctaagagagaaaaaagatacacttacaaagtgattatctcaatgttatcatgagttttgggggttatatgaattcctacatttctagaatactgttttcaatttctatacttatcaagggctctgtgtaaagaaaaaggtgtatacttcaattttactcagctttgataaatgatctactttaaaacttgtgaaataaaagacaggatgcttcataaattttatagaacttatatccaattaatataatttttatctaatatatacacccttactgttagtaaatcgttacataactacataaatggttacattaacttttaaattcacaaatttaaaagcggtttaagctccgtgacacattggactacgaatgctacgatggatatgaaatcagttatggaaacaccacaggttccatagtgtgtggtgaagatgggtagtcccatttcccaacatgttatagtaagtattttattcaagtattttttattagaattaaataaaataataaatagacacctacatatgtatatgtacacatatgtgtgtacatatatgtacatatatatgtagtcctcctatgagtgtgaattatcttgagacttaaaaagaaaaaacaacgttgaaaatgcagatgtcttcctaagaaatcaaataagatacagttaagagtatataaaaagctttatttagaaagtttccaataagactattgatttttccccacatataaagtattttttttcagattcttcagaaaagtgtgggcctcctccacctattagcaatggtgataccacctcctttctactaaaagtgtatgtgccacagtcaagagtcgagtaccaatgccagccctactatgaacttcagggttctaattatgtaacatgtagtaatggagagtggtcggaaccaccaagatgcatacgtaagttcttaaaattctagatcctgagaaaatcagagtaataagtttgatatttgcttttttatactagaatttttatgggttattaccctagaactgtgttcacaaacagctattctgctgaatgtttgcctttcagatcttaatatataagtgtataagcttggaaaattccatgtaaacaatgaccaagtttcttttttaaaacaggaatgtcggcctggggtggtggctcacgcctgtagtcccagcactttggaaggccgaggcaggcagaccatgaggtcaggagttcgagatcagcctgaccaacatggtgaaccccgtatctacaaaaaatacaaaaattagccaggcatgctggcatatgcctgtaatcccagctactcaggagggtgaggcaggagaatcatttgaacccgggaggcagaggttgcagtgagtggagattgcaccattgccctccagcctgggcgacagagggagaccccatctccaaaaataaaaaaataataaataaataaataaataaataaataaataaataaataaataaaacagaagaagaagaaaagaaaaagagaaaaagaaaaaaccaagaatgttcagagtcttcaatttgttaatggatacaatgagtcttcaagaatgacaaccatttattgcgcacatatgaaatatggcatctcagcttaacaccagtaatcattttcacattattaacacttaggtaaagagttttcaaacagttctgaaaacattgtttcaaaaaaccacaaactattaaaccctacttgaacacatgaaatttttcctgatagaacacatagctggttaacactgagaagttctttctctgattattattcttacttatattttatcagtattcctagcaagcaacaaagaaattaacgaaacttcagccatttccataacccattgcttttccatttttaccttattctcctcttcccttataccagaatcaaaatgaatacactaaaaacccctcaagccagtaatataggtatacttccagaattttgtcccccaagtactatgaacttgaagcaacacaactcaaaaaatataagccacaatgattatggcaacaacaagaaaacctaaaagaaaatttgccacaagtttctactagcctatgaggtagagccctgggacacccatcagtccttgaatgtcagataacctattcctatcacagctcttaaactgtaagttcatgagtttttcaagtgctcaagttcctaagtacaggatgatacaagcagttgttttctgtgatgtgactcatttcctttattttgatgctatgctaccttttacctttcatattgactgatgacgctgatattttggctgatcttacaatgggctaaaccttaattattgtcccctacttaagtatccacttctgtagatgatcatgtccaagtttgagctccaaactatgcaagtggtaagactgaagaagaaattagtatcctcaaatcaaaatagtttacaagtatcttcaaacttgatttcatagaaaagtgttaggtttcagagataaattctgagtcttaaatttgattgactgaggagatggacactcctaagatgggtttcacagcaaaagcattacctcttctcacaatcaagaacaggaaaggattataattatctgaagatataagatcagttctatgatacaagcaagactttcagtcttcaaaactaaagaagcaaagagcattcaagcacagaattctagggaaaaaggcaaccttatggaaaagattacatatacatatggcatattaaagcaatgaggaaaattttcccaggcagcaggaaactttagaaagttttggaaaatatgtttggagaagtatttagagttcaaacaatatttatttttgaattgtaaacagcccctgaatgtattgaagagctcttaaaattttttggatttcaaaagtgatatgtactatgttaagaaatttatttaagtaagtacttgaaagatgtattaaaatatgattggggaaatttctaaagaaatgctaatgctaataagggctaaactagaatgcagaatacttgagtcaaaagaagagataggtgagtgaatgatatcatcaaaagtgaaaagcttgctatgtaagaactgacatttttatcatgtaagtactaggcttaatacctggggtatgggttgataggtacagcaaaccaccatggcacacatttacctatggaacaaacctgcacatcctgcacatgtaccctggaacttaaaaaaaaaattataaatttttttacaaaagaattttataaaagaaaatccatatgtggaagtaacattatcttactgattttacagatgaaggcatagtgagacagagtaatttgtccataatcatgtagggattcatattaactctgtgtgcttatccttgcctctctttaaaatagaaaatgaagatgacagggatagatgatgttgatagagagagagataactgatagatattgaggtatatttatgtatgtatgtatgtatgtatatatagtttcattttaacagatgactattagaaagattatacctttctacagttctgtttctacattgtgggcataagagaaaaatataaacatagaattaaattagcaaaatgtgagtacatttggagtgcttgtagtcacggcttgtcgaatgggggaaaggaggataagtaaccatgactccaatggaacatgttagcataatcctttttgatatgaagtcactagggtggacacaacatattttaggaaagaagagttcaggctctagagaaagactgccagggttcacgtttatcacctcacctgatgatctctgctgtgatgttggggaagtgcaactgaacttattatatttttgaaatgctaacgtcagtatgtagcacaagttaataactattaactatttggattattttataattttattttatcctaaactactcattaggatgcattttatttgctcatgaaagagaaaattatgattgttaattgtttttttctgctttcagatccatgtataataactgaagaaaacatgaataaaaataacataaagttaaaaggaagaagtgacagaaaatattatgcaaaaacaggggataccattgaatttatgtgtaaattgggatataatgcaaatacatcaattctatcatttcaagcagtgtgtcgggaagggatagtggaataccccagatgcgaataaggcagcattgttaccctaaatgtatgtccaacttccacttttccacttctcactcttatggtctcaaagcttgcaaagatagcttctgatattgttgtaatttctactttatttcaaagaaaattaatataatagtttcaatttgcaacttaatatattctcaaaaatatattaaaacaaactaaattattgcttatgcttgtactaaaataataaaaactactcttatattggacttcttatcaatgaattagtaagtatagagacagacagctgaatggctttctgcatattgtatagtatacctagacatagaaacaaaatgactttagattttatttggggaagtaataataccataaaattagatattaaaattgtaagtgaagataaacacactatagtattcccttattgtagccatggtcctctagatgcagttaaccaaatagggtcatttttattaaaagtagtgtttcctggcaaacactgacattacatcattatcatgatttaaaggaaatagtactagagaaggtgaattattatcattttcctgtgaaaaaagaaaagaggttttgctaaccctttcagagcattgggaacacagccagaagtgcattaaatgtatatattaacttgggcaatgttgacactttaggatgctgaagccaggtgcagtggcacacgcctgtaatcctagcactttgagaggccaagctggcaatcatcagaggtcaaaagttcaagaccagcctgttcaacacggtgaaaccctgtctctactaaaaatagaaaaactagctcggcatgatggcgtgcacctgtagtcccagctactcaggaggctgaggtgggagaatcactttaaccagtggggcagaggttgaactgagccaagatagtgccactgcactccagcctgggcaatagagtgagactctgtcttaaaaataaataaataggatgctgaaaattcctatttaaggaaataattctttttctgatttatttaaggctacatttgtattttcttaatacaaatattttgaaagtttcttcatatatggttttttgcatttcttattaagttttgcttcagatttttttttgtcttttctcctgttaattgccttcactctctttctgttctgtacttttctttgtatataaggattttttgaaaagattgtatatccctgttaacaaattgaaatctctattcactttaatagatttttacccccagttagcatatggttagtgagaagttgcagggtaagaagaaaacaatgttccctttcccaacacttttcctgattatagagaaaaaagcatgaacttgtataatgatctagtcctgtacagaatgagaaatattaattgctagactgagaatgttttggtggctaaagctaggaataactttttaagactgaagaatgatataagctatcaaatctaactcagttttcaaataacaggtttgcagagactggagaataaaaagtaaaaaattgttttattaattccagtgactaattctacttcatcaacatacatcataaataaaatttcaaaaataattgctgatatggtttggctgtgtcccacccaattttcaccttgaattatataatcaccatgcatcaaaggtagggccaggtggagataatggaatcatgggagcagtttccccataccccactcatggtagtaaatacatctcatgagatctaatggttttataaatgaaagttcccctggacaagttctcttgcctgccaccatgtaagatgtacctttgctactcattcaccttctgtcatgatggtgaggccttcccagcaatgtggaactgtgagtccattaaacctctttcctttataaattacctagtctcaagtatgtttttattagcagtgtgagaatcaactaatacagtaaattggtattacacagtagagtggggtgctgctgtaaagataaccaaaaatgtagagtgactttggaactgggtaacagacagaggttggaacagtttggaggactcagaagaaggcaggaagatgtggggaagtttggaacttcttagagagacttgttaaatggctttgaccaaaatgctgatagtgatttggaaaatgcaatctaggctgaggtggtctcagctagagatgagaaacttgttgggaacaggagcaaggtgattgtcgctatgttatagctcagagactggtggcattttgccacttccctagagatgtggaactttgaacttgagagatgatttaaggcatctggcggaaaaaatttctgagcagcaaagcattcaagagatgacttgggtgctgttaaaagcattcaattttatatattcacaaatatatggtttggaattggaaattatgttaaaagggaagcagagcataaaagttcagaaaatttgcagcctgatgatttgatagaaaagaaaaacccattttctggggagcaatttaagctggctgcagaaatttgcacaagtaatgagaaaccaaatgttaatcaccaagacaatggggaaaatgtctccagggcatgtcagaggtctccagggcatgtcagaggtcttcaggacaacccctcccatcacaggcccagaggcctaggagaaaaaaatggttttgtgagcagggcccaggaccatgctgctttttgcagtttcaggagttggtgccctgcatcccagcaggggctaaaaggggccaacatagagctcagaccattgctttggatggtgcaagccccaagccttggtagcttccatgtgatgttgagattttggttcacagaagtcaagaattaaggtttgggaacctctgcttagatttcaaaggatgtatggaaatgcctggatgtccagcaaatgtttgctgcaggggtggggccctcatggagaacctctgctatggcagtgcagaaggaaaatgtggggtgggagcccccacacagagtccccactggggcactgcttagtggagctgtgagaagaggcccactgtactccagaccccagaatggtagttccaccgacagttagcatcgtgcacctggaaaagatgcagacaatgccatcccatggaagcagtcaggagggaagctgtaccctgcaaagccacaggggtggagttgcctaagaccatgggaacccatctgctgcatcagcgtgacctggatgtgagacatggagtcaaatgagatcatttttgagctttaagatttgactgccctgctggattttgtacttgcatgagacctgtagcccctttgttttggccaatttctcccatttggaacaggtttacttacacattgtctgcaccattgtctgtaccattgtatctaggaaataactaatttgcttttgattttacaaagggacttgccttgtctcagatgagacttgagactgtggacttttgagttaatgctgaaatgagttaagactttgagaggcttttgggaaggcataattggttctgaaatgcaaggacatgatatttgggaggggccagggtggaatgatatagtttgactctgtgtctctgctcaaatcttaccccatgttaagggcagggccatgtggagataattgaatcatggggactatttccccatattgttctcatggtagtgagtaagtctcacaaggtctgatggttttataaatgggagttcccctgcacaagccctcttgcttgtcaccatgtaagatgtgactttgctcctcatttaccttccaccatgattgtgaggcctccccagccatgtggaactgtgagtcaattaaacctcttgttttaataaattacctagtctcaggtatgtctttattagcagcatgagaacagactaatatgattgccttagtttcctaaaatggtacaaaaataaatggcaggaaaccacaactgtaggagcaacaaacaatatcatcaggaagaggaaaataaaatgtgatataaaagcatcagtggggttattaaagagtagagtatgcacctagcaaagtgaattggtgtgacagataagaaatttggtgtagtgggttttaaaagggaaaccatagaggaatgattacagagattattaatctggagaataaaccataaaaatctaagtctagggaagaaaccagtacaattgcaataagtacaatcatcaaaatgttcttacattcctttctaaacaattattcctagtgtatagcttaatgtggttccaggcaaagtgagagataaaatctcacagaaacattatctagccaattgttttttaattataagactaatgaacaaatcttacaaatctttaggcaggaaaataaaaatgactgaaaatgaaatcttagggaaaatagaatggttgttatattaaaatgtaaatatacttggtgtgatatttatcaagcaaaatagctgtttatgggccagacatagtggatcaacctgtaatcccagcactttgggatgctgaggtgaaagggttgcttgaggtcaggagtttgtgatcagcctgggagtcacagcaagatcctgtgtataaaaacaaagaaaactaattagctgggcttggtggtgcatgcctgtagtcccagctactacaggaggatgaggtgggacaattgtgccactgcactccaacccagcgacagagccagtccctgtctcaaaacgaaaataaaacaaacccccccatttattagttcattaatttgtgcctagaaaccaattgttttaacacatccattaagaatcattatatgccaagccttttatctagataggaagcacattttgaatttgaaaatactattgcttgatatgaagttaattataacttctttgaagatacaatgcaaacacaaaattcagaatacaaaagtatgtagacagtatgttgttaacaataagggaagaaaatatagcggggagattggcaggaaaaacaagacattttgattttatcactttgaggtttcttctactttacagttattttatttatttatttatttttaattttgtgggtacacagtaggtatatatatttatggggtgtatgaggtattttgatacaggcatgcaatgtgagataagcacatcatggagaatagggtatccatcccctcaagcatttatcctttgagttacaaacaacccaattacactaagttatatttaaggtatactattaaattattgttgactatagtagccttattgtgctatcaattagtaggtcttattcattcttctaattatttatttgtacctattgaaaataggtacccacctcctctctgacacccccaaccactgcctcccaccactagccccttgctacagtagcccattcatctactgtctatgtccatgagttcaattgttcttatttgtagatcccacaaataagtgagaatatgtgaagtttgtctttctgtgcctggcttatttcacttaacataatgatctccagttccatccatgttgctataagtaactagatcttattcttttttatggcagaatactactccattgtatatacataccatgtatatacatggattttcttgatccattcatctgttgatggacacttaggctgcttacaaaccttagctattgtaaacagtgcagcaacaaacatagggatgcagatgtctcttccatatactgatttcctttcttttgggtatatgccctgcagtgggattgctggatcatatggtagctcaatgtttagttttctgaggaacctccaaactgttctccatagtggttatgctaacttgcattcccaccaacagtgtacaagtgttcccttttctccatatcctcccaagcatttattactgatttttggatataagccatattaattggagttagatgatatcacactgtagtttcgatttgcatttctctgataatcaatgatattgagtaccttttcatatgcttgtttgccatttatatgtctttgtttgagaaatgtctattcaaatcttttgcacgtttttaattggattattagaatctttcctatagcgttgtttgagctccttatatattgcggttattcatgccctgtcagatgggtacttcacgaatattttctcccgttctgtgggttgtcacttctctttgttgtttcttttactgtgcagaagaagatttttaactttatgtaatcccattggttcatttgtgtttaggtttcctgtgcttatgggatattgcccccaaaatttttgaacagacctatatcctggagattctctgcaatgttttcttgtagtagtttcatagtttgaggtcttagatttaagtctgtaatctacgttgatttttttttatatggtgagacatagggtctagttacattcttctgcatatgaacatcctgttttcccagcaccatttattgaaagacagtcttttccccagtgtacattcttggcactcttgtcagaaatgagttcactgtaggtgtgtggatttacttctgtgctctctattctgttccattggtctatgtgcctgtttttatgccactattatgctgttttgattactatagttgtgtagtataatttgaagtcaggtaatatgattcctctagttttgttcttattgcttaggatagctttggctattctgggtcttttgtggttccatataaattttagaattgttttttcctacgtctgtgaagaatgttattggtattttcacagtgattgcactgaatctgtagattgctttaggtagtatggacattttaacaatgttgattcttccaatccataaacataaaatatctttccatctttttgtatccttttcaatttctttcatcaggcttttatagttttcattatagagctctttaacttctttatttaattcctaggtatttaactttatttgtggctactgtaaatgggactactttcttgatttctttttcacattgttcactgttgacgtatagaaatgctactgatttctgtatgtttatttcatacccagcaaatttaccaaatttatcagttctaatagttttctggttgagtctttaggtttttccaaatataagatcatatcatctgcaaacaaggataacttggtttctttcttcccaacttggatgccctttgtattcttctcttgcctgattgctgtagctaggacttcgtgtattatgttgaataactatgtaacagtgggcatccttgtcatgttccagtcctttgaggaaaggatttcagtttttctccattcagtatgatactaactgtgtatctgttgaatacagcttttgttactttgaggtgtgttccttctatccccagtatttgagggttttcatcatgaaggatattgaattttatcgaatgctttttcagcatcaactgaaatgatcgtatggtttttatccttcattctgttaatatgatgtatcacattgattgacttgtgtatattgcaccatccttgcatcccacaggtaaaccccatttggtcatgatgaatgatctttctaatgtattgctgaattcagtttgctagtattttgttgaggatttttgtatcgatatttattagagattttaacctgtaattttctttctcttttttgggtgtgtctttgtctaattttggcatcagggtaatactggccccatatattccgccagcatctgccatacctcagtaccatatcagaaagaaggagcctagagtattattctgtttctctgggatgttctctcacatacatgcattccctcatcattggtcacactttttgccattttctgtttactatcaatcttaaccaagcttagcatctgtggatggaagtccataggtgagctataatacccacccatagagtgcagcaatagccccttgcatcaatagcctttccagaacttccctctatgaacattcccaataagaaaaagtacagttacaaatataaaatatggcaggagtatctctaccactagtcagggggcagcatctaggcagtcttagtttagtgagagaaataatcattcctcagcccgttgtccctttagtaatgtacacttaaattcagaggacttgaagtaatgttttcagctgcaatgacttcttgtggtaaaatctacagctgtaattctaaattggtaaaaatggatctggcaaaacagaaacagtttacggggttggaaatatgtacgagctgaccattcatgacatttgccataatccatgtgtctgtacatctgtaagcattgcctttgggataaccactcaattctttcaaacttccagatatattgctttcaatgttatttaccacgaatcttgccttgtaatctagattttattatctacaaggtgattgcttcactcaaattgggacgtgctgtcagaaaaacagacagattgctttgcacaaggagaagaagaatcacagagtttagaccatttcaaaaaaggagccagaagttcttttgtggattatatcattggtcaaaaatgctggctgcaaactgcttatgaatgtaacatacaccaagagcaaccaccagtggagagttgctgcatgtgtcatttccatattattagtttttctaaactgttccatgctaattggaatgtttgtctgatattacctatgaaataataggcattttgagttttagatttattaaccacaatggtgagggctatcttcatcaaagctcagtaatgaacaaggaattgtcttttaatccccctttaaaaattcacaaataataaccatacatatttatggggtgcatagtaatgtgtgtgtgtgtttgtgtgtgtgtgtgtgtgtgtgtgagtgtatatatatatatatacacacacatatatatacacacacatatatacacacacacatatatatacatatatatatacacatatatatataatgtatagtaatcagagtaattagcatctccattatctcaaacatttatcatttctttctgttgggaacactgaatattctccttccagctatttggtactatctagtatattcttggtaactgaaaaaaaattacatctaagtgttaacctcaggtatcttgaaatgccaactcctaacagtcatagcctgggagttcatgttagccttcttgcaactatgcatatccacataattaatcaaaatcatttgtgttttggtgagaattagcatctgcaatggtgagttttatgtgtcagcttagctaggctatcaatccaagttatttaatcaaatattaatctaagtgttgctgtgaacaaggtattttatagatggagttaataacatctacaataagttgcctttaagtaaagattacccttgataatatgggcgggtcacattcaatcaattgaagcagtaagagtcaaaacttcggcttcccaaagaagaaattctaccttaagactgtaacatcaactcttctctgagtttctactctattaacctgccctgtgaattttggacttgcttatactcacaaatcaagtaaaccaattgcataaaacaaatctctatctcatctatctatacacacctcacactatacattctgtttctctggaaaacactaatacatcatcttaccacttcacatttttaagcaattaaaatctctcactatcttcccaagatttggtattacttaatattcactagagaggctggtttgaccgattataaaattcccatttaacaagaataactaagaccaggtgaagagagcccttttccaaaatctgactataagtcggtaattgaattcactaccaaattacaaaccatttatttcaaggactctgtggaaagattaatctggcaggcaccgatacttctctgttttgcaaaacagaccacatatttaatgttatttctctagtattgatggtcatttggtctttaaatcctggcgcttggaaggtaggatctgttgatgaagggtcagagtgaaggagtgccatgatttaacctgtatctccccaagtctccatcaaaacctttgtcacacatgaagccaattatatttggttcagatatttatctcaatattgctggggttgaatgttcatttgctttactttccaccatgagatgttttaatatcaccaaacttgctagcagcaaccaagaaaatgtatttctagtaatttctccatcattttgtatcacattctaaatacatatatatatatatatatatatatatatatatatatatatatatatataaaacaaactcttgagtcaaagtcatatactccaaactacactcctacaattcattccagataatcttcctctgaggattttcccttcagacaaagagtggattggtaacaccctggcaataaacatttgtcatacccttcatcctatcctccttaaatttcatggtgcctttgccatatcatgaagaaggaaagaagctcagtgtccacttctgataccactctgccactcctacactgctaagctaacagcagtgatcttgctttcagaactagcaattcacatttttacctatcattatgttaactgctgaaaattatttaacacagcattaatgtcaacagcatagtgagaattgtgactcttatgtgtagtgtctgattatcctaatcttcaccttgaattcatatgtttaagggagatgactcaatgagtgtctgtgacctctgaagttcttccatctcctttcctttattagttgatgagctccctcagctgcatcttatgaaatccagttatttattatacttattttagatgaacaacctaaaaaatgtgatttgagcacttaactcagattcttatttatcttcaatctggtgtacacctaaagattctcttgcaagaattttaacaagggtcaaattatcagtcttctatgaaattacagaaaatatcacagacttgtttttaaaacttttcttaaagaaacaggcagaaaactgtcaaaaacatgggtgagcgctaccgaggtagagaaataaaacattactctttcattagatacaattaaactttgaaaacacatttaaatatgatttctaaaataggtaagacttggttacatttgatgacaccaataaagatgaactaggtaagtaatcataatggagtacattcttaaatgcaattatttttatgacacatacgtacctcagagtggagataaattaaaatattagtatgtaatgtatcatagttactatgttttgcagattaaagatgtccacaaataatttgaaaatcctctgattaagtgacctatttccccatcatcttgaacttgtgctaacccatgacttttctgaccaataggatatggtataagtatctctatgccagttacggatgtaagctttaaaaaaatagcagcttctgccttggtgtcttgtagcttctaatcagcatgagagaattctgggtaccctgtagagaggccctgagagtgacaggagtcacctaaaccccaaatttcacttgttgctggcaaagcaccaaatatgtgactgaagacatattgaaccctccaccgcagaagattaaccagatgaataacaatgaatgtctccattaatacacagaaaataaaagatttatccatttgatccccaccaaaattctatgccccatagaattgtgagatgtcattaaatggtatattagaaaagaagaaatatctcaaaacactaacctaagttccaacttaagaaggtaggaaatcatgaatattagtgtataaatcaatgaagcaagtgcaatatagaaaaaactgttttcttaatcttctcaaagaatgaataaaaccaatcaaagttagttctttgagaagaataaatgatatatttctagcaagaacaatgaagaaaaaaagaagaaacaaattacctgtcatttggcatagtatagggcattgactgacatggttccaatagttgaagggtatacaattattttaacttctgaaatgtccaaagtgtcagggttttgtctgaaaaacacaccaaaaaaaagagaatacccaaaagagttccattattaaatggaaattttatatgaaggaaaattctacaagaaggtacagcaatggccttggtcatattcatgagcaaatacctcctctttttctgggactcactctagagactgctgaagctctgtcttaggctactgaaggaaaagtttaaagggattctccattagaacacctgctgccagaggctagatgattatcctgtctttctgatggcagttcataaatgaatggttactactctacctggaaagttgtggcagatcctcatgggtaaatataagactaaaggaattcaatagggtaaactttaatgtgttttctcgctattatggaagacattgaggacataaaaggccagatcacatgggttgataccaattcatgaccagtgattaattaatgcaaaaatagttgattcaagtacttgttgcccgagatactacctttatgggaattaaaaagacaaatcaaactgggacaagctgatgcccaccaaaataaaaactctaccaggattggaaagcgactggagtcaacaaataggtatttcggttcattacctagaagtaactacttatatacatgaaaggaatggtcacagaaggacctaaaccaacagaagcaccagaaaaggtataaattgtttaccataatggtccagtttcttagcaagataggtaagatttaaaaattcattaggacatatccactggggtgatggcccagcatacagctagtaaatagattatatttgatgttcgttcttaacaccaggaagatttaagcaagctttgaaggccactaaaacgtatttgagacttggtttttttcatggaagttaaatctaacgtatgaaaattaaataatctgaattgtttttgcccaccaagttatattcttctgatcaaggaagctattttacagcacgtgatatacaacaatgggcaaataaacaccacatcgaatatatatatcatatcctttatcttctgcagagtagtggaaatatttgaaatcattaattgaaatacctgccaaaaataaagactggggcagataggtcagtaataaaggatgaaagagctggtttacttgttttcaagttgtgcattaaaattaaacatgagataatcatgtggttttgtttttagttctggtttctgtgatgaataacatttattgattcatgtttgttgagccaaccttgcaccacaggaataaagcctacttgattgtggtgtattagcgttttgatatgctgccagattcagtttgatcagattttgttgactatttttgcatctatgttcatcaaggatattgaccagaagttttccttttcagctgtgtctctgccaggttttggcattaggtgatgctggcctcatagaatgatttaggaaggagtccctcctcctcaattttttggaatagtttcagtaggaatgataccagctcttcctttcatatctggtagaatttgcctgtgaatccgtctggtcctgggcttttgctggttggtaggcttttaattactgattcaattttggaactcatttttgcttggcttggagattgaatctaaatgtccatcaacggtagattggatttttaagatgtggtacacatttaccatggaatactgtgcagccgtaaaatatagtgagataatgtcctttgcacgaacagagatggagctggaggccgttatctaagcaaactaacacaggaacagaaaaccaaataccgtatgttgtcacttataagtgaaagctaaacactgagtacatatggataccaagaagagaacaacagatacttgagggtggaggatgggaggagagtgaagatttaacaagccaccttttgagtactatgcttattacctaagtgacaaaataatttgcacaccaaacccctctgacatgccatttacctatgtagcaaacctgcacatgtgctcctgaatctaaaataaaagtaaaacataaaattaaaataaaaagttaaacatgggagaaaccaaagatgatttactattagataaatttcctagatagagtggtagaagtaagaacgatttggggatgaaaccggcacttatctacaagtcttttcaaacacagcacaattttcttcttttctgccttaccccataatttctgagtccagtttaaaatgaacagttcttgacacatcactcatatttaaacaggagttactgtctatagtttttaatttaaatgaattcagaagggattggtgggccagatgaaggactggcaaatgacagtcatggggaactgtggcctgctgcctatttttgtagggctctgactacaatggtttttacattttgacatctttttaaaattaaagtaagaaaaatcatttgataattaaaatattcataaaatttatatgaaatttacatatttgtgtccataaagttttattggaacacaaccatgttcactagtttacgtattccccatgttacactatcagggccaacagagtagttgcaacagagatcacagaagctagaatgtcccgtcctctcacctggcctaaccgggccttcaggtggaaatgctttgttaccaagtagaggtaacaggccagtaagtttgtacatttctaatcctatcccatgtgaatgaaaataaaccaagaaagaagccttagcaagattgttatttccagtgaataggttaactccatggtcaaacctgatatttctttttggagaggaaagtttgggttaaaataagtgatagataaaaagaaggtgacataattgcctaaataagagatctaacaaatatactatttaaagggaaaaatcaaacataactttgcttctagagagtcttacagcaaaaaaataattttctctcttaccttttagtctgatgtctgttacagtgaaataccttgtctcacaaagaccctactgagaggcgacagtgtgctggcagccctcgcagccttcactcgcttttggtgcctcctcggcctcggcacccactctggccgctattgaggagcccttcagcccactgcactgtgggagcccctttctgggctggctgaggccagagctggctccctcagcttgcggggaggtgtggagtgagaggcccggagggagagacatgggcaggaacccgggctgcccacagagcttgtgggccaggaggacttccaggtgggtgtgggatctgcaggcccacacttggaatggccggccagcacagccagcccgggcagtgaggggcttagcacccaggccagcagctgcagagggtgatccgggtcccccagcagtgccagcaggccagcgcagagctcgaactctcaccaggcctcagctgcctccctgtggggcagggcttgggacctgcagccagccatgcctgagccaccccgctgccatgggctcctgtgcagccagagcctccctgacgagcactgcccgctgctccgcagcgcccgttcccattaaccgcccaagggctgaggagtgcgggtgcagggtgcaggactggcaggcagctctgcctgcagccagctgtgggatccactaggtgaagccagctgggctcctgagtctagtggggacttggcgaacctttatgtctggctaagggattgtagatacaccaatcagcactgtgtgtccagctcaaggtttgtaaatgcaccaagcagcactctgtgtctggctccaggtttgtgaatgcaccaatcagcactctgtatgtggctaatctggtggggacttggagaacctttatgtctagctaagggattgtaaataaaccaatcagcactctgtgtctagctcaaggtaaacgcaccaatcagcaccctgtcaaaacagaccaatcagctctctgtaaaacagaccaatcagctttctgtaaaatggaccaatcagcaggatgtgcgtggggccagataagggataaacgcaggctgccccagccagcagtggcaaccctcgggggtccagttctacactgttctttccctctttgcaataaatcttgctgctgctcactctttggttccacactgcatttatgagctgtaacactcactgcagaggtctgcagcttcactcttgaggccagccagtgagaccacgaacccactaagaggaacgaacaactccagatgggaggaacgaacaactccagatgggaggaacgaacaacaccagacatcccaccttaagagctgtgacactcactgaaggtctgcagcttcactcctgaagccagtgagaccacgaacccaccagaaggaagaagctccaaacgtgtgaacatcagaaggaacaaactccagatgcatcacctttaagaactgtaacactcaccgcgagggtccgcggcttcattcttgaagtcagtgagaccaagaacccactaattccagacacactaccattactaaaacaaaatgccatggatctgggaagcagcaggcttgagcaacatcattactggagtgatgtatagcatatgcttcagtgaaacaaaggaaattcaggtttctcacacacacacatgctgatgtggtttgtatctgtagaaaaaatgcatcctgtatgacccagtggtggtaggacaaagaagtctgcgtgtgagttctatggatggatccctcaacgaacaaccctctcctactgctgctgtgccctttgcctgtgatacagcctttttgtgagcataagttgtttgagtcctgtgaattccttcagcaatccaacaccaacattcttaccacctggtaagactaaacaacttaatatatataaaagcaaataaaatacttctacatgaaaactatcccaataaatgtctatgtctttcattaaatactgcttcagtcattaaataatgtatatttgtaggagtacatctgcatctctgagtttcatctgcaaaatggagatgacatttttgaaatcagaatttaattcacaaatgtatgtaaataggttttagtatactgggcatttaacaatacttataaccatatagtaagtattcaataaatcgaagctactgttatcatttatattattcaaaggaaaacagagttggtcagtagaaacctactttttctttttgcatcagcctatgtaacaagaaattttttctcctgcaacttgatcacacaggtcagcagcagtgagttaaaggcagcttatagatataacagatacaaaatcccacatataaaaactataacaatataataagcacattaatagaaaaagatgaaagacactacaagaatttagacaaaaaataaacaccctcttggaggccaggaaatagatctgaaaggagatgatatttcatgtgaggttcaaacttgcatataattttggtaggtagatgcggagaaaatcaatacttaggagaaacagaatgtgaaagaccaacaacaagataaagaaaaaacataattgggaagtttcaaaaagttagcatgactaaaactcagggtattcactgtgatgagtgatgtgaggtatggaatcagaaaagattttaagattttatagacctgacaagaagactgaactttactcagagagtgatcagggagccatggatggattttaagcaagtgagatgcatagacagacggaccacggtttcatgagcgtggagactgaattacagtcaggaagtcaggagttaacaatatagaatgttcagataggagcagcactatttgagacatcagtttctaccgtgtgtgatttgtaatatccagtacaatatctatgcaaaatgaatttgacatttattgagacataagaaatactttttttaagtatcaggtttcttacttcataaaggtgaaatactaaaatatttgagaatacaaaaatgggcatttgtagccccaataaacatcaaattcaagaagaaaattaattggaaattccatgcaaatcatgtacaataaaaaattataatattaaaaactgattcaatttactgagaaaatcagtgatgttccagtagaaaggtacaggcataaataattcatacagttaaagcaaaatagtaaacaagtaaatggaaagtgttcaaaaaatgtaaatacttttgtaaaaaacagtagaatgttttattataaaattagtaagattaaatatttaagcctatacagttatggtagaaacagtttacatatacatagtttgagtcagcataaacagatatgtataggtttataaacaacatgctagggtttaaccagaacctaaaaaaatgcaccaatattttgtcttttccttcccactactcaaaatttacgtaaataactttttaaaatattatttacaaacaatttttctgcaacttcactataaccagaaaaactgagagcactcttattacccaaaaagaaatattaaattatatgacaggagttgtaaatacttaagcttacattaaaataaaatcatattaatggttttaaatataacatgaaatgtaaaatctctatactgttcttaaatgattttaaaactatccacaaatatgcaagaaaatagaaaatccttgagagtggttgacagacaaacaagaaagatactgaagtgtaaagcttgactgttttgggaacaaaaagttatcctgattgagttgaaaaaaggctgaagaaggaaatgaaggtgttttccattagcaaccattcataaattactttcagggcaccaaacatgatataaaacatctgagagcatttttagtaaacttgcacaattctgctatgagacatatttttctaaaatggtttggtcttgagcatcagtaggaagaatatgtcctgtaagtaaaggatgggatgtataggaaggactttatggagtacagctggagaatgctggagctcttagcaacggaggaagctatggattaggtaaactcttgcatgatcagcttacatgatccctggaggaaaatagcatgagtaggacatcacaacctgttctcatttctttgctcagttagtaggtaaaagtcaagtcattatccattaaaacttatcaactgatggaacacaatgggcaccgaaaacagagaacacaaaacaaataaaaaagatgaaaataaaatgtgttgaagtttgtaaaattatacaggattttagaaataaattaatgtttgtactttatatgtgcataaataaatcaattaaaagtttttcagttttttttgagacagggtctcactctgtgctgatgtcaattccctggtctcagttattgtacttgataatacatgggagggcataatctactgaaattacttaaaataagaaacagaaaaacaaaaggaaaatctaagtttccaaattagaagaatggaagaaatattcagcaaaaaaattggaaaataattgttgagtactgcttcaaaaaagaatagacaagagaagatactgttaattcaactaaaaattggcactagctctgtgaaaattaactctgtgctcataaataaatgataacatcccctagattcagacaagccagtatttaaatgtcagagagtttagaagaagccatcaaaacattgacatggtgaagcctttcagacagaagagaaaccaggagaatgtgttgttccatagaccatgtgaagcaggtatttcaaaatggaaggatgggaaactcatgtgaatttttgctgattattcagtttcaaccaatggatttgattacaaagaagatattgatgactgttacaagagaggtttaagtgtagtggtgggaatgaaaaaatgaaatgaggcagaaattgtagctaatacattggagtcattgtattataaaatgagaagagaattgggagcttactagaaagagatttggttccacaaaggattttttgagctttttttgttgttgttgctctttaagatggaagatgtttggtattttcgcatattggcagaaataatttgaaaaatggagaaattaatgataacagttgagagggaataattgaaagagcaaaatccttgcatagaaaagaggggatcaaatctggtagagaccataacaggataggagtaaggatcaacatccagtgaaacaggagacaatgcaaaaaaggatgtgtgtgaacagcaggtagttttcttctgattgcttctatatctagatgaaaaaaataaataaagtcattagcaaagtacaaggtgaggactgatggttaaggagggagataataaaacagaggaggagaaaggaagtgtcaaaatcatttaggcctatgatcattaatttaaagcaaggcaagtcagcaccgttgcatttggttttttttttcaactcttcataatgtaaacctttatttatttatttatctttattattatgctttaagttctagggtacatgtgcacaatgtgcaagtttgctacataggtataaatgtgccatgttggtttgctgcacccatcaactcgtcatttacattaggtatttatcctaatgctatcactccccctgccccccaccccatgataggccctggtgtgtgatgtcccccgccctgtgtctaagtgttctcattgttcaattcccacctatgaatgagaacatgcggtgtttggttttctgtccttgtgatagtttgctgggaatgatggtttccagtttcatccatgtcccttcaaaggacatgaactcatcctttttatggctgcatagtattccatggtgtatatgtgccacagtttcttaatccagtctaccactgatggacatttgggctagttccaagcctttgcaattgagaatagtgccatgataaacatacgtgtgcatgtgtctttatagtagcatgatttataatcctttgggtatatatacccagtaatgggatggctgggtcaaatggtatttctagttctagatccttgaggaattgccacactgtcttccacaatggttgaactaatttacactcctagcaacagtgtaaaagtgttcctatttgtccacatcctctccagcatttggtgtttcctgacttattaatggtcgccattctaaatggtgtgagatggtatctcattgccattttgatttgcatttctctgatgaccagtgatgatgagcattttttcatgtgtctgttggctgaataaatatcttcttttgagaagagtctgttcttatcctttgcccactttttgatgggtttgtttttttcttctaaatttgttaagttctttgtagattctggctatcagccgtttatcagatgggtagattgcaaaaattttctcccattctgtaggttgcccgttcaccctgatggtagtttcttttgctgtgcacaagttcttcagtgtaattagatcccatttgtctattttggcttttgttgccattgcttttggtgttttagtgatgaagtccttgcccgtgcctatgtcctgaatggtatggcttaggttttctttttgggtttttatggttttgggtctaacatttaagtctttaatccatcttgaattaatttttgtataaggtgtaaggaagggatccagtttcagctttctatatatggctagccagttttcccaacaccatttaagaaataggaaatcctttctccatttcttgtttttctcaggtttgtcaaagatcagatggttgtagatgtgtggtgttatttctgaggcctctgttctggtccattggtctatatctctgttttggtaccggtaccatgctgtaccatgctgttttggttactgtagcatagtttgaagtcaggtagcttgaagcctccagctttgttctttttgcttaggattgctttggtaatgagggctcttttttggttccatatgaactttaaagtagtttagtccaattctgtgaagaaagacattagtagcttgatgggaatggcattgaatctataaatcaccttgggcagtatggccattttcacaatattgattcttcctatccatgagcatgaaatgttcttccatttgtttgtgtccttttttatttcgttgagcagtggatcatagttctccatgaagaggtccgtccttcacatcccttgtaagttggattcctaggtattttattctccttgtagcaattgtgagtgagagttcactcatgatttgactttctgcttgtctgttattggtgtgtaggaaagcttgtgatttttgcacattgactttgtatcctgagactttgctgaagttgcttaccagcctaaggagattttgggctgagacgatggggttttctaaatacacaatcatgtcatctgcaaacagagacaatttgacttcctcttttcctaattgaataccctttatttctttctcttgacggaaatccccggccagaacttccaaaactatgttgaataggagtggtgagagaggacatccctgtcgtgtgtcagttttcaaagggaatgcttccagtttttgcccatttagaatgatattcgctgagggtttgtcataaatagctcttattattttgagatgcattccatcaatacctagttccccgagagtttttagcatgaagggctgttgaattttgttgaaggccttttctgcatctatcgagataatcatgtggtttttgtctttggttctgtttatgtggtggagtatgtgtattgatttgcatatgtttaaccagccttgcatcctagagatgaggccgacttgatcgtggtggataagctttttgatgtgctgctggattccgtttgccagtattttattgaggattttcgcatcaatgttcatcagggatattggtctaaaattctatttttttgttgtgtctctgccaggttttggtgtcaggatgatgttggcctcataaaatgagttagggaggagtcccgctttttgtattgattggaatagtttcagaaggaatggtaccagctcctctttgtacctttggtagaattcagctgtaaatccatctgctcctggactttttttggttggtaggacattaattattgcctcaatttcagaacctgttattggtctattcagacattcaaattcttcctggtttagtcttgggaggatgtatgtgttcaggaatttatccatttcttctagattgtctagtttatttgcatagaggtgtttatagtattctctgatggtagtttgtatttctgtgggatcggtggtgatatcccctttatcattttttattgcatctatttgattcctttctcttttcttctttattagtattgctaggggtatattaattttgttgattctttcaaattttcagcttttctgctctggtttctccccatctttgtggtttttacctacctttggtctttgatgttggtgaccttcagatggggttttggtgtggatgtcctttttgttgatgttgatgctattcctttctgtttgttagttttccttctaacaatcaggtccctcagctgcaggtctgttggattttgctggaggtccactccagaccctgtttcctgggtatcaccagcagaggctgtagaatagcaaatattgcagaacagcaaatattgctgcctgatccttcctctggaagctttgtcccagaggggcacttgcctgtatgaggtgtaagtcgtcgcctactgggaggttgtctcccagttaggctacataggggtcagggacccacttgaggaggcagtctgtctgttctcagagctcaaatgccatgctgggagaaccacctcactcttcagagctgtcagacagggacgtttaaagtttgctgccttttgtttagctatgccctgcccccagaggtggggtctacagaggcagcaggcctagctgtgctgcagtgggctccacccagttcaagctttcaggccactttgtttacctactcaagcctcagcaatagcggatgcccctccccccaccaggctgttgcctcacaggttgatctcagactgctgcactagcagtcagcaaggctccgtgggtgtgggacccaccgaaccaggagcaggagagtgtctcctggtctgccgtttactaagaccctcggaaaagtgcagtatttgggcaggaatgtcccatttttcccaggtgcagtctgccatggcttcccttggctaggaaagggaaatcccctgaccccttgcacttccagggtgaggcaatgccccgcccagtttcggctccccctccatgtgctgtacccactgtccaaccagtcccaatgagatgaaccaggtacctcaattggaaatacagaaatctcccatcctctgcgctggtcacgctgggagctgcagaccagagctgttcctattcagccatcttggagcggtgaccgcatttgtttttcttgtagacacactctgctgcttcagttcagagacagggcaggcagagaatttatttgcaaaggtttgaggttttctaaaacttggattacagatagaaagaaaggaatgggcaggagagtgtgtgcaagggattgacttacagtgatgaaccattgaatctaatttgggtatggtgggaagagagaaagtgaagggaaaagaatagtgaaaaagcatcagtgtcattgaatggttggaacaaatttagtagagtaagtgagctaaaaagattgttgaaatggtctagagtgtgacactttagataatttaggtagtttaattggaaatgataaggtttagatagactagaatcaatagtggagactagtagctcacagagacttctctggtttcttgattgaacatagctatatgcattcccattgacttctgaaccaccatcagtaagtttcatcttagtggaagtccttaggctgtccctttctccaaattttgccattaaatttttgactgactggccactttgttgcttgccccagctaatatcctctacacatactaatcttctctacttgcttcccactgtaacctctttatattcaataggatccttgggcagggaattttccacgctataaagtcactcccctccagtggagcagcagagtttccagtccacacagactgcttgcctacccagggttcaacttctgagccacagaactgagctgtgagacaaaggtggataaaagcatccactcttttttactgagatttatgtggactttctggaataaatatttcccaacagtatgctctttggccaatttctagagattatttttataattttatccagttttattgctgccttttggtggtgagtgaatataccaagacccagaaatacccattctcaaagtcccatcagaacaaaattattttgaagtaaaatttgttcaacaattttgggaaccattacataccaaaaattattcttgatttgactttttatagtctaaaaatatgaaaactattaagaagttacctcattcttttttttttttttttttttttgagacggagtctcgctctgtcaccctggctggaggggagtggtgcgatctcagctcactgcgaactccgcctcccgagttcacgccattctcctgcctcagcctcccaagtagctgggactacaggcacctaccaccacgcccagctaatttttgtattttcagtagagatggggtttcaccatgttagccaggatggtctgaagttacctcattcttaataccagttttaagtggaatttataactagaacagtgatgctgttatgttaagatgaggactgatcaccttcacttgcttgcctactgatgtagctgaactcttggctagaaaaaagaaggggcttcctctttcctcttcaatggcccatttctgaatattccaaactcagagactcagggaccacaacaaggaaattgaacagcttttattttgctcaagttaatattacatgataaactcagagtattattgtgaaaacactgattagacactatttgcttattttgcacaaccctccatgaactttgatgtttaccacaaaggactttactaaactagcttccagttagtacactgaaattcaaagtcatgctcataactgttaatgaaagcagattcaaagcaacaccaccaccactgaagtatttttagttatataagattggaactaccaagcatgtggctcctggtcagtgtaattctaatctcacggatatcctctgttgggggagaaggtaagttcaaaacagacctgaatatttagttcctttttcagatacatttatcggtttttgtgtgtatgcttacatatttttaaatgaataaatggatgaaaatattttaaatgagttataatattaatctattttatggaaatactttctaacatgcaattagcaggaaaatagaataaaattagttctctccatcctctaagttgcaaaggtaaatggccaccaaatagagaatgtaaagaggaattaaatgagggaaaacctgctatactaacggtggcaaggtgaagtattagtgtaattctgcatacactctgcaatgccactaactagaacaatcaatctcaaaaagatttggccaccttcaaaatgctttttggattttagtttcctagatttgatcatttaaattttaaaggtcattaaaatggaggaattcccatttcaattgaattatccttcaacagagggaaatatattttactgaaacaatagaaaatatcatttatatataaaccagtgaactgtcaagaaattgcttcttctgagctcttaaatgttgagaatgaagtaatgtatcacctctttattaatactacaaactgcttcttatgatattttataaacggtcccattttatttcatgttgaaattaaggccaccatatcaaaggaattgcaaacaaaatctctaccaaggtctaggatactaattaaactatgtctgtacatggagtttcgatcattatgctttaccctttgatttccaaaaagtttttactttactgtttggctgtttcctaatgtttccagacctttgaacttttatttgaacagtttctcatcagtcctgacataacagaacaacatgaacaataacatgctttcctttaaatatttgcccttagaaatgttgcaaaatattatttctattgcttgaaattcatttttttttgagatggactttcactcttgtttcccaggctggagtgcaatggtgtgatttcggctcaccacaacttccatctcctgggttcaagcaattctcctgcgtcagcctcccaagtggctaggattacaggcatgcaccacgacgcctggctaattttgtatttttagtagagatggggtttctccatgttggtcaggctggtctcgaactcccgacctcaggtgatctgcccgcctcggcctcccacagtgttgggattgcaggcataagccaccacgcctggcccttgaaattcgttttattttgttttcacttttagtgctgagttgtaatcacaggagtgtgattgtatgagtgtatttgatttttcttaagtctgtgtttatggtatttattaagtggcttatacacctattacacatggcattacatgaggatttctaaataggggggtagcagaggaaaataagtgaaaaatatgagagaaatatgtagaattttgacaattcctaaccctcctcccaccaaaaaaaagttcaagcttcaatccagtctctgggagaaacttcagtgaaattctatctaaaggttgcctagatgttaaatgatctgtaagtgtgtgttacactgtcatttaggtgtctactgagagacctgccaaacagcaaaaacaacacactgaagcaacacatttgtatacatagaaagctgcatgcttccagtagcaaaatatttatcaagcactatgttgtgcttcatgtagcaaagaagctggaagaaaatgacaaccctaaccacacctcactgcaacttacagtgtcctaaagaaaagcaaaatgtaaataggcaaataaattgcaaggctatatataggtgactgtgagtgagtgtgtgtgtgtgtgtgtgtgtgtgtgtataaacagtcatgcatcacttaatgatagggacactttctgagaagtgcgtccttaggcgatttccttcttattcaaacattatagagtggacttacacaaacctaggttttatagcctactaggtaactaggccatatggtatagcctgtcgctcctaggctgcaaacctgtacagcatgttactgtactgaatactgtgggcaactgtagcacaattgtaagtatatgtttatctcaatatagaaaagtacaataaaaatacagtataaaatattaaaaacggcagacttgtatagggcttttaccatgaatagggtgtgcaggactgaaagttactctcagtaagtcattacatgagtggtgagtgaatgtgatggcttagaacatcaccatacactactagaggtggtataaacactgtatacttaggctaaactaatttattttatttatttatttacttgaatagttttgggggagcaggtggtttttggttacatggataagttcttcagtgctaattactgagcttttgatgcacccaggatagactaaatttattttaaacttttcttcgataataaattaaccttagtttatgttaacctttttacttcatcaactttaatttttgtgtctttcgagataatatttagcttaaaaaacattgtagagatgtacaaaagattttttctttctgttcttgtgctataagcttttatcttttaaatattttacttatttatttactttttaaacctttttgttaaaaacagacacaaacacacacattaacctcggcctacaaagagtcaggatcatcagtatcactgtcttcttcccccgctcttgtcccactggaaggtcttcacggcagtaacaggcatggagctgtcctctcctatgataacaaaggtttcttctagaatagttcctgaaggacctgcctcaggaaacattaactgttttacagttaatttttttaatcaatagaagaagttaactataaaatactaataacaattatactatatgaaatacattaaccagtaacacttctatattatcatcatcaagtattacgtactgtacaaaattgtgtgtggcatatttttatgtgactggcaatgctgtaggtttgtttacccccggcattgccacaaatatgtgagtaatatattgcactgcaatgttacgatggctattaggtgataggaatttttcagctacactataatcttatgggtccactgtcatataagtgatcagtcattgaccaaaatgtcattatgtggtgaataactgtacgactgtatatatatatatatatatgtgtgtgtgtgtgtgtgtgtgtgtgtgtgtgtatcccagaagaaatgtattcacaatattctatcaaaatattgagacaataaaaattattttctacttttgaaattggtggttgtgtaaaggaggcttgcaagaagacattaacactcctagctagcaccattgcagatatgcacaatgaatacttgatgaatgtcatagaattctttctgaagcataggtacaatataaatggttgatgaaaaccaagttattctggatagcaaagaatatgtaggtacaaatgtatgaaaataaactactataattttggaggagtgaaggataattgaaagagttatggtaggttaatactatcaagacgggagtctttccctcaacacctttaccaaaactatctaatgtcaaattttaaacagttagataatcaatttcaggtttcacaaggtgaaaatatttcaaatattgtgcaacattaaacattacttctagatagatgaaaaagagaaatttctcttgatttgtcagcttaatttctgcacacatctttcaaataaggtgaaaaataaaattatttcttatgcagcagtactatattgcaaaaatatcttgacataaaaacaaagagcagtattatattgaggaaatatcttgagctaaatacgtactcaaagataaagcatatcaaacccatagaacgtacaacatcaagagtgaaccccaacataaactatgaactttgggtggtaattatattgacagtgagggagcttatgcatgtggtagggaagaggaagtggtatataggaaatctctaccttccactcaatcttgctgtgaaaaacctgtaaataaagtataaagtctaataaaaaatatgtgtgtatatatatgtatgtgtacacaaaaaaagagtaaaaagtatgaagatttcacccattttctacattgttttaatatatcttgcaccatagtgtgtatggatgtatttatacatatatacagtagtcctttagcatcctcaaggaattggttccaggacgctacccacccccagcagataccaaaatccaaggatactcaagtgtctaagagagaatggtgtagtatttgtacataacctgtgcatatcctcccatacaatttattttattttattttaattttttttgaggtggagtcttgctctgtcgcccccaggctcgagtttagtggcatgatctccgctcactgcaacctccccctcctgggttcaagtgattcttctgcctcagcctcccaggtagctgggatcacaggcgtgcaccaccacacctggctaatttttgtatttttagtagagatggggtttcaccatgttggccaggctggtctcaaattcctgacctcaagtgacccactcacctcagcctcccaaagtgctgggattacaggcatgagctaccacactcagccctctcatacaatttaaggaatctctagagtatttataatacctaatacaatgtaaatgctgtaaaaatagttgttatattgtatctttaattgcattatttttattgttttattatctttattgtttttttcaaatatttttgatctgcagttggttgaatcagacgaagtgaaacgagtggggctgactgtatatatatatatatatatatatatatatatatgtgcgtgtgtgtgtgtgttcacaagtataaatatataaatacaaatatacaaatacatatttgtatatacaacattaaccagaatttagctctaactttatcttgattgagttgttcttagtgattttcttatattccctaaattatttccactgaaactatattaactttgtaaccagaaaatattcaaaatgatattaataaacaaaaaacaaaactacatatccaacatctttactgcaccagaaaaaaaaataggacagagtttctggcagagacacctatggcagtcaatgagaatagagaaaataagtaaattgagagctaagaacaaccctatcacttttctactgtatactatgtagatcaggaagatttgctactcttacactctgtcttcattcttaaattgttgtgtgtgggttttattcttgaagacaatgcaggagagttcatatttcatatcactccaaaatataaattttatattcattaacaattacctcctcaaatagtcatgtactcctagttagtgatgcttttcattcctaatttgtacactggaaagcatttaagctaaaggcatttaagctaaatgaaagaaaaacactataagtgagatgattaaaatataatctagtgatttatttatgtaacttattatgtaattcttcagttttatgttattttcccagcaacattttgtgattttccaaaaataaaccatggaattctatatgatgaagaaaaatataagccattttcccaggttcctacaggggaagttttctattactcctgtgaatataattttgtgtctccttcaaaatcattttggactcgcataacatgcacagaagaaggatggtcaccaacaccaaagtgtctcagtgagtaaatgctctgttcattaaatggatgtcattcagtgaatagagaaggatatgccagacaagatcataaggtcttgataatcacagggacagtgaccaaagaagctggaaagatgggagatgtagtccccctattttgagatgcctcctataagaatcaatgaagaataaatatgtcaactgtcttgtgttacctggaaatgctctacgtgttgaaatatattaatttttttaaactgatctttaatatatttgactgctaatatttctttactaatattcatttcgcagcagcctgatcaaagttttccttttaaatgtcatttttatacatattctgttttgaatttaccattctttagcatattgaaaggaggtttagcattttcacttttatatttcaataaataatttctttggtccttcacagtgtagctatattaattctccaataaatgtagagagcagactccaatgataacaggtgtattaaaagaaaaaaaaattgggagacagatacatgaggcaacaaaggagatagcaatgatctttctcctaagaaacatttatgagagttaagagagaaatagatatatgaagaggttcttttgtccctaaaaggttgacaaacataaaatatttcattataaaaaccatagagcaagaaaatgaaatattttcttctatatatacatataaaagaaccaaaaatatgtttcatcatatatatagtagcatgagttaacttcttttgaaagtgtttatatttgatttcagctttgaaagctttcctttttaattttttttgttcgtttgtttgttttgttttgtttttgagccatctcaactcactgctacctctgccttctagattcaagtgattctcctgtctcagcctccagagtagctggaattataagtgcgcaccactatgcccgctaatttttgtatttttactagaaacagggtttcaccatgttggccaggcaggtctcgaactcctggcctcaagtgatccactcgcctcagcctcccaaagcgcagagattaccagagtgagccacttcacccggtttattaaaatattttaaaatgcagttgtactttttctttgctacttccatcttgtacattaatccgtttttggtccttaggactgtgtttctttccttttgtggaaaatggtcattctgaatcttcaggacaaacacatctggaaggtgatactgtgcaaattatttgcaacacaggatacagacttcaaaacaatgagaacaacatttcatgtgtagaacggggctggtccacccctcccaaatgcaggtccactggtaagtacaatgctgttctctcatatgctgttatctattataaagtttgagagaaataaatcttttttacaggttaaatataggttttgccacatacttttatctttattcatttgattttcagttccaattgtgtccaagtggatgttgaataacatagtttgcctacctatataaatcaaatgttctcaaagtgtggtcgctaaaccggtagcatcatcatctccttggagattgtttgaaatgaaaatacaattccataagctcattctagacacacggaatcaaaaatgtcgaaatagaaccctgaatctgttttaccaacccctccagggaattctatgcacacttctgtgtgagaagcattgctatagtctattatcactacacatggacctgaaactctctgatgaattttgcattgttcagcatagtatccttaatcattggcaattaaattatctgaagttatttttattattatagacttattttcttttatttttccacatctccaatttagatcctttgattaaccattcttcttctctactaacttgggtaattttcaaaatgtgtttttaaatctttgcttattcactaagaaaatgcctatttgtgtttatttttaagaggctaaaatgtataagcaggatgattgcaaacaaaaatctggtatcacataatctatttatgctgactttttgcattttataaattaatgttaaataaatagaactggtaatatttgtttactcaaactcaaagagagatatccaggaaaactttcgtttacactggcttccagaagggaaaaataaaggtctatcagtgttctagcgaaggatgaagaagaaatttaaaacatcaaagcttgtacctgacaaaaaatagtttcatgtcttttcttcaatattacatttaaatttattaaaatcaacaaaatatttgatgagattgtctacttattttaaattcgtcttgaaacatatttgtaactgtattagttgatttgctactcaaaatgaacactaggtggaaccacttcttttttttctactcagacacttcctgtgtgaatccgcccacagtacaaaatgctcatatactgtcgagacagatgagtaaatatccatctggtgagagagtacgttatgaatgtaggagcccttatgaaatgtttggggatgaagaagtgatgtgtttaaatggaaactggacagaaccacctcaatgcaaaggtagagtattatatttcttttaacattttgggggagtatagcagggttaaaatatgttgatttaaacaaaatgaagtcatttttattaatagatttttcaaatgcaaataaaatgattgatggtgcttaaaattcaattcttcctgtgaacagaacacaagtaatagggtgtattatttttgagaaagattcgaccaaattaaaagagttggaacctgaaaaacaatactttttaagcatcacaacacttagttccttctcaggaatacgtgtaataaaagatacattatgtgcatttgacagccataagtgatgtgcattctaagatatggaataggcagttgaagagagatcatagactgtgatataaatgtgggcatcttcagtatatggattatatttaaaggtgtgtgactgactgtatttataaaaagaagtccgagcacatagtcctgggtcattctaataaatagagatggagtaagggaaaccagaaaaggaaattgtatcttacttacctttatgttttaaaattaatgttgtcctgtgtttttttttttttttcactattttacttagactctacctatgtttattattgaagtgagtttttgtagacagcatatagttgggtcatgtttacatatccattcatcctttcatggcctgttaactggtgcacttggaccaattacacttaacataattattgatatataggacttaaacctctgtcatttatttgtttctgtctgttccctctgggtttcagtcctatttccctattcctccattccctgtagggaaaattattaaggagattaattttgattcatatgtattgttttccattgtatctctttgcatagcttttcttctccttttaaaaagttgttgctctagctaatactatatatatgtaataatatattactgtctactggcactgacatttaaatcaacaactggaatatggaaagcttactttcatgtagatccatttatactctccacattgtaagtataaatgccagtcgtattttctctgcatgcattgagcaccatattaaactcatttgcttcaaatatcaaacataattgaaaaaacttatgaggaaaaagatatcgtgttatattgactcctctttttatccattatatcgttctattttttcaggatcctgaagtctcaagctctttcttttatctgttttattttaatttgaagaattcctttagttatctttaggcataggtctactggagacaaattctcttggtttccctttctctgagaatgtctatatttacccctttacttgtaaaagatcgtgtcactggatatcaaatttggagttgacagttctttgaacacttgaaaactgtgccacatggttatagatgaaaaacttaccatcatttgaattgttgatcccctcaaggaaaagcatagtttttgtctagttgctttcaaggtatttttttctttttttaaagtagttttattttaatgtatattggtataaattccaatgtttttatcctctttggagttcactcagcttcttaaatataagtttatgccttattgtcaaaatgggaagttttcaggtatccttttatttattcatttttccagcccaatatcctttctcttctttttctgcatctgcattatttgttgttgtatttttctgaatgtctcagttcagttttttgttttcagtctattttcagagtgggtaatttatattgctgtatgttcaagttcatggatttatttgtctgtcagctccccatgtattattaagtatattcagtgtttttaaaaaatttttatcatacttttccattttataattcctacg

SEQ ID NO: 116 - DNA, 87650 bp, Homo sapiens
aacatcattaaaatggacataaattaagtttttacggcaggacaaagtagtcgtatgcctaaaaataaaaagatggaactgagtatttgatgattaatcttagctcaatagttctcaaagtgtggtcgctaaaccggtagcatcatcatcttcttggagattgtttgaaatgaaaataaaattccgtaagctcattctagacatccagaatcaaaagtctcaaagtaaaaccctgaaactgttttaccaacacctccagggaattctatttacacttccgagtgagaagcattgctatagtctattcactacacatggatatgaaactctctgatgaattttgcattgttcagcataatatccttaatcattggcaattaaattatctgaggttatttttattattataggctttttaaaaaaatttttccacatctccaatttggatcctttgattaaccattcttcctccttttaacttgggtaattttcaaaatgtgtttttaattctttgcttattcgctaagaaaatgcctatttgagtttatttttaagaggctaaaatgtataagcaggatgattgcaaacaaaaatctggtatcacataatctatttatgctgactttttgcattttataaattaatgttaaataaatagaactggtaatatttgtttactcaaactcaaagagagatatccaggaaaactttcgtttacactggcttccagaagggaaaaataaaggtctatcagtgttctagcgaaggatgaagaagaaatttaaaacatcaacgcttgtaccttacaaaaaatagtttcatgtcttttcctcaatattacatttaaatttattaaaatcaacaaaatatttgatgagattgtctacttattttaaattcgtcttgaaatatatttgtaactgttatcagttgatttgctactcaaaatgaacactaggtggaaccacttcttttttttctattcagacacctcctgtgtgaatccgcccacagtacaaaatgcttatatagtgtcgagacagatgagtaaatatccatctggtgagagagtacgttatcaatgtaggagcccttatgaaatgtttggggatgaagaagtgatgtgtttaaatggaaactggacggaaccacctcaatgcaaaggtagagtattatatttcttttaacattttgggggagtatagcagggttaaaatatgttgatttaaacaaaatgaagtcatttttattaatagatttttcaaatgcaaataaaatgactgatggtgcttaaaattcaattcttcctgtgaacagaacacaagtaatagggtatattattttccagaaagattcgaccaaattgagagttggaacctgaaaaacaatactttttaagcattacaacacttagttccttctcaggaatacgtgtaataaaagatacattatgtgcatttgacagccataagtgatgtgcattctaagatatggaataggcagttgaagagagatcatagactgtgatataaatgtgggcatcttcagtatatggattatatttaaaggtgtgtgactgactgtatttataaaaagaagtccgagcacatagtcctgggtcattctaatataaagagatgaaataagggaaaccaaaaaaggaaattgtatcttactcacctttatgttttaaaattaatgtttttctgtattttttttttcactattttacttagactctacctatgtttattattgaagtgagtttttgtagacagcatatagttgggtcatgtttacatatccattcatcctttcatggcctgttaactggtgcacttggaccatttacacttaaaataattattgatatataggacttaaatctctgtcgtttatttgtttctgcctgtttcctctgggtttcagtcctatttccctattcctccattccctgtagggaaattattaaggagattaatttcgattcatatgtattgttttccattctatctctttgtatagcttttctcctccttttaaaaagttgttgctctagctaatactatatatgtaataatatattactgtctactggcactgacatttaaatctacaactggaatatggaaaccttactttcatgtagatccatttacactctccacgttgtaagtataaatgccactagtattttctctgcatacattgagctccatattaaactcacttgcttcaaatatcgaacataattgaaaaaacttatgaggaaaaagatatcctgttatattgactcctctgtttatccattctatttttctattttttcaggatcctaaagtctcaagctctttcttttatctgttttattttaatttgaagaattcctttagttaatctttaggcataggtctactggagacaaattcccttggtatccctttctctgagaatgtctgtattgatccccttacttgtaaaagatcgtgtcactggatatcaaatttggagttgacagttctttgaacacttgaaaaccgtgccacatggttatagatgaaaaactcagcatcatttgaattgttgatcccctcgaggaaaagcatagtttttgtctagttgctttcaaggtatttttttctttttttaaagtagttttattttaatgtatattggtataaattccaatgtttttatcctctttggagttcactcagcttcttaaatataagtttataccttatggtcaaaatgggaagttttcaggcatcattttatttattcatttttccagcccaatatcctttctcttctttttctgcatcggcattatttgttgttgtatttttctgaatgtctcagttcagttttttgttttcagtttattttcagagtgggtaatttatattgctgtatgttcaagttcatggatttatttgtctgtcagctccccatgtattattaagtatattcagtgtttttaaaaaatttttgtcatacttttccattttataattcctatgggatttttcgaatatgaaataagaaacttcctttgtcatagttttctatgtttagcatgtattcattcggaaagacatttcttaatcctggtctaccataagcagcaatatttgttaatgttttatgtgttctttcagtacggagaaaagaacttaaatatattactttcagtttaaagggttaaaatttcttccaggactcatttctttcaccagaaatcacaaaactgttgatattatatacagtgctgtgtttgcgtttgccttatttgaacttgtattttgatttgctctcacaacaaatcaagtgatgaaatgatgttttttagattctacaggaaaatgtgggccccctccacctattgacaatggggacattacttcattcccgttgtcagtatatgctccagcttcatcagttgagtaccaatgccagaacttgtatcaacttgagggtaacaagcgaataacatgtagaaatggacaatggtcagaaccaccaaaatgcttacgtaagtactttaatattcacgtggctggaaaaatctctgtgatgagtctgatatttcactgtttgtaacaaaatactcacagattattgaacaaccattctgctgaatgcttgcctaccaaatatttctgtcagaaagtaaagtttagaaatttttctctttagggctgggtgcggtggctcacacctgtaatcccagcactttgggaggctgaggcgggcagatcacgaggtcaggagattgaggaccatcctggctaacacggtgaaaccccgtctctactaaaaatacaaaataataataataaccggcatggtgacgggcacctgtagtcccagctagtcgggagtctgaggcaggaaaatggcgggaacccgggaggcggaggttgcagtgagccgagttcgcgccactgcactccagcctgggtgacaaagcgagactccgtctcaataaaaacaacaaaaaaagtaatttttctctttatatttatattttattttaaagcatttagttgacaaataaaaatatattttgatgtttgacaatatgttgttttgatatatttatgctacaaagattaccacaaattaattagcacattcttcatcacctatgcttagcattgggtgtaggtgggtgtgtgagtatgtgtgtgtgtgtttgtggtgaggacacttaaaatctgctttcttaccaattttcaaataaacaatacaatattattagctctaaatatcactagatctctatgtttgattccaagttcttattcatattatagctgaaagtttgtactctttgaccaatatcttaatcaaaagcagcaatgataagttctaaaacgcagggatcctaaaatgacaactgatgtaatgaatcattgataatacacccctaattctcatacattaaacatcgaacctcattttcacatcgattaccattctaagtttattcaaatcaatatgatgtttctacatagttggtttggatagtgttttgagaaataattcctgaaccatcatataacattctacttgaaaacctgaaagtctatgaagatttgcatactacttaatgttttatgtttactgttttttattttcagatccgtgtgtaatatcccgagaaattatggaaaattataacatagcattaaggtggacagccaaacagaagctttattcgagaacaggtgaatcagttgaatttgtgtgtaaacggggatatcgtctttcatcacgttctcacacattgcgaacaacatgttgggatgggaaactggagtatccaacttgtgcaaaaagatagaatcaatcataaagtgcacacctttattcagaactttagtattaaatcagttctcaatttcattttttatgtattgttttactcctttttattcatacgtaaaattttggattaatttgtgaaaatgtaattataagctgagaccggtggctctcttcttaaaagcaccatattaaatcctggaaaactaacggttgtgtccagttcataaaatgtttgtggcaagaaattagacgcaatttttcagactttatttctgttcatcactcttaaatctcccaaagctttctccacagcttctgaggctcactgttttacagaaaatggaaagcatatcattgtctctgatttcaaaattatatcactttacaaagatgtaaaaaccaagtcaagtcttaactcatgttggtaatgagatataagtaattactatttatcaatacataaatgcaccaaaagtgatatcaatacataaatgcaccaaaactgatgaaatgtagatacttctacaagatgtcaatctagcacacgtgataatgcaaactaatcataaagaggagttaaaacgtaatagggtatataaatattacaacataaacatacaaaaaataaaaacacagtatcagttataacatgctcacttgcatgcactcacttgcaaacatagaaacatgatacttttgccctgatttaatgtttatagaaaaaacattgccaggaaattcaaaactatagataaatgtgtgtgtgtgtgtgtgtgtgtgtgtatacatgtatatgtatgtgagtgtgtgcgtgtgtgtgtgtgtgtatttagagatactaggggtaaaagttagggtttaattcttttgtatatatcggtatcctctgatttttctacctttaacatatatcactttggaaacaaaagcacaatttattttaaaataatgatgtctaacaagcaaggcggtgcatgttgagaatgataaagatttcatcagtaatgatcttaacatcaaatagcctcttaagtatttttggagtagaagagttttggaaatttcaatagtaaggttctgaaatgtaatttttatattcattctttttaatcagcactagttaggtaaaatcatttttgattaggaacattttaaactcataaaggaggtgaagccattatgtgaaaaataaagatatcaataatacaacacaaatattatttaatgataccttattacttcttactgtataaaatcaggtggcttatatactcaggctgtctccttgttagtgatcctgatttagataaattgcttgagttgaggaaagccagatttcaaaaatctaaaggacatttgttataattagcaacttatgttgatagtaatgttaacatttgggaatatacgtttattcctaaattgttttagtacatttgagccactataagaaattaccataaactggctagtttataaaaaatagaaatttatttcatacagttttagaggctgagattttccagcttaagataccaactgatttgatgtcttgtaagggcttgctccctgttttggtgccttcccactatggtgccttcctactatgtccttacaatgtggaaggggcaagggagttccatgactcttctttgtaaaaagactaatccaatgtattagggtggaatcctcatgacctaatcacctaaaaagtccttacttcctgatactatcaccatagtgatgaggacgtaacacacatattttgaaagggtactactatgcacaccatagcacagcatagggataaacaaatatgttccatgtaaatggaaaccaaaagaaagcaggggggctatactaacattaactaaaattgaattttaagtcaaatctgtaaaaagaaacaaggaaggtcattatacaaaggagtcaattcacaaatagattataactattgcaaatatgtatgcactcaacatgggagcaatgaaacttataaagcaagcattaatacatctaaaggaagaaatagacaaaaatgcagtaatagtaggggacttcaataacccacattcaacaatggatagacagtctatacagaaatcaataaaaacattggacttgaactctatattagaccaaatggacctatcagacctatatagaacattccatttgacaacagtagaataaacattcttctcaagcacacaaggtataatctccaatatagatcatatgtggggccacaaaacaagtcttaaaaaattttaaaaagattgaaattacataaatttttttaacattgtcatatgaaactagaaaacaatagcagaagaaatgttaggaaattcacaaatacatggaaattaaacaacatgatccggaacaaccaatggggcaatgaagaaattcaaagggaaatttaaaaatatcttgagaaaaacaaaaatggaaaagcaacattctaaaaaacatatggtatgcaacaaaagcagtataaagggatgtttagagatatgaatgactccatgaagatcctaataaagcaagtaactttgtatctcaggaaactagaaaatgaagaaaaaaattaacccaaagctactggaaagaaaaaaatagtaaggtacagaacagaaataaataaaacagactggaaaaataatagaggatccacaaaactagaagttggcttttgaaaatataaacaagattgacaaacctttagctgaactaaaaaagagagaaggaacaaataaaattagaaatgaaacaggaaacattgtaactgatagcacagaaatacaaaaaaccagaagagaccgctatgaacagttatatgccaacatataactgttggataacctaatggaaacaaatatattcatagacatctacaacctaccacgattactgaaacataatgaaatacaaaattaatacagaacagtaatgagtaagaaaaatgaacaagtaataaaaagtctctcatcaaaaaaacaaaacaaaacaaaaaaaactcatggcttcatgatggatggaatcctaccaaacatttaaagaatcaacactaatccttctcaaattctgtcaaaaatttaagagtgaactctcagttttattatatgaggtcaaaaatcatactgacaccaaagccacacatggacactacaaaaaacaattataggtcaatattcttcatgaatatagaggcaaaaatgctcaacaaaatacttccaaagtgaagacaacacattaaaggaatcattcgccataatgaaaagtaatgtatatctgggatgtaaagatagtatatatacaccaatcaattactgttccacaccgaattaaaagaatgaaaagcaaaaattgtatattcatctcaatagatacagaaaaagcatttaacaaaatcaacatcctttcatgataaaaagtctcaacaaattagccataaaagaaattaccccaagacaataaaggctacatatcacaggctcacatttaacattatactcaagagtgaaaagttgaaacatttttgtctatgatcagaaaaaaaaaaaaaaacaaggaggctcgctctcaccacttatgttcaacatagtgctggaaatcctggctagagctgttaggcatggaaattggaaaagaaaacagttgtctctgtttgcagatgccatgatctcattatatacatggaaaacccaaggacttcaccaaactttgctaaaagtaataaccaattcagtaaagttgcagggtacaagatctacagacagagccagttacatttctatacactaacagcaagctattgaaataagaaattgaaaacaaacatctaatttacaatagcatcaaaaataataaaatacttgagactaaatcaaagcaaggagatgagagttctgtactctgaaaactatgaaatattgatgaaagaaattgaagaaaacacaaataaatgaaaagatgtcctgtcttcaaggatcaaaagaatcaatattataaaattgtcttcaatacctaaaactccagattccatgcaatattgtcaatattctaaacacatctttcgcagaaatggaaaaaaaattctaaaattaatatagaacaagagacaccaaatagctaaagcagtcttacaagacaaaaaaggaagagacagcacactatcatgctctctggtttcaaattacactacaaatctataataatcagaacagtttagtcctgatacaaaaaagatacatagacagaattaaaagctccgaaataaaatcatgcatatataaaggcacttccaaatattcatggaaaattgaattaaaataagaaaattttaaaactacactttatttcttaacataagctccatcaagttcaacacacttttgaaaacagtgatacaagccatttagtccatccctaaagactcgatggttctggaactatatccatgttaagcagtctttttcacataattaactgaaacaatgggtaccctttgtaagattttttaaaattaggcaaaagaaagaagtcaggagaaggcaaaccaggactttaatgtaggaatgctcaaagatttcccataaaaattctcacaaaattgtttttgtctgttgagaggaatgagcaggagcattgttctggtggaggaggactctctgatgaagttttcctgggcatttttctgctaaagctttgaaaactttctcaaaacattctcttaagaagcaaatgtttctctttggccttccagaactcaactagtaaaatgccttggccatctcataaactgttgccatgatgttttctcctgactggcctgcttttgctttcattggaccacttccacctttggtatgccattgctttgattatgttttgtattcaggatcatactgataaactcatgtttcagctcttgttacaaatctttgaagaaatgtttcaggttcttattcccacttgtttaatacactttccgttaaaaactattcccttgctggccgggcgccgtggctcacgcctgtaatcccagcactttgggaggccgaagcgtgaggatcacgaggtcaggagatcgagactatcctggctaacacggtgaaaccccgtctctactaaaaataaaaaaaaatctgcgggcgaggtggtgggcgcctgtagtcccagctactggggaggctgaggcaggagaatggcctgaacccggcaggcggagcttccagtgaactgagattgccccacagcactccagcctgggcaacggagccagactcagtctcaaaaacaaaacactcttctcttgtctactacacctcatctgggtgcaatggtcttgggtctcactgaatggaaattttgctataacattgattttcccatcagaatttgtaagatgaactaattatggtgttgactattgattctgctcttagtcatcagtcatctttaatccagatgtgagcaaaattatttttttctcacaaattagtgtggctagtctgccgctgtgggcttcatccttaacattgtcttgcctctgcctaaaatgagttatctgtttctaaatggctgatttcttttggggtgttgtccccataaatttttcaataatttcactgaagctccatgacaagtgttggttaggatgtggaaaaaaggaaacacttgtacattatgggtgggaatgtagattgttacagccattgtagaaaactatatggaggttcctcaaaatattaaacatagaactatcgcatgactcagcaattccacttctgggtgtataaacaaagaaaacaaaatcagtatgtctaagaaatatctgcactctcatgttttttgcaggattgttcacaatagctatgatatggaaacaacttatgtttctgtcaaagatgattgaataaagaaaatgtggtgcatatatacagtggaatacattaaattctgcctttaaaaagaaggcaaatctgtcttttttaacaacattgataaacatggcagatattaagtaagtgaagtaaaccagacacagaaagacaaatgctgcatgatgtcatttatatttggaatctaaaaaacacctgagctcatagatatggagagtagaagtatagttaccaggggttgcacagtgggagaaatagagagatgtcagtcagaggatacaagttttaagacaaataatttctggagacctagtgtaaagcatgatgactatagttattaataatatattatatatttgaaattacaaagacaatagttcttaagtgttctgatgtcattcatacaaaaggtaacaaggtgagatattggatatttgattagcttcattatgataatcattataaaatgttatgtatatcaaaataatatgttgtataacgtgaatataaaaatttgtatttgccaatgatacttttataggggtgaaaaaattgattacattaatcagtaaaaatggaagttaatggaccaaaatattacttctaggttttgaaatataaatatgtctttttgtaaaaacagaaaggttttttgtttgttgtagttgtttgtatcaccttggagtcgtgtattttgatttattcaatctggatatctctggaaactggctcctcattgcttctcatgtgccctaattttatctgagtatttctctctttttttttcagcataacatgttctaagttcactttatatttcctctgcccaacattcaaaatcatacacctttcctagaaagtctgattatttttaaagcagaataaaatttagaactcaagaaccatgaagtattggtaatagatgggaatgtccaatactttggaaatataattattttcagggatttttggtggtaaaatctttgaaatataaataaaatataaaagtttgttgttctcactggattttacaattcaaatttaataatacatctgtgaaaacaactttagtatatacatgttttcatttttgtgagtatatggtacgtctatgtatgtatgaggtacataaaatattttgatacaggcatacaaggtgtaataatcacatcagggtaaatgaggtattcatcatctctagcatttatactttctttgtgttacaaacaatccaattatccctcttattttaaaatgtgcaataaattacttttgactatagtcaccctgttgtgctatcaaatactagatcttatttattctatctaactatatgtttatgctcattaaatatattcttctctcatttgtctttactgactcattcatgaaaatgtcaaaagtgtaatgaaacgttgctattagtagttaaactactaagtgaaaattaaaatttctttgtgtttattttgcccctagatagttgactctgagtgtgaatcttcttttcaaaaatgatttaaatacttcttatctctggttcaccctattaccgaatccatagagttgtatattaattttcacttgtgttcttcatgcttagattttgcttttttctttcttatatactaacaataaactgtctgaaaaagaaatttaaagatctattccttttctgataacaccaaaaaataaaattaggagtaaatttaaccaaggatctcaaaaatctatatattttaaacaatacaatattgatgaaacaaattgaagaagacacacataaacagaaaaatagcccatgttcagggactgcaagatttaatatggataaaatgttcatattacacaaaaagatgtaaggattcaatgcagtccccatcaaaattctaatgtcatttttcacagaaaaatgaaaaacagttcaaaaatatgtatgaaatgacaagagatcccgaaggtcaaagtaattttgattaaaaagaacaaagctggaggcattacacttctaaattttgaattatgatataatgctattataggcacgatagcatgacattggcataaaacaagacaccaataaaacagaatagaattcaatatattttcaataaagatgacaagaactcacatagggaaaataatagtctcttcaatacatcttgctgggaaaatcggatattcacacatagaagaatgtaattgatccactgtttcacactacataaaactactcagaatatatgtaagactgacatgtaaagcttgaaactataaaactgctagaggaaaataaaagagaaaaaaatacatgacattggtctgggctatgatttcttggattggttccccaagcataggcaacaaaaggaaaaatacacacattgtattacatcaaactaaaaagcttctgcacagcaaagtaaacaatgcccagagtgaagagacaactcatgagttggaaaaatatttgcaagccatatatctgataaagcgttaatattcaaaatatataaggaactcaactcaatggctaataaaaaggaattaaccaatttaaaaataggcaatgtacctgaatggacatttctcaaaagaagacgtaccaatggccaacaagtattattatcaacaatacaaaaaaacatcaagtgttatcaaacatgtggagaaaaggacacacttgcacattgttgatggaaatgtatattagtatagccattatggaaaatactatagagtttgtcaaaaatgaaaagcagaacatataatcaatccagtaatcctactactgaatatatgtacaaagaaaaaggaatcagtatgtcaaagagttatctgcattcccatcttcattacagcattatttataatagccaaaatatggaatcaacttaagtatccattacagatgaatagataaagaaaatgtggtctatatacacaatgtaatactattcagctttgaaaaaaggaaatcctgcattttcaagaacatagaataaacagggaggacattaagttaggtggaataagacagacaaaaccacatgattgcacttatacatgcaatccgttgtaaaatatggtgactttagttaacaataatatgttgtattcttgaaaactacttagtgtagattttaagcagtctcaccacacacaaaaatgagaagtatgtgaaggaaagcatatatttattagcttgatttagccactatctaatgtatacatatttcaacacaatatgttttacataataaatatatgcaattttatttgccaataaaaaataaatgaaaatgtttacaaaaagagaatatgtggtatagatacacagtagaatactatacaaactaaaaagaagacaattttgtcaatagggaaaacgtggatgaatctagtggacattatgctatctaaaataaagtcaacacaaagaaaaatcctgcatgatcttattgatatgtggaatctaagaaattcaaatttacagaaggtgagagtagagtggtggttaccagaagctgaagggatggcggtgtttctaggaggtgttggtcaaagggtataaattttcagttagactagaggaatacattttactatctatttcacagcatggtgttcacacttaataataataataataatagtgataatattatatatttcaatattgctgagtacatatattctatttaatatatttaagcctagcctttctaactactacagaaagagaagctaaatgtcttttgtaagtatgcttatcttacaaaaaataagttcatttgacattcatgtaataaatctaatctttgttttattgattttcagattaacaaagaccttatctgaatactctttacaacttttatgtaaatctaaaattattccataggagaaattttatgtaaaaaaagataaaagtatgaagcatgtttcagtttgggtatttcactttgtattcactgaatattgaaaaaattaaaatactatcaactaatacataaagtcatataaactcctaaataaccgctgaggaacctacttacttttgtgtgtcattttggatagtcaaggttttttgctatgctatactttaaaaagtaattaatgaaggggctgactctttttttgttaatagcacacttaacaatattagtggattcctggtgttcttcactaaggtccttggtcagtaatttctgattatattttatgcaaagaactttgaaaacaccttgtgctgtattttaaagtttattatcatccatatttctgaccaatcacagatgttgcaaaaggttgggacacttggaaaaataaaattattttcaaaaagattatttttttatagaatttcaaaaacaaccatctttaaaatactaacaatagttttaaaaattacaatacttttataaagtttttacgaacactacttacagatagagtaaaatttcattataactgaaaatgttttcagtaacctgttatacttggctaagtgtcattattcaactgaaattccacctctcttcaacatttacgtatatattttcctgaagatttttgtcttatgttttgcagttattttaaagttatggaggaggttttgcttattttactatatttactatatggtttgtctttagcattattgatagatctttttcttctaaatatgggccgtattttctgcttctttacatatctagtagtgttttattctactctggtcaatgccaataacacattgtgatgacagccatggaatataaaagttacctatgggtttgtcatatatgctatttatggtattggggtacttttcttctatacatatgtttttaaattttcctgtgcacatcataggtgtacagtaggtgtatgtattgatggagtacttagaatgttttgatacaggcatacaatgtgaaatgagcacatcatggggaatggggtatacatgccctcaagtatctttcctttgagttccaaccatccaataatactgtataagttattttaaaatgtacaagtaagttatcattgactatagccaaccgattgtgctgtcaaatagatggacttatttattttttctattttttttcgtacacattgaccatccccatctcccctctagccctataccacccttcacagtctctagtaaccatccttcaactttctatgtccaagagttcaattgttttgatttttagatgccacagataagtgagaacatgtgaggtttgtatttctgtgcctggctaatttcacttaaaataatgatctccagttccatccatgttgttgcaaatgattggatctcattctttattatggcaaagtagtactccattgtgtatgtgtgccacattttatttattcattcatctgttgatggacactttggtggcttccaaatcgtagctattgtatacagtgaggcaacaaacataggtgtgcagataccgcttccatacactgatttccgtacactgctgttgtatacacagcattaggatggctggatcataaggtagctcaatttttagttttctaagaaacctccaaactgttctccatagtggttgtattaatttacattcccaccaacagtgtacaagatttccctattctccacatcctcattagcatctgttattttctctcttttccatataagccattttcactggagtgagatgatatctcactgtagttctgatttgcatttctctgatgatcagttatgttgatcatcttttcacatgtctgttttccatttgaatgtatccttttaagaaatctatattcagatcttttgcccttttttgatctgattattagatgatttctgatagagttgtttgagctctttaattattctggttattaatcccttgtcagatgggtagtttgcaatattttgtcccactcagtgttatttcttcactttgttcattgtgtcctttgctgtgcagaacatttttaacttgatgtgatctcatttgtccatttctgctttgcttgcctgtgcttgtgagttattgctgaagaaatttttgcccagaacaaagtccttgagattttccccaatgttttctggtagaagtttcatagtttgaggtcttagacttaagtctttatccatttgatttgatttttggatatggtgaaacatagaggtctagtttcattcttctgcatatgaaaatccagttttcctagaaccgttaattgaagagactgtcttttccacaacgtccctttgtcaaaaatgcattcactgtagatgtgtaaatttgtttctgtgttctctattctgttccattagactgtatgtctgtttttatgccagtactatgctgttttagttactacaactctgtagtataatttgaagtcaggtaatgttattccttcagttttgtttttattgcttaggatagctttagctattttgggtacctttagcttttgtggtaccataaaaattttaggattgtttttctctattactgtgaagaatgtccctggtattttcatagtgatttcttgaatctgtagattgccttgggtagtatggacattataacaatattgatccttccagtccatgatcatgaaatatcttttttatttttggtgtcctcttcaacttctatttttagtgttttactgtttttcttatagagatctttgacttctttggttaatatctaattatttatttttatctgtggttactgtaaatgggattacctttaggatttttttcagattgtttgctgtcaacatatacaaatgctactggttttttatgttgatattatatcttgcacctttactggatttgtttatcagttctaatagttttctggtgattaccttacgtttatcgaaaaaaacttataccatctgcaaacaaagataatttggcttctttcttttcagtttggatacctttatatccctctcttgtctaactgctgtagccaggacttccagtattatgttgaataacagtggtgaagtgggtatccttgtcatgttccagtactttgaggaaattatttcagactttctccattcagtttgagagtagctgtgtgtctgtcaaatgcagctttgattatgtttgggtgtgttccttctatcttcagttttctttagtgttttatcatgaaggattttgaattttatcaaatgcctttttggaatcaattgaaataatcatgtggtttatatccttcattgtgttggtatgatgtattacattgattgagttgtatatgttgagccatctttgcatctcaaggataaatcccatttggtcatgttgaatgatctttctagtatgctgttaaatttgtttgctattcttttgttgagaatttttacaattacatttgtcagagatattgacctgtagtattctttttttaatgtgtctttgtctgattttcttttcagggtaatattagcctcacattggaagtatttgctcctcctcctcctctatttttcaaaatagttagagtagaattggtactagttcttctttaaatgttagggagaattcaacagtgaagccaatatgtcctgagcttttctttactatgagactttttattctggctttgatctcattacttgtattaataattgatctgttcaggttttggatttctttctgcttcaatcttagtaggttttatgtgtctaggaatttgtccatttcttctagattttccaatttattggaatatcattccacatagtggccaataatgattctttgaatttctccaggatcagatgtaatgtttccttttcatttctgattttatttatttgaattctcactctttttctcttagtctggataaaggttgatcagcatgtttaatattttaaaataacaacttatgtttcattgatctttgtattttattcatttcaatttcaagtttatctgctgtgatatttattatttattttcttctaataattttggatttggattgcccttccttttctagttctttaacataaatcaccaaattgtttatttgaagtttttcctttcttttttatgtagtcacttatagctataaatttttctcttggtactaaaactgctatatcccataggttttgtgtttccattatcatttgtttcacaaaatattttaatttcttcattgatccactgtgcattcaggggcatattctttaatttccagattctttaattttttgtttcaacttgccataaggattgcaaatactatcttataaccagaaaacaacttaacactgtttgcataaacaaacaagccaaagaaaactcataaatactctccaccttaattttcccttctgctttcaaactttttgttgtttctatttttatcttattgtacagactatgtcttgaaaatctgtagttattatgtttcattagttcattatttagtctttctacttaggatattagcttacacaacccagttgcagtgttttaatattctgtatttttctatgtacttactattaccagtgagatttgtgtcttcaggtgattattgttcatgaatttaattttttgattgaaatattccctttagcatttcttgtaggacaggtctggcataataaaattcctcaccttttgcttatctgagaatgtctttatttcttctttatgtttaagggatattttcaccagatattctactctaggataaacgttatttttctgtcagcatgtgtcatatcactcctgtaaggattcctctaaaaagcctgctaccagatgtattggtgctccattgtatgttatttatttctttgttcttactgattttagaatagtctctttatccttgaccttagagaatttgattattaaatgagttgaggtagtcttctttgggttaaatctgcttggcatcctataaccttctagtacctgatatagatatcattctctaggtttgggaagttctttgtgattatccatttgaataaactttctactcctatctcgttctctacttcttccttaaggtgaatactcttagatttgctttttggaggttattttttagatcctgtaggcatacttcattgtttttaattctttatttttttgtctcctctgactgtgtattttcacatagcttgtcttcaagctcaacaattctttcttctgcttgatctattctgctattaaagaatagcacgtgtaatatcttcttcagtatgtcaattgcatgtttcggctccagaatctctgcttgattttttaaaattatttcaatctctttgttcaatttatctgatagagttcagaattccttctctgtgttatcttgattttctttgagtttcttcaacaaaactattttgaattcgttgtttgaaaggtgacataactcagtttctctaggattgttccctggtgctttgtttagttcatttggtgaggtcgggttttcctggatggcgttaatgctagcagatattcttctgtgtctgggcactgaagagttaggtatttattgttttcttcactgtctgggcttaattgtaaccatccttcttggcaagatgttccacatgtttgaaaggacttgggtgttgtgacctaagctgtaacttctttacagggtgtcaaaatcccaccaatgcagtggttcttgcagacttctgggggtactctattgatggtcttgcacatgatctgagagaattcagagtgatgagggcccctggaccagggtggtttccaggggaccagtttcaaaaaccttagatgtctgcttgatgttatatggtactgtatctgggctggcagtcatattgcaagttaaaatgttgtggggtggggtggggggaggggggagggatagcatttggagatatacctaatgttaaatgacgagttactgggttcagcacaccaacatggcacatgtatacataggtaactaaccttcacgttgtgcacatgtaccctaaaccttaaagtataataataaaaaaaaatcctcctcactgttccctcccctttccaaagtcagaggagcctcaccctatggtctaacaccactccaggccatgaggagtactgccagacaactgctgatgttcccttaaggtttaggtgctcctaagtcagtttgtggtgaatgctggctagcctaggattcacccttctgggaactgggctcccatctggtccatggtatgtccaaaaatgccacccaccagtcaagtccaggaactggggaccctgggagcccaggtggttctctatcccctgtggccatgctggtacctgaagccagcaagtctcagaggctcacctaaggccctcaacatagtatctgggtatcactgcaggttattgagggccaagggctcttcagttaggctgggtgaatgctgccaggactgcatcatttccttcagggcattgggttcccttttggttcagggtatgtcaagaaatgtcatctgggagctagggcttaaagcaggggcctcattcctttgacagttgccctatcctgctttgtctgagctgatatccaagatgtaagacaaagtcttccccgttcttccctctcctctcctcaagcagaaggaaggggtttcttttggagctgtgaaatgtgaagcctggggttaggggttgggtgatgccagcatgctcttggctgcctcagctggtgcagttggtgtctctgaatattctgtgtcttcccccagtccatagtctctgagcctagttcagcactaagactcacatatgtgtgcagtccttatgtcctagactgtctttctagtttatttagagacacaatgcatggtaggtagccctaggtggcaagatttgtgggaacttgatttcagacccctgcggtcagcaataccgtcatggctagcattggtttaaatactccctccatgggaaggggttagctgagtttggtttggctttcctttctgctctaacagcacagcattttgttcaatgcctcacaattgctatgttctccctccctcagtgcctagagcaaggctctgtacatcatggcacagctgcaagtgtggggagaggggaaagggtagtgtcagtgactcaagattgtctgacctatctcttacgtgcctctttcagggatatgaagttaaaaccatgtactatgagtgctaatctgataatgttttcattttatgaaggtgtttttttttttttctgtgtacatagttgttaacttggtatctttgaaggggaatggttggtgtctcctattccaccatctggctctgctctgcctaatttgtggagactctttatcatgaagaaatgtcaaagtttctcaaatgtttttagtacttctatgaaaatgatcatatagttttgttgattctgttattgtgatatgttacatctattggtttgtgtatgtctgctcatctttattttatgcatagtttgaaaaaaaatactaccagttttttatactgtttggttgaattcagcagtgaagataacaggcgttgggcttttttgataggtgaattttattactgatttaatcaacttactcattatttgtttgttttgattttctatttattcctaatacgatctgtattaggaatttttattttaatttgtatttgtattttacaagctattttatttttagcttgtatttgtatttgtagctgtatttgtattttagcttgcttctcccttagattcccccatgagatgtacctaaagaaaacttggaccaagtgaaaggcaaggcattatctggtagcagctgctggtagcagctgagatcaccaacagtagctttccttgcttctggaagttttcctaagaaacatccactgcagtacaatggataattagtggggcatcactaagattcctgaacttcggaattttctggaaatagcatttatgacctttgttccctcagttcttccagtagttgcagaagcctttcgttccctttattgatactctctttactcaaaaaatgagagataaaataaattaatgttttatattacttttggattcagtccattactgtccctaaataatattttacaagtacatttcagggaatcaattccacagatggttgtgaaaccactaactggaattattgaagcattttgcaaaactctctgaactttgatatttactaagtgaccttaaaggcctagcttcgtggtagtttcctcaaattcggaatcacccttggtaactaataatgaaagatttcaaactccaaacagtacaactgaaacttttgcattactatactactgagaatatctaacatgttgttactaattaatgtcattctaaccttgtgggtttcctatgctaatggacaaggtaaattgaaagagatctaaacactcagctcccatcttaaatgtaacttcatgtaatatctagcttcctatgtctccatgtctacaattttttatgaaccaaagaggatttattcactatgctagtagaaatagcatattttgtaagactataacagaaattaattttatgaaatattatctcattttaacttaaacaatgaataatattttctttgttttataagttctacagtgtaaaagacatttaatattgattatggagatatgtgaatatactcatgaaactttaagtaggaaacatgtcactagacagattctaaccttaaaatgttcagaagtttcttatttgtaatgcaaggggagtgactgatattttcataatcttacagatggtgattttttatagattcatatatcaaaacatcaaataatacattttaaattctgcagtttcttttatttctataataccttaagaaagctgctaaaatgaattaacattaatatgaacttaatatttcaacaagattagcaacatgtaaatcacaacatgtaaatcacaacatgaatataatcaaaaagtagactatatgcttaacttacttttaaatgacagtaaattttgcatttctgagctcactagcaaatgttcaataaataaatacataattattttttatagctttatgttattgttcactgatttgttttctcctcaacagtcatatattttctatattaactacctttttgaatgcaggccttgcatattaaagaactatatcgtaacattagcagtggaaccacatgggtcaaatgtcatggacaatcaaaggtttgtggccattaatgaagaatacaaattttgtaattatccaaaacttcataatatttcaacaaatgtagtggagggtaatactggaaatccaattatcaatttatgagagtatcttttccctcagcctctcttctcaaagctatgccactttatttgattctaggtaaagagctttaggttttacagtattatctatcacatgatttgctagttttatttgttgtgcaaaatcaaacttgatctgtgctaaaatggaaaaaaaaggaaattctcctgttatttcctttgttaactgaactgatacaggtacatttttttcaaataaagattaaatagattaaagtagaatgaaaagaagaaaagtagtaccattctgaaatgactggaattagaaaagcatatgcactatactttcttacttactttcttaaaagcactatagaaaagaatgatgacaaattcttccttatctgatattccagttgaaaacttgtctcctccaatgaactctttgtaagagtaaacttgagcaaaatgtcttgtaaatttgggtcgcacctatatttctcaaaggagaaagtaactcattgggttactttcaaagtcttggttagagagaaacatctttgtgtattcagtagcattggctcaattgcatcccgccaaaattcatttgttaaagtccaaattcccaatacctgagaatgtgactgcatttggagaaggagtgcttaaagatgtaattaagttaaaggccaatgattcaggtgggtcctactccagtataactggtgtctatataggaagagaaaataagaacacaccatatagagaaagatcacgcaaggcatagaaagaatacaaccatttacaaggcaaaggaagaggtctcagaagaatccaatcctgttgacagctctatctcaaactattagcctccagaactgtgagaaaataaatttctatgaaatcagtggtactttgttatggtagctctagcagatgaataccatgatatttacacaatttattaaaagaacattaataactaaaaataattttttactttttactcaagaatatatatatatatatgtagccaccacacagattttagaggctattcatcagaatttggtaattacatcttgggtgtattttcctgctgatttttgtcttgttgaatactttatgtgtatatatatctgtattcatctatattcagaatctagtaaatcaaatctaagaaagatttttcatatcattaatgaaggacatactttgtgaattgcttatgctaataaaatttttttaatggtagttgatatttcagttctgaacaataaaatcggcacaccaattcttttggaaaccacgctatttgaaagacaaacttgacagaaaatttgtaattgtaacctattataatgttcattgaatttgtattggccattatttcttccatcaagtcataagttatttatacttatttaaaaataggttgtcaataacattatttttaattatgaatatcctttcagaattgtataaattttatattcatctactagagttgccataacaaagtgtcaagagtgacaattaacattgtagagcagggttgcttttaaatcccttttaaactgatcattacagtaccaaatgcattacagttaattgccattgtacttctttgggatgctgaaatttgtttcacatctcactaagaagatggcttctgtgtatatttcatgtgcccccattaagctttggcataacataagagcccatactttccttgacttttcctactacagactaagtttcaataatttctctatgaaattccagtgccttttagtgggaagaacgatttttagaaacaaacctaaaccatgaaaaactcacttcaggttcgaaattatcgttgactaagaaaaataatttttggccgagcaggatggctcacacattaatcccagcactttcgagggccaaggcgcgcagatcacttgaggccaggagttggccaacatgatgaaatgctgtctctactaaaagtttaaaaaaatagctggatgtggcggcacacacctgtaattccagcttcacaggagactgaggcaggagaatcacttgaacccgggagacagaggttgacgtgagccaatatagtgccactgcactctagctttggagacagagcaagactattaaaaataaaaataaaaatgaagaaaaaaagaaagatttaaatgatttcctttagtttatgtccctttctacctcggactaaatatcctgcaatcataagaaaatgtaagagtatctcaggaggttacacagggccgggaagtttcgattttccaatacggaggagacactcagcagaaaactgtgcatccatgcttgagggactgggtcagagaaggtgtcatgcgtcgcccaacaagcctctggatccagttctgtaactagcaaacgcttccctcaaagtaaagatgtcacttctctgaacttagtcttctcatctgcacactaaagctgttgtgccactagcgtctttctagttctctctggtttatgatgattcaaacttaacttttatttaattatattcttaagttttcataacaaatagaatgtaaatactattttctatcacttgttccataattatagagtaaacataaatgatatgctatttaaattgtgatgttgttcaacattctataggtatacatacctatagaatgtaagaatatatacatatttgtacattcgtctatgcacttattttttatgtcaataatatatcttatctgacacatgaattctaactatggtaagaatgcatgccatcgcatacaaacaaaatgccacaaaactaaacaaaatgttttatatctggagataatttgctacatatcagattttttatgttacagtcatatttcttgtctctcttttccaaaaaacaatcattgctaatgcgtgcaccctgaactggcagcttgagcttaacttggtatagttgtagataagctcagtttaaattaatgctgataaaacctccagaattgctgaagagaccatactatgttagtagaagtagagaaagtgaaatgaggttcttgtcctgttagctgacttgagatccattaaagattttaagtggagaaataaaatgaccagatgaaaggtcattaatttatacacagggaaatagattacaaagatgagaggtcaggatcaggaaactagttatgattgctgcaatctcagaagaaaatggttgagagacgatgtttatcaaaggttattgccagggtttttttgcgcctgtttgtttgttcgttttgacagaaaaaaattgagtgaaagggaacaccacaattgcagaagttcagttattattgagagaggtaatgagaatgattgacatgaatttcccccaaaaaatgttctgtcaataattactatattatgaacaaatagagcatggaatatttttatagctgactcagcgaaaatagctattacagcaaacctatgtctatactgaaattcacatatacattcaaagaatattactctataccatttatctcaagagaactaatcttcaaagcaaaagaaatcagcaacatgtttttaattaaaattttaacttccttcaaaaatgtctttttggccgggcacagtggctcacacctgtaatcccagcactttgggaggccgaggagggcggatcacgaggtcaggagatcaagaccatcctggctaacagggcgaaaccccgtctctactaaaaaatatacaaaaaaaattatctgggcgtggtggcgggcgtctgtagtcccagctactcgggaggctgaggcgggattattgcgtgaatccaggaggcagagcttgcagtgagcggagatcgagtcactgcactccagcctgggcaactgagcaagattctgtctcaaaaaaaaaaaaaagtcttttttatttatctgttaagaacagataaatcattcatgaggcattcaagtcaaaaaagaatttttatttttttgttggcagatttacttagtggaaacaacatttgtatttagctttaaaagtaaattaagtggaggaaaatgaagattttcattaataaccctaatattaatagacaatggtggtactgaggagaacatctatctctttcaggcttcatgaggaaatgatgtttttcagtgtcaacaaagtactctcaactgtgtggtttgcccaccaaatatcatgtctgtaataatataccgtacttagcctaccacgttttaaaatgattggtttccaactatcatggcatagaagagaatatatagatagttgaagagttaaagaaattatagcataagaagcatgcaaaaagatagagttatagcattataatgactgtcttgagatatttcaaaacatttatgagggggagtaagttagcttttgatgaggactgtcacagtcagtgaagcaggtaacagtattatccaacatcgaatcagaggtcaagtgattttctaaaagtgtgacctatacggatattgccctatgtcgggggtgggggtagaagagttgatctcttctgagccctccacgttttaagttgtatgattcaacattgtacatacaaaccttgttttaattatactctatttttaaaaactgcagttagcttttgagttagctgggtgtgttgacccaggcctatagtcccagctactctggaggatgaggtgaaaggattgcttgagcccaagaggtcgaggatagagccagccaggatggcacccctgcgttccaaccgggctgacagagagagacctcttctcaaaaacaaacaaacaaaggaacagaaattcacttttttgtgtattttattaagaattttaacacctctgttcaacagggacatcagcctgtagttttctttttgtgttgtttccttgtttggttttggtatcagggcaatgctggcatgctacaataagttggaaaaattccattttctttgcttttggcatagtttgagaaaaattactctgagtttttttttttttaatatttggtagaattcagcagtgacgataacaggttttgggcttttttgatgggtgaattttattactgatttaatcaacttactcattatttgtctgtttagatttctatttattcctaattcaatcttggtatgttgtatgtgtccaaaaatttgtccatttcttccaggtataccaatttattggcaaacaattgttccttatagtttttatgatcctttgtgtttctgtagaaccagatgtaatgtctcccttttcctctctgattttatttatttggatcgtctcccttatttttcttagtctaagaaaatgtttgtcaattttttttaaaatctttgctttactgattttgtcatacttacatttagtctctgcgttgtttgtttctgctctgatctttattatttctttttcgacttgtttttagtaatgttgttcttaaatttttagctccttaaggtgcaatgtttggttgtttatttgagagatttattctttttgataaggcatttattgttataaaatttcctcttagaactggttttgctgtatctcatctattatagtatgctgtgcttccattgtcatttgtctcaaaaactttccaaattttttttagttccttcattgagccattggttttaaatgtacatgttgtttaatttccaagtgtttgtaaagtttccaagttttattctgatgttaattgttgtataccattatgatcagaaaagattcttgatataattactatttttttcaacctgttacaacttgctttatgacctaacttatgatctattctggagaatattctatgtgcagttaaggagaatgtgttctgcagcagtcgaatgaagtattccgaaaatgtctgttagatctatttggtctagaatgttctttaagtccaatgtctttttgttgattttctgtgggaattatttttccattgctgaaagtggggagttgaaaactcctactatcattgtattgcaatctctctctctctttagagctattaatatttactctctctctctctctctctctctatatatatatatatataggtgctctaatgttgagtatatatatatatatatatgtttacaattcccatgggtatatgctgatttgatgcctttatcattatataatgactttcattgtttctttttctgtttttagttaaagtccattttatctcatttacatatttctgctcctgctcttcttttccaacagcatggaatatctctttctctccttttactttcagactatgagtccttagaggtatcatgtgtctcttgtagcaagcatagagttgagtgttttctttttaatccactaaccgactctatgtcttttaattgaataattcaatccattgacattcaaggtaattattgatagataaagattaactattgccatttggtaattatattctagtcatttggcagattttttttcttcctttcttcttcactcttttgtggttaaatgatttttttctatcagtgttgtttgactcttctctttttacttgtagtgcaattattatggatttgtgctgtggttattctgaggcccacaaaattcttatatttataacagcttattttaccagataacaacttgtgattcactttttaaaagaaaaaaacaactctacatttttactctaccttatcacacattttgaatttttgatgttacaactcacaactttttaaattgcatactctctaaccaattttgtagctattatttttaattgtttgctatattatagcttcatttctaagttctaggatattcagggtggtaatcttggctctcagtggttgcttttaagtttctgtaggagggagagaagctggagaactcctacactgcagttttgctgatgttattctctccatgattctcttattttaatgaacagtatcttaaaccacggcaagtatagtaatgtaaaataaagaataaacagaagaagtcaatgagagaacatgtgtggacttgagttatattcttccaacaaaacagaaaattttatatatatatatatatatatacatatatatatatatatatatatatgaatgtattgtactaaaaataaaagataccccaaaacacaactttaaaaacatttaaatatcaagaatatgctgaaacttttgtactcagtatgatctattgtgagttctgaaaatcagtatgctactctaaacacataaaaatacagagagtggaatgggatccagacacaccggtttgttttcatacaaccttatgtaattaagttgggtactggaaagcaaaggacaacagaaaattttagagacatggaccctgagagttactcattaatgattcatctgtatgtggaagaaactcacctattttccagtgtttaattttaaaattagtgttctcattttaagaagagtatgtgggataagagtattttgaccatttgtggggggggggaaaaaaaccttgccatgccaaacagcaggattttcacgagatgagtgtgccagatgtttattttcaacttgaaatcaacccagttcctatcttcattttcttctgcattgcagaagatcagcctgaaactacagtttctgaagttcctttctccatagcttgcttctcccttagattcccccatgagatgtacttaaagaagacttggaagaagagaaagacaagggattatctggtagcagctgctggtagcagctgagatcaccaacagtagctttctttgattctggacgttttgctgagaaacatccactgcagcaccatagataattagtgagggcatcactaagactcttgaacatcagaattttctggaaatagcatttttgacctttgttccctcagttcttccaatagttgcagaagcctttcgttccctttatggaaactctctttactcaaaaaatgagaaataaagtaaattaatgttttatgttacttttgcattcagtccattactgtgcctaaataaaattgtaccagtacatatcaggcaatcaaatccacagatgattgtgaaaccactaactggaattattgaagcattttgtaaaactctctgaactttgatatttactaaatgaccttaaagcccctagcttcatggtagtgcacttaaattcagaaccacacttggtaactaataatgaaagatttcaaaccccaaacagtgcaactgaaacttttgtattagcatactactgagaatatctaacatgttgttactaatcaatgtcattctgaccttgtgggtttcctgtgctaatggacaaggtaagttaaaagagatctaaacactcagcttccctcttaaatgtaacttcatgtaatatctagctttgtatgtctataattattttatgaatcaaagaggatttattcactatgctagtagaagtgacatattttgtgagagtataacagaaattaattttataaaaaattatctcattttaacttaaagaaaaaatgaataatgttttatttgttttctaagttctacagtgtaaaaggcatttaatattgattatggagatatgtgaatatactcatgaaactttaagtaggaaacatgtcattagacagattctaagcttaaaatgttcagaattttcctatacgtaatacaaggggaacattgggagtgactgatgttttcataatcttacatatggtgatttttatagatttatatatcaaaaaatcaaataatacattttaaattatgcagtttcttatatttctattatagcttaagaaagctgctaaaactaattaacattaatatcaacttactacgtcaacaaaattagcaacatacatatataatgaaaaaatagaatataaacttacattggaaagatagtaagttttgattggcatttctgagttcactagcaaatgttcaataagtaaatatacagaaaatacttttcatagcgttatgtcattgttcactgatttctcctagatagtcatatattttctgtattaattatctttttgaatgcaggccttgcatattaaagaactatatggtaacattagcagtggaaccacatgggtcaaaaatcatggacaatcaagggtgtgtgtccattaatgaagaatacaaattttgtaattatccaaaacttcatatttcagccaatgtaatggagggtaatactggaaatcccattatcaatttatgagactatcttttccctcaaccactcttcgcgaagctatgccactttatttgattctagggaaagagctttaagttttatagtattatctatcacatgatttgctagttttatttgttgcgcaaaatcaaacttgatctgtgccaaaatggaaaaaaaaaggaatttcaccagttatttccttttttaactgaactgttacaggtacatttcttcaaataaagactaaatagattaaagtagaatgcaaagaagaaaatactactattttgaaatgactggaattagagaagcatatgcactatattttcttacttactttcttaaaagcactatagaaaagaatgatgacaaattctttcttatctgatattccagtggaaaacttgcctcctccaatgaactctttgtaagagtaaacttgagcaaaatgtcttgtaaatttgggttgcacctatatttctcaaaggagaaagtaactcatttagtggaataacatcttgggtagagagaaacatctttgtgaattcagtagcattggctcaactgcatcccgccaaaattcatttgttaaagtccaaattcccaatacctgagaatgtgactgcatttggagaaggagtgcttagcgatgtaattaagttaaaggtcaatgattcaggtgggtcctactccaatataactggtgtccatataagaagagaaaataagaacacaccgtatagggaaagatcacgcaaggcatagagagaaaacaaccatttacaaggcaaaggaggaggtctcagaagcatccaatcctgttgacagctatatctcaaactagtagcctccagaactgtgagaaaataaatttctatgaaatcagtagtactttgttatggtagctctagcagatgaatactatgatatttacacaatgtattaaaagaatattaataattaaaaataactttttactttttactcaaggatatatatatatatatacccaccaacacagattttagagggtattcatcagaattgggtaattatatcttgggtgtattgtccttgctgatttttgtcttgttgaatactttgtgtttacatattatctgtattcatctatattcagaatctagtaaatcgaatcagcaaatatttttcatatgattaatgaaggatatactttgtgagttgcttatgctaagaatttttttttaatggtggttgatgtttcagttctgaacaataaaatcagcacaccaattcttttggaagccacgctatttgaaagataaacttgacagaaaatttgtaattgcaacctattataatgttcattgaatttgtattgaccaatatttcttccatcaactcataagttatttacacttatttaaaaacaggttgtcaggaaaattatttttaatcatgaatatcctttcagaattgtataaactttatattcatctactagagttgccataacaaagtgtcaagggtgacaattagtaatgtagagtagggttgcctctaaattccttttaaactgatcattttcagtacccaatgcattacagttaattgccattgtacttctttgggacgctcaaatttatttcaagtttaactaagaagctggcttctgtgtatatttcacgtgtccccattacactttggcataacaaaaggtcccaggatttccttgacttttcctactacagaccaagttccaataatttccctatgaaattccagtgccttttagtgggagaaacgattttcagaaacaaacctaaactatgaaaaactcactacagtttcgaaattatcactgactaagaaaagtaatttttggtcgagccggggggctcctgccttaatcccagcactttcgggggccaaggcgcgcggatcacttgaggtcaggagttggagaccagcccggccaacatgatggaacgctgtctctactaacaattcaaaaaattagccggagtggcggcacacacctgcaatcccagctactcaggagactgaggcaggagaataacttgaacctgggaggcagaggttgcagtgagccgagatggtgccactgtactctagccttggtgacagaacaagactgttaaaaaaaaaaaaaaaaaaaagaaaagaaagaaaaattaaaatgatttcctttaatatatgtccctttcttcttcagactaaatagcctgcaatcataagaaaatgtaagagtatctcaggaggttacacagtgcagggagatttagattttccaatatggaggagacactcagcagaaaactgtgcatccatgcttgagggactgggtcagagaagctgtcatgcgtcacccaacaagcctctggagccagttctgtaactagcaaacacttcccacaaagtaaagatgtcacttctctgaacttagtcttctcatctgcacactaaagctgttgtgccgctagcctccttcccgttctctctgatttatgatgattcaaacttaaagatttttccttagtgatattcttaagttttcccaataaataggctgtaaatattattttctatcacttgttccagaattatagaagaaacataaattatatgctatttaaattatggtattggtcaacattctatatgtctacatacatatagaatgtaagaatatatatatatttgaacattcgtgtatgcacctatttttttatgtcaataatatatctcatccgatacatgaattctaactatggtaagaatgcatgccatcgaatacaaacaaaatgccacaaaactcaagaaaatgttttatttctggagataattggtacatttctgattttttttaatgtttagagtcatatttcttgtttctcttttccaaaaaacaattattggtaatgtgtgcaccctgaactgacagctttagcataacttggtatagttctagataagctcagttcaaattaatgttgataaaacctccagaattgctaaagagaccatactacattagtagaagtagagaaagtagaatgaggttcttcttgtcctgttagctgatttgggatccattaaggattttaagtgtagaaataaaatgaccagatgaagggttattaatttatacccaggaaaacagattatacagatgagaggtcaggatcaggaaactagttatggttgctgtaattccacaagaaaatgtttgagagaaggtgatatcaaaatttatctctaatatgatttattacagtaaaaattatttatacttttttgtttgttttttattgcaagtgaaaccttgtgattttccagacattaaacatggaggtctatttcatgagaatatgcgtagaccatactttccagtagctgtaggaaaatattactcctattactgtgatgaacattttgagactccttcaggaagttactgggattacattcattgcacacaaaatgggtggtcaccagcagtaccatgtctcagtaagtaatcctctgaactgctacacatgtataaaactttaaaagattaaagagaggagagcacataattgattactcttgtcttatgtaacagaaatagggccaagaaatgagttgttcaagcaaaatgaccaaaatagatcttttctattatgaggagttcttgaaaatcatatgaaaaataaatatagagactttatgagaatatctatatagtttatacatattttaattatgaaaactaaagagaagtaatattaaatattgacatttcctcttgtacaacctttgttagtaattttggttcatactaagttgtacattatttttggatgtttatgcgatcttatttaaatatggtaacaataattttaatatactttttgtgcaaatttatgtttctcatttactttatttatttatcattgctatgtccttaggaaaatgttattttccttatttggaaaatggatataatcaaaattatggaagaaagtttgtacagggtaactctacagaagttgcctgccatcctggctacggtcttccaaaagcgcagaccacagttacatgtacggagaaaggctggtctcctactcccagatgcatccgtgtcagtaagtacaccgctctgagatcccagcatgttcatgtctttctaagtaacacggacgacagtctcagacttgtctatattaactgtggcaaaatgtttttgtcaacttgttttgccaacggacctatttagttttacttttttaattgtgtgaatatacaaatttcttgataagtacatagcaaaataaatgctcctattaatgggcattagtcaagaatacagtaaaagaattagaacacaatacttgttggctaaataaagtcatattgaagcggcattaatgtctcgggtaaatacccgaggttcgtcatcttgcaccaagaagattaagtacaaatgggtattctgggatcttgtacatattctactctagaaggtttcctacagtatttattcaaatatacatttatataaacagttccttcttttttcacatgttgctaatgattggtgatgtcacattttaatatttacaagttgagtggctataaaatggtatagcattgtaatgtaaatttgcatttcttttactaccagctggatttagaatacatgttcacagtttaattggtatttaatgattctaaaatttggaaatgcagtttgatttcttttatttatctttttgggagttttggttgttattagttggaatcatcttaataattctgaaggtaaaatctcttttaattatatgtaatgcaaatgcattctctttgtggctagtattgttctttccttttttctgcattatgaacaagttgctcattttactaaataattgtcaatcttttttcatgatgaatgttttttggttctttttttatattttattattattatattttaagttttagggtacatgtgcacaatgtgcaggttagttacatatgtatacatgtgccatgctggtgtgctgcacccattaactcatcatttagcattaggtatatctcctaatactatccctcccccctccccccaccccacaacagtccccagagtgtgatgttccccttcctgtgtccatgtgttctcgttgttcagttcccacctatgagtgagaacacgtggtgtttggtgttttgtccttgtgatagtttactgagaatggtgatttccagtttcatccatgtccctacaaagaacatgaactcatcattttttatggctgcatagaattccatggtgtatatgtgccacattttcttaatccagtctatcattgttggacatttgggttggttccaagtctttgctattgtgaataatgccgcaataagcatacgtgtgcatgtgtctttatagcagcatgatttatagtcctttgggtatatacccattaatgggatggctgggtcaaatggtatttctagttctagatccctgaggaatcaccacactgtcttccacaatggttgaactagtttacagtcccaccaatggtgtaaaagtgttcctatttcttcacatcctctccagcacctgttgtttcctgactttttaatgattgccattctaactggtgtgagatggtatctcattgtggttttgatttgcatttctctgatggccagtgatggtgagcattttttcatgtgttttttggctgcgtaaatgtcttcttttgagaagcatctgttcatgtcctttgcccactttttgatggggttgtttgtttttttcttgtaaatttgtttgagttcattgtagattctggatattagccctttgtcagatgagtaggttgcaaaaattttctcccattttgtaggttgcctgttcactctgatggtagtttcttttgctgtgcggaagctctttagtttaattagatcccatttgtcaattttggcttttgttgccattgcttttggtgttttagacatgaagtccttgcccatgcctatgtcctgaatggtaatgcctaggttttcttttagggtttttatggtgttaggtctatcatttaagtctttaatccatcttgaattaatttttgtataaggtgtaaggaagggatccagtttcagctttctacatatggctagcctgttttcccagcaacatttattaaatagggaatcctttccccattacttgtttttctcaggtttgtcaaagatcagatagttgtagatatgcagcgttatttctgagggctctgttctgttccattgatctatatctctgttttggtagcagtaccatgctgttttggttactgtagccttgtagtatagtttgaagtcacgtagtgtgatgcctccagctttgttcttttggcttaggattgacttggtgatgcgggctcttttttggttccatatgaactttaaagtacttttttccactttggtgaagaaagtcattggtagcttgatggggatggcattgaatctataaattaccttgggcagtatggccattttcatgatattgattcctcctacccatgagcatggaatgttcttccatttgtttgtatcctcttttatttccttgagcagtggtttgtggttctccttgaagaggtccttcgcgtcccttgtaagttggattcctaggtattttattctctttgaagcaattgtgaatgggagttcactcatgatttggctctctgtttgtctgttattggtgtataagaatgcttgtgatttttgtacattgattttgtatcctgagactttgctgaagttgctaatcagctttaggagattttgggctgagacaatggggttttctagatatacaatcatgtcacctgcaaacaaggacaatttgacttcctcttttcctaattgaataccctttatttctttctcctgaaggagatccctggccagaacttccaacactatgttgaataggagtggtgagagagggcatccctgtcttgtgctgattttcaaaggaatgcttccagtttttgcccattcagtatgatattggctgtgggtttgtcatagatagttcttgttattttgagatatgtcccatcaatatctaatttattgagagtttttagcatgaagcgttgttgaattttgtcaaaggccttttctgcatctattgagataatcatgtggtttttgtctttggttctgtctatatgctggattacatttattgatttgcgtatattgaactagccttgcatccccgggatgaagaccacttgatcatggtggataagctttttgatgtgctgttggattcggtttgccagtattttattgaggatttttgtatcaatattaatcaaggatattggtctaaaattatcttttttggttgtgtctctgcctggctttggtatcaggatgatgctggcctcataaaatgagttagggaggattccctctttttctattgattggaatagtttcagaaggaatggtaccagttgctccttgtacctctggtagaattcggctgtgaatccatctggtcctggactctttttggttggtaagctattgattattgccacaatttcagagcctgttattggtctattcagagattcaacttcttcctggtttagtcttgggagagtgtatgtgtcaaggaatttatccatttcttctagattttctagtttatttgcgcagaggtgtttgtagtattctctgatggtagtttgtatttctgtgggattggtggtgatatcccctttatcattttttattgtgtctatttgattcatctctctttttttctttattactcttgctagcagtctatcgattttgttgatcctttcaaaaaaccagctcctggattcattaattttttgacaggctttttgtgcctctatttccttcagttctcctctgattttagttatttcttgccttctgctagctttgaatgtgtttgctcttgcttttctagttcttttaattgtgatgttagggtgtcaattttggatctttcctgctttctcttgtgggcatttagtgctataaatttccctctacacactgctttgaatgtgtcccatagattctggtatgttgtgtctttgttctcgttggtttcaaagaacatctttatttctgccttcatttctttatgtacccagtagtcattcaggagcagtttgttcagtttccatgtagttgagcagttttgagtgagtttcttaatcctgagttctagtttgattgcactgtggtctgagagacagtttgttataatttctgttcttttacatttgctgaggagagctttacttccaactatgtggtcaattttggaattggtgtggtgtggtgctgaaaaaaatgtatattctgtcgatttggggtggagagttctgtaaatgtctattaggtccgcttggtgcagagctgagttcaattcctgggtatccttgttgactttccatctcgttgatctgtctaatgttgacagtggtgtgttaaagtctcccattattattgtgtgggagtctaagtctctttgtaggtcactccagacttgctttatgaatctgggtgctcctgtattgggtgcatatatatctaggatagttagctcttcttgttgaattgatccctttaccattatgtaatggccttctttgtctcttttgatctttgttggtttaaagtttgtttcatcagagactaggattgcaacccctgcctttttttgttttccatttgcttggtagatcttcctccatccttttattttgagcctatgtgtgtctctgcacatgagatgggtttcctgaatacagcacactgatgggtcttgactctttatccaatttgccagtctgtgtcttttaattggagcatttagtccatttacatttaaagttaatattgttaaatgtgaatttgatcctgtcattatgatgttagctggttattttgcttgttagttgatgcagtttcttcctagtctcgatggtctttacattttggcatgattttgcagtggctggtaccagttgttcctttccatgtttagtgcttccttcaggagctcttttagggcaggcctggtggtgacaaaatctctcagcatttgcttatctgtaaaggattttatttctccttcacttatgaagcttagtttggctggatatgaaattctgggttgaaaattcttctctttaagaatgttgaatattggcccccactctcttctggcttgtagagtttctgctgagagatctgctattagtctgatgggcttccctttgtgggtaacccgacctttctctctggctgcccttaacattttttccttcatttcaactttggtgaatctgacaattatgtgtcttggagttgctcttctctaggagtatctttgtggcgttctctgtatttcctgaatctgaatgttggcctgccttgctagattggggaagttctcctggataatatcctgcagagtgttttccaacttggttccattctccccgtcactttcaggtacaccaatcagatgtagatttggtcttttcacatagtcccatatttcttggaggttttgttcatttctttttggtcttttttctctaaacttcccttctcgcttcatttcattcatttcatcttccatcactgataccctttcttccagatgatcacatcggctcctgaggcttctgtattcttcacgtagttctcgagccttggctttcagctccaccagctcctttaagcacttctctgtattggttattctacttatacatttgtctaaatttttttcaaatttttaacttctttgcctttggtttgaatttcctcctgtagcttggagtagtttgattgtctgaagccttcttttctcaactcgtcaaagtcattctccgtccagctttgttccgttgctggtgaggaactttgttcctttggaggaggagaggtgctctgcttttagagtttccagtttttctgctctgttttttccccatctttgtggttttatctacttttggtctttgatgatggtgatgtacagatgggtttttggtgtggatgtcctttctgtttgttagttttccttctaacagacaggaccctcagctgcaggtctgttggagtttgctagaggtccactctagaccctgtttgcctgggtatctgcagcagtggctgcagaacagcggattttcatgaaccgcgaatgctgctgtatgatggttcctctggaagttttgtctcagaggagtacccggccgtgtgaggtgtcagtctgcccctactgggtggtgcctcccagttaggctgctcgggggttggggtcagcgaccaacttgaggaggcagtctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcctggctgctttgtttacctaagcaagcctgggcaatggcaggcccccctcccccagcctcgctgccgccttgcagtttgatctcagactgctatgctagcaatcagagagactccgtgggcataggaccctctgagccaggtgagcgatataatctcctggtgtgccgttttttaagcccgtgggaaaagcgcagtattagggtgggagtgacccgattttccaggtgccgtgtgtcacccctttctttgactaggaaagggaactccctgaccccttgtgcctcccaagtgaggcaatgccttcccctgctttggctcacgcacggtgcgctgcacccattgtcctgcacccactgtctggcactccctagtgagatgaacccagaacctcagatggaaatgcagaaatcacccgtcttctgcgtcgctcacgctgggagctgtagaccagagctgttccgatttggccatcttggctgccctctatgatatctattttttagttagtgctctgttgctttaaattaaggctcatcttcagttacagctgacttttactttttaagtaaaggggactctgaaaattgtttgtgtgtattgtttgcaatttacaaaacattccattatagaaaccgcataataattatggaataattgagacgaaagataatgggaatcttcctacaccattataggagcaactgtcctcaacaatagcctaagcccctgaaagaaaagtccctttttctcctgccataagcaccaactctatcattaatccacctaataaatattgttgtgtgtcaagcactttgtaggtattgaaaataaagctgtttacaatagaaactgaacattgtagtttagaggctggaggagattaataggaaagtaggcaagaatagatcagaaaactcatgattatgacaaatgctatattataaatatgcatcatctttaacatgatttctttttctttcagatagtaaaattggtccatttacatttgtttttgaattactaattagaaaagaacatatacattactaatatcttaaaacatatgcgttactaaaataattactaccttgtacatatacccattagtaatgtatagaacacatacattactaatatataaagaacaaatacattgctaatatattagaacttatttttgctatcttgcttgctttcttttttctgcttacatttccacatgcctctcaaacaccacgtctatatgggtttaagcacccacttaagatgacaaccattttaaattcttggagacaaaggatttacaaaattactttcttgcctatggtagcagggtgtaccgtatctttgcctgggaaatggcatttgacttaatgaggtttaagaccccttaatagtaccaaaaatactcaggttgttgcaaagtagccagaaagtcttccaaaatttcattagggactggagagtctcctagatctgcactcctcaaggactgccagagctctgttgacagtctcaaggattctttgctttcattctgcccttccctgtgttcaacatttccttcagaaattcgtggtttcctttaagaacacggatgtctaggaaacttccagttttgctgttttcaattcattaacaaatgtttcattgtttcgccatattgccatgtttttacttgttccctcctataaaagaactattcaactaatatttacttttttcttgactttttctattttaggaacatgctcaaaatcagatatagaaattgaaaatggattcatttccgaatcttcctctatttatattttaaataaagaaatacaatataaatgtaaaccaggatatgcaacagcagatggaaattcttcaggatcaattacatgtttgcaaaatggatggtcagcacaaccaatttgcattagtaagtgatttacatattcccattcagtttctgtcaacttcgttcctctctttgagatgatagtgttttacttaaaaatatagaaaacaattttaggagtaaagagatacaaatacttctaaaaccattcaacattctgtgccaaattaagtcttttgcatgtttagagtaatggctacttgggaagatgatcatttcatctcttacaactcaatctgcctttacataaaagcaatcttatcatgtacagactagttagggagctgcatgagagtatcagcaaaatatgttagttgccaataaaaactttgttgtcttccctttctttgtatttcaaaattatcagctgcttgtattgcattccgtgctcacgctcagaaaagttgtacatgtcgggggagaaatgagtgcttaattctgaatttctgctagcgtcaggagaatcagaccttaataatttgtatcaatgatgctactgaggatatccaatcaaaaaattatctctaccctattgtttactacagagaaaacaagtaaaggaaaagggtaagtgggtgggctgaatgtttacaaacctcatacttgccaatggattctttacatgtaaagttctctgaacgtgctcgacctttacttagtatgataaagagaatgcataatgaacaaaggaaatctttcagtggcaaaagttgattttttttctttcctctttatatattcacaaagagttttaaagataaattgctgaatgtatttttaacccaaatactgttgtataatttacatactcccaaatccacttcattttcaagggtacaattcaactatttttagtcatgagataatatggaaccttgatacataatacaacatggaagactctcaaaaatattaagctaagagagaaaaaagatacacttacaaagtgattatctcaatgttatcatgagttttgggggttatatgaattcctacatttctagaatactgttttcaatttctatacttatcaagggctctgtgtaaagaaaaaggtgtatacttcaattttactcagctttgataaatgatctactttaaaacttgtgaaataaaagacaggatgcttcataaattttatagaacttatatccaattaatataatttttatctaatatatacacccttactgttagtaaatcgttacataactacataaatggttacattaacttttaaattcacaaatttaaaagcggtttaagctccgtgacacattggactacgaatgctacgatggatatgaaatcagttatggaaacaccacaggttccatagtgtgtggtgaagatgggtagtcccatttcccaacatgttatagtaagtattttattcaagtattttttattagaattaaataaaataataaatagacacctacatatgtatatgtacacatatgtgtgtacatatatgtacatatatatgtagtcctcctatgagtgtgaattatcttgagacttaaaaagaaaaaacaacgttgaaaatgcagatgtcttcctaagaaatcaaataagatacagttaagagtatataaaaagctttatttagaaagtttccaataagactattgatttttccccacatataaagtattttttttcagattcttcagaaaagtgtgggcctcctccacctattagcaatggtgataccacctcctttctactaaaagtgtatgtgccacagtcaagagtcgagtaccaatgccagccctactatgaacttcagggttctaattatgtaacatgtagtaatggagagtggtcggaaccaccaagatgcatacgtaagttcttaaaattctagatcctgagaaaatcagagtaataagtttgatatttgcttttttatactagaatttttatgggttattaccctagaactgtgttcacaaacagctattctgctgaatgtttgcctttcagatcttaatatataagtgtataagcttggaaaattccatgtaaacaatgaccaagtttcttttttaaaacaggaatgtcggcctggggtggtggctcacgcctgtagtcccagcactttggaaggccgaggcaggcagaccatgaggtcaggagttcgagatcagcctgaccaacatggtgaaccccgtatctacaaaaaatacaaaaattagccaggcatgctggcatatgcctgtaatcccagctactcaggagggtgaggcaggagaatcatttgaacccgggaggcagaggttgcagtgagtggagattgcaccattgccctccagcctgggcgacagagggagaccccatctccaaaaataaaaaaataataaataaataaataaataaataaataaataaataaataaataaaacagaagaagaagaaaagaaaaagagaaaaagaaaaaaccaagaatgttcagagtcttcaatttgttaatggatacaatgagtcttcaagaatgacaaccatttattgcgcacatatgaaatatggcatctcagcttaacaccagtaatcattttcacattattaacacttaggtaaagagttttcaaacagttctgaaaacattgtttcaaaaaaccacaaactattaaaccctacttgaacacatgaaatttttcctgatagaacacatagctggttaacactgagaagttctttctctgattattattcttacttatattttatcagtattcctagcaagcaacaaagaaattaacgaaacttcagccatttccataacccattgcttttccatttttaccttattctcctcttcccttataccagaatcaaaatgaatacactaaaaacccctcaagccagtaatataggtatacttccagaattttgtcccccaagtactatgaacttgaagcaacacaactcaaaaaatataagccacaatgattatggcaacaacaagaaaacctaaaagaaaatttgccacaagtttctactagcctatgaggtagagccctgggacacccatcagtccttgaatgtcagataacctattcctatcacagctcttaaactgtaagttcatgagtttttcaagtgctcaagttcctaagtacaggatgatacaagcagttgttttctgtgatgtgactcatttcctttattttgatgctatgctaccttttacctttcatattgactgatgacgctgatattttggctgatcttacaatgggctaaaccttaattattgtcccctacttaagtatccacttctgtagatgatcatgtccaagtttgagctccaaactatgcaagtggtaagactgaagaagaaattagtatcctcaaatcaaaatagtttacaagtatcttcaaacttgatttcatagaaaagtgttaggtttcagagataaattctgagtcttaaatttgattgactgaggagatggacactcctaagatgggtttcacagcaaaagcattacctcttctcacaatcaagaacaggaaaggattataattatctgaagatataagatcagttctatgatacaagcaagactttcagtcttcaaaactaaagaagcaaagagcattcaagcacagaattctagggaaaaaggcaaccttatggaaaagattacatatacatatggcatattaaagcaatgaggaaaattttcccaggcagcaggaaactttagaaagttttggaaaatatgtttggagaagtatttagagttcaaacaatatttatttttgaattgtaaacagcccctgaatgtattgaagagctcttaaaattttttggatttcaaaagtgatatgtactatgttaagaaatttatttaagtaagtacttgaaagatgtattaaaatatgattggggaaatttctaaagaaatgctaatgctaataagggctaaactagaatgcagaatacttgagtcaaaagaagagataggtgagtgaatgatatcatcaaaagtgaaaagcttgctatgtaagaactgacatttttatcatgtaagtactaggcttaatacctggggtatgggttgataggtacagcaaaccaccatggcacacatttacctatggaacaaacctgcacatcctgcacatgtaccctggaacttaaaaaaaaaattataaatttttttacaaaagaattttataaaagaaaatccatatgtggaagtaacattatcttactgattttacagatgaaggcatagtgagacagagtaatttgtccataatcatgtagggattcatattaactctgtgtgcttatccttgcctctctttaaaatagaaaatgaagatgacagggatagatgatgttgatagagagagagataactgatagatattgaggtatatttatgtatgtatgtatgtatgtatatatagtttcattttaacagatgactattagaaagattatacctttctacagttctgtttctacattgtgggcataagagaaaaatataaacatagaattaaattagcaaaatgtgagtacatttggagtgcttgtagtcacggcttgtcgaatgggggaaaggaggataagtaaccatgactccaatggaacatgttagcataatcctttttgatatgaagtcactagggtggacacaacatattttaggaaagaagagttcaggctctagagaaagactgccagggttcacgtttatcacctcacctgatgatctctgctgtgatgttggggaagtgcaactgaacttattatatttttgaaatgctaacgtcagtatgtagcacaagttaataactattaactatttggattattttataattttattttatcctaaactactcattaggatgcattttatttgctcatgaaagagaaaattatgattgttaattgtttttttctgctttcagatccatgtataataactgaagaaaacatgaataaaaataacataaagttaaaaggaagaagtgacagaaaatattatgcaaaaacaggggataccattgaatttatgtgtaaattgggatataatgcaaatacatcaattctatcatttcaagcagtgtgtcgggaagggatagtggaataccccagatgcgaataaggcagcattgttaccctaaatgtatgtccaacttccacttttccacttctcactcttatggtctcaaagcttgcaaagatagcttctgatattgttgtaatttctactttatttcaaagaaaattaatataatagtttcaatttgcaacttaatatattctcaaaaatatattaaaacaaactaaattattgcttatgcttgtactaaaataataaaaactactcttatattggacttcttatcaatgaattagtaagtatagagacagacagctgaatggctttctgcatattgtatagtatacctagacatagaaacaaaatgactttagattttatttggggaagtaataataccataaaattagatattaaaattgtaagtgaagataaacacactatagtattcccttattgtagccatggtcctctagatgcagttaaccaaatagggtcatttttattaaaagtagtgtttcctggcaaacactgacattacatcattatcatgatttaaaggaaatagtactagagaaggtgaattattatcattttcctgtgaaaaaagaaaagaggttttgctaaccctttcagagcattgggaacacagccagaagtgcattaaatgtatatattaacttgggcaatgttgacactttaggatgctgaagccaggtgcagtggcacacgcctgtaatcctagcactttgagaggccaagctggcaatcatcagaggtcaaaagttcaagaccagcctgttcaacacggtgaaaccctgtctctactaaaaatagaaaaactagctcggcatgatggcgtgcacctgtagtcccagctactcaggaggctgaggtgggagaatcactttaaccagtggggcagaggttgaactgagccaagatagtgccactgcactccagcctgggcaatagagtgagactctgtcttaaaaataaataaataggatgctgaaaattcctatttaaggaaataattctttttctgatttatttaaggctacatttgtattttcttaatacaaatattttgaaagtttcttcatatatggttttttgcatttcttattaagttttgcttcagatttttttttgtcttttctcctgttaattgccttcactctctttctgttctgtacttttctttgtatataaggattttttgaaaagattgtatatccctgttaacaaattgaaatctctattcactttaatagatttttacccccagttagcatatggttagtgagaagttgcagggtaagaagaaaacaatgttccctttcccaacacttttcctgattatagagaaaaaagcatgaacttgtataatgatctagtcctgtacagaatgagaaatattaattgctagactgagaatgttttggtggctaaagctaggaataactttttaagactgaagaatgatataagctatcaaatctaactcagttttcaaataacaggtttgcagagactggagaataaaaagtaaaaaattgttttattaattccagtgactaattctacttcatcaacatacatcataaataaaatttcaaaaataattgctgatatggtttggctgtgtcccacccaattttcaccttgaattatataatcaccatgcatcaaaggtagggccaggtggagataatggaatcatgggagcagtttccccataccccactcatggtagtaaatacatctcatgagatctaatggttttataaatgaaagttcccctggacaagttctcttgcctgccaccatgtaagatgtacctttgctactcattcaccttctgtcatgatggtgaggccttcccagcaatgtggaactgtgagtccattaaacctctttcctttataaattacctagtctcaagtatgtttttattagcagtgtgagaatcaactaatacagtaaattggtattacacagtagagtggggtgctgctgtaaagataaccaaaaatgtagagtgactttggaactgggtaacagacagaggttggaacagtttggaggactcagaagaaggcaggaagatgtggggaagtttggaacttcttagagagacttgttaaatggctttgaccaaaatgctgatagtgatttggaaaatgcaatctaggctgaggtggtctcagctagagatgagaaacttgttgggaacaggagcaaggtgattgtcgctatgttatagctcagagactggtggcattttgccacttccctagagatgtggaactttgaacttgagagatgatttaaggcatctggcggaaaaaatttctgagcagcaaagcattcaagagatgacttgggtgctgttaaaagcattcaattttatatattcacaaatatatggtttggaattggaaattatgttaaaagggaagcagagcataaaagttcagaaaatttgcagcctgatgatttgatagaaaagaaaaacccattttctggggagcaatttaagctggctgcagaaatttgcacaagtaatgagaaaccaaatgttaatcaccaagacaatggggaaaatgtctccagggcatgtcagaggtctccagggcatgtcagaggtcttcaggacaacccctcccatcacaggcccagaggcctaggagaaaaaaatggttttgtgagcagggcccaggaccatgctgctttttgcagtttcaggagttggtgccctgcatcccagcaggggctaaaaggggccaacatagagctcagaccattgctttggatggtgcaagccccaagccttggtagcttccatgtgatgttgagattttggttcacagaagtcaagaattaaggtttgggaacctctgcttagatttcaaaggatgtatggaaatgcctggatgtccagcaaatgtttgctgcaggggtggggccctcatggagaacctctgctatggcagtgcagaaggaaaatgtggggtgggagcccccacacagagtccccactggggcactgcttagtggagctgtgagaagaggcccactgtactccagaccccagaatggtagttccaccgacagttagcatcgtgcacctggaaaagatgcagacaatgccatcccatggaagcagtcaggagggaagctgtaccctgcaaagccacaggggtggagttgcctaagaccatgggaacccatctgctgcatcagcgtgacctggatgtgagacatggagtcaaatgagatcatttttgagctttaagatttgactgccctgctggattttgtacttgcatgagacctgtagcccctttgttttggccaatttctcccatttggaacaggtttacttacacattgtctgcaccattgtctgtaccattgtatctaggaaataactaatttgcttttgattttacaaagggacttgccttgtctcagatgagacttgagactgtggacttttgagttaatgctgaaatgagttaagactttgagaggcttttgggaaggcataattggttctgaaatgcaaggacatgatatttgggaggggccagggtggaatgatatagtttgactctgtgtctctgctcaaatcttaccccatgttaagggcagggccatgtggagataattgaatcatggggactatttccccatattgttctcatggtagtgagtaagtctcacaaggtctgatggttttataaatgggagttcccctgcacaagccctcttgcttgtcaccatgtaagatgtgactttgctcctcatttaccttccaccatgattgtgaggcctccccagccatgtggaactgtgagtcaattaaacctcttgttttaataaattacctagtctcaggtatgtctttattagcagcatgagaacagactaatatgattgccttagtttcctaaaatggtacaaaaataaatggcaggaaaccacaactgtaggagcaacaaacaatatcatcaggaagaggaaaataaaatgtgatataaaagcatcagtggggttattaaagagtagagtatgcacctagcaaagtgaattggtgtgacagataagaaatttggtgtagtgggttttaaaagggaaaccatagaggaatgattacagagattattaatctggagaataaaccataaaaatctaagtctagggaagaaaccagtacaattgcaataagtacaatcatcaaaatgttcttacattcctttctaaacaattattcctagtgtatagcttaatgtggttccaggcaaagtgagagataaaatctcacagaaacattatctagccaattgttttttaattataagactaatgaacaaatcttacaaatctttaggcaggaaaataaaaatgactgaaaatgaaatcttagggaaaatagaatggttgttatattaaaatgtaaatatacttggtgtgatatttatcaagcaaaatagctgtttatgggccagacatagtggatcaacctgtaatcccagcactttgggatgctgaggtgaaagggttgcttgaggtcaggagtttgtgatcagcctgggagtcacagcaagatcctgtgtataaaaacaaagaaaactaattagctgggcttggtggtgcatgcctgtagtcccagctactacaggaggatgaggtgggacaattgtgccactgcactccaacccagcgacagagccagtccctgtctcaaaacgaaaataaaacaaacccccccatttattagttcattaatttgtgcctagaaaccaattgttttaacacatccattaagaatcattatatgccaagccttttatctagataggaagcacattttgaatttgaaaatactattgcttgatatgaagttaattataacttctttgaagatacaatgcaaacacaaaattcagaatacaaaagtatgtagacagtatgttgttaacaataagggaagaaaatatagcggggagattggcaggaaaaacaagacattttgattttatcactttgaggtttcttctactttacagttattttatttatttatttatttttaattttgtgggtacacagtaggtatatatatttatggggtgtatgaggtattttgatacaggcatgcaatgtgagataagcacatcatggagaatagggtatccatcccctcaagcatttatcctttgagttacaaacaacccaattacactaagttatatttaaggtatactattaaattattgttgactatagtagccttattgtgctatcaattagtaggtcttattcattcttctaattatttatttgtacctattgaaaataggtacccacctcctctctgacacccccaaccactgcctcccaccactagccccttgctacagtagcccattcatctactgtctatgtccatgagttcaattgttcttatttgtagatcccacaaataagtgagaatatgtgaagtttgtctttctgtgcctggcttatttcacttaacataatgatctccagttccatccatgttgctataagtaactagatcttattcttttttatggcagaatactactccattgtatatacataccatgtatatacatggattttcttgatccattcatctgttgatggacacttaggctgcttacaaaccttagctattgtaaacagtgcagcaacaaacatagggatgcagatgtctcttccatatactgatttcctttcttttgggtatatgccctgcagtgggattgctggatcatatggtagctcaatgtttagttttctgaggaacctccaaactgttctccatagtggttatgctaacttgcattcccaccaacagtgtacaagtgttcccttttctccatatcctcccaagcatttattactgatttttggatataagccatattaattggagttagatgatatcacactgtagtttcgatttgcatttctctgataatcaatgatattgagtaccttttcatatgcttgtttgccatttatatgtctttgtttgagaaatgtctattcaaatcttttgcacgtttttaattggattattagaatctttcctatagcgttgtttgagctccttatatattgcggttattcatgccctgtcagatgggtacttcacgaatattttctcccgttctgtgggttgtcacttctctttgttgtttcttttactgtgcagaagaagatttttaactttatgtaatcccattggttcatttgtgtttaggtttcctgtgcttatgggatattgcccccaaaatttttgaacagacctatatcctggagattctctgcaatgttttcttgtagtagtttcatagtttgaggtcttagatttaagtctgtaatctacgttgatttttttttatatggtgagacatagggtctagttacattcttctgcatatgaacatcctgttttcccagcaccatttattgaaagacagtcttttccccagtgtacattcttggcactcttgtcagaaatgagttcactgtaggtgtgtggatttacttctgtgctctctattctgttccattggtctatgtgcctgtttttatgccactattatgctgttttgattactatagttgtgtagtataatttgaagtcaggtaatatgattcctctagttttgttcttattgcttaggatagctttggctattctgggtcttttgtggttccatataaattttagaattgttttttcctacgtctgtgaagaatgttattggtattttcacagtgattgcactgaatctgtagattgctttaggtagtatggacattttaacaatgttgattcttccaatccataaacataaaatatctttccatctttttgtatccttttcaatttctttcatcaggcttttatagttttcattatagagctctttaacttctttatttaattcctaggtatttaactttatttgtggctactgtaaatgggactactttcttgatttctttttcacattgttcactgttgacgtatagaaatgctactgatttctgtatgtttatttcatacccagcaaatttaccaaatttatcagttctaatagttttctggttgagtctttaggtttttccaaatataagatcatatcatctgcaaacaaggataacttggtttctttcttcccaacttggatgccctttgtattcttctcttgcctgattgctgtagctaggacttcgtgtattatgttgaataactatgtaacagtgggcatccttgtcatgttccagtcctttgaggaaaggatttcagtttttctccattcagtatgatactaactgtgtatctgttgaatacagcttttgttactttgaggtgtgttccttctatccccagtatttgagggttttcatcatgaaggatattgaattttatcgaatgctttttcagcatcaactgaaatgatcgtatggtttttatccttcattctgttaatatgatgtatcacattgattgacttgtgtatattgcaccatccttgcatcccacaggtaaaccccatttggtcatgatgaatgatctttctaatgtattgctgaattcagtttgctagtattttgttgaggatttttgtatcgatatttattagagattttaacctgtaattttctttctcttttttgggtgtgtctttgtctaattttggcatcagggtaatactggccccatatattccgccagcatctgccatacctcagtaccatatcagaaagaaggagcctagagtattattctgtttctctgggatgttctctcacatacatgcattccctcatcattggtcacactttttgccattttctgtttactatcaatcttaaccaagcttagcatctgtggatggaagtccataggtgagctataatacccacccatagagtgcagcaatagccccttgcatcaatagcctttccagaacttccctctatgaacattcccaataagaaaaagtacagttacaaatataaaatatggcaggagtatctctaccactagtcagggggcagcatctaggcagtcttagtttagtgagagaaataatcattcctcagcccgttgtccctttagtaatgtacacttaaattcagaggacttgaagtaatgttttcagctgcaatgacttcttgtggtaaaatctacagctgtaattctaaattggtaaaaatggatctggcaaaacagaaacagtttacggggttggaaatatgtacgagctgaccattcatgacatttgccataatccatgtgtctgtacatctgtaagcattgcctttgggataaccactcaattctttcaaacttccagatatattgctttcaatgttatttaccacgaatcttgccttgtaatctagattttattatctacaaggtgattgcttcactcaaattgggacgtgctgtcagaaaaacagacagattgctttgcacaaggagaagaagaatcacagagtttagaccatttcaaaaaaggagccagaagttcttttgtggattatatcattggtcaaaaatgctggctgcaaactgcttatgaatgtaacatacaccaagagcaaccaccagtggagagttgctgcatgtgtcatttccatattattagtttttctaaactgttccatgctaattggaatgtttgtctgatattacctatgaaataataggcattttgagttttagatttattaaccacaatggtgagggctatcttcatcaaagctcagtaatgaacaaggaattgtcttttaatccccctttaaaaattcacaaataataaccatacatatttatggggtgcatagtaatgtgtgtgtgtgtttgtgtgtgtgtgtgtgtgtgtgtgagtgtatatatatatatatacacacacatatatatacacacacatatatacacacacacatatatatacatatatatatacacatatatatataatgtatagtaatcagagtaattagcatctccattatctcaaacatttatcatttctttctgttgggaacactgaatattctccttccagctatttggtactatctagtatattcttggtaactgaaaaaaaattacatctaagtgttaacctcaggtatcttgaaatgccaactcctaacagtcatagcctgggagttcatgttagccttcttgcaactatgcatatccacataattaatcaaaatcatttgtgttttggtgagaattagcatctgcaatggtgagttttatgtgtcagcttagctaggctatcaatccaagttatttaatcaaatattaatctaagtgttgctgtgaacaaggtattttatagatggagttaataacatctacaataagttgcctttaagtaaagattacccttgataatatgggcgggtcacattcaatcaattgaagcagtaagagtcaaaacttcggcttcccaaagaagaaattctaccttaagactgtaacatcaactcttctctgagtttctactctattaacctgccctgtgaattttggacttgcttatactcacaaatcaagtaaaccaattgcataaaacaaatctctatctcatctatctatacacacctcacactatacattctgtttctctggaaaacactaatacatcatcttaccacttcacatttttaagcaattaaaatctctcactatcttcccaagatttggtattacttaatattcactagagaggctggtttgaccgattataaaattcccatttaacaagaataactaagaccaggtgaagagagcccttttccaaaatctgactataagtcggtaattgaattcactaccaaattacaaaccatttatttcaaggactctgtggaaagattaatctggcaggcaccgatacttctctgttttgcaaaacagaccacatatttaatgttatttctctagtattgatggtcatttggtctttaaatcctggcgcttggaaggtaggatctgttgatgaagggtcagagtgaaggagtgccatgatttaacctgtatctccccaagtctccatcaaaacctttgtcacacatgaagccaattatatttggttcagatatttatctcaatattgctggggttgaatgttcatttgctttactttccaccatgagatgttttaatatcaccaaacttgctagcagcaaccaagaaaatgtatttctagtaatttctccatcattttgtatcacattctaaatacatatatatatatatatatatatatatatatatatatatatatatatataaaacaaactcttgagtcaaagtcatatactccaaactacactcctacaattcattccagataatcttcctctgaggattttcccttcagacaaagagtggattggtaacaccctggcaataaacatttgtcatacccttcatcctatcctccttaaatttcatggtgcctttgccatatcatgaagaaggaaagaagctcagtgtccacttctgataccactctgccactcctacactgctaagctaacagcagtgatcttgctttcagaactagcaattcacatttttacctatcattatgttaactgctgaaaattatttaacacagcattaatgtcaacagcatagtgagaattgtgactcttatgtgtagtgtctgattatcctaatcttcaccttgaattcatatgtttaagggagatgactcaatgagtgtctgtgacctctgaagttcttccatctcctttcctttattagttgatgagctccctcagctgcatcttatgaaatccagttatttattatacttattttagatgaacaacctaaaaaatgtgatttgagcacttaactcagattcttatttatcttcaatctggtgtacacctaaagattctcttgcaagaattttaacaagggtcaaattatcagtcttctatgaaattacagaaaatatcacagacttgtttttaaaacttttcttaaagaaacaggcagaaaactgtcaaaaacatgggtgagcgctaccgaggtagagaaataaaacattactctttcattagatacaattaaactttgaaaacacatttaaatatgatttctaaaataggtaagacttggttacatttgatgacaccaataaagatgaactaggtaagtaatcataatggagtacattcttaaatgcaattatttttatgacacatacgtacctcagagtggagataaattaaaatattagtatgtaatgtatcatagttactatgttttgcagattaaagatgtccacaaataatttgaaaatcctctgattaagtgacctatttccccatcatcttgaacttgtgctaacccatgacttttctgaccaataggatatggtataagtatctctatgccagttacggatgtaagctttaaaaaaatagcagcttctgccttggtgtcttgtagcttctaatcagcatgagagaattctgggtaccctgtagagaggccctgagagtgacaggagtcacctaaaccccaaatttcacttgttgctggcaaagcaccaaatatgtgactgaagacatattgaaccctccaccgcagaagattaaccagatgaataacaatgaatgtctccattaatacacagaaaataaaagatttatccatttgatccccaccaaaattctatgccccatagaattgtgagatgtcattaaatggtatattagaaaagaagaaatatctcaaaacactaacctaagttccaacttaagaaggtaggaaatcatgaatattagtgtataaatcaatgaagcaagtgcaatatagaaaaaactgttttcttaatcttctcaaagaatgaataaaaccaatcaaagttagttctttgagaagaataaatgatatatttctagcaagaacaatgaagaaaaaaagaagaaacaaattacctgtcatttggcatagtatagggcattgactgacatggttccaatagttgaagggtatacaattattttaacttctgaaatgtccaaagtgtcagggttttgtctgaaaaacacaccaaaaaaaagagaatacccaaaagagttccattattaaatggaaattttatatgaaggaaaattctacaagaaggtacagcaatggccttggtcatattcatgagcaaatacctcctctttttctgggactcactctagagactgctgaagctctgtcttaggctactgaaggaaaagtttaaagggattctccattagaacacctgctgccagaggctagatgattatcctgtctttctgatggcagttcataaatgaatggttactactctacctggaaagttgtggcagatcctcatgggtaaatataagactaaaggaattcaatagggtaaactttaatgtgttttctcgctattatggaagacattgaggacataaaaggccagatcacatgggttgataccaattcatgaccagtgattaattaatgcaaaaatagttgattcaagtacttgttgcccgagatactacctttatgggaattaaaaagacaaatcaaactgggacaagctgatgcccaccaaaataaaaactctaccaggattggaaagcgactggagtcaacaaataggtatttcggttcattacctagaagtaactacttatatacatgaaaggaatggtcacagaaggacctaaaccaacagaagcaccagaaaaggtataaattgtttaccataatggtccagtttcttagcaagataggtaagatttaaaaattcattaggacatatccactggggtgatggcccagcatacagctagtaaatagattatatttgatgttcgttcttaacaccaggaagatttaagcaagctttgaaggccactaaaacgtatttgagacttggtttttttcatggaagttaaatctaacgtatgaaaattaaataatctgaattgtttttgcccaccaagttatattcttctgatcaaggaagctattttacagcacgtgatatacaacaatgggcaaataaacaccacatcgaatatatatatcatatcctttatcttctgcagagtagtggaaatatttgaaatcattaattgaaatacctgccaaaaataaagactggggcagataggtcagtaataaaggatgaaagagctggtttacttgttttcaagttgtgcattaaaattaaacatgagataatcatgtggttttgtttttagttctggtttctgtgatgaataacatttattgattcatgtttgttgagccaaccttgcaccacaggaataaagcctacttgattgtggtgtattagcgttttgatatgctgccagattcagtttgatcagattttgttgactatttttgcatctatgttcatcaaggatattgaccagaagttttccttttcagctgtgtctctgccaggttttggcattaggtgatgctggcctcatagaatgatttaggaaggagtccctcctcctcaattttttggaatagtttcagtaggaatgataccagctcttcctttcatatctggtagaatttgcctgtgaatccgtctggtcctgggcttttgctggttggtaggcttttaattactgattcaattttggaactcatttttgcttggcttggagattgaatctaaatgtccatcaacggtagattggatttttaagatgtggtacacatttaccatggaatactgtgcagccgtaaaatatagtgagataatgtcctttgcacgaacagagatggagctggaggccgttatctaagcaaactaacacaggaacagaaaaccaaataccgtatgttgtcacttataagtgaaagctaaacactgagtacatatggataccaagaagagaacaacagatacttgagggtggaggatgggaggagagtgaagatttaacaagccaccttttgagtactatgcttattacctaagtgacaaaataatttgcacaccaaacccctctgacatgccatttacctatgtagcaaacctgcacatgtgctcctgaatctaaaataaaagtaaaacataaaattaaaataaaaagttaaacatgggagaaaccaaagatgatttactattagataaatttcctagatagagtggtagaagtaagaacgatttggggatgaaaccggcacttatctacaagtcttttcaaacacagcacaattttcttcttttctgccttaccccataatttctgagtccagtttaaaatgaacagttcttgacacatcactcatatttaaacaggagttactgtctatagtttttaatttaaatgaattcagaagggattggtgggccagatgaaggactggcaaatgacagtcatggggaactgtggcctgctgcctatttttgtagggctctgactacaatggtttttacattttgacatctttttaaaattaaagtaagaaaaatcatttgataattaaaatattcataaaatttatatgaaatttacatatttgtgtccataaagttttattggaacacaaccatgttcactagtttacgtattccccatgttacactatcagggccaacagagtagttgcaacagagatcacagaagctagaatgtcccgtcctctcacctggcctaaccgggccttcaggtggaaatgctttgttaccaagtagaggtaacaggccagtaagtttgtacatttctaatcctatcccatgtgaatgaaaataaaccaagaaagaagccttagcaagattgttatttccagtgaataggttaactccatggtcaaacctgatatttctttttggagaggaaagtttgggttaaaataagtgatagataaaaagaaggtgacataattgcctaaataagagatctaacaaatatactatttaaagggaaaaatcaaacataactttgcttctagagagtcttacagcaaaaaaataattttctctcttaccttttagtctgatgtctgttacagtgaaataccttgtctcacaaagaccctactgagaggcgacagtgtgctggcagccctcgcagccttcactcgcttttggtgcctcctcggcctcggcacccactctggccgctattgaggagcccttcagcccactgcactgtgggagcccctttctgggctggctgaggccagagctggctccctcagcttgcggggaggtgtggagtgagaggcccggagggagagacatgggcaggaacccgggctgcccacagagcttgtgggccaggaggacttccaggtgggtgtgggatctgcaggcccacacttggaatggccggccagcacagccagcccgggcagtgaggggcttagcacccaggccagcagctgcagagggtgatccgggtcccccagcagtgccagcaggccagcgcagagctcgaactctcaccaggcctcagctgcctccctgtggggcagggcttgggacctgcagccagccatgcctgagccaccccgctgccatgggctcctgtgcagccagagcctccctgacgagcactgcccgctgctccgcagcgcccgttcccattaaccgcccaagggctgaggagtgcgggtgcagggtgcaggactggcaggcagctctgcctgcagccagctgtgggatccactaggtgaagccagctgggctcctgagtctagtggggacttggcgaacctttatgtctggctaagggattgtagatacaccaatcagcactgtgtgtccagctcaaggtttgtaaatgcaccaagcagcactctgtgtctggctccaggtttgtgaatgcaccaatcagcactctgtatgtggctaatctggtggggacttggagaacctttatgtctagctaagggattgtaaataaaccaatcagcactctgtgtctagctcaaggtaaacgcaccaatcagcaccctgtcaaaacagaccaatcagctctctgtaaaacagaccaatcagctttctgtaaaatggaccaatcagcaggatgtgcgtggggccagataagggataaacgcaggctgccccagccagcagtggcaaccctcgggggtccagttctacactgttctttccctctttgcaataaatcttgctgctgctcactctttggttccacactgcatttatgagctgtaacactcactgcagaggtctgcagcttcactcttgaggccagccagtgagaccacgaacccactaagaggaacgaacaactccagatgggaggaacgaacaactccagatgggaggaacgaacaacaccagacatcccaccttaagagctgtgacactcactgaaggtctgcagcttcactcctgaagccagtgagaccacgaacccaccagaaggaagaagctccaaacgtgtgaacatcagaaggaacaaactccagatgcatcacctttaagaactgtaacactcaccgcgagggtccgcggcttcattcttgaagtcagtgagaccaagaacccactaattccagacacactaccattactaaaacaaaatgccatggatctgggaagcagcaggcttgagcaacatcattactggagtgatgtatagcatatgcttcagtgaaacaaaggaaattcaggtttctcacacacacacatgctgatgtggtttgtatctgtagaaaaaatgcatcctgtatgacccagtggtggtaggacaaagaagtctgcgtgtgagttctatggatggatccctcaacgaacaaccctctcctactgctgctgtgccctttgcctgtgatacagcctttttgtgagcataagttgtttgagtcctgtgaattccttcagcaatccaacaccaacattcttaccacctggtaagactaaacaacttaatatatataaaagcaaataaaatacttctacatgaaaactatcccaataaatgtctatgtctttcattaaatactgcttcagtcattaaataatgtatatttgtaggagtacatctgcatctctgagtttcatctgcaaaatggagatgacatttttgaaatcagaatttaattcacaaatgtatgtaaataggttttagtatactgggcatttaacaatacttataaccatatagtaagtattcaataaatcgaagctactgttatcatttatattattcaaaggaaaacagagttggtcagtagaaacctactttttctttttgcatcagcctatgtaacaagaaattttttctcctgcaacttgatcacacaggtcagcagcagtgagttaaaggcagcttatagatataacagatacaaaatcccacatataaaaactataacaatataataagcacattaatagaaaaagatgaaagacactacaagaatttagacaaaaaataaacaccctcttggaggccaggaaatagatctgaaaggagatgatatttcatgtgaggttcaaacttgcatataattttggtaggtagatgcggagaaaatcaatacttaggagaaacagaatgtgaaagaccaacaacaagataaagaaaaaacataattgggaagtttcaaaaagttagcatgactaaaactcagggtattcactgtgatgagtgatgtgaggtatggaatcagaaaagattttaagattttatagacctgacaagaagactgaactttactcagagagtgatcagggagccatggatggattttaagcaagtgagatgcatagacagacggaccacggtttcatgagcgtggagactgaattacagtcaggaagtcaggagttaacaatatagaatgttcagataggagcagcactatttgagacatcagtttctaccgtgtgtgatttgtaatatccagtacaatatctatgcaaaatgaatttgacatttattgagacataagaaatactttttttaagtatcaggtttcttacttcataaaggtgaaatactaaaatatttgagaatacaaaaatgggcatttgtagccccaataaacatcaaattcaagaagaaaattaattggaaattccatgcaaatcatgtacaataaaaaattataatattaaaaactgattcaatttactgagaaaatcagtgatgttccagtagaaaggtacaggcataaataattcatacagttaaagcaaaatagtaaacaagtaaatggaaagtgttcaaaaaatgtaaatacttttgtaaaaaacagtagaatgttttattataaaattagtaagattaaatatttaagcctatacagttatggtagaaacagtttacatatacatagtttgagtcagcataaacagatatgtataggtttataaacaacatgctagggtttaaccagaacctaaaaaaatgcaccaatattttgtcttttccttcccactactcaaaatttacgtaaataactttttaaaatattatttacaaacaatttttctgcaacttcactataaccagaaaaactgagagcactcttattacccaaaaagaaatattaaattatatgacaggagttgtaaatacttaagcttacattaaaataaaatcatattaatggttttaaatataacatgaaatgtaaaatctctatactgttcttaaatgattttaaaactatccacaaatatgcaagaaaatagaaaatccttgagagtggttgacagacaaacaagaaagatactgaagtgtaaagcttgactgttttgggaacaaaaagttatcctgattgagttgaaaaaaggctgaagaaggaaatgaaggtgttttccattagcaaccattcataaattactttcagggcaccaaacatgatataaaacatctgagagcatttttagtaaacttgcacaattctgctatgagacatatttttctaaaatggtttggtcttgagcatcagtaggaagaatatgtcctgtaagtaaaggatgggatgtataggaaggactttatggagtacagctggagaatgctggagctcttagcaacggaggaagctatggattaggtaaactcttgcatgatcagcttacatgatccctggaggaaaatagcatgagtaggacatcacaacctgttctcatttctttgctcagttagtaggtaaaagtcaagtcattatccattaaaacttatcaactgatggaacacaatgggcaccgaaaacagagaacacaaaacaaataaaaaagatgaaaataaaatgtgttgaagtttgtaaaattatacaggattttagaaataaattaatgtttgtactttatatgtgcataaataaatcaattaaaagtttttcagttttttttgagacagggtctcactctgtgctgatgtcaattccctggtctcagttattgtacttgataatacatgggagggcataatctactgaaattacttaaaataagaaacagaaaaacaaaaggaaaatctaagtttccaaattagaagaatggaagaaatattcagcaaaaaaattggaaaataattgttgagtactgcttcaaaaaagaatagacaagagaagatactgttaattcaactaaaaattggcactagctctgtgaaaattaactctgtgctcataaataaatgataacatcccctagattcagacaagccagtatttaaatgtcagagagtttagaagaagccatcaaaacattgacatggtgaagcctttcagacagaagagaaaccaggagaatgtgttgttccatagaccatgtgaagcaggtatttcaaaatggaaggatgggaaactcatgtgaatttttgctgattattcagtttcaaccaatggatttgattacaaagaagatattgatgactgttacaagagaggtttaagtgtagtggtgggaatgaaaaaatgaaatgaggcagaaattgtagctaatacattggagtcattgtattataaaatgagaagagaattgggagcttactagaaagagatttggttccacaaaggattttttgagctttttttgttgttgttgctctttaagatggaagatgtttggtattttcgcatattggcagaaataatttgaaaaatggagaaattaatgataacagttgagagggaataattgaaagagcaaaatccttgcatagaaaagaggggatcaaatctggtagagaccataacaggataggagtaaggatcaacatccagtgaaacaggagacaatgcaaaaaaggatgtgtgtgaacagcaggtagttttcttctgattgcttctatatctagatgaaaaaaataaataaagtcattagcaaagtacaaggtgaggactgatggttaaggagggagataataaaacagaggaggagaaaggaagtgtcaaaatcatttaggcctatgatcattaatttaaagcaaggcaagtcagcaccgttgcatttggttttttttttcaactcttcataatgtaaacctttatttatttatttatctttattattatgctttaagttctagggtacatgtgcacaatgtgcaagtttgctacataggtataaatgtgccatgttggtttgctgcacccatcaactcgtcatttacattaggtatttatcctaatgctatcactccccctgccccccaccccatgataggccctggtgtgtgatgtcccccgccctgtgtctaagtgttctcattgttcaattcccacctatgaatgagaacatgcggtgtttggttttctgtccttgtgatagtttgctgggaatgatggtttccagtttcatccatgtcccttcaaaggacatgaactcatcctttttatggctgcatagtattccatggtgtatatgtgccacagtttcttaatccagtctaccactgatggacatttgggctagttccaagcctttgcaattgagaatagtgccatgataaacatacgtgtgcatgtgtctttatagtagcatgatttataatcctttgggtatatatacccagtaatgggatggctgggtcaaatggtatttctagttctagatccttgaggaattgccacactgtcttccacaatggttgaactaatttacactcctagcaacagtgtaaaagtgttcctatttgtccacatcctctccagcatttggtgtttcctgacttattaatggtcgccattctaaatggtgtgagatggtatctcattgccattttgatttgcatttctctgatgaccagtgatgatgagcattttttcatgtgtctgttggctgaataaatatcttcttttgagaagagtctgttcttatcctttgcccactttttgatgggtttgtttttttcttctaaatttgttaagttctttgtagattctggctatcagccgtttatcagatgggtagattgcaaaaattttctcccattctgtaggttgcccgttcaccctgatggtagtttcttttgctgtgcacaagttcttcagtgtaattagatcccatttgtctattttggcttttgttgccattgcttttggtgttttagtgatgaagtccttgcccgtgcctatgtcctgaatggtatggcttaggttttctttttgggtttttatggttttgggtctaacatttaagtctttaatccatcttgaattaatttttgtataaggtgtaaggaagggatccagtttcagctttctatatatggctagccagttttcccaacaccatttaagaaataggaaatcctttctccatttcttgtttttctcaggtttgtcaaagatcagatggttgtagatgtgtggtgttatttctgaggcctctgttctggtccattggtctatatctctgttttggtaccggtaccatgctgtaccatgctgttttggttactgtagcatagtttgaagtcaggtagcttgaagcctccagctttgttctttttgcttaggattgctttggtaatgagggctcttttttggttccatatgaactttaaagtagtttagtccaattctgtgaagaaagacattagtagcttgatgggaatggcattgaatctataaatcaccttgggcagtatggccattttcacaatattgattcttcctatccatgagcatgaaatgttcttccatttgtttgtgtccttttttatttcgttgagcagtggatcatagttctccatgaagaggtccgtccttcacatcccttgtaagttggattcctaggtattttattctccttgtagcaattgtgagtgagagttcactcatgatttgactttctgcttgtctgttattggtgtgtaggaaagcttgtgatttttgcacattgactttgtatcctgagactttgctgaagttgcttaccagcctaaggagattttgggctgagacgatggggttttctaaatacacaatcatgtcatctgcaaacagagacaatttgacttcctcttttcctaattgaataccctttatttctttctcttgacggaaatccccggccagaacttccaaaactatgttgaataggagtggtgagagaggacatccctgtcgtgtgtcagttttcaaagggaatgcttccagtttttgcccatttagaatgatattcgctgagggtttgtcataaatagctcttattattttgagatgcattccatcaatacctagttccccgagagtttttagcatgaagggctgttgaattttgttgaaggccttttctgcatctatcgagataatcatgtggtttttgtctttggttctgtttatgtggtggagtatgtgtattgatttgcatatgtttaaccagccttgcatcctagagatgaggccgacttgatcgtggtggataagctttttgatgtgctgctggattccgtttgccagtattttattgaggattttcgcatcaatgttcatcagggatattggtctaaaattctatttttttgttgtgtctctgccaggttttggtgtcaggatgatgttggcctcataaaatgagttagggaggagtcccgctttttgtattgattggaatagtttcagaaggaatggtaccagctcctctttgtacctttggtagaattcagctgtaaatccatctgctcctggactttttttggttggtaggacattaattattgcctcaatttcagaacctgttattggtctattcagacattcaaattcttcctggtttagtcttgggaggatgtatgtgttcaggaatttatccatttcttctagattgtctagtttatttgcatagaggtgtttatagtattctctgatggtagtttgtatttctgtgggatcggtggtgatatcccctttatcattttttattgcatctatttgattcctttctcttttcttctttattagtattgctaggggtatattaattttgttgattctttcaaattttcagcttttctgctctggtttctccccatctttgtggtttttacctacctttggtctttgatgttggtgaccttcagatggggttttggtgtggatgtcctttttgttgatgttgatgctattcctttctgtttgttagttttccttctaacaatcaggtccctcagctgcaggtctgttggattttgctggaggtccactccagaccctgtttcctgggtatcaccagcagaggctgtagaatagcaaatattgcagaacagcaaatattgctgcctgatccttcctctggaagctttgtcccagaggggcacttgcctgtatgaggtgtaagtcgtcgcctactgggaggttgtctcccagttaggctacataggggtcagggacccacttgaggaggcagtctgtctgttctcagagctcaaatgccatgctgggagaaccacctcactcttcagagctgtcagacagggacgtttaaagtttgctgccttttgtttagctatgccctgcccccagaggtggggtctacagaggcagcaggcctagctgtgctgcagtgggctccacccagttcaagctttcaggccactttgtttacctactcaagcctcagcaatagcggatgcccctccccccaccaggctgttgcctcacaggttgatctcagactgctgcactagcagtcagcaaggctccgtgggtgtgggacccaccgaaccaggagcaggagagtgtctcctggtctgccgtttactaagaccctcggaaaagtgcagtatttgggcaggaatgtcccatttttcccaggtgcagtctgccatggcttcccttggctaggaaagggaaatcccctgaccccttgcacttccagggtgaggcaatgccccgcccagtttcggctccccctccatgtgctgtacccactgtccaaccagtcccaatgagatgaaccaggtacctcaattggaaatacagaaatctcccatcctctgcgctggtcacgctgggagctgcagaccagagctgttcctattcagccatcttggagcggtgaccgcatttgtttttcttgtagacacactctgctgcttcagttcagagacagggcaggcagagaatttatttgcaaaggtttgaggttttctaaaacttggattacagatagaaagaaaggaatgggcaggagagtgtgtgcaagggattgacttacagtgatgaaccattgaatctaatttgggtatggtgggaagagagaaagtgaagggaaaagaatagtgaaaaagcatcagtgtcattgaatggttggaacaaatttagtagagtaagtgagctaaaaagattgttgaaatggtctagagtgtgacactttagataatttaggtagtttaattggaaatgataaggtttagatagactagaatcaatagtggagactagtagctcacagagacttctctggtttcttgattgaacatagctatatgcattcccattgacttctgaaccaccatcagtaagtttcatcttagtggaagtccttaggctgtccctttctccaaattttgccattaaatttttgactgactggccactttgttgcttgccccagctaatatcctctacacatactaatcttctctacttgcttcccactgtaacctctttatattcaataggatccttgggcagggaattttccacgctataaagtcactcccctccagtggagcagcagagtttccagtccacacagactgcttgcctacccagggttcaacttctgagccacagaactgagctgtgagacaaaggtggataaaagcatccactcttttttactgagatttatgtggactttctggaataaatatttcccaacagtatgctctttggccaatttctagagattatttttataattttatccagttttattgctgccttttggtggtgagtgaatataccaagacccagaaatacccattctcaaagtcccatcagaacaaaattattttgaagtaaaatttgttcaacaattttgggaaccattacataccaaaaattattcttgatttgactttttatagtctaaaaatatgaaaactattaagaagttacctcattcttttttttttttttttttttttgagacggagtctcgctctgtcaccctggctggaggggagtggtgcgatctcagctcactgcgaactccgcctcccgagttcacgccattctcctgcctcagcctcccaagtagctgggactacaggcacctaccaccacgcccagctaatttttgtattttcagtagagatggggtttcaccatgttagccaggatggtctgaagttacctcattcttaataccagttttaagtggaatttataactagaacagtgatgctgttatgttaagatgaggactgatcaccttcacttgcttgcctactgatgtagctgaactcttggctagaaaaaagaaggggcttcctctttcctcttcaatggcccatttctgaatattccaaactcagagactcagggaccacaacaaggaaattgaacagcttttattttgctcaagttaatattacatgataaactcagagtattattgtgaaaacactgattagacactatttgcttattttgcacaaccctccatgaactttgatgtttaccacaaaggactttactaaactagcttccagttagtacactgaaattcaaagtcatgctcataactgttaatgaaagcagattcaaagcaacaccaccaccactgaagtatttttagttatataagattggaactaccaagcatgtggctcctggtcagtgtaattctaatctcacggatatcctctgttgggggagaaggtaagttcaaaacagacctgaatatttagttcctttttcagatacatttatcggtttttgtgtgtatgcttacatatttttaaatgaataaatggatgaaaatattttaaatgagttataatattaatctattttatggaaatactttctaacatgcaattagcaggaaaatagaataaaattagttctctccatcctctaagttgcaaaggtaaatggccaccaaatagagaatgtaaagaggaattaaatgagggaaaacctgctatactaacggtggcaaggtgaagtattagtgtaattctgcatacactctgcaatgccactaactagaacaatcaatctcaaaaagatttggccaccttcaaaatgctttttggattttagtttcctagatttgatcatttaaattttaaaggtcattaaaatggaggaattcccatttcaattgaattatccttcaacagagggaaatatattttactgaaacaatagaaaatatcatttatatataaaccagtgaactgtcaagaaattgcttcttctgagctcttaaatgttgagaatgaagtaatgtatcacctctttattaatactacaaactgcttcttatgatattttataaacggtcccattttatttcatgttgaaattaaggccaccatatcaaaggaattgcaaacaaaatctctaccaaggtctaggatactaattaaactatgtctgtacatggagtttcgatcattatgctttaccctttgatttccaaaaagtttttactttactgtttggctgtttcctaatgtttccagacctttgaacttttatttgaacagtttctcatcagtcctgacataacagaacaacatgaacaataacatgctttcctttaaatatttgcccttagaaatgttgcaaaatattatttctattgcttgaaattcatttttttttgagatggactttcactcttgtttcccaggctggagtgcaatggtgtgatttcggctcaccacaacttccatctcctgggttcaagcaattctcctgcgtcagcctcccaagtggctaggattacaggcatgcaccacgacgcctggctaattttgtatttttagtagagatggggtttctccatgttggtcaggctggtctcgaactcccgacctcaggtgatctgcccgcctcggcctcccacagtgttgggattgcaggcataagccaccacgcctggcccttgaaattcgttttattttgttttcacttttagtgctgagttgtaatcacaggagtgtgattgtatgagtgtatttgatttttcttaagtctgtgtttatggtatttattaagtggcttatacacctattacacatggcattacatgaggatttctaaataggggggtagcagaggaaaataagtgaaaaatatgagagaaatatgtagaattttgacaattcctaaccctcctcccaccaaaaaaaagttcaagcttcaatccagtctctgggagaaacttcagtgaaattctatctaaaggttgcctagatgttaaatgatctgtaagtgtgtgttacactgtcatttaggtgtctactgagagacctgccaaacagcaaaaacaacacactgaagcaacacatttgtatacatagaaagctgcatgcttccagtagcaaaatatttatcaagcactatgttgtgcttcatgtagcaaagaagctggaagaaaatgacaaccctaaccacacctcactgcaacttacagtgtcctaaagaaaagcaaaatgtaaataggcaaataaattgcaaggctatatataggtgactgtgagtgagtgtgtgtgtgtgtgtgtgtgtgtgtgtataaacagtcatgcatcacttaatgatagggacactttctgagaagtgcgtccttaggcgatttccttcttattcaaacattatagagtggacttacacaaacctaggttttatagcctactaggtaactaggccatatggtatagcctgtcgctcctaggctgcaaacctgtacagcatgttactgtactgaatactgtgggcaactgtagcacaattgtaagtatatgtttatctcaatatagaaaagtacaataaaaatacagtataaaatattaaaaacggcagacttgtatagggcttttaccatgaatagggtgtgcaggactgaaagttactctcagtaagtcattacatgagtggtgagtgaatgtgatggcttagaacatcaccatacactactagaggtggtataaacactgtatacttaggctaaactaatttattttatttatttatttacttgaatagttttgggggagcaggtggtttttggttacatggataagttcttcagtgctaattactgagcttttgatgcacccaggatagactaaatttattttaaacttttcttcgataataaattaaccttagtttatgttaacctttttacttcatcaactttaatttttgtgtctttcgagataatatttagcttaaaaaacattgtagagatgtacaaaagattttttctttctgttcttgtgctataagcttttatcttttaaatattttacttatttatttactttttaaacctttttgttaaaaacagacacaaacacacacattaacctcggcctacaaagagtcaggatcatcagtatcactgtcttcttcccccgctcttgtcccactggaaggtcttcacggcagtaacaggcatggagctgtcctctcctatgataacaaaggtttcttctagaatagttcctgaaggacctgcctcaggaaacattaactgttttacagttaatttttttaatcaatagaagaagttaactataaaatactaataacaattatactatatgaaatacattaaccagtaacacttctatattatcatcatcaagtattacgtactgtacaaaattgtgtgtggcatatttttatgtgactggcaatgctgtaggtttgtttacccccggcattgccacaaatatgtgagtaatatattgcactgcaatgttacgatggctattaggtgataggaatttttcagctacactataatcttatgggtccactgtcatataagtgatcagtcattgaccaaaatgtcattatgtggtgaataactgtacgactgtatatatatatatatatatgtgtgtgtgtgtgtgtgtgtgtgtgtgtgtgtatcccagaagaaatgtattcacaatattctatcaaaatattgagacaataaaaattattttctacttttgaaattggtggttgtgtaaaggaggcttgcaagaagacattaacactcctagctagcaccattgcagatatgcacaatgaatacttgatgaatgtcatagaattctttctgaagcataggtacaatataaatggttgatgaaaaccaagttattctggatagcaaagaatatgtaggtacaaatgtatgaaaataaactactataattttggaggagtgaaggataattgaaagagttatggtaggttaatactatcaagacgggagtctttccctcaacacctttaccaaaactatctaatgtcaaattttaaacagttagataatcaatttcaggtttcacaaggtgaaaatatttcaaatattgtgcaacattaaacattacttctagatagatgaaaaagagaaatttctcttgatttgtcagcttaatttctgcacacatctttcaaataaggtgaaaaataaaattatttcttatgcagcagtactatattgcaaaaatatcttgacataaaaacaaagagcagtattatattgaggaaatatcttgagctaaatacgtactcaaagataaagcatatcaaacccatagaacgtacaacatcaagagtgaaccccaacataaactatgaactttgggtggtaattatattgacagtgagggagcttatgcatgtggtagggaagaggaagtggtatataggaaatctctaccttccactcaatcttgctgtgaaaaacctgtaaataaagtataaagtctaataaaaaatatgtgtgtatatatatgtatgtgtacacaaaaaaagagtaaaaagtatgaagatttcacccattttctacattgttttaatatatcttgcaccatagtgtgtatggatgtatttatacatatatacagtagtcctttagcatcctcaaggaattggttccaggacgctacccacccccagcagataccaaaatccaaggatactcaagtgtctaagagagaatggtgtagtatttgtacataacctgtgcatatcctcccatacaatttattttattttattttaattttttttgaggtggagtcttgctctgtcgcccccaggctcgagtttagtggcatgatctccgctcactgcaacctccccctcctgggttcaagtgattcttctgcctcagcctcccaggtagctgggatcacaggcgtgcaccaccacacctggctaatttttgtatttttagtagagatggggtttcaccatgttggccaggctggtctcaaattcctgacctcaagtgacccactcacctcagcctcccaaagtgctgggattacaggcatgagctaccacactcagccctctcatacaatttaaggaatctctagagtatttataatacctaatacaatgtaaatgctgtaaaaatagttgttatattgtatctttaattgcattatttttattgttttattatctttattgtttttttcaaatatttttgatctgcagttggttgaatcagacgaagtgaaacgagtggggctgactgtatatatatatatatatatatatatatatatatgtgcgtgtgtgtgtgtgttcacaagtataaatatataaatacaaatatacaaatacatatttgtatatacaacattaaccagaatttagctctaactttatcttgattgagttgttcttagtgattttcttatattccctaaattatttccactgaaactatattaactttgtaaccagaaaatattcaaaatgatattaataaacaaaaaacaaaactacatatccaacatctttactgcaccagaaaaaaaaataggacagagtttctggcagagacacctatggcagtcaatgagaatagagaaaataagtaaattgagagctaagaacaaccctatcacttttctactgtatactatgtagatcaggaagatttgctactcttacactctgtcttcattcttaaattgttgtgtgtgggttttattcttgaagacaatgcaggagagttcatatttcatatcactccaaaatataaattttatattcattaacaattacctcctcaaatagtcatgtactcctagttagtgatgcttttcattcctaatttgtacactggaaagcatttaagctaaaggcatttaagctaaatgaaagaaaaacactataagtgagatgattaaaatataatctagtgatttatttatgtaacttattatgtaattcttcagttttatgttattttcccagcaacattttgtgattttccaaaaataaaccatggaattctatatgatgaagaaaaatataagccattttcccaggttcctacaggggaagttttctattactcctgtgaatataattttgtgtctccttcaaaatcattttggactcgcataacatgcacagaagaaggatggtcaccaacaccaaagtgtctcagtgagtaaatgctctgttcattaaatggatgtcattcagtgaatagagaaggatatgccagacaagatcataaggtcttgataatcacagggacagtgaccaaagaagctggaaagatgggagatgtagtccccctattttgagatgcctcctataagaatcaatgaagaataaatatgtcaactgtcttgtgttacctggaaatgctctacgtgttgaaatatattaatttttttaaactgatctttaatatatttgactgctaatatttctttactaatattcatttcgcagcagcctgatcaaagttttccttttaaatgtcatttttatacatattctgttttgaatttaccattctttagcatattgaaaggaggtttagcattttcacttttatatttcaataaataatttctttggtccttcacagtgtagctatattaattctccaataaatgtagagagcagactccaatgataacaggtgtattaaaagaaaaaaaaattgggagacagatacatgaggcaacaaaggagatagcaatgatctttctcctaagaaacatttatgagagttaagagagaaatagatatatgaagaggttcttttgtccctaaaaggttgacaaacataaaatatttcattataaaaaccatagagcaagaaaatgaaatattttcttctatatatacatataaaagaaccaaaaatatgtttcatcatatatatagtagcatgagttaacttcttttgaaagtgtttatatttgatttcagctttgaaagctttcctttttaattttttttgttcgtttgtttgttttgttttgtttttgagccatctcaactcactgctacctctgccttctagattcaagtgattctcctgtctcagcctccagagtagctggaattataagtgcgcaccactatgcccgctaatttttgtatttttactagaaacagggtttcaccatgttggccaggcaggtctcgaactcctggcctcaagtgatccactcgcctcagcctcccaaagcgcagagattaccagagtgagccacttcacccggtttattaaaatattttaaaatgcagttgtactttttctttgctacttccatcttgtacattaatccgtttttggtccttaggactgtgtttctttccttttgtggaaaatggtcattctgaatcttcaggacaaacacatctggaaggtgatactgtgcaaattatttgcaacacaggatacagacttcaaaacaatgagaacaacatttcatgtgtagaacggggctggtccacccctcccaaatgcaggtccactggtaagtacaatgctgttctctcatatgctgttatctattataaagtttgagagaaataaatcttttttacaggttaaatataggttttgccacatacttttatctttattcatttgattttcagttccaattgtgtccaagtggatgttgaataacatagtttgcctacctatataaatcaaatgttctcaaagtgtggtcgctaaaccggtagcatcatcatctccttggagattgtttgaaatgaaaatacaattccataagctcattctagacacacggaatcaaaaatgtcgaaatagaaccctgaatctgttttaccaacccctccagggaattctatgcacacttctgtgtgagaagcattgctatagtctattatcactacacatggacctgaaactctctgatgaattttgcattgttcagcatagtatccttaatcattggcaattaaattatctgaagttatttttattattatagacttattttcttttatttttccacatctccaatttagatcctttgattaaccattcttcttctctactaacttgggtaattttcaaaatgtgtttttaaatctttgcttattcactaagaaaatgcctatttgtgtttatttttaagaggctaaaatgtataagcaggatgattgcaaacaaaaatctggtatcacataatctatttatgctgactttttgcattttataaattaatgttaaataaatagaactggtaatatttgtttactcaaactcaaagagagatatccaggaaaactttcgtttacactggcttccagaagggaaaaataaaggtctatcagtgttctagcgaaggatgaagaagaaatttaaaacatcaaagcttgtacctgacaaaaaatagtttcatgtcttttcttcaatattacatttaaatttattaaaatcaacaaaatatttgatgagattgtctacttattttaaattcgtcttgaaacatatttgtaactgtattagttgatttgctactcaaaatgaacactaggtggaaccacttcttttttttctactcagacacttcctgtgtgaatccgcccacagtacaaaatgctcatatactgtcgagacagatgagtaaatatccatctggtgagagagtacgttatgaatgtaggagcccttatgaaatgtttggggatgaagaagtgatgtgtttaaatggaaactggacagaaccacctcaatgcaaaggtagagtattatatttcttttaacattttgggggagtatagcagggttaaaatatgttgatttaaacaaaatgaagtcatttttattaatagatttttcaaatgcaaataaaatgattgatggtgcttaaaattcaattcttcctgtgaacagaacacaagtaatagggtgtattatttttgagaaagattcgaccaaattaaaagagttggaacctgaaaaacaatactttttaagcatcacaacacttagttccttctcaggaatacgtgtaataaaagatacattatgtgcatttgacagccataagtgatgtgcattctaagatatggaataggcagttgaagagagatcatagactgtgatataaatgtgggcatcttcagtatatggattatatttaaaggtgtgtgactgactgtatttataaaaagaagtccgagcacatagtcctgggtcattctaataaatagagatggagtaagggaaaccagaaaaggaaattgtatcttacttacctttatgttttaaaattaatgttgtcctgtgtttttttttttttttcactattttacttagactctacctatgtttattattgaagtgagtttttgtagacagcatatagttgggtcatgtttacatatccattcatcctttcatggcctgttaactggtgcacttggaccaattacacttaacataattattgatatataggacttaaacctctgtcatttatttgtttctgtctgttccctctgggtttcagtcctatttccctattcctccattccctgtagggaaaattattaaggagattaattttgattcatatgtattgttttccattgtatctctttgcatagcttttcttctccttttaaaaagttgttgctctagctaatactatatatatgtaataatatattactgtctactggcactgacatttaaatcaacaactggaatatggaaagcttactttcatgtagatccatttatactctccacattgtaagtataaatgccagtcgtattttctctgcatgcattgagcaccatattaaactcatttgcttcaaatatcaaacataattgaaaaaacttatgaggaaaaagatatcgtgttatattgactcctctttttatccattatatcgttctattttttcaggatcctgaagtctcaagctctttcttttatctgttttattttaatttgaagaattcctttagttatctttaggcataggtctactggagacaaattctcttggtttccctttctctgagaatgtctatatttacccctttacttgtaaaagatcgtgtcactggatatcaaatttggagttgacagttctttgaacacttgaaaactgtgccacatggttatagatgaaaaacttaccatcatttgaattgttgatcccctcaaggaaaagcatagtttttgtctagttgctttcaaggtatttttttctttttttaaagtagttttattttaatgtatattggtataaattccaatgtttttatcctctttggagttcactcagcttcttaaatataagtttatgccttattgtcaaaatgggaagttttcaggtatccttttatttattcatttttccagcccaatatcctttctcttctttttctgcatctgcattatttgttgttgtatttttctgaatgtctcagttcagttttttgttttcagtctattttcagagtgggtaatttatattgctgtatgttcaagttcatggatttatttgtctgtcagctccccatgtattattaagtatattcagtgtttttaaaaaatttttatcatacttttccattttataattcctacg

SEQ ID NO: 117 - DNA, 150169 bp, Homo sapiens
gacttacacttgtgcaacatattacaaaatggatggagccagtaatgtaacatgcattaatagcagatggacaggaaggccaacatgcagaggtactttggtgaattttcaaaatttatttatataatgtgtgggcccagcccagtggctggcgcctgtaatcccagcactttgggaggccgaggtgggcggatcacttgaggtcaggagttcgagaccagcctggccaacatggtgaaaacccgtctctactaaaaatacaaaaaaatagtggggcatggtgacatgcatctgaagtcccagctacttgggagactgaggcaggagaatcgcttgaaccagggagatgaagattgaagtgggccaagatcgtgccactgcactccacccagggtgacagagtgagattccgtctcaaaaaaataaataaacctgaaataaataaatatataagtacaatttatttatatagagtgttttgggaataaaatatagaattgtctctaacatcattaaaatggacataaattaagtttttacggcaggacaaagtagtcgtatgcctaaaaataaaaagatggaactgagtatttgatgattaatcttagctcaatagttctcaaagtgtggtcgctaaaccggtagcatcatcatcttcttggagattgtttgaaatgaaaataaaattccgtaagctcattctagacatccagaatcaaaagtctcaaagtaaaaccctgaaactgttttaccaacacctccagggaattctatttacacttccgagtgagaagcattgctatagtctattcactacacatggatatgaaactctctgatgaattttgcattgttcagcataatatccttaatcattggcaattaaattatctgaggttatttttattattataggctttttaaaaaaatttttccacatctccaatttggatcctttgattaaccattcttcctccttttaacttgggtaattttcaaaatgtgtttttaattctttgcttattcgctaagaaaatgcctatttgagtttatttttaagaggctaaaatgtataagcaggatgattgcaaacaaaaatctggtatcacataatctatttatgctgactttttgcattttataaattaatgttaaataaatagaactggtaatatttgtttactcaaactcaaagagagatatccaggaaaactttcgtttacactggcttccagaagggaaaaataaaggtctatcagtgttctagcgaaggatgaagaagaaatttaaaacatcaacgcttgtaccttacaaaaaatagtttcatgtcttttcctcaatattacatttaaatttattaaaatcaacaaaatatttgatgagattgtctacttattttaaattcgtcttgaaatatatttgtaactgttatcagttgatttgctactcaaaatgaacactaggtggaaccacttcttttttttctattcagacacctcctgtgtgaatccgcccacagtacaaaatgcttatatagtgtcgagacagatgagtaaatatccatctggtgagagagtacgttatcaatgtaggagcccttatgaaatgtttggggatgaagaagtgatgtgtttaaatggaaactggacggaaccacctcaatgcaaaggtagagtattatatttcttttaacattttgggggagtatagcagggttaaaatatgttgatttaaacaaaatgaagtcatttttattaatagatttttcaaatgcaaataaaatgactgatggtgcttaaaattcaattcttcctgtgaacagaacacaagtaatagggtatattattttccagaaagattcgaccaaattgagagttggaacctgaaaaacaatactttttaagcattacaacacttagttccttctcaggaatacgtgtaataaaagatacattatgtgcatttgacagccataagtgatgtgcattctaagatatggaataggcagttgaagagagatcatagactgtgatataaatgtgggcatcttcagtatatggattatatttaaaggtgtgtgactgactgtatttataaaaagaagtccgagcacatagtcctgggtcattctaatataaagagatgaaataagggaaaccaaaaaaggaaattgtatcttactcacctttatgttttaaaattaatgtttttctgtattttttttttcactattttacttagactctacctatgtttattattgaagtgagtttttgtagacagcatatagttgggtcatgtttacatatccattcatcctttcatggcctgttaactggtgcacttggaccatttacacttaaaataattattgatatataggacttaaatctctgtcgtttatttgtttctgcctgtttcctctgggtttcagtcctatttccctattcctccattccctgtagggaaattattaaggagattaatttcgattcatatgtattgttttccattctatctctttgtatagcttttctcctccttttaaaaagttgttgctctagctaatactatatatgtaataatatattactgtctactggcactgacatttaaatctacaactggaatatggaaaccttactttcatgtagatccatttacactctccacgttgtaagtataaatgccactagtattttctctgcatacattgagctccatattaaactcacttgcttcaaatatcgaacataattgaaaaaacttatgaggaaaaagatatcctgttatattgactcctctgtttatccattctatttttctattttttcaggatcctaaagtctcaagctctttcttttatctgttttattttaatttgaagaattcctttagttaatctttaggcataggtctactggagacaaattcccttggtatccctttctctgagaatgtctgtattgatccccttacttgtaaaagatcgtgtcactggatatcaaatttggagttgacagttctttgaacacttgaaaaccgtgccacatggttatagatgaaaaactcagcatcatttgaattgttgatcccctcgaggaaaagcatagtttttgtctagttgctttcaaggtatttttttctttttttaaagtagttttattttaatgtatattggtataaattccaatgtttttatcctctttggagttcactcagcttcttaaatataagtttataccttatggtcaaaatgggaagttttcaggcatcattttatttattcatttttccagcccaatatcctttctcttctttttctgcatcggcattatttgttgttgtatttttctgaatgtctcagttcagttttttgttttcagtttattttcagagtgggtaatttatattgctgtatgttcaagttcatggatttatttgtctgtcagctccccatgtattattaagtatattcagtgtttttaaaaaatttttgtcatacttttccattttataattcctatgggatttttcgaatatgaaataagaaacttcctttgtcatagttttctatgtttagcatgtattcattcggaaagacatttcttaatcctggtctaccataagcagcaatatttgttaatgttttatgtgttctttcagtacggagaaaagaacttaaatatattactttcagtttaaagggttaaaatttcttccaggactcatttctttcaccagaaatcacaaaactgttgatattatatacagtgctgtgtttgcgtttgccttatttgaacttgtattttgatttgctctcacaacaaatcaagtgatgaaatgatgttttttagattctacaggaaaatgtgggccccctccacctattgacaatggggacattacttcattcccgttgtcagtatatgctccagcttcatcagttgagtaccaatgccagaacttgtatcaacttgagggtaacaagcgaataacatgtagaaatggacaatggtcagaaccaccaaaatgcttacgtaagtactttaatattcacgtggctggaaaaatctctgtgatgagtctgatatttcactgtttgtaacaaaatactcacagattattgaacaaccattctgctgaatgcttgcctaccaaatatttctgtcagaaagtaaagtttagaaatttttctctttagggctgggtgcggtggctcacacctgtaatcccagcactttgggaggctgaggcgggcagatcacgaggtcaggagattgaggaccatcctggctaacacggtgaaaccccgtctctactaaaaatacaaaataataataataaccggcatggtgacgggcacctgtagtcccagctagtcgggagtctgaggcaggaaaatggcgggaacccgggaggcggaggttgcagtgagccgagttcgcgccactgcactccagcctgggtgacaaagcgagactccgtctcaataaaaacaacaaaaaaagtaatttttctctttatatttatattttattttaaagcatttagttgacaaataaaaatatattttgatgtttgacaatatgttgttttgatatatttatgctacaaagattaccacaaattaattagcacattcttcatcacctatgcttagcattgggtgtaggtgggtgtgtgagtatgtgtgtgtgtgtttgtggtgaggacacttaaaatctgctttcttaccaattttcaaataaacaatacaatattattagctctaaatatcactagatctctatgtttgattccaagttcttattcatattatagctgaaagtttgtactctttgaccaatatcttaatcaaaagcagcaatgataagttctaaaacgcagggatcctaaaatgacaactgatgtaatgaatcattgataatacacccctaattctcatacattaaacatcgaacctcattttcacatcgattaccattctaagtttattcaaatcaatatgatgtttctacatagttggtttggatagtgttttgagaaataattcctgaaccatcatataacattctacttgaaaacctgaaagtctatgaagatttgcatactacttaatgttttatgtttactgttttttattttcagatccgtgtgtaatatcccgagaaattatggaaaattataacatagcattaaggtggacagccaaacagaagctttattcgagaacaggtgaatcagttgaatttgtgtgtaaacggggatatcgtctttcatcacgttctcacacattgcgaacaacatgttgggatgggaaactggagtatccaacttgtgcaaaaagatagaatcaatcataaagtgcacacctttattcagaactttagtattaaatcagttctcaatttcattttttatgtattgttttactcctttttattcatacgtaaaattttggattaatttgtgaaaatgtaattataagctgagaccggtggctctcttcttaaaagcaccatattaaatcctggaaaactaacggttgtgtccagttcataaaatgtttgtggcaagaaattagacgcaatttttcagactttatttctgttcatcactcttaaatctcccaaagctttctccacagcttctgaggctcactgttttacagaaaatggaaagcatatcattgtctctgatttcaaaattatatcactttacaaagatgtaaaaaccaagtcaagtcttaactcatgttggtaatgagatataagtaattactatttatcaatacataaatgcaccaaaagtgatatcaatacataaatgcaccaaaactgatgaaatgtagatacttctacaagatgtcaatctagcacacgtgataatgcaaactaatcataaagaggagttaaaacgtaatagggtatataaatattacaacataaacatacaaaaaataaaaacacagtatcagttataacatgctcacttgcatgcactcacttgcaaacatagaaacatgatacttttgccctgatttaatgtttatagaaaaaacattgccaggaaattcaaaactatagataaatgtgtgtgtgtgtgtgtgtgtgtgtgtatacatgtatatgtatgtgagtgtgtgcgtgtgtgtgtgtgtgtatttagagatactaggggtaaaagttagggtttaattcttttgtatatatcggtatcctctgatttttctacctttaacatatatcactttggaaacaaaagcacaatttattttaaaataatgatgtctaacaagcaaggcggtgcatgttgagaatgataaagatttcatcagtaatgatcttaacatcaaatagcctcttaagtatttttggagtagaagagttttggaaatttcaatagtaaggttctgaaatgtaatttttatattcattctttttaatcagcactagttaggtaaaatcatttttgattaggaacattttaaactcataaaggaggtgaagccattatgtgaaaaataaagatatcaataatacaacacaaatattatttaatgataccttattacttcttactgtataaaatcaggtggcttatatactcaggctgtctccttgttagtgatcctgatttagataaattgcttgagttgaggaaagccagatttcaaaaatctaaaggacatttgttataattagcaacttatgttgatagtaatgttaacatttgggaatatacgtttattcctaaattgttttagtacatttgagccactataagaaattaccataaactggctagtttataaaaaatagaaatttatttcatacagttttagaggctgagattttccagcttaagataccaactgatttgatgtcttgtaagggcttgctccctgttttggtgccttcccactatggtgccttcctactatgtccttacaatgtggaaggggcaagggagttccatgactcttctttgtaaaaagactaatccaatgtattagggtggaatcctcatgacctaatcacctaaaaagtccttacttcctgatactatcaccatagtgatgaggacgtaacacacatattttgaaagggtactactatgcacaccatagcacagcatagggataaacaaatatgttccatgtaaatggaaaccaaaagaaagcaggggggctatactaacattaactaaaattgaattttaagtcaaatctgtaaaaagaaacaaggaaggtcattatacaaaggagtcaattcacaaatagattataactattgcaaatatgtatgcactcaacatgggagcaatgaaacttataaagcaagcattaatacatctaaaggaagaaatagacaaaaatgcagtaatagtaggggacttcaataacccacattcaacaatggatagacagtctatacagaaatcaataaaaacattggacttgaactctatattagaccaaatggacctatcagacctatatagaacattccatttgacaacagtagaataaacattcttctcaagcacacaaggtataatctccaatatagatcatatgtggggccacaaaacaagtcttaaaaaattttaaaaagattgaaattacataaatttttttaacattgtcatatgaaactagaaaacaatagcagaagaaatgttaggaaattcacaaatacatggaaattaaacaacatgatccggaacaaccaatggggcaatgaagaaattcaaagggaaatttaaaaatatcttgagaaaaacaaaaatggaaaagcaacattctaaaaaacatatggtatgcaacaaaagcagtataaagggatgtttagagatatgaatgactccatgaagatcctaataaagcaagtaactttgtatctcaggaaactagaaaatgaagaaaaaaattaacccaaagctactggaaagaaaaaaatagtaaggtacagaacagaaataaataaaacagactggaaaaataatagaggatccacaaaactagaagttggcttttgaaaatataaacaagattgacaaacctttagctgaactaaaaaagagagaaggaacaaataaaattagaaatgaaacaggaaacattgtaactgatagcacagaaatacaaaaaaccagaagagaccgctatgaacagttatatgccaacatataactgttggataacctaatggaaacaaatatattcatagacatctacaacctaccacgattactgaaacataatgaaatacaaaattaatacagaacagtaatgagtaagaaaaatgaacaagtaataaaaagtctctcatcaaaaaaacaaaacaaaacaaaaaaaactcatggcttcatgatggatggaatcctaccaaacatttaaagaatcaacactaatccttctcaaattctgtcaaaaatttaagagtgaactctcagttttattatatgaggtcaaaaatcatactgacaccaaagccacacatggacactacaaaaaacaattataggtcaatattcttcatgaatatagaggcaaaaatgctcaacaaaatacttccaaagtgaagacaacacattaaaggaatcattcgccataatgaaaagtaatgtatatctgggatgtaaagatagtatatatacaccaatcaattactgttccacaccgaattaaaagaatgaaaagcaaaaattgtatattcatctcaatagatacagaaaaagcatttaacaaaatcaacatcctttcatgataaaaagtctcaacaaattagccataaaagaaattaccccaagacaataaaggctacatatcacaggctcacatttaacattatactcaagagtgaaaagttgaaacatttttgtctatgatcagaaaaaaaaaaaaaaacaaggaggctcgctctcaccacttatgttcaacatagtgctggaaatcctggctagagctgttaggcatggaaattggaaaagaaaacagttgtctctgtttgcagatgccatgatctcattatatacatggaaaacccaaggacttcaccaaactttgctaaaagtaataaccaattcagtaaagttgcagggtacaagatctacagacagagccagttacatttctatacactaacagcaagctattgaaataagaaattgaaaacaaacatctaatttacaatagcatcaaaaataataaaatacttgagactaaatcaaagcaaggagatgagagttctgtactctgaaaactatgaaatattgatgaaagaaattgaagaaaacacaaataaatgaaaagatgtcctgtcttcaaggatcaaaagaatcaatattataaaattgtcttcaatacctaaaactccagattccatgcaatattgtcaatattctaaacacatctttcgcagaaatggaaaaaaaattctaaaattaatatagaacaagagacaccaaatagctaaagcagtcttacaagacaaaaaaggaagagacagcacactatcatgctctctggtttcaaattacactacaaatctataataatcagaacagtttagtcctgatacaaaaaagatacatagacagaattaaaagctccgaaataaaatcatgcatatataaaggcacttccaaatattcatggaaaattgaattaaaataagaaaattttaaaactacactttatttcttaacataagctccatcaagttcaacacacttttgaaaacagtgatacaagccatttagtccatccctaaagactcgatggttctggaactatatccatgttaagcagtctttttcacataattaactgaaacaatgggtaccctttgtaagattttttaaaattaggcaaaagaaagaagtcaggagaaggcaaaccaggactttaatgtaggaatgctcaaagatttcccataaaaattctcacaaaattgtttttgtctgttgagaggaatgagcaggagcattgttctggtggaggaggactctctgatgaagttttcctgggcatttttctgctaaagctttgaaaactttctcaaaacattctcttaagaagcaaatgtttctctttggccttccagaactcaactagtaaaatgccttggccatctcataaactgttgccatgatgttttctcctgactggcctgcttttgctttcattggaccacttccacctttggtatgccattgctttgattatgttttgtattcaggatcatactgataaactcatgtttcagctcttgttacaaatctttgaagaaatgtttcaggttcttattcccacttgtttaatacactttccgttaaaaactattcccttgctggccgggcgccgtggctcacgcctgtaatcccagcactttgggaggccgaagcgtgaggatcacgaggtcaggagatcgagactatcctggctaacacggtgaaaccccgtctctactaaaaataaaaaaaaatctgcgggcgaggtggtgggcgcctgtagtcccagctactggggaggctgaggcaggagaatggcctgaacccggcaggcggagcttccagtgaactgagattgccccacagcactccagcctgggcaacggagccagactcagtctcaaaaacaaaacactcttctcttgtctactacacctcatctgggtgcaatggtcttgggtctcactgaatggaaattttgctataacattgattttcccatcagaatttgtaagatgaactaattatggtgttgactattgattctgctcttagtcatcagtcatctttaatccagatgtgagcaaaattatttttttctcacaaattagtgtggctagtctgccgctgtgggcttcatccttaacattgtcttgcctctgcctaaaatgagttatctgtttctaaatggctgatttcttttggggtgttgtccccataaatttttcaataatttcactgaagctccatgacaagtgttggttaggatgtggaaaaaaggaaacacttgtacattatgggtgggaatgtagattgttacagccattgtagaaaactatatggaggttcctcaaaatattaaacatagaactatcgcatgactcagcaattccacttctgggtgtataaacaaagaaaacaaaatcagtatgtctaagaaatatctgcactctcatgttttttgcaggattgttcacaatagctatgatatggaaacaacttatgtttctgtcaaagatgattgaataaagaaaatgtggtgcatatatacagtggaatacattaaattctgcctttaaaaagaaggcaaatctgtcttttttaacaacattgataaacatggcagatattaagtaagtgaagtaaaccagacacagaaagacaaatgctgcatgatgtcatttatatttggaatctaaaaaacacctgagctcatagatatggagagtagaagtatagttaccaggggttgcacagtgggagaaatagagagatgtcagtcagaggatacaagttttaagacaaataatttctggagacctagtgtaaagcatgatgactatagttattaataatatattatatatttgaaattacaaagacaatagttcttaagtgttctgatgtcattcatacaaaaggtaacaaggtgagatattggatatttgattagcttcattatgataatcattataaaatgttatgtatatcaaaataatatgttgtataacgtgaatataaaaatttgtatttgccaatgatacttttataggggtgaaaaaattgattacattaatcagtaaaaatggaagttaatggaccaaaatattacttctaggttttgaaatataaatatgtctttttgtaaaaacagaaaggttttttgtttgttgtagttgtttgtatcaccttggagtcgtgtattttgatttattcaatctggatatctctggaaactggctcctcattgcttctcatgtgccctaattttatctgagtatttctctctttttttttcagcataacatgttctaagttcactttatatttcctctgcccaacattcaaaatcatacacctttcctagaaagtctgattatttttaaagcagaataaaatttagaactcaagaaccatgaagtattggtaatagatgggaatgtccaatactttggaaatataattattttcagggatttttggtggtaaaatctttgaaatataaataaaatataaaagtttgttgttctcactggattttacaattcaaatttaataatacatctgtgaaaacaactttagtatatacatgttttcatttttgtgagtatatggtacgtctatgtatgtatgaggtacataaaatattttgatacaggcatacaaggtgtaataatcacatcagggtaaatgaggtattcatcatctctagcatttatactttctttgtgttacaaacaatccaattatccctcttattttaaaatgtgcaataaattacttttgactatagtcaccctgttgtgctatcaaatactagatcttatttattctatctaactatatgtttatgctcattaaatatattcttctctcatttgtctttactgactcattcatgaaaatgtcaaaagtgtaatgaaacgttgctattagtagttaaactactaagtgaaaattaaaatttctttgtgtttattttgcccctagatagttgactctgagtgtgaatcttcttttcaaaaatgatttaaatacttcttatctctggttcaccctattaccgaatccatagagttgtatattaattttcacttgtgttcttcatgcttagattttgcttttttctttcttatatactaacaataaactgtctgaaaaagaaatttaaagatctattccttttctgataacaccaaaaaataaaattaggagtaaatttaaccaaggatctcaaaaatctatatattttaaacaatacaatattgatgaaacaaattgaagaagacacacataaacagaaaaatagcccatgttcagggactgcaagatttaatatggataaaatgttcatattacacaaaaagatgtaaggattcaatgcagtccccatcaaaattctaatgtcatttttcacagaaaaatgaaaaacagttcaaaaatatgtatgaaatgacaagagatcccgaaggtcaaagtaattttgattaaaaagaacaaagctggaggcattacacttctaaattttgaattatgatataatgctattataggcacgatagcatgacattggcataaaacaagacaccaataaaacagaatagaattcaatatattttcaataaagatgacaagaactcacatagggaaaataatagtctcttcaatacatcttgctgggaaaatcggatattcacacatagaagaatgtaattgatccactgtttcacactacataaaactactcagaatatatgtaagactgacatgtaaagcttgaaactataaaactgctagaggaaaataaaagagaaaaaaatacatgacattggtctgggctatgatttcttggattggttccccaagcataggcaacaaaaggaaaaatacacacattgtattacatcaaactaaaaagcttctgcacagcaaagtaaacaatgcccagagtgaagagacaactcatgagttggaaaaatatttgcaagccatatatctgataaagcgttaatattcaaaatatataaggaactcaactcaatggctaataaaaaggaattaaccaatttaaaaataggcaatgtacctgaatggacatttctcaaaagaagacgtaccaatggccaacaagtattattatcaacaatacaaaaaaacatcaagtgttatcaaacatgtggagaaaaggacacacttgcacattgttgatggaaatgtatattagtatagccattatggaaaatactatagagtttgtcaaaaatgaaaagcagaacatataatcaatccagtaatcctactactgaatatatgtacaaagaaaaaggaatcagtatgtcaaagagttatctgcattcccatcttcattacagcattatttataatagccaaaatatggaatcaacttaagtatccattacagatgaatagataaagaaaatgtggtctatatacacaatgtaatactattcagctttgaaaaaaggaaatcctgcattttcaagaacatagaataaacagggaggacattaagttaggtggaataagacagacaaaaccacatgattgcacttatacatgcaatccgttgtaaaatatggtgactttagttaacaataatatgttgtattcttgaaaactacttagtgtagattttaagcagtctcaccacacacaaaaatgagaagtatgtgaaggaaagcatatatttattagcttgatttagccactatctaatgtatacatatttcaacacaatatgttttacataataaatatatgcaattttatttgccaataaaaaataaatgaaaatgtttacaaaaagagaatatgtggtatagatacacagtagaatactatacaaactaaaaagaagacaattttgtcaatagggaaaacgtggatgaatctagtggacattatgctatctaaaataaagtcaacacaaagaaaaatcctgcatgatcttattgatatgtggaatctaagaaattcaaatttacagaaggtgagagtagagtggtggttaccagaagctgaagggatggcggtgtttctaggaggtgttggtcaaagggtataaattttcagttagactagaggaatacattttactatctatttcacagcatggtgttcacacttaataataataataataatagtgataatattatatatttcaatattgctgagtacatatattctatttaatatatttaagcctagcctttctaactactacagaaagagaagctaaatgtcttttgtaagtatgcttatcttacaaaaaataagttcatttgacattcatgtaataaatctaatctttgttttattgattttcagattaacaaagaccttatctgaatactctttacaacttttatgtaaatctaaaattattccataggagaaattttatgtaaaaaaagataaaagtatgaagcatgtttcagtttgggtatttcactttgtattcactgaatattgaaaaaattaaaatactatcaactaatacataaagtcatataaactcctaaataaccgctgaggaacctacttacttttgtgtgtcattttggatagtcaaggttttttgctatgctatactttaaaaagtaattaatgaaggggctgactctttttttgttaatagcacacttaacaatattagtggattcctggtgttcttcactaaggtccttggtcagtaatttctgattatattttatgcaaagaactttgaaaacaccttgtgctgtattttaaagtttattatcatccatatttctgaccaatcacagatgttgcaaaaggttgggacacttggaaaaataaaattattttcaaaaagattatttttttatagaatttcaaaaacaaccatctttaaaatactaacaatagttttaaaaattacaatacttttataaagtttttacgaacactacttacagatagagtaaaatttcattataactgaaaatgttttcagtaacctgttatacttggctaagtgtcattattcaactgaaattccacctctcttcaacatttacgtatatattttcctgaagatttttgtcttatgttttgcagttattttaaagttatggaggaggttttgcttattttactatatttactatatggtttgtctttagcattattgatagatctttttcttctaaatatgggccgtattttctgcttctttacatatctagtagtgttttattctactctggtcaatgccaataacacattgtgatgacagccatggaatataaaagttacctatgggtttgtcatatatgctatttatggtattggggtacttttcttctatacatatgtttttaaattttcctgtgcacatcataggtgtacagtaggtgtatgtattgatggagtacttagaatgttttgatacaggcatacaatgtgaaatgagcacatcatggggaatggggtatacatgccctcaagtatctttcctttgagttccaaccatccaataatactgtataagttattttaaaatgtacaagtaagttatcattgactatagccaaccgattgtgctgtcaaatagatggacttatttattttttctattttttttcgtacacattgaccatccccatctcccctctagccctataccacccttcacagtctctagtaaccatccttcaactttctatgtccaagagttcaattgttttgatttttagatgccacagataagtgagaacatgtgaggtttgtatttctgtgcctggctaatttcacttaaaataatgatctccagttccatccatgttgttgcaaatgattggatctcattctttattatggcaaagtagtactccattgtgtatgtgtgccacattttatttattcattcatctgttgatggacactttggtggcttccaaatcgtagctattgtatacagtgaggcaacaaacataggtgtgcagataccgcttccatacactgatttccgtacactgctgttgtatacacagcattaggatggctggatcataaggtagctcaatttttagttttctaagaaacctccaaactgttctccatagtggttgtattaatttacattcccaccaacagtgtacaagatttccctattctccacatcctcattagcatctgttattttctctcttttccatataagccattttcactggagtgagatgatatctcactgtagttctgatttgcatttctctgatgatcagttatgttgatcatcttttcacatgtctgttttccatttgaatgtatccttttaagaaatctatattcagatcttttgcccttttttgatctgattattagatgatttctgatagagttgtttgagctctttaattattctggttattaatcccttgtcagatgggtagtttgcaatattttgtcccactcagtgttatttcttcactttgttcattgtgtcctttgctgtgcagaacatttttaacttgatgtgatctcatttgtccatttctgctttgcttgcctgtgcttgtgagttattgctgaagaaatttttgcccagaacaaagtccttgagattttccccaatgttttctggtagaagtttcatagtttgaggtcttagacttaagtctttatccatttgatttgatttttggatatggtgaaacatagaggtctagtttcattcttctgcatatgaaaatccagttttcctagaaccgttaattgaagagactgtcttttccacaacgtccctttgtcaaaaatgcattcactgtagatgtgtaaatttgtttctgtgttctctattctgttccattagactgtatgtctgtttttatgccagtactatgctgttttagttactacaactctgtagtataatttgaagtcaggtaatgttattccttcagttttgtttttattgcttaggatagctttagctattttgggtacctttagcttttgtggtaccataaaaattttaggattgtttttctctattactgtgaagaatgtccctggtattttcatagtgatttcttgaatctgtagattgccttgggtagtatggacattataacaatattgatccttccagtccatgatcatgaaatatcttttttatttttggtgtcctcttcaacttctatttttagtgttttactgtttttcttatagagatctttgacttctttggttaatatctaattatttatttttatctgtggttactgtaaatgggattacctttaggatttttttcagattgtttgctgtcaacatatacaaatgctactggttttttatgttgatattatatcttgcacctttactggatttgtttatcagttctaatagttttctggtgattaccttacgtttatcgaaaaaaacttataccatctgcaaacaaagataatttggcttctttcttttcagtttggatacctttatatccctctcttgtctaactgctgtagccaggacttccagtattatgttgaataacagtggtgaagtgggtatccttgtcatgttccagtactttgaggaaattatttcagactttctccattcagtttgagagtagctgtgtgtctgtcaaatgcagctttgattatgtttgggtgtgttccttctatcttcagttttctttagtgttttatcatgaaggattttgaattttatcaaatgcctttttggaatcaattgaaataatcatgtggtttatatccttcattgtgttggtatgatgtattacattgattgagttgtatatgttgagccatctttgcatctcaaggataaatcccatttggtcatgttgaatgatctttctagtatgctgttaaatttgtttgctattcttttgttgagaatttttacaattacatttgtcagagatattgacctgtagtattctttttttaatgtgtctttgtctgattttcttttcagggtaatattagcctcacattggaagtatttgctcctcctcctcctctatttttcaaaatagttagagtagaattggtactagttcttctttaaatgttagggagaattcaacagtgaagccaatatgtcctgagcttttctttactatgagactttttattctggctttgatctcattacttgtattaataattgatctgttcaggttttggatttctttctgcttcaatcttagtaggttttatgtgtctaggaatttgtccatttcttctagattttccaatttattggaatatcattccacatagtggccaataatgattctttgaatttctccaggatcagatgtaatgtttccttttcatttctgattttatttatttgaattctcactctttttctcttagtctggataaaggttgatcagcatgtttaatattttaaaataacaacttatgtttcattgatctttgtattttattcatttcaatttcaagtttatctgctgtgatatttattatttattttcttctaataattttggatttggattgcccttccttttctagttctttaacataaatcaccaaattgtttatttgaagtttttcctttcttttttatgtagtcacttatagctataaatttttctcttggtactaaaactgctatatcccataggttttgtgtttccattatcatttgtttcacaaaatattttaatttcttcattgatccactgtgcattcaggggcatattctttaatttccagattctttaattttttgtttcaacttgccataaggattgcaaatactatcttataaccagaaaacaacttaacactgtttgcataaacaaacaagccaaagaaaactcataaatactctccaccttaattttcccttctgctttcaaactttttgttgtttctatttttatcttattgtacagactatgtcttgaaaatctgtagttattatgtttcattagttcattatttagtctttctacttaggatattagcttacacaacccagttgcagtgttttaatattctgtatttttctatgtacttactattaccagtgagatttgtgtcttcaggtgattattgttcatgaatttaattttttgattgaaatattccctttagcatttcttgtaggacaggtctggcataataaaattcctcaccttttgcttatctgagaatgtctttatttcttctttatgtttaagggatattttcaccagatattctactctaggataaacgttatttttctgtcagcatgtgtcatatcactcctgtaaggattcctctaaaaagcctgctaccagatgtattggtgctccattgtatgttatttatttctttgttcttactgattttagaatagtctctttatccttgaccttagagaatttgattattaaatgagttgaggtagtcttctttgggttaaatctgcttggcatcctataaccttctagtacctgatatagatatcattctctaggtttgggaagttctttgtgattatccatttgaataaactttctactcctatctcgttctctacttcttccttaaggtgaatactcttagatttgctttttggaggttattttttagatcctgtaggcatacttcattgtttttaattctttatttttttgtctcctctgactgtgtattttcacatagcttgtcttcaagctcaacaattctttcttctgcttgatctattctgctattaaagaatagcacgtgtaatatcttcttcagtatgtcaattgcatgtttcggctccagaatctctgcttgattttttaaaattatttcaatctctttgttcaatttatctgatagagttcagaattccttctctgtgttatcttgattttctttgagtttcttcaacaaaactattttgaattcgttgtttgaaaggtgacataactcagtttctctaggattgttccctggtgctttgtttagttcatttggtgaggtcgggttttcctggatggcgttaatgctagcagatattcttctgtgtctgggcactgaagagttaggtatttattgttttcttcactgtctgggcttaattgtaaccatccttcttggcaagatgttccacatgtttgaaaggacttgggtgttgtgacctaagctgtaacttctttacagggtgtcaaaatcccaccaatgcagtggttcttgcagacttctgggggtactctattgatggtcttgcacatgatctgagagaattcagagtgatgagggcccctggaccagggtggtttccaggggaccagtttcaaaaaccttagatgtctgcttgatgttatatggtactgtatctgggctggcagtcatattgcaagttaaaatgttgtggggtggggtggggggaggggggagggatagcatttggagatatacctaatgttaaatgacgagttactgggttcagcacaccaacatggcacatgtatacataggtaactaaccttcacgttgtgcacatgtaccctaaaccttaaagtataataataaaaaaaaatcctcctcactgttccctcccctttccaaagtcagaggagcctcaccctatggtctaacaccactccaggccatgaggagtactgccagacaactgctgatgttcccttaaggtttaggtgctcctaagtcagtttgtggtgaatgctggctagcctaggattcacccttctgggaactgggctcccatctggtccatggtatgtccaaaaatgccacccaccagtcaagtccaggaactggggaccctgggagcccaggtggttctctatcccctgtggccatgctggtacctgaagccagcaagtctcagaggctcacctaaggccctcaacatagtatctgggtatcactgcaggttattgagggccaagggctcttcagttaggctgggtgaatgctgccaggactgcatcatttccttcagggcattgggttcccttttggttcagggtatgtcaagaaatgtcatctgggagctagggcttaaagcaggggcctcattcctttgacagttgccctatcctgctttgtctgagctgatatccaagatgtaagacaaagtcttccccgttcttccctctcctctcctcaagcagaaggaaggggtttcttttggagctgtgaaatgtgaagcctggggttaggggttgggtgatgccagcatgctcttggctgcctcagctggtgcagttggtgtctctgaatattctgtgtcttcccccagtccatagtctctgagcctagttcagcactaagactcacatatgtgtgcagtccttatgtcctagactgtctttctagtttatttagagacacaatgcatggtaggtagccctaggtggcaagatttgtgggaacttgatttcagacccctgcggtcagcaataccgtcatggctagcattggtttaaatactccctccatgggaaggggttagctgagtttggtttggctttcctttctgctctaacagcacagcattttgttcaatgcctcacaattgctatgttctccctccctcagtgcctagagcaaggctctgtacatcatggcacagctgcaagtgtggggagaggggaaagggtagtgtcagtgactcaagattgtctgacctatctcttacgtgcctctttcagggatatgaagttaaaaccatgtactatgagtgctaatctgataatgttttcattttatgaaggtgtttttttttttttctgtgtacatagttgttaacttggtatctttgaaggggaatggttggtgtctcctattccaccatctggctctgctctgcctaatttgtggagactctttatcatgaagaaatgtcaaagtttctcaaatgtttttagtacttctatgaaaatgatcatatagttttgttgattctgttattgtgatatgttacatctattggtttgtgtatgtctgctcatctttattttatgcatagtttgaaaaaaaatactaccagttttttatactgtttggttgaattcagcagtgaagataacaggcgttgggcttttttgataggtgaattttattactgatttaatcaacttactcattatttgtttgttttgattttctatttattcctaatacgatctgtattaggaatttttattttaatttgtatttgtattttacaagctattttatttttagcttgtatttgtatttgtagctgtatttgtattttagcttgcttctcccttagattcccccatgagatgtacctaaagaaaacttggaccaagtgaaaggcaaggcattatctggtagcagctgctggtagcagctgagatcaccaacagtagctttccttgcttctggaagttttcctaagaaacatccactgcagtacaatggataattagtggggcatcactaagattcctgaacttcggaattttctggaaatagcatttatgacctttgttccctcagttcttccagtagttgcagaagcctttcgttccctttattgatactctctttactcaaaaaatgagagataaaataaattaatgttttatattacttttggattcagtccattactgtccctaaataatattttacaagtacatttcagggaatcaattccacagatggttgtgaaaccactaactggaattattgaagcattttgcaaaactctctgaactttgatatttactaagtgaccttaaaggcctagcttcgtggtagtttcctcaaattcggaatcacccttggtaactaataatgaaagatttcaaactccaaacagtacaactgaaacttttgcattactatactactgagaatatctaacatgttgttactaattaatgtcattctaaccttgtgggtttcctatgctaatggacaaggtaaattgaaagagatctaaacactcagctcccatcttaaatgtaacttcatgtaatatctagcttcctatgtctccatgtctacaattttttatgaaccaaagaggatttattcactatgctagtagaaatagcatattttgtaagactataacagaaattaattttatgaaatattatctcattttaacttaaacaatgaataatattttctttgttttataagttctacagtgtaaaagacatttaatattgattatggagatatgtgaatatactcatgaaactttaagtaggaaacatgtcactagacagattctaaccttaaaatgttcagaagtttcttatttgtaatgcaaggggagtgactgatattttcataatcttacagatggtgattttttatagattcatatatcaaaacatcaaataatacattttaaattctgcagtttcttttatttctataataccttaagaaagctgctaaaatgaattaacattaatatgaacttaatatttcaacaagattagcaacatgtaaatcacaacatgtaaatcacaacatgaatataatcaaaaagtagactatatgcttaacttacttttaaatgacagtaaattttgcatttctgagctcactagcaaatgttcaataaataaatacataattattttttatagctttatgttattgttcactgatttgttttctcctcaacagtcatatattttctatattaactacctttttgaatgcaggccttgcatattaaagaactatatcgtaacattagcagtggaaccacatgggtcaaatgtcatggacaatcaaaggtttgtggccattaatgaagaatacaaattttgtaattatccaaaacttcataatatttcaacaaatgtagtggagggtaatactggaaatccaattatcaatttatgagagtatcttttccctcagcctctcttctcaaagctatgccactttatttgattctaggtaaagagctttaggttttacagtattatctatcacatgatttgctagttttatttgttgtgcaaaatcaaacttgatctgtgctaaaatggaaaaaaaaggaaattctcctgttatttcctttgttaactgaactgatacaggtacatttttttcaaataaagattaaatagattaaagtagaatgaaaagaagaaaagtagtaccattctgaaatgactggaattagaaaagcatatgcactatactttcttacttactttcttaaaagcactatagaaaagaatgatgacaaattcttccttatctgatattccagttgaaaacttgtctcctccaatgaactctttgtaagagtaaacttgagcaaaatgtcttgtaaatttgggtcgcacctatatttctcaaaggagaaagtaactcattgggttactttcaaagtcttggttagagagaaacatctttgtgtattcagtagcattggctcaattgcatcccgccaaaattcatttgttaaagtccaaattcccaatacctgagaatgtgactgcatttggagaaggagtgcttaaagatgtaattaagttaaaggccaatgattcaggtgggtcctactccagtataactggtgtctatataggaagagaaaataagaacacaccatatagagaaagatcacgcaaggcatagaaagaatacaaccatttacaaggcaaaggaagaggtctcagaagaatccaatcctgttgacagctctatctcaaactattagcctccagaactgtgagaaaataaatttctatgaaatcagtggtactttgttatggtagctctagcagatgaataccatgatatttacacaatttattaaaagaacattaataactaaaaataattttttactttttactcaagaatatatatatatatatgtagccaccacacagattttagaggctattcatcagaatttggtaattacatcttgggtgtattttcctgctgatttttgtcttgttgaatactttatgtgtatatatatctgtattcatctatattcagaatctagtaaatcaaatctaagaaagatttttcatatcattaatgaaggacatactttgtgaattgcttatgctaataaaatttttttaatggtagttgatatttcagttctgaacaataaaatcggcacaccaattcttttggaaaccacgctatttgaaagacaaacttgacagaaaatttgtaattgtaacctattataatgttcattgaatttgtattggccattatttcttccatcaagtcataagttatttatacttatttaaaaataggttgtcaataacattatttttaattatgaatatcctttcagaattgtataaattttatattcatctactagagttgccataacaaagtgtcaagagtgacaattaacattgtagagcagggttgcttttaaatcccttttaaactgatcattacagtaccaaatgcattacagttaattgccattgtacttctttgggatgctgaaatttgtttcacatctcactaagaagatggcttctgtgtatatttcatgtgcccccattaagctttggcataacataagagcccatactttccttgacttttcctactacagactaagtttcaataatttctctatgaaattccagtgccttttagtgggaagaacgatttttagaaacaaacctaaaccatgaaaaactcacttcaggttcgaaattatcgttgactaagaaaaataatttttggccgagcaggatggctcacacattaatcccagcactttcgagggccaaggcgcgcagatcacttgaggccaggagttggccaacatgatgaaatgctgtctctactaaaagtttaaaaaaatagctggatgtggcggcacacacctgtaattccagcttcacaggagactgaggcaggagaatcacttgaacccgggagacagaggttgacgtgagccaatatagtgccactgcactctagctttggagacagagcaagactattaaaaataaaaataaaaatgaagaaaaaaagaaagatttaaatgatttcctttagtttatgtccctttctacctcggactaaatatcctgcaatcataagaaaatgtaagagtatctcaggaggttacacagggccgggaagtttcgattttccaatacggaggagacactcagcagaaaactgtgcatccatgcttgagggactgggtcagagaaggtgtcatgcgtcgcccaacaagcctctggatccagttctgtaactagcaaacgcttccctcaaagtaaagatgtcacttctctgaacttagtcttctcatctgcacactaaagctgttgtgccactagcgtctttctagttctctctggtttatgatgattcaaacttaacttttatttaattatattcttaagttttcataacaaatagaatgtaaatactattttctatcacttgttccataattatagagtaaacataaatgatatgctatttaaattgtgatgttgttcaacattctataggtatacatacctatagaatgtaagaatatatacatatttgtacattcgtctatgcacttattttttatgtcaataatatatcttatctgacacatgaattctaactatggtaagaatgcatgccatcgcatacaaacaaaatgccacaaaactaaacaaaatgttttatatctggagataatttgctacatatcagattttttatgttacagtcatatttcttgtctctcttttccaaaaaacaatcattgctaatgcgtgcaccctgaactggcagcttgagcttaacttggtatagttgtagataagctcagtttaaattaatgctgataaaacctccagaattgctgaagagaccatactatgttagtagaagtagagaaagtgaaatgaggttcttgtcctgttagctgacttgagatccattaaagattttaagtggagaaataaaatgaccagatgaaaggtcattaatttatacacagggaaatagattacaaagatgagaggtcaggatcaggaaactagttatgattgctgcaatctcagaagaaaatggttgagagacgatgtttatcaaaggttattgccagggtttttttgcgcctgtttgtttgttcgttttgacagaaaaaaattgagtgaaagggaacaccacaattgcagaagttcagttattattgagagaggtaatgagaatgattgacatgaatttcccccaaaaaatgttctgtcaataattactatattatgaacaaatagagcatggaatatttttatagctgactcagcgaaaatagctattacagcaaacctatgtctatactgaaattcacatatacattcaaagaatattactctataccatttatctcaagagaactaatcttcaaagcaaaagaaatcagcaacatgtttttaattaaaattttaacttccttcaaaaatgtctttttggccgggcacagtggctcacacctgtaatcccagcactttgggaggccgaggagggcggatcacgaggtcaggagatcaagaccatcctggctaacagggcgaaaccccgtctctactaaaaaatatacaaaaaaaattatctgggcgtggtggcgggcgtctgtagtcccagctactcgggaggctgaggcgggattattgcgtgaatccaggaggcagagcttgcagtgagcggagatcgagtcactgcactccagcctgggcaactgagcaagattctgtctcaaaaaaaaaaaaaagtcttttttatttatctgttaagaacagataaatcattcatgaggcattcaagtcaaaaaagaatttttatttttttgttggcagatttacttagtggaaacaacatttgtatttagctttaaaagtaaattaagtggaggaaaatgaagattttcattaataaccctaatattaatagacaatggtggtactgaggagaacatctatctctttcaggcttcatgaggaaatgatgtttttcagtgtcaacaaagtactctcaactgtgtggtttgcccaccaaatatcatgtctgtaataatataccgtacttagcctaccacgttttaaaatgattggtttccaactatcatggcatagaagagaatatatagatagttgaagagttaaagaaattatagcataagaagcatgcaaaaagatagagttatagcattataatgactgtcttgagatatttcaaaacatttatgagggggagtaagttagcttttgatgaggactgtcacagtcagtgaagcaggtaacagtattatccaacatcgaatcagaggtcaagtgattttctaaaagtgtgacctatacggatattgccctatgtcgggggtgggggtagaagagttgatctcttctgagccctccacgttttaagttgtatgattcaacattgtacatacaaaccttgttttaattatactctatttttaaaaactgcagttagcttttgagttagctgggtgtgttgacccaggcctatagtcccagctactctggaggatgaggtgaaaggattgcttgagcccaagaggtcgaggatagagccagccaggatggcacccctgcgttccaaccgggctgacagagagagacctcttctcaaaaacaaacaaacaaaggaacagaaattcacttttttgtgtattttattaagaattttaacacctctgttcaacagggacatcagcctgtagttttctttttgtgttgtttccttgtttggttttggtatcagggcaatgctggcatgctacaataagttggaaaaattccattttctttgcttttggcatagtttgagaaaaattactctgagtttttttttttttaatatttggtagaattcagcagtgacgataacaggttttgggcttttttgatgggtgaattttattactgatttaatcaacttactcattatttgtctgtttagatttctatttattcctaattcaatcttggtatgttgtatgtgtccaaaaatttgtccatttcttccaggtataccaatttattggcaaacaattgttccttatagtttttatgatcctttgtgtttctgtagaaccagatgtaatgtctcccttttcctctctgattttatttatttggatcgtctcccttatttttcttagtctaagaaaatgtttgtcaattttttttaaaatctttgctttactgattttgtcatacttacatttagtctctgcgttgtttgtttctgctctgatctttattatttctttttcgacttgtttttagtaatgttgttcttaaatttttagctccttaaggtgcaatgtttggttgtttatttgagagatttattctttttgataaggcatttattgttataaaatttcctcttagaactggttttgctgtatctcatctattatagtatgctgtgcttccattgtcatttgtctcaaaaactttccaaattttttttagttccttcattgagccattggttttaaatgtacatgttgtttaatttccaagtgtttgtaaagtttccaagttttattctgatgttaattgttgtataccattatgatcagaaaagattcttgatataattactatttttttcaacctgttacaacttgctttatgacctaacttatgatctattctggagaatattctatgtgcagttaaggagaatgtgttctgcagcagtcgaatgaagtattccgaaaatgtctgttagatctatttggtctagaatgttctttaagtccaatgtctttttgttgattttctgtgggaattatttttccattgctgaaagtggggagttgaaaactcctactatcattgtattgcaatctctctctctctttagagctattaatatttactctctctctctctctctctctctatatatatatatatataggtgctctaatgttgagtatatatatatatatatatgtttacaattcccatgggtatatgctgatttgatgcctttatcattatataatgactttcattgtttctttttctgtttttagttaaagtccattttatctcatttacatatttctgctcctgctcttcttttccaacagcatggaatatctctttctctccttttactttcagactatgagtccttagaggtatcatgtgtctcttgtagcaagcatagagttgagtgttttctttttaatccactaaccgactctatgtcttttaattgaataattcaatccattgacattcaaggtaattattgatagataaagattaactattgccatttggtaattatattctagtcatttggcagattttttttcttcctttcttcttcactcttttgtggttaaatgatttttttctatcagtgttgtttgactcttctctttttacttgtagtgcaattattatggatttgtgctgtggttattctgaggcccacaaaattcttatatttataacagcttattttaccagataacaacttgtgattcactttttaaaagaaaaaaacaactctacatttttactctaccttatcacacattttgaatttttgatgttacaactcacaactttttaaattgcatactctctaaccaattttgtagctattatttttaattgtttgctatattatagcttcatttctaagttctaggatattcagggtggtaatcttggctctcagtggttgcttttaagtttctgtaggagggagagaagctggagaactcctacactgcagttttgctgatgttattctctccatgattctcttattttaatgaacagtatcttaaaccacggcaagtatagtaatgtaaaataaagaataaacagaagaagtcaatgagagaacatgtgtggacttgagttatattcttccaacaaaacagaaaattttatatatatatatatatatatacatatatatatatatatatatatatgaatgtattgtactaaaaataaaagataccccaaaacacaactttaaaaacatttaaatatcaagaatatgctgaaacttttgtactcagtatgatctattgtgagttctgaaaatcagtatgctactctaaacacataaaaatacagagagtggaatgggatccagacacaccggtttgttttcatacaaccttatgtaattaagttgggtactggaaagcaaaggacaacagaaaattttagagacatggaccctgagagttactcattaatgattcatctgtatgtggaagaaactcacctattttccagtgtttaattttaaaattagtgttctcattttaagaagagtatgtgggataagagtattttgaccatttgtggggggggggaaaaaaaccttgccatgccaaacagcaggattttcacgagatgagtgtgccagatgtttattttcaacttgaaatcaacccagttcctatcttcattttcttctgcattgcagaagatcagcctgaaactacagtttctgaagttcctttctccatagcttgcttctcccttagattcccccatgagatgtacttaaagaagacttggaagaagagaaagacaagggattatctggtagcagctgctggtagcagctgagatcaccaacagtagctttctttgattctggacgttttgctgagaaacatccactgcagcaccatagataattagtgagggcatcactaagactcttgaacatcagaattttctggaaatagcatttttgacctttgttccctcagttcttccaatagttgcagaagcctttcgttccctttatggaaactctctttactcaaaaaatgagaaataaagtaaattaatgttttatgttacttttgcattcagtccattactgtgcctaaataaaattgtaccagtacatatcaggcaatcaaatccacagatgattgtgaaaccactaactggaattattgaagcattttgtaaaactctctgaactttgatatttactaaatgaccttaaagcccctagcttcatggtagtgcacttaaattcagaaccacacttggtaactaataatgaaagatttcaaaccccaaacagtgcaactgaaacttttgtattagcatactactgagaatatctaacatgttgttactaatcaatgtcattctgaccttgtgggtttcctgtgctaatggacaaggtaagttaaaagagatctaaacactcagcttccctcttaaatgtaacttcatgtaatatctagctttgtatgtctataattattttatgaatcaaagaggatttattcactatgctagtagaagtgacatattttgtgagagtataacagaaattaattttataaaaaattatctcattttaacttaaagaaaaaatgaataatgttttatttgttttctaagttctacagtgtaaaaggcatttaatattgattatggagatatgtgaatatactcatgaaactttaagtaggaaacatgtcattagacagattctaagcttaaaatgttcagaattttcctatacgtaatacaaggggaacattgggagtgactgatgttttcataatcttacatatggtgatttttatagatttatatatcaaaaaatcaaataatacattttaaattatgcagtttcttatatttctattatagcttaagaaagctgctaaaactaattaacattaatatcaacttactacgtcaacaaaattagcaacatacatatataatgaaaaaatagaatataaacttacattggaaagatagtaagttttgattggcatttctgagttcactagcaaatgttcaataagtaaatatacagaaaatacttttcatagcgttatgtcattgttcactgatttctcctagatagtcatatattttctgtattaattatctttttgaatgcaggccttgcatattaaagaactatatggtaacattagcagtggaaccacatgggtcaaaaatcatggacaatcaagggtgtgtgtccattaatgaagaatacaaattttgtaattatccaaaacttcatatttcagccaatgtaatggagggtaatactggaaatcccattatcaatttatgagactatcttttccctcaaccactcttcgcgaagctatgccactttatttgattctagggaaagagctttaagttttatagtattatctatcacatgatttgctagttttatttgttgcgcaaaatcaaacttgatctgtgccaaaatggaaaaaaaaaggaatttcaccagttatttccttttttaactgaactgttacaggtacatttcttcaaataaagactaaatagattaaagtagaatgcaaagaagaaaatactactattttgaaatgactggaattagagaagcatatgcactatattttcttacttactttcttaaaagcactatagaaaagaatgatgacaaattctttcttatctgatattccagtggaaaacttgcctcctccaatgaactctttgtaagagtaaacttgagcaaaatgtcttgtaaatttgggttgcacctatatttctcaaaggagaaagtaactcatttagtggaataacatcttgggtagagagaaacatctttgtgaattcagtagcattggctcaactgcatcccgccaaaattcatttgttaaagtccaaattcccaatacctgagaatgtgactgcatttggagaaggagtgcttagcgatgtaattaagttaaaggtcaatgattcaggtgggtcctactccaatataactggtgtccatataagaagagaaaataagaacacaccgtatagggaaagatcacgcaaggcatagagagaaaacaaccatttacaaggcaaaggaggaggtctcagaagcatccaatcctgttgacagctatatctcaaactagtagcctccagaactgtgagaaaataaatttctatgaaatcagtagtactttgttatggtagctctagcagatgaatactatgatatttacacaatgtattaaaagaatattaataattaaaaataactttttactttttactcaaggatatatatatatatatacccaccaacacagattttagagggtattcatcagaattgggtaattatatcttgggtgtattgtccttgctgatttttgtcttgttgaatactttgtgtttacatattatctgtattcatctatattcagaatctagtaaatcgaatcagcaaatatttttcatatgattaatgaaggatatactttgtgagttgcttatgctaagaatttttttttaatggtggttgatgtttcagttctgaacaataaaatcagcacaccaattcttttggaagccacgctatttgaaagataaacttgacagaaaatttgtaattgcaacctattataatgttcattgaatttgtattgaccaatatttcttccatcaactcataagttatttacacttatttaaaaacaggttgtcaggaaaattatttttaatcatgaatatcctttcagaattgtataaactttatattcatctactagagttgccataacaaagtgtcaagggtgacaattagtaatgtagagtagggttgcctctaaattccttttaaactgatcattttcagtacccaatgcattacagttaattgccattgtacttctttgggacgctcaaatttatttcaagtttaactaagaagctggcttctgtgtatatttcacgtgtccccattacactttggcataacaaaaggtcccaggatttccttgacttttcctactacagaccaagttccaataatttccctatgaaattccagtgccttttagtgggagaaacgattttcagaaacaaacctaaactatgaaaaactcactacagtttcgaaattatcactgactaagaaaagtaatttttggtcgagccggggggctcctgccttaatcccagcactttcgggggccaaggcgcgcggatcacttgaggtcaggagttggagaccagcccggccaacatgatggaacgctgtctctactaacaattcaaaaaattagccggagtggcggcacacacctgcaatcccagctactcaggagactgaggcaggagaataacttgaacctgggaggcagaggttgcagtgagccgagatggtgccactgtactctagccttggtgacagaacaagactgttaaaaaaaaaaaaaaaaaaaagaaaagaaagaaaaattaaaatgatttcctttaatatatgtccctttcttcttcagactaaatagcctgcaatcataagaaaatgtaagagtatctcaggaggttacacagtgcagggagatttagattttccaatatggaggagacactcagcagaaaactgtgcatccatgcttgagggactgggtcagagaagctgtcatgcgtcacccaacaagcctctggagccagttctgtaactagcaaacacttcccacaaagtaaagatgtcacttctctgaacttagtcttctcatctgcacactaaagctgttgtgccgctagcctccttcccgttctctctgatttatgatgattcaaacttaaagatttttccttagtgatattcttaagttttcccaataaataggctgtaaatattattttctatcacttgttccagaattatagaagaaacataaattatatgctatttaaattatggtattggtcaacattctatatgtctacatacatatagaatgtaagaatatatatatatttgaacattcgtgtatgcacctatttttttatgtcaataatatatctcatccgatacatgaattctaactatggtaagaatgcatgccatcgaatacaaacaaaatgccacaaaactcaagaaaatgttttatttctggagataattggtacatttctgattttttttaatgtttagagtcatatttcttgtttctcttttccaaaaaacaattattggtaatgtgtgcaccctgaactgacagctttagcataacttggtatagttctagataagctcagttcaaattaatgttgataaaacctccagaattgctaaagagaccatactacattagtagaagtagagaaagtagaatgaggttcttcttgtcctgttagctgatttgggatccattaaggattttaagtgtagaaataaaatgaccagatgaagggttattaatttatacccaggaaaacagattatacagatgagaggtcaggatcaggaaactagttatggttgctgtaattccacaagaaaatgtttgagagaaggtgatatcaaaatttatctctaatatgatttattacagtaaaaattatttatacttttttgtttgttttttattgcaagtgaaaccttgtgattttccagacattaaacatggaggtctatttcatgagaatatgcgtagaccatactttccagtagctgtaggaaaatattactcctattactgtgatgaacattttgagactccttcaggaagttactgggattacattcattgcacacaaaatgggtggtcaccagcagtaccatgtctcagtaagtaatcctctgaactgctacacatgtataaaactttaaaagattaaagagaggagagcacataattgattactcttgtcttatgtaacagaaatagggccaagaaatgagttgttcaagcaaaatgaccaaaatagatcttttctattatgaggagttcttgaaaatcatatgaaaaataaatatagagactttatgagaatatctatatagtttatacatattttaattatgaaaactaaagagaagtaatattaaatattgacatttcctcttgtacaacctttgttagtaattttggttcatactaagttgtacattatttttggatgtttatgcgatcttatttaaatatggtaacaataattttaatatactttttgtgcaaatttatgtttctcatttactttatttatttatcattgctatgtccttaggaaaatgttattttccttatttggaaaatggatataatcaaaattatggaagaaagtttgtacagggtaactctacagaagttgcctgccatcctggctacggtcttccaaaagcgcagaccacagttacatgtacggagaaaggctggtctcctactcccagatgcatccgtgtcagtaagtacaccgctctgagatcccagcatgttcatgtctttctaagtaacacggacgacagtctcagacttgtctatattaactgtggcaaaatgtttttgtcaacttgttttgccaacggacctatttagttttacttttttaattgtgtgaatatacaaatttcttgataagtacatagcaaaataaatgctcctattaatgggcattagtcaagaatacagtaaaagaattagaacacaatacttgttggctaaataaagtcatattgaagcggcattaatgtctcgggtaaatacccgaggttcgtcatcttgcaccaagaagattaagtacaaatgggtattctgggatcttgtacatattctactctagaaggtttcctacagtatttattcaaatatacatttatataaacagttccttcttttttcacatgttgctaatgattggtgatgtcacattttaatatttacaagttgagtggctataaaatggtatagcattgtaatgtaaatttgcatttcttttactaccagctggatttagaatacatgttcacagtttaattggtatttaatgattctaaaatttggaaatgcagtttgatttcttttatttatctttttgggagttttggttgttattagttggaatcatcttaataattctgaaggtaaaatctcttttaattatatgtaatgcaaatgcattctctttgtggctagtattgttctttccttttttctgcattatgaacaagttgctcattttactaaataattgtcaatcttttttcatgatgaatgttttttggttctttttttatattttattattattatattttaagttttagggtacatgtgcacaatgtgcaggttagttacatatgtatacatgtgccatgctggtgtgctgcacccattaactcatcatttagcattaggtatatctcctaatactatccctcccccctccccccaccccacaacagtccccagagtgtgatgttccccttcctgtgtccatgtgttctcgttgttcagttcccacctatgagtgagaacacgtggtgtttggtgttttgtccttgtgatagtttactgagaatggtgatttccagtttcatccatgtccctacaaagaacatgaactcatcattttttatggctgcatagaattccatggtgtatatgtgccacattttcttaatccagtctatcattgttggacatttgggttggttccaagtctttgctattgtgaataatgccgcaataagcatacgtgtgcatgtgtctttatagcagcatgatttatagtcctttgggtatatacccattaatgggatggctgggtcaaatggtatttctagttctagatccctgaggaatcaccacactgtcttccacaatggttgaactagtttacagtcccaccaatggtgtaaaagtgttcctatttcttcacatcctctccagcacctgttgtttcctgactttttaatgattgccattctaactggtgtgagatggtatctcattgtggttttgatttgcatttctctgatggccagtgatggtgagcattttttcatgtgttttttggctgcgtaaatgtcttcttttgagaagcatctgttcatgtcctttgcccactttttgatggggttgtttgtttttttcttgtaaatttgtttgagttcattgtagattctggatattagccctttgtcagatgagtaggttgcaaaaattttctcccattttgtaggttgcctgttcactctgatggtagtttcttttgctgtgcggaagctctttagtttaattagatcccatttgtcaattttggcttttgttgccattgcttttggtgttttagacatgaagtccttgcccatgcctatgtcctgaatggtaatgcctaggttttcttttagggtttttatggtgttaggtctatcatttaagtctttaatccatcttgaattaatttttgtataaggtgtaaggaagggatccagtttcagctttctacatatggctagcctgttttcccagcaacatttattaaatagggaatcctttccccattacttgtttttctcaggtttgtcaaagatcagatagttgtagatatgcagcgttatttctgagggctctgttctgttccattgatctatatctctgttttggtagcagtaccatgctgttttggttactgtagccttgtagtatagtttgaagtcacgtagtgtgatgcctccagctttgttcttttggcttaggattgacttggtgatgcgggctcttttttggttccatatgaactttaaagtacttttttccactttggtgaagaaagtcattggtagcttgatggggatggcattgaatctataaattaccttgggcagtatggccattttcatgatattgattcctcctacccatgagcatggaatgttcttccatttgtttgtatcctcttttatttccttgagcagtggtttgtggttctccttgaagaggtccttcgcgtcccttgtaagttggattcctaggtattttattctctttgaagcaattgtgaatgggagttcactcatgatttggctctctgtttgtctgttattggtgtataagaatgcttgtgatttttgtacattgattttgtatcctgagactttgctgaagttgctaatcagctttaggagattttgggctgagacaatggggttttctagatatacaatcatgtcacctgcaaacaaggacaatttgacttcctcttttcctaattgaataccctttatttctttctcctgaaggagatccctggccagaacttccaacactatgttgaataggagtggtgagagagggcatccctgtcttgtgctgattttcaaaggaatgcttccagtttttgcccattcagtatgatattggctgtgggtttgtcatagatagttcttgttattttgagatatgtcccatcaatatctaatttattgagagtttttagcatgaagcgttgttgaattttgtcaaaggccttttctgcatctattgagataatcatgtggtttttgtctttggttctgtctatatgctggattacatttattgatttgcgtatattgaactagccttgcatccccgggatgaagaccacttgatcatggtggataagctttttgatgtgctgttggattcggtttgccagtattttattgaggatttttgtatcaatattaatcaaggatattggtctaaaattatcttttttggttgtgtctctgcctggctttggtatcaggatgatgctggcctcataaaatgagttagggaggattccctctttttctattgattggaatagtttcagaaggaatggtaccagttgctccttgtacctctggtagaattcggctgtgaatccatctggtcctggactctttttggttggtaagctattgattattgccacaatttcagagcctgttattggtctattcagagattcaacttcttcctggtttagtcttgggagagtgtatgtgtcaaggaatttatccatttcttctagattttctagtttatttgcgcagaggtgtttgtagtattctctgatggtagtttgtatttctgtgggattggtggtgatatcccctttatcattttttattgtgtctatttgattcatctctctttttttctttattactcttgctagcagtctatcgattttgttgatcctttcaaaaaaccagctcctggattcattaattttttgacaggctttttgtgcctctatttccttcagttctcctctgattttagttatttcttgccttctgctagctttgaatgtgtttgctcttgcttttctagttcttttaattgtgatgttagggtgtcaattttggatctttcctgctttctcttgtgggcatttagtgctataaatttccctctacacactgctttgaatgtgtcccatagattctggtatgttgtgtctttgttctcgttggtttcaaagaacatctttatttctgccttcatttctttatgtacccagtagtcattcaggagcagtttgttcagtttccatgtagttgagcagttttgagtgagtttcttaatcctgagttctagtttgattgcactgtggtctgagagacagtttgttataatttctgttcttttacatttgctgaggagagctttacttccaactatgtggtcaattttggaattggtgtggtgtggtgctgaaaaaaatgtatattctgtcgatttggggtggagagttctgtaaatgtctattaggtccgcttggtgcagagctgagttcaattcctgggtatccttgttgactttccatctcgttgatctgtctaatgttgacagtggtgtgttaaagtctcccattattattgtgtgggagtctaagtctctttgtaggtcactccagacttgctttatgaatctgggtgctcctgtattgggtgcatatatatctaggatagttagctcttcttgttgaattgatccctttaccattatgtaatggccttctttgtctcttttgatctttgttggtttaaagtttgtttcatcagagactaggattgcaacccctgcctttttttgttttccatttgcttggtagatcttcctccatccttttattttgagcctatgtgtgtctctgcacatgagatgggtttcctgaatacagcacactgatgggtcttgactctttatccaatttgccagtctgtgtcttttaattggagcatttagtccatttacatttaaagttaatattgttaaatgtgaatttgatcctgtcattatgatgttagctggttattttgcttgttagttgatgcagtttcttcctagtctcgatggtctttacattttggcatgattttgcagtggctggtaccagttgttcctttccatgtttagtgcttccttcaggagctcttttagggcaggcctggtggtgacaaaatctctcagcatttgcttatctgtaaaggattttatttctccttcacttatgaagcttagtttggctggatatgaaattctgggttgaaaattcttctctttaagaatgttgaatattggcccccactctcttctggcttgtagagtttctgctgagagatctgctattagtctgatgggcttccctttgtgggtaacccgacctttctctctggctgcccttaacattttttccttcatttcaactttggtgaatctgacaattatgtgtcttggagttgctcttctctaggagtatctttgtggcgttctctgtatttcctgaatctgaatgttggcctgccttgctagattggggaagttctcctggataatatcctgcagagtgttttccaacttggttccattctccccgtcactttcaggtacaccaatcagatgtagatttggtcttttcacatagtcccatatttcttggaggttttgttcatttctttttggtcttttttctctaaacttcccttctcgcttcatttcattcatttcatcttccatcactgataccctttcttccagatgatcacatcggctcctgaggcttctgtattcttcacgtagttctcgagccttggctttcagctccaccagctcctttaagcacttctctgtattggttattctacttatacatttgtctaaatttttttcaaatttttaacttctttgcctttggtttgaatttcctcctgtagcttggagtagtttgattgtctgaagccttcttttctcaactcgtcaaagtcattctccgtccagctttgttccgttgctggtgaggaactttgttcctttggaggaggagaggtgctctgcttttagagtttccagtttttctgctctgttttttccccatctttgtggttttatctacttttggtctttgatgatggtgatgtacagatgggtttttggtgtggatgtcctttctgtttgttagttttccttctaacagacaggaccctcagctgcaggtctgttggagtttgctagaggtccactctagaccctgtttgcctgggtatctgcagcagtggctgcagaacagcggattttcatgaaccgcgaatgctgctgtatgatggttcctctggaagttttgtctcagaggagtacccggccgtgtgaggtgtcagtctgcccctactgggtggtgcctcccagttaggctgctcgggggttggggtcagcgaccaacttgaggaggcagtctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcctggctgctttgtttacctaagcaagcctgggcaatggcaggcccccctcccccagcctcgctgccgccttgcagtttgatctcagactgctatgctagcaatcagagagactccgtgggcataggaccctctgagccaggtgagcgatataatctcctggtgtgccgttttttaagcccgtgggaaaagcgcagtattagggtgggagtgacccgattttccaggtgccgtgtgtcacccctttctttgactaggaaagggaactccctgaccccttgtgcctcccaagtgaggcaatgccttcccctgctttggctcacgcacggtgcgctgcacccattgtcctgcacccactgtctggcactccctagtgagatgaacccagaacctcagatggaaatgcagaaatcacccgtcttctgcgtcgctcacgctgggagctgtagaccagagctgttccgatttggccatcttggctgccctctatgatatctattttttagttagtgctctgttgctttaaattaaggctcatcttcagttacagctgacttttactttttaagtaaaggggactctgaaaattgtttgtgtgtattgtttgcaatttacaaaacattccattatagaaaccgcataataattatggaataattgagacgaaagataatgggaatcttcctacaccattataggagcaactgtcctcaacaatagcctaagcccctgaaagaaaagtccctttttctcctgccataagcaccaactctatcattaatccacctaataaatattgttgtgtgtcaagcactttgtaggtattgaaaataaagctgtttacaatagaaactgaacattgtagtttagaggctggaggagattaataggaaagtaggcaagaatagatcagaaaactcatgattatgacaaatgctatattataaatatgcatcatctttaacatgatttctttttctttcagatagtaaaattggtccatttacatttgtttttgaattactaattagaaaagaacatatacattactaatatcttaaaacatatgcgttactaaaataattactaccttgtacatatacccattagtaatgtatagaacacatacattactaatatataaagaacaaatacattgctaatatattagaacttatttttgctatcttgcttgctttcttttttctgcttacatttccacatgcctctcaaacaccacgtctatatgggtttaagcacccacttaagatgacaaccattttaaattcttggagacaaaggatttacaaaattactttcttgcctatggtagcagggtgtaccgtatctttgcctgggaaatggcatttgacttaatgaggtttaagaccccttaatagtaccaaaaatactcaggttgttgcaaagtagccagaaagtcttccaaaatttcattagggactggagagtctcctagatctgcactcctcaaggactgccagagctctgttgacagtctcaaggattctttgctttcattctgcccttccctgtgttcaacatttccttcagaaattcgtggtttcctttaagaacacggatgtctaggaaacttccagttttgctgttttcaattcattaacaaatgtttcattgtttcgccatattgccatgtttttacttgttccctcctataaaagaactattcaactaatatttacttttttcttgactttttctattttaggaacatgctcaaaatcagatatagaaattgaaaatggattcatttccgaatcttcctctatttatattttaaataaagaaatacaatataaatgtaaaccaggatatgcaacagcagatggaaattcttcaggatcaattacatgtttgcaaaatggatggtcagcacaaccaatttgcattagtaagtgatttacatattcccattcagtttctgtcaacttcgttcctctctttgagatgatagtgttttacttaaaaatatagaaaacaattttaggagtaaagagatacaaatacttctaaaaccattcaacattctgtgccaaattaagtcttttgcatgtttagagtaatggctacttgggaagatgatcatttcatctcttacaactcaatctgcctttacataaaagcaatcttatcatgtacagactagttagggagctgcatgagagtatcagcaaaatatgttagttgccaataaaaactttgttgtcttccctttctttgtatttcaaaattatcagctgcttgtattgcattccgtgctcacgctcagaaaagttgtacatgtcgggggagaaatgagtgcttaattctgaatttctgctagcgtcaggagaatcagaccttaataatttgtatcaatgatgctactgaggatatccaatcaaaaaattatctctaccctattgtttactacagagaaaacaagtaaaggaaaagggtaagtgggtgggctgaatgtttacaaacctcatacttgccaatggattctttacatgtaaagttctctgaacgtgctcgacctttacttagtatgataaagagaatgcataatgaacaaaggaaatctttcagtggcaaaagttgattttttttctttcctctttatatattcacaaagagttttaaagataaattgctgaatgtatttttaacccaaatactgttgtataatttacatactcccaaatccacttcattttcaagggtacaattcaactatttttagtcatgagataatatggaaccttgatacataatacaacatggaagactctcaaaaatattaagctaagagagaaaaaagatacacttacaaagtgattatctcaatgttatcatgagttttgggggttatatgaattcctacatttctagaatactgttttcaatttctatacttatcaagggctctgtgtaaagaaaaaggtgtatacttcaattttactcagctttgataaatgatctactttaaaacttgtgaaataaaagacaggatgcttcataaattttatagaacttatatccaattaatataatttttatctaatatatacacccttactgttagtaaatcgttacataactacataaatggttacattaacttttaaattcacaaatttaaaagcggtttaagctccgtgacacattggactacgaatgctacgatggatatgaaatcagttatggaaacaccacaggttccatagtgtgtggtgaagatgggtagtcccatttcccaacatgttatagtaagtattttattcaagtattttttattagaattaaataaaataataaatagacacctacatatgtatatgtacacatatgtgtgtacatatatgtacatatatatgtagtcctcctatgagtgtgaattatcttgagacttaaaaagaaaaaacaacgttgaaaatgcagatgtcttcctaagaaatcaaataagatacagttaagagtatataaaaagctttatttagaaagtttccaataagactattgatttttccccacatataaagtattttttttcagattcttcagaaaagtgtgggcctcctccacctattagcaatggtgataccacctcctttctactaaaagtgtatgtgccacagtcaagagtcgagtaccaatgccagccctactatgaacttcagggttctaattatgtaacatgtagtaatggagagtggtcggaaccaccaagatgcatacgtaagttcttaaaattctagatcctgagaaaatcagagtaataagtttgatatttgcttttttatactagaatttttatgggttattaccctagaactgtgttcacaaacagctattctgctgaatgtttgcctttcagatcttaatatataagtgtataagcttggaaaattccatgtaaacaatgaccaagtttcttttttaaaacaggaatgtcggcctggggtggtggctcacgcctgtagtcccagcactttggaaggccgaggcaggcagaccatgaggtcaggagttcgagatcagcctgaccaacatggtgaaccccgtatctacaaaaaatacaaaaattagccaggcatgctggcatatgcctgtaatcccagctactcaggagggtgaggcaggagaatcatttgaacccgggaggcagaggttgcagtgagtggagattgcaccattgccctccagcctgggcgacagagggagaccccatctccaaaaataaaaaaataataaataaataaataaataaataaataaataaataaataaataaaacagaagaagaagaaaagaaaaagagaaaaagaaaaaaccaagaatgttcagagtcttcaatttgttaatggatacaatgagtcttcaagaatgacaaccatttattgcgcacatatgaaatatggcatctcagcttaacaccagtaatcattttcacattattaacacttaggtaaagagttttcaaacagttctgaaaacattgtttcaaaaaaccacaaactattaaaccctacttgaacacatgaaatttttcctgatagaacacatagctggttaacactgagaagttctttctctgattattattcttacttatattttatcagtattcctagcaagcaacaaagaaattaacgaaacttcagccatttccataacccattgcttttccatttttaccttattctcctcttcccttataccagaatcaaaatgaatacactaaaaacccctcaagccagtaatataggtatacttccagaattttgtcccccaagtactatgaacttgaagcaacacaactcaaaaaatataagccacaatgattatggcaacaacaagaaaacctaaaagaaaatttgccacaagtttctactagcctatgaggtagagccctgggacacccatcagtccttgaatgtcagataacctattcctatcacagctcttaaactgtaagttcatgagtttttcaagtgctcaagttcctaagtacaggatgatacaagcagttgttttctgtgatgtgactcatttcctttattttgatgctatgctaccttttacctttcatattgactgatgacgctgatattttggctgatcttacaatgggctaaaccttaattattgtcccctacttaagtatccacttctgtagatgatcatgtccaagtttgagctccaaactatgcaagtggtaagactgaagaagaaattagtatcctcaaatcaaaatagtttacaagtatcttcaaacttgatttcatagaaaagtgttaggtttcagagataaattctgagtcttaaatttgattgactgaggagatggacactcctaagatgggtttcacagcaaaagcattacctcttctcacaatcaagaacaggaaaggattataattatctgaagatataagatcagttctatgatacaagcaagactttcagtcttcaaaactaaagaagcaaagagcattcaagcacagaattctagggaaaaaggcaaccttatggaaaagattacatatacatatggcatattaaagcaatgaggaaaattttcccaggcagcaggaaactttagaaagttttggaaaatatgtttggagaagtatttagagttcaaacaatatttatttttgaattgtaaacagcccctgaatgtattgaagagctcttaaaattttttggatttcaaaagtgatatgtactatgttaagaaatttatttaagtaagtacttgaaagatgtattaaaatatgattggggaaatttctaaagaaatgctaatgctaataagggctaaactagaatgcagaatacttgagtcaaaagaagagataggtgagtgaatgatatcatcaaaagtgaaaagcttgctatgtaagaactgacatttttatcatgtaagtactaggcttaatacctggggtatgggttgataggtacagcaaaccaccatggcacacatttacctatggaacaaacctgcacatcctgcacatgtaccctggaacttaaaaaaaaaattataaatttttttacaaaagaattttataaaagaaaatccatatgtggaagtaacattatcttactgattttacagatgaaggcatagtgagacagagtaatttgtccataatcatgtagggattcatattaactctgtgtgcttatccttgcctctctttaaaatagaaaatgaagatgacagggatagatgatgttgatagagagagagataactgatagatattgaggtatatttatgtatgtatgtatgtatgtatatatagtttcattttaacagatgactattagaaagattatacctttctacagttctgtttctacattgtgggcataagagaaaaatataaacatagaattaaattagcaaaatgtgagtacatttggagtgcttgtagtcacggcttgtcgaatgggggaaaggaggataagtaaccatgactccaatggaacatgttagcataatcctttttgatatgaagtcactagggtggacacaacatattttaggaaagaagagttcaggctctagagaaagactgccagggttcacgtttatcacctcacctgatgatctctgctgtgatgttggggaagtgcaactgaacttattatatttttgaaatgctaacgtcagtatgtagcacaagttaataactattaactatttggattattttataattttattttatcctaaactactcattaggatgcattttatttgctcatgaaagagaaaattatgattgttaattgtttttttctgctttcagatccatgtataataactgaagaaaacatgaataaaaataacataaagttaaaaggaagaagtgacagaaaatattatgcaaaaacaggggataccattgaatttatgtgtaaattgggatataatgcaaatacatcaattctatcatttcaagcagtgtgtcgggaagggatagtggaataccccagatgcgaataaggcagcattgttaccctaaatgtatgtccaacttccacttttccacttctcactcttatggtctcaaagcttgcaaagatagcttctgatattgttgtaatttctactttatttcaaagaaaattaatataatagtttcaatttgcaacttaatatattctcaaaaatatattaaaacaaactaaattattgcttatgcttgtactaaaataataaaaactactcttatattggacttcttatcaatgaattagtaagtatagagacagacagctgaatggctttctgcatattgtatagtatacctagacatagaaacaaaatgactttagattttatttggggaagtaataataccataaaattagatattaaaattgtaagtgaagataaacacactatagtattcccttattgtagccatggtcctctagatgcagttaaccaaatagggtcatttttattaaaagtagtgtttcctggcaaacactgacattacatcattatcatgatttaaaggaaatagtactagagaaggtgaattattatcattttcctgtgaaaaaagaaaagaggttttgctaaccctttcagagcattgggaacacagccagaagtgcattaaatgtatatattaacttgggcaatgttgacactttaggatgctgaagccaggtgcagtggcacacgcctgtaatcctagcactttgagaggccaagctggcaatcatcagaggtcaaaagttcaagaccagcctgttcaacacggtgaaaccctgtctctactaaaaatagaaaaactagctcggcatgatggcgtgcacctgtagtcccagctactcaggaggctgaggtgggagaatcactttaaccagtggggcagaggttgaactgagccaagatagtgccactgcactccagcctgggcaatagagtgagactctgtcttaaaaataaataaataggatgctgaaaattcctatttaaggaaataattctttttctgatttatttaaggctacatttgtattttcttaatacaaatattttgaaagtttcttcatatatggttttttgcatttcttattaagttttgcttcagatttttttttgtcttttctcctgttaattgccttcactctctttctgttctgtacttttctttgtatataaggattttttgaaaagattgtatatccctgttaacaaattgaaatctctattcactttaatagatttttacccccagttagcatatggttagtgagaagttgcagggtaagaagaaaacaatgttccctttcccaacacttttcctgattatagagaaaaaagcatgaacttgtataatgatctagtcctgtacagaatgagaaatattaattgctagactgagaatgttttggtggctaaagctaggaataactttttaagactgaagaatgatataagctatcaaatctaactcagttttcaaataacaggtttgcagagactggagaataaaaagtaaaaaattgttttattaattccagtgactaattctacttcatcaacatacatcataaataaaatttcaaaaataattgctgatatggtttggctgtgtcccacccaattttcaccttgaattatataatcaccatgcatcaaaggtagggccaggtggagataatggaatcatgggagcagtttccccataccccactcatggtagtaaatacatctcatgagatctaatggttttataaatgaaagttcccctggacaagttctcttgcctgccaccatgtaagatgtacctttgctactcattcaccttctgtcatgatggtgaggccttcccagcaatgtggaactgtgagtccattaaacctctttcctttataaattacctagtctcaagtatgtttttattagcagtgtgagaatcaactaatacagtaaattggtattacacagtagagtggggtgctgctgtaaagataaccaaaaatgtagagtgactttggaactgggtaacagacagaggttggaacagtttggaggactcagaagaaggcaggaagatgtggggaagtttggaacttcttagagagacttgttaaatggctttgaccaaaatgctgatagtgatttggaaaatgcaatctaggctgaggtggtctcagctagagatgagaaacttgttgggaacaggagcaaggtgattgtcgctatgttatagctcagagactggtggcattttgccacttccctagagatgtggaactttgaacttgagagatgatttaaggcatctggcggaaaaaatttctgagcagcaaagcattcaagagatgacttgggtgctgttaaaagcattcaattttatatattcacaaatatatggtttggaattggaaattatgttaaaagggaagcagagcataaaagttcagaaaatttgcagcctgatgatttgatagaaaagaaaaacccattttctggggagcaatttaagctggctgcagaaatttgcacaagtaatgagaaaccaaatgttaatcaccaagacaatggggaaaatgtctccagggcatgtcagaggtctccagggcatgtcagaggtcttcaggacaacccctcccatcacaggcccagaggcctaggagaaaaaaatggttttgtgagcagggcccaggaccatgctgctttttgcagtttcaggagttggtgccctgcatcccagcaggggctaaaaggggccaacatagagctcagaccattgctttggatggtgcaagccccaagccttggtagcttccatgtgatgttgagattttggttcacagaagtcaagaattaaggtttgggaacctctgcttagatttcaaaggatgtatggaaatgcctggatgtccagcaaatgtttgctgcaggggtggggccctcatggagaacctctgctatggcagtgcagaaggaaaatgtggggtgggagcccccacacagagtccccactggggcactgcttagtggagctgtgagaagaggcccactgtactccagaccccagaatggtagttccaccgacagttagcatcgtgcacctggaaaagatgcagacaatgccatcccatggaagcagtcaggagggaagctgtaccctgcaaagccacaggggtggagttgcctaagaccatgggaacccatctgctgcatcagcgtgacctggatgtgagacatggagtcaaatgagatcatttttgagctttaagatttgactgccctgctggattttgtacttgcatgagacctgtagcccctttgttttggccaatttctcccatttggaacaggtttacttacacattgtctgcaccattgtctgtaccattgtatctaggaaataactaatttgcttttgattttacaaagggacttgccttgtctcagatgagacttgagactgtggacttttgagttaatgctgaaatgagttaagactttgagaggcttttgggaaggcataattggttctgaaatgcaaggacatgatatttgggaggggccagggtggaatgatatagtttgactctgtgtctctgctcaaatcttaccccatgttaagggcagggccatgtggagataattgaatcatggggactatttccccatattgttctcatggtagtgagtaagtctcacaaggtctgatggttttataaatgggagttcccctgcacaagccctcttgcttgtcaccatgtaagatgtgactttgctcctcatttaccttccaccatgattgtgaggcctccccagccatgtggaactgtgagtcaattaaacctcttgttttaataaattacctagtctcaggtatgtctttattagcagcatgagaacagactaatatgattgccttagtttcctaaaatggtacaaaaataaatggcaggaaaccacaactgtaggagcaacaaacaatatcatcaggaagaggaaaataaaatgtgatataaaagcatcagtggggttattaaagagtagagtatgcacctagcaaagtgaattggtgtgacagataagaaatttggtgtagtgggttttaaaagggaaaccatagaggaatgattacagagattattaatctggagaataaaccataaaaatctaagtctagggaagaaaccagtacaattgcaataagtacaatcatcaaaatgttcttacattcctttctaaacaattattcctagtgtatagcttaatgtggttccaggcaaagtgagagataaaatctcacagaaacattatctagccaattgttttttaattataagactaatgaacaaatcttacaaatctttaggcaggaaaataaaaatgactgaaaatgaaatcttagggaaaatagaatggttgttatattaaaatgtaaatatacttggtgtgatatttatcaagcaaaatagctgtttatgggccagacatagtggatcaacctgtaatcccagcactttgggatgctgaggtgaaagggttgcttgaggtcaggagtttgtgatcagcctgggagtcacagcaagatcctgtgtataaaaacaaagaaaactaattagctgggcttggtggtgcatgcctgtagtcccagctactacaggaggatgaggtgggacaattgtgccactgcactccaacccagcgacagagccagtccctgtctcaaaacgaaaataaaacaaacccccccatttattagttcattaatttgtgcctagaaaccaattgttttaacacatccattaagaatcattatatgccaagccttttatctagataggaagcacattttgaatttgaaaatactattgcttgatatgaagttaattataacttctttgaagatacaatgcaaacacaaaattcagaatacaaaagtatgtagacagtatgttgttaacaataagggaagaaaatatagcggggagattggcaggaaaaacaagacattttgattttatcactttgaggtttcttctactttacagttattttatttatttatttatttttaattttgtgggtacacagtaggtatatatatttatggggtgtatgaggtattttgatacaggcatgcaatgtgagataagcacatcatggagaatagggtatccatcccctcaagcatttatcctttgagttacaaacaacccaattacactaagttatatttaaggtatactattaaattattgttgactatagtagccttattgtgctatcaattagtaggtcttattcattcttctaattatttatttgtacctattgaaaataggtacccacctcctctctgacacccccaaccactgcctcccaccactagccccttgctacagtagcccattcatctactgtctatgtccatgagttcaattgttcttatttgtagatcccacaaataagtgagaatatgtgaagtttgtctttctgtgcctggcttatttcacttaacataatgatctccagttccatccatgttgctataagtaactagatcttattcttttttatggcagaatactactccattgtatatacataccatgtatatacatggattttcttgatccattcatctgttgatggacacttaggctgcttacaaaccttagctattgtaaacagtgcagcaacaaacatagggatgcagatgtctcttccatatactgatttcctttcttttgggtatatgccctgcagtgggattgctggatcatatggtagctcaatgtttagttttctgaggaacctccaaactgttctccatagtggttatgctaacttgcattcccaccaacagtgtacaagtgttcccttttctccatatcctcccaagcatttattactgatttttggatataagccatattaattggagttagatgatatcacactgtagtttcgatttgcatttctctgataatcaatgatattgagtaccttttcatatgcttgtttgccatttatatgtctttgtttgagaaatgtctattcaaatcttttgcacgtttttaattggattattagaatctttcctatagcgttgtttgagctccttatatattgcggttattcatgccctgtcagatgggtacttcacgaatattttctcccgttctgtgggttgtcacttctctttgttgtttcttttactgtgcagaagaagatttttaactttatgtaatcccattggttcatttgtgtttaggtttcctgtgcttatgggatattgcccccaaaatttttgaacagacctatatcctggagattctctgcaatgttttcttgtagtagtttcatagtttgaggtcttagatttaagtctgtaatctacgttgatttttttttatatggtgagacatagggtctagttacattcttctgcatatgaacatcctgttttcccagcaccatttattgaaagacagtcttttccccagtgtacattcttggcactcttgtcagaaatgagttcactgtaggtgtgtggatttacttctgtgctctctattctgttccattggtctatgtgcctgtttttatgccactattatgctgttttgattactatagttgtgtagtataatttgaagtcaggtaatatgattcctctagttttgttcttattgcttaggatagctttggctattctgggtcttttgtggttccatataaattttagaattgttttttcctacgtctgtgaagaatgttattggtattttcacagtgattgcactgaatctgtagattgctttaggtagtatggacattttaacaatgttgattcttccaatccataaacataaaatatctttccatctttttgtatccttttcaatttctttcatcaggcttttatagttttcattatagagctctttaacttctttatttaattcctaggtatttaactttatttgtggctactgtaaatgggactactttcttgatttctttttcacattgttcactgttgacgtatagaaatgctactgatttctgtatgtttatttcatacccagcaaatttaccaaatttatcagttctaatagttttctggttgagtctttaggtttttccaaatataagatcatatcatctgcaaacaaggataacttggtttctttcttcccaacttggatgccctttgtattcttctcttgcctgattgctgtagctaggacttcgtgtattatgttgaataactatgtaacagtgggcatccttgtcatgttccagtcctttgaggaaaggatttcagtttttctccattcagtatgatactaactgtgtatctgttgaatacagcttttgttactttgaggtgtgttccttctatccccagtatttgagggttttcatcatgaaggatattgaattttatcgaatgctttttcagcatcaactgaaatgatcgtatggtttttatccttcattctgttaatatgatgtatcacattgattgacttgtgtatattgcaccatccttgcatcccacaggtaaaccccatttggtcatgatgaatgatctttctaatgtattgctgaattcagtttgctagtattttgttgaggatttttgtatcgatatttattagagattttaacctgtaattttctttctcttttttgggtgtgtctttgtctaattttggcatcagggtaatactggccccatatattccgccagcatctgccatacctcagtaccatatcagaaagaaggagcctagagtattattctgtttctctgggatgttctctcacatacatgcattccctcatcattggtcacactttttgccattttctgtttactatcaatcttaaccaagcttagcatctgtggatggaagtccataggtgagctataatacccacccatagagtgcagcaatagccccttgcatcaatagcctttccagaacttccctctatgaacattcccaataagaaaaagtacagttacaaatataaaatatggcaggagtatctctaccactagtcagggggcagcatctaggcagtcttagtttagtgagagaaataatcattcctcagcccgttgtccctttagtaatgtacacttaaattcagaggacttgaagtaatgttttcagctgcaatgacttcttgtggtaaaatctacagctgtaattctaaattggtaaaaatggatctggcaaaacagaaacagtttacggggttggaaatatgtacgagctgaccattcatgacatttgccataatccatgtgtctgtacatctgtaagcattgcctttgggataaccactcaattctttcaaacttccagatatattgctttcaatgttatttaccacgaatcttgccttgtaatctagattttattatctacaaggtgattgcttcactcaaattgggacgtgctgtcagaaaaacagacagattgctttgcacaaggagaagaagaatcacagagtttagaccatttcaaaaaaggagccagaagttcttttgtggattatatcattggtcaaaaatgctggctgcaaactgcttatgaatgtaacatacaccaagagcaaccaccagtggagagttgctgcatgtgtcatttccatattattagtttttctaaactgttccatgctaattggaatgtttgtctgatattacctatgaaataataggcattttgagttttagatttattaaccacaatggtgagggctatcttcatcaaagctcagtaatgaacaaggaattgtcttttaatccccctttaaaaattcacaaataataaccatacatatttatggggtgcatagtaatgtgtgtgtgtgtttgtgtgtgtgtgtgtgtgtgtgtgagtgtatatatatatatatacacacacatatatatacacacacatatatacacacacacatatatatacatatatatatacacatatatatataatgtatagtaatcagagtaattagcatctccattatctcaaacatttatcatttctttctgttgggaacactgaatattctccttccagctatttggtactatctagtatattcttggtaactgaaaaaaaattacatctaagtgttaacctcaggtatcttgaaatgccaactcctaacagtcatagcctgggagttcatgttagccttcttgcaactatgcatatccacataattaatcaaaatcatttgtgttttggtgagaattagcatctgcaatggtgagttttatgtgtcagcttagctaggctatcaatccaagttatttaatcaaatattaatctaagtgttgctgtgaacaaggtattttatagatggagttaataacatctacaataagttgcctttaagtaaagattacccttgataatatgggcgggtcacattcaatcaattgaagcagtaagagtcaaaacttcggcttcccaaagaagaaattctaccttaagactgtaacatcaactcttctctgagtttctactctattaacctgccctgtgaattttggacttgcttatactcacaaatcaagtaaaccaattgcataaaacaaatctctatctcatctatctatacacacctcacactatacattctgtttctctggaaaacactaatacatcatcttaccacttcacatttttaagcaattaaaatctctcactatcttcccaagatttggtattacttaatattcactagagaggctggtttgaccgattataaaattcccatttaacaagaataactaagaccaggtgaagagagcccttttccaaaatctgactataagtcggtaattgaattcactaccaaattacaaaccatttatttcaaggactctgtggaaagattaatctggcaggcaccgatacttctctgttttgcaaaacagaccacatatttaatgttatttctctagtattgatggtcatttggtctttaaatcctggcgcttggaaggtaggatctgttgatgaagggtcagagtgaaggagtgccatgatttaacctgtatctccccaagtctccatcaaaacctttgtcacacatgaagccaattatatttggttcagatatttatctcaatattgctggggttgaatgttcatttgctttactttccaccatgagatgttttaatatcaccaaacttgctagcagcaaccaagaaaatgtatttctagtaatttctccatcattttgtatcacattctaaatacatatatatatatatatatatatatatatatatatatatatatatatataaaacaaactcttgagtcaaagtcatatactccaaactacactcctacaattcattccagataatcttcctctgaggattttcccttcagacaaagagtggattggtaacaccctggcaataaacatttgtcatacccttcatcctatcctccttaaatttcatggtgcctttgccatatcatgaagaaggaaagaagctcagtgtccacttctgataccactctgccactcctacactgctaagctaacagcagtgatcttgctttcagaactagcaattcacatttttacctatcattatgttaactgctgaaaattatttaacacagcattaatgtcaacagcatagtgagaattgtgactcttatgtgtagtgtctgattatcctaatcttcaccttgaattcatatgtttaagggagatgactcaatgagtgtctgtgacctctgaagttcttccatctcctttcctttattagttgatgagctccctcagctgcatcttatgaaatccagttatttattatacttattttagatgaacaacctaaaaaatgtgatttgagcacttaactcagattcttatttatcttcaatctggtgtacacctaaagattctcttgcaagaattttaacaagggtcaaattatcagtcttctatgaaattacagaaaatatcacagacttgtttttaaaacttttcttaaagaaacaggcagaaaactgtcaaaaacatgggtgagcgctaccgaggtagagaaataaaacattactctttcattagatacaattaaactttgaaaacacatttaaatatgatttctaaaataggtaagacttggttacatttgatgacaccaataaagatgaactaggtaagtaatcataatggagtacattcttaaatgcaattatttttatgacacatacgtacctcagagtggagataaattaaaatattagtatgtaatgtatcatagttactatgttttgcagattaaagatgtccacaaataatttgaaaatcctctgattaagtgacctatttccccatcatcttgaacttgtgctaacccatgacttttctgaccaataggatatggtataagtatctctatgccagttacggatgtaagctttaaaaaaatagcagcttctgccttggtgtcttgtagcttctaatcagcatgagagaattctgggtaccctgtagagaggccctgagagtgacaggagtcacctaaaccccaaatttcacttgttgctggcaaagcaccaaatatgtgactgaagacatattgaaccctccaccgcagaagattaaccagatgaataacaatgaatgtctccattaatacacagaaaataaaagatttatccatttgatccccaccaaaattctatgccccatagaattgtgagatgtcattaaatggtatattagaaaagaagaaatatctcaaaacactaacctaagttccaacttaagaaggtaggaaatcatgaatattagtgtataaatcaatgaagcaagtgcaatatagaaaaaactgttttcttaatcttctcaaagaatgaataaaaccaatcaaagttagttctttgagaagaataaatgatatatttctagcaagaacaatgaagaaaaaaagaagaaacaaattacctgtcatttggcatagtatagggcattgactgacatggttccaatagttgaagggtatacaattattttaacttctgaaatgtccaaagtgtcagggttttgtctgaaaaacacaccaaaaaaaagagaatacccaaaagagttccattattaaatggaaattttatatgaaggaaaattctacaagaaggtacagcaatggccttggtcatattcatgagcaaatacctcctctttttctgggactcactctagagactgctgaagctctgtcttaggctactgaaggaaaagtttaaagggattctccattagaacacctgctgccagaggctagatgattatcctgtctttctgatggcagttcataaatgaatggttactactctacctggaaagttgtggcagatcctcatgggtaaatataagactaaaggaattcaatagggtaaactttaatgtgttttctcgctattatggaagacattgaggacataaaaggccagatcacatgggttgataccaattcatgaccagtgattaattaatgcaaaaatagttgattcaagtacttgttgcccgagatactacctttatgggaattaaaaagacaaatcaaactgggacaagctgatgcccaccaaaataaaaactctaccaggattggaaagcgactggagtcaacaaataggtatttcggttcattacctagaagtaactacttatatacatgaaaggaatggtcacagaaggacctaaaccaacagaagcaccagaaaaggtataaattgtttaccataatggtccagtttcttagcaagataggtaagatttaaaaattcattaggacatatccactggggtgatggcccagcatacagctagtaaatagattatatttgatgttcgttcttaacaccaggaagatttaagcaagctttgaaggccactaaaacgtatttgagacttggtttttttcatggaagttaaatctaacgtatgaaaattaaataatctgaattgtttttgcccaccaagttatattcttctgatcaaggaagctattttacagcacgtgatatacaacaatgggcaaataaacaccacatcgaatatatatatcatatcctttatcttctgcagagtagtggaaatatttgaaatcattaattgaaatacctgccaaaaataaagactggggcagataggtcagtaataaaggatgaaagagctggtttacttgttttcaagttgtgcattaaaattaaacatgagataatcatgtggttttgtttttagttctggtttctgtgatgaataacatttattgattcatgtttgttgagccaaccttgcaccacaggaataaagcctacttgattgtggtgtattagcgttttgatatgctgccagattcagtttgatcagattttgttgactatttttgcatctatgttcatcaaggatattgaccagaagttttccttttcagctgtgtctctgccaggttttggcattaggtgatgctggcctcatagaatgatttaggaaggagtccctcctcctcaattttttggaatagtttcagtaggaatgataccagctcttcctttcatatctggtagaatttgcctgtgaatccgtctggtcctgggcttttgctggttggtaggcttttaattactgattcaattttggaactcatttttgcttggcttggagattgaatctaaatgtccatcaacggtagattggatttttaagatgtggtacacatttaccatggaatactgtgcagccgtaaaatatagtgagataatgtcctttgcacgaacagagatggagctggaggccgttatctaagcaaactaacacaggaacagaaaaccaaataccgtatgttgtcacttataagtgaaagctaaacactgagtacatatggataccaagaagagaacaacagatacttgagggtggaggatgggaggagagtgaagatttaacaagccaccttttgagtactatgcttattacctaagtgacaaaataatttgcacaccaaacccctctgacatgccatttacctatgtagcaaacctgcacatgtgctcctgaatctaaaataaaagtaaaacataaaattaaaataaaaagttaaacatgggagaaaccaaagatgatttactattagataaatttcctagatagagtggtagaagtaagaacgatttggggatgaaaccggcacttatctacaagtcttttcaaacacagcacaattttcttcttttctgccttaccccataatttctgagtccagtttaaaatgaacagttcttgacacatcactcatatttaaacaggagttactgtctatagtttttaatttaaatgaattcagaagggattggtgggccagatgaaggactggcaaatgacagtcatggggaactgtggcctgctgcctatttttgtagggctctgactacaatggtttttacattttgacatctttttaaaattaaagtaagaaaaatcatttgataattaaaatattcataaaatttatatgaaatttacatatttgtgtccataaagttttattggaacacaaccatgttcactagtttacgtattccccatgttacactatcagggccaacagagtagttgcaacagagatcacagaagctagaatgtcccgtcctctcacctggcctaaccgggccttcaggtggaaatgctttgttaccaagtagaggtaacaggccagtaagtttgtacatttctaatcctatcccatgtgaatgaaaataaaccaagaaagaagccttagcaagattgttatttccagtgaataggttaactccatggtcaaacctgatatttctttttggagaggaaagtttgggttaaaataagtgatagataaaaagaaggtgacataattgcctaaataagagatctaacaaatatactatttaaagggaaaaatcaaacataactttgcttctagagagtcttacagcaaaaaaataattttctctcttaccttttagtctgatgtctgttacagtgaaataccttgtctcacaaagaccctactgagaggcgacagtgtgctggcagccctcgcagccttcactcgcttttggtgcctcctcggcctcggcacccactctggccgctattgaggagcccttcagcccactgcactgtgggagcccctttctgggctggctgaggccagagctggctccctcagcttgcggggaggtgtggagtgagaggcccggagggagagacatgggcaggaacccgggctgcccacagagcttgtgggccaggaggacttccaggtgggtgtgggatctgcaggcccacacttggaatggccggccagcacagccagcccgggcagtgaggggcttagcacccaggccagcagctgcagagggtgatccgggtcccccagcagtgccagcaggccagcgcagagctcgaactctcaccaggcctcagctgcctccctgtggggcagggcttgggacctgcagccagccatgcctgagccaccccgctgccatgggctcctgtgcagccagagcctccctgacgagcactgcccgctgctccgcagcgcccgttcccattaaccgcccaagggctgaggagtgcgggtgcagggtgcaggactggcaggcagctctgcctgcagccagctgtgggatccactaggtgaagccagctgggctcctgagtctagtggggacttggcgaacctttatgtctggctaagggattgtagatacaccaatcagcactgtgtgtccagctcaaggtttgtaaatgcaccaagcagcactctgtgtctggctccaggtttgtgaatgcaccaatcagcactctgtatgtggctaatctggtggggacttggagaacctttatgtctagctaagggattgtaaataaaccaatcagcactctgtgtctagctcaaggtaaacgcaccaatcagcaccctgtcaaaacagaccaatcagctctctgtaaaacagaccaatcagctttctgtaaaatggaccaatcagcaggatgtgcgtggggccagataagggataaacgcaggctgccccagccagcagtggcaaccctcgggggtccagttctacactgttctttccctctttgcaataaatcttgctgctgctcactctttggttccacactgcatttatgagctgtaacactcactgcagaggtctgcagcttcactcttgaggccagccagtgagaccacgaacccactaagaggaacgaacaactccagatgggaggaacgaacaactccagatgggaggaacgaacaacaccagacatcccaccttaagagctgtgacactcactgaaggtctgcagcttcactcctgaagccagtgagaccacgaacccaccagaaggaagaagctccaaacgtgtgaacatcagaaggaacaaactccagatgcatcacctttaagaactgtaacactcaccgcgagggtccgcggcttcattcttgaagtcagtgagaccaagaacccactaattccagacacactaccattactaaaacaaaatgccatggatctgggaagcagcaggcttgagcaacatcattactggagtgatgtatagcatatgcttcagtgaaacaaaggaaattcaggtttctcacacacacacatgctgatgtggtttgtatctgtagaaaaaatgcatcctgtatgacccagtggtggtaggacaaagaagtctgcgtgtgagttctatggatggatccctcaacgaacaaccctctcctactgctgctgtgccctttgcctgtgatacagcctttttgtgagcataagttgtttgagtcctgtgaattccttcagcaatccaacaccaacattcttaccacctggtaagactaaacaacttaatatatataaaagcaaataaaatacttctacatgaaaactatcccaataaatgtctatgtctttcattaaatactgcttcagtcattaaataatgtatatttgtaggagtacatctgcatctctgagtttcatctgcaaaatggagatgacatttttgaaatcagaatttaattcacaaatgtatgtaaataggttttagtatactgggcatttaacaatacttataaccatatagtaagtattcaataaatcgaagctactgttatcatttatattattcaaaggaaaacagagttggtcagtagaaacctactttttctttttgcatcagcctatgtaacaagaaattttttctcctgcaacttgatcacacaggtcagcagcagtgagttaaaggcagcttatagatataacagatacaaaatcccacatataaaaactataacaatataataagcacattaatagaaaaagatgaaagacactacaagaatttagacaaaaaataaacaccctcttggaggccaggaaatagatctgaaaggagatgatatttcatgtgaggttcaaacttgcatataattttggtaggtagatgcggagaaaatcaatacttaggagaaacagaatgtgaaagaccaacaacaagataaagaaaaaacataattgggaagtttcaaaaagttagcatgactaaaactcagggtattcactgtgatgagtgatgtgaggtatggaatcagaaaagattttaagattttatagacctgacaagaagactgaactttactcagagagtgatcagggagccatggatggattttaagcaagtgagatgcatagacagacggaccacggtttcatgagcgtggagactgaattacagtcaggaagtcaggagttaacaatatagaatgttcagataggagcagcactatttgagacatcagtttctaccgtgtgtgatttgtaatatccagtacaatatctatgcaaaatgaatttgacatttattgagacataagaaatactttttttaagtatcaggtttcttacttcataaaggtgaaatactaaaatatttgagaatacaaaaatgggcatttgtagccccaataaacatcaaattcaagaagaaaattaattggaaattccatgcaaatcatgtacaataaaaaattataatattaaaaactgattcaatttactgagaaaatcagtgatgttccagtagaaaggtacaggcataaataattcatacagttaaagcaaaatagtaaacaagtaaatggaaagtgttcaaaaaatgtaaatacttttgtaaaaaacagtagaatgttttattataaaattagtaagattaaatatttaagcctatacagttatggtagaaacagtttacatatacatagtttgagtcagcataaacagatatgtataggtttataaacaacatgctagggtttaaccagaacctaaaaaaatgcaccaatattttgtcttttccttcccactactcaaaatttacgtaaataactttttaaaatattatttacaaacaatttttctgcaacttcactataaccagaaaaactgagagcactcttattacccaaaaagaaatattaaattatatgacaggagttgtaaatacttaagcttacattaaaataaaatcatattaatggttttaaatataacatgaaatgtaaaatctctatactgttcttaaatgattttaaaactatccacaaatatgcaagaaaatagaaaatccttgagagtggttgacagacaaacaagaaagatactgaagtgtaaagcttgactgttttgggaacaaaaagttatcctgattgagttgaaaaaaggctgaagaaggaaatgaaggtgttttccattagcaaccattcataaattactttcagggcaccaaacatgatataaaacatctgagagcatttttagtaaacttgcacaattctgctatgagacatatttttctaaaatggtttggtcttgagcatcagtaggaagaatatgtcctgtaagtaaaggatgggatgtataggaaggactttatggagtacagctggagaatgctggagctcttagcaacggaggaagctatggattaggtaaactcttgcatgatcagcttacatgatccctggaggaaaatagcatgagtaggacatcacaacctgttctcatttctttgctcagttagtaggtaaaagtcaagtcattatccattaaaacttatcaactgatggaacacaatgggcaccgaaaacagagaacacaaaacaaataaaaaagatgaaaataaaatgtgttgaagtttgtaaaattatacaggattttagaaataaattaatgtttgtactttatatgtgcataaataaatcaattaaaagtttttcagttttttttgagacagggtctcactctgtgctgatgtcaattccctggtctcagttattgtacttgataatacatgggagggcataatctactgaaattacttaaaataagaaacagaaaaacaaaaggaaaatctaagtttccaaattagaagaatggaagaaatattcagcaaaaaaattggaaaataattgttgagtactgcttcaaaaaagaatagacaagagaagatactgttaattcaactaaaaattggcactagctctgtgaaaattaactctgtgctcataaataaatgataacatcccctagattcagacaagccagtatttaaatgtcagagagtttagaagaagccatcaaaacattgacatggtgaagcctttcagacagaagagaaaccaggagaatgtgttgttccatagaccatgtgaagcaggtatttcaaaatggaaggatgggaaactcatgtgaatttttgctgattattcagtttcaaccaatggatttgattacaaagaagatattgatgactgttacaagagaggtttaagtgtagtggtgggaatgaaaaaatgaaatgaggcagaaattgtagctaatacattggagtcattgtattataaaatgagaagagaattgggagcttactagaaagagatttggttccacaaaggattttttgagctttttttgttgttgttgctctttaagatggaagatgtttggtattttcgcatattggcagaaataatttgaaaaatggagaaattaatgataacagttgagagggaataattgaaagagcaaaatccttgcatagaaaagaggggatcaaatctggtagagaccataacaggataggagtaaggatcaacatccagtgaaacaggagacaatgcaaaaaaggatgtgtgtgaacagcaggtagttttcttctgattgcttctatatctagatgaaaaaaataaataaagtcattagcaaagtacaaggtgaggactgatggttaaggagggagataataaaacagaggaggagaaaggaagtgtcaaaatcatttaggcctatgatcattaatttaaagcaaggcaagtcagcaccgttgcatttggttttttttttcaactcttcataatgtaaacctttatttatttatttatctttattattatgctttaagttctagggtacatgtgcacaatgtgcaagtttgctacataggtataaatgtgccatgttggtttgctgcacccatcaactcgtcatttacattaggtatttatcctaatgctatcactccccctgccccccaccccatgataggccctggtgtgtgatgtcccccgccctgtgtctaagtgttctcattgttcaattcccacctatgaatgagaacatgcggtgtttggttttctgtccttgtgatagtttgctgggaatgatggtttccagtttcatccatgtcccttcaaaggacatgaactcatcctttttatggctgcatagtattccatggtgtatatgtgccacagtttcttaatccagtctaccactgatggacatttgggctagttccaagcctttgcaattgagaatagtgccatgataaacatacgtgtgcatgtgtctttatagtagcatgatttataatcctttgggtatatatacccagtaatgggatggctgggtcaaatggtatttctagttctagatccttgaggaattgccacactgtcttccacaatggttgaactaatttacactcctagcaacagtgtaaaagtgttcctatttgtccacatcctctccagcatttggtgtttcctgacttattaatggtcgccattctaaatggtgtgagatggtatctcattgccattttgatttgcatttctctgatgaccagtgatgatgagcattttttcatgtgtctgttggctgaataaatatcttcttttgagaagagtctgttcttatcctttgcccactttttgatgggtttgtttttttcttctaaatttgttaagttctttgtagattctggctatcagccgtttatcagatgggtagattgcaaaaattttctcccattctgtaggttgcccgttcaccctgatggtagtttcttttgctgtgcacaagttcttcagtgtaattagatcccatttgtctattttggcttttgttgccattgcttttggtgttttagtgatgaagtccttgcccgtgcctatgtcctgaatggtatggcttaggttttctttttgggtttttatggttttgggtctaacatttaagtctttaatccatcttgaattaatttttgtataaggtgtaaggaagggatccagtttcagctttctatatatggctagccagttttcccaacaccatttaagaaataggaaatcctttctccatttcttgtttttctcaggtttgtcaaagatcagatggttgtagatgtgtggtgttatttctgaggcctctgttctggtccattggtctatatctctgttttggtaccggtaccatgctgtaccatgctgttttggttactgtagcatagtttgaagtcaggtagcttgaagcctccagctttgttctttttgcttaggattgctttggtaatgagggctcttttttggttccatatgaactttaaagtagtttagtccaattctgtgaagaaagacattagtagcttgatgggaatggcattgaatctataaatcaccttgggcagtatggccattttcacaatattgattcttcctatccatgagcatgaaatgttcttccatttgtttgtgtccttttttatttcgttgagcagtggatcatagttctccatgaagaggtccgtccttcacatcccttgtaagttggattcctaggtattttattctccttgtagcaattgtgagtgagagttcactcatgatttgactttctgcttgtctgttattggtgtgtaggaaagcttgtgatttttgcacattgactttgtatcctgagactttgctgaagttgcttaccagcctaaggagattttgggctgagacgatggggttttctaaatacacaatcatgtcatctgcaaacagagacaatttgacttcctcttttcctaattgaataccctttatttctttctcttgacggaaatccccggccagaacttccaaaactatgttgaataggagtggtgagagaggacatccctgtcgtgtgtcagttttcaaagggaatgcttccagtttttgcccatttagaatgatattcgctgagggtttgtcataaatagctcttattattttgagatgcattccatcaatacctagttccccgagagtttttagcatgaagggctgttgaattttgttgaaggccttttctgcatctatcgagataatcatgtggtttttgtctttggttctgtttatgtggtggagtatgtgtattgatttgcatatgtttaaccagccttgcatcctagagatgaggccgacttgatcgtggtggataagctttttgatgtgctgctggattccgtttgccagtattttattgaggattttcgcatcaatgttcatcagggatattggtctaaaattctatttttttgttgtgtctctgccaggttttggtgtcaggatgatgttggcctcataaaatgagttagggaggagtcccgctttttgtattgattggaatagtttcagaaggaatggtaccagctcctctttgtacctttggtagaattcagctgtaaatccatctgctcctggactttttttggttggtaggacattaattattgcctcaatttcagaacctgttattggtctattcagacattcaaattcttcctggtttagtcttgggaggatgtatgtgttcaggaatttatccatttcttctagattgtctagtttatttgcatagaggtgtttatagtattctctgatggtagtttgtatttctgtgggatcggtggtgatatcccctttatcattttttattgcatctatttgattcctttctcttttcttctttattagtattgctaggggtatattaattttgttgattctttcaaattttcagcttttctgctctggtttctccccatctttgtggtttttacctacctttggtctttgatgttggtgaccttcagatggggttttggtgtggatgtcctttttgttgatgttgatgctattcctttctgtttgttagttttccttctaacaatcaggtccctcagctgcaggtctgttggattttgctggaggtccactccagaccctgtttcctgggtatcaccagcagaggctgtagaatagcaaatattgcagaacagcaaatattgctgcctgatccttcctctggaagctttgtcccagaggggcacttgcctgtatgaggtgtaagtcgtcgcctactgggaggttgtctcccagttaggctacataggggtcagggacccacttgaggaggcagtctgtctgttctcagagctcaaatgccatgctgggagaaccacctcactcttcagagctgtcagacagggacgtttaaagtttgctgccttttgtttagctatgccctgcccccagaggtggggtctacagaggcagcaggcctagctgtgctgcagtgggctccacccagttcaagctttcaggccactttgtttacctactcaagcctcagcaatagcggatgcccctccccccaccaggctgttgcctcacaggttgatctcagactgctgcactagcagtcagcaaggctccgtgggtgtgggacccaccgaaccaggagcaggagagtgtctcctggtctgccgtttactaagaccctcggaaaagtgcagtatttgggcaggaatgtcccatttttcccaggtgcagtctgccatggcttcccttggctaggaaagggaaatcccctgaccccttgcacttccagggtgaggcaatgccccgcccagtttcggctccccctccatgtgctgtacccactgtccaaccagtcccaatgagatgaaccaggtacctcaattggaaatacagaaatctcccatcctctgcgctggtcacgctgggagctgcagaccagagctgttcctattcagccatcttggagcggtgaccgcatttgtttttcttgtagacacactctgctgcttcagttcagagacagggcaggcagagaatttatttgcaaaggtttgaggttttctaaaacttggattacagatagaaagaaaggaatgggcaggagagtgtgtgcaagggattgacttacagtgatgaaccattgaatctaatttgggtatggtgggaagagagaaagtgaagggaaaagaatagtgaaaaagcatcagtgtcattgaatggttggaacaaatttagtagagtaagtgagctaaaaagattgttgaaatggtctagagtgtgacactttagataatttaggtagtttaattggaaatgataaggtttagatagactagaatcaatagtggagactagtagctcacagagacttctctggtttcttgattgaacatagctatatgcattcccattgacttctgaaccaccatcagtaagtttcatcttagtggaagtccttaggctgtccctttctccaaattttgccattaaatttttgactgactggccactttgttgcttgccccagctaatatcctctacacatactaatcttctctacttgcttcccactgtaacctctttatattcaataggatccttgggcagggaattttccacgctataaagtcactcccctccagtggagcagcagagtttccagtccacacagactgcttgcctacccagggttcaacttctgagccacagaactgagctgtgagacaaaggtggataaaagcatccactcttttttactgagatttatgtggactttctggaataaatatttcccaacagtatgctctttggccaatttctagagattatttttataattttatccagttttattgctgccttttggtggtgagtgaatataccaagacccagaaatacccattctcaaagtcccatcagaacaaaattattttgaagtaaaatttgttcaacaattttgggaaccattacataccaaaaattattcttgatttgactttttatagtctaaaaatatgaaaactattaagaagttacctcattcttttttttttttttttttttttgagacggagtctcgctctgtcaccctggctggaggggagtggtgcgatctcagctcactgcgaactccgcctcccgagttcacgccattctcctgcctcagcctcccaagtagctgggactacaggcacctaccaccacgcccagctaatttttgtattttcagtagagatggggtttcaccatgttagccaggatggtctgaagttacctcattcttaataccagttttaagtggaatttataactagaacagtgatgctgttatgttaagatgaggactgatcaccttcacttgcttgcctactgatgtagctgaactcttggctagaaaaaagaaggggcttcctctttcctcttcaatggcccatttctgaatattccaaactcagagactcagggaccacaacaaggaaattgaacagcttttattttgctcaagttaatattacatgataaactcagagtattattgtgaaaacactgattagacactatttgcttattttgcacaaccctccatgaactttgatgtttaccacaaaggactttactaaactagcttccagttagtacactgaaattcaaagtcatgctcataactgttaatgaaagcagattcaaagcaacaccaccaccactgaagtatttttagttatataagattggaactaccaagcatgtggctcctggtcagtgtaattctaatctcacggatatcctctgttgggggagaaggtaagttcaaaacagacctgaatatttagttcctttttcagatacatttatcggtttttgtgtgtatgcttacatatttttaaatgaataaatggatgaaaatattttaaatgagttataatattaatctattttatggaaatactttctaacatgcaattagcaggaaaatagaataaaattagttctctccatcctctaagttgcaaaggtaaatggccaccaaatagagaatgtaaagaggaattaaatgagggaaaacctgctatactaacggtggcaaggtgaagtattagtgtaattctgcatacactctgcaatgccactaactagaacaatcaatctcaaaaagatttggccaccttcaaaatgctttttggattttagtttcctagatttgatcatttaaattttaaaggtcattaaaatggaggaattcccatttcaattgaattatccttcaacagagggaaatatattttactgaaacaatagaaaatatcatttatatataaaccagtgaactgtcaagaaattgcttcttctgagctcttaaatgttgagaatgaagtaatgtatcacctctttattaatactacaaactgcttcttatgatattttataaacggtcccattttatttcatgttgaaattaaggccaccatatcaaaggaattgcaaacaaaatctctaccaaggtctaggatactaattaaactatgtctgtacatggagtttcgatcattatgctttaccctttgatttccaaaaagtttttactttactgtttggctgtttcctaatgtttccagacctttgaacttttatttgaacagtttctcatcagtcctgacataacagaacaacatgaacaataacatgctttcctttaaatatttgcccttagaaatgttgcaaaatattatttctattgcttgaaattcatttttttttgagatggactttcactcttgtttcccaggctggagtgcaatggtgtgatttcggctcaccacaacttccatctcctgggttcaagcaattctcctgcgtcagcctcccaagtggctaggattacaggcatgcaccacgacgcctggctaattttgtatttttagtagagatggggtttctccatgttggtcaggctggtctcgaactcccgacctcaggtgatctgcccgcctcggcctcccacagtgttgggattgcaggcataagccaccacgcctggcccttgaaattcgttttattttgttttcacttttagtgctgagttgtaatcacaggagtgtgattgtatgagtgtatttgatttttcttaagtctgtgtttatggtatttattaagtggcttatacacctattacacatggcattacatgaggatttctaaataggggggtagcagaggaaaataagtgaaaaatatgagagaaatatgtagaattttgacaattcctaaccctcctcccaccaaaaaaaagttcaagcttcaatccagtctctgggagaaacttcagtgaaattctatctaaaggttgcctagatgttaaatgatctgtaagtgtgtgttacactgtcatttaggtgtctactgagagacctgccaaacagcaaaaacaacacactgaagcaacacatttgtatacatagaaagctgcatgcttccagtagcaaaatatttatcaagcactatgttgtgcttcatgtagcaaagaagctggaagaaaatgacaaccctaaccacacctcactgcaacttacagtgtcctaaagaaaagcaaaatgtaaataggcaaataaattgcaaggctatatataggtgactgtgagtgagtgtgtgtgtgtgtgtgtgtgtgtgtgtataaacagtcatgcatcacttaatgatagggacactttctgagaagtgcgtccttaggcgatttccttcttattcaaacattatagagtggacttacacaaacctaggttttatagcctactaggtaactaggccatatggtatagcctgtcgctcctaggctgcaaacctgtacagcatgttactgtactgaatactgtgggcaactgtagcacaattgtaagtatatgtttatctcaatatagaaaagtacaataaaaatacagtataaaatattaaaaacggcagacttgtatagggcttttaccatgaatagggtgtgcaggactgaaagttactctcagtaagtcattacatgagtggtgagtgaatgtgatggcttagaacatcaccatacactactagaggtggtataaacactgtatacttaggctaaactaatttattttatttatttatttacttgaatagttttgggggagcaggtggtttttggttacatggataagttcttcagtgctaattactgagcttttgatgcacccaggatagactaaatttattttaaacttttcttcgataataaattaaccttagtttatgttaacctttttacttcatcaactttaatttttgtgtctttcgagataatatttagcttaaaaaacattgtagagatgtacaaaagattttttctttctgttcttgtgctataagcttttatcttttaaatattttacttatttatttactttttaaacctttttgttaaaaacagacacaaacacacacattaacctcggcctacaaagagtcaggatcatcagtatcactgtcttcttcccccgctcttgtcccactggaaggtcttcacggcagtaacaggcatggagctgtcctctcctatgataacaaaggtttcttctagaatagttcctgaaggacctgcctcaggaaacattaactgttttacagttaatttttttaatcaatagaagaagttaactataaaatactaataacaattatactatatgaaatacattaaccagtaacacttctatattatcatcatcaagtattacgtactgtacaaaattgtgtgtggcatatttttatgtgactggcaatgctgtaggtttgtttacccccggcattgccacaaatatgtgagtaatatattgcactgcaatgttacgatggctattaggtgataggaatttttcagctacactataatcttatgggtccactgtcatataagtgatcagtcattgaccaaaatgtcattatgtggtgaataactgtacgactgtatatatatatatatatatgtgtgtgtgtgtgtgtgtgtgtgtgtgtgtgtatcccagaagaaatgtattcacaatattctatcaaaatattgagacaataaaaattattttctacttttgaaattggtggttgtgtaaaggaggcttgcaagaagacattaacactcctagctagcaccattgcagatatgcacaatgaatacttgatgaatgtcatagaattctttctgaagcataggtacaatataaatggttgatgaaaaccaagttattctggatagcaaagaatatgtaggtacaaatgtatgaaaataaactactataattttggaggagtgaaggataattgaaagagttatggtaggttaatactatcaagacgggagtctttccctcaacacctttaccaaaactatctaatgtcaaattttaaacagttagataatcaatttcaggtttcacaaggtgaaaatatttcaaatattgtgcaacattaaacattacttctagatagatgaaaaagagaaatttctcttgatttgtcagcttaatttctgcacacatctttcaaataaggtgaaaaataaaattatttcttatgcagcagtactatattgcaaaaatatcttgacataaaaacaaagagcagtattatattgaggaaatatcttgagctaaatacgtactcaaagataaagcatatcaaacccatagaacgtacaacatcaagagtgaaccccaacataaactatgaactttgggtggtaattatattgacagtgagggagcttatgcatgtggtagggaagaggaagtggtatataggaaatctctaccttccactcaatcttgctgtgaaaaacctgtaaataaagtataaagtctaataaaaaatatgtgtgtatatatatgtatgtgtacacaaaaaaagagtaaaaagtatgaagatttcacccattttctacattgttttaatatatcttgcaccatagtgtgtatggatgtatttatacatatatacagtagtcctttagcatcctcaaggaattggttccaggacgctacccacccccagcagataccaaaatccaaggatactcaagtgtctaagagagaatggtgtagtatttgtacataacctgtgcatatcctcccatacaatttattttattttattttaattttttttgaggtggagtcttgctctgtcgcccccaggctcgagtttagtggcatgatctccgctcactgcaacctccccctcctgggttcaagtgattcttctgcctcagcctcccaggtagctgggatcacaggcgtgcaccaccacacctggctaatttttgtatttttagtagagatggggtttcaccatgttggccaggctggtctcaaattcctgacctcaagtgacccactcacctcagcctcccaaagtgctgggattacaggcatgagctaccacactcagccctctcatacaatttaaggaatctctagagtatttataatacctaatacaatgtaaatgctgtaaaaatagttgttatattgtatctttaattgcattatttttattgttttattatctttattgtttttttcaaatatttttgatctgcagttggttgaatcagacgaagtgaaacgagtggggctgactgtatatatatatatatatatatatatatatatatgtgcgtgtgtgtgtgtgttcacaagtataaatatataaatacaaatatacaaatacatatttgtatatacaacattaaccagaatttagctctaactttatcttgattgagttgttcttagtgattttcttatattccctaaattatttccactgaaactatattaactttgtaaccagaaaatattcaaaatgatattaataaacaaaaaacaaaactacatatccaacatctttactgcaccagaaaaaaaaataggacagagtttctggcagagacacctatggcagtcaatgagaatagagaaaataagtaaattgagagctaagaacaaccctatcacttttctactgtatactatgtagatcaggaagatttgctactcttacactctgtcttcattcttaaattgttgtgtgtgggttttattcttgaagacaatgcaggagagttcatatttcatatcactccaaaatataaattttatattcattaacaattacctcctcaaatagtcatgtactcctagttagtgatgcttttcattcctaatttgtacactggaaagcatttaagctaaaggcatttaagctaaatgaaagaaaaacactataagtgagatgattaaaatataatctagtgatttatttatgtaacttattatgtaattcttcagttttatgttattttcccagcaacattttgtgattttccaaaaataaaccatggaattctatatgatgaagaaaaatataagccattttcccaggttcctacaggggaagttttctattactcctgtgaatataattttgtgtctccttcaaaatcattttggactcgcataacatgcacagaagaaggatggtcaccaacaccaaagtgtctcagtgagtaaatgctctgttcattaaatggatgtcattcagtgaatagagaaggatatgccagacaagatcataaggtcttgataatcacagggacagtgaccaaagaagctggaaagatgggagatgtagtccccctattttgagatgcctcctataagaatcaatgaagaataaatatgtcaactgtcttgtgttacctggaaatgctctacgtgttgaaatatattaatttttttaaactgatctttaatatatttgactgctaatatttctttactaatattcatttcgcagcagcctgatcaaagttttccttttaaatgtcatttttatacatattctgttttgaatttaccattctttagcatattgaaaggaggtttagcattttcacttttatatttcaataaataatttctttggtccttcacagtgtagctatattaattctccaataaatgtagagagcagactccaatgataacaggtgtattaaaagaaaaaaaaattgggagacagatacatgaggcaacaaaggagatagcaatgatctttctcctaagaaacatttatgagagttaagagagaaatagatatatgaagaggttcttttgtccctaaaaggttgacaaacataaaatatttcattataaaaaccatagagcaagaaaatgaaatattttcttctatatatacatataaaagaaccaaaaatatgtttcatcatatatatagtagcatgagttaacttcttttgaaagtgtttatatttgatttcagctttgaaagctttcctttttaattttttttgttcgtttgtttgttttgttttgtttttgagccatctcaactcactgctacctctgccttctagattcaagtgattctcctgtctcagcctccagagtagctggaattataagtgcgcaccactatgcccgctaatttttgtatttttactagaaacagggtttcaccatgttggccaggcaggtctcgaactcctggcctcaagtgatccactcgcctcagcctcccaaagcgcagagattaccagagtgagccacttcacccggtttattaaaatattttaaaatgcagttgtactttttctttgctacttccatcttgtacattaatccgtttttggtccttaggactgtgtttctttccttttgtggaaaatggtcattctgaatcttcaggacaaacacatctggaaggtgatactgtgcaaattatttgcaacacaggatacagacttcaaaacaatgagaacaacatttcatgtgtagaacggggctggtccacccctcccaaatgcaggtccactggtaagtacaatgctgttctctcatatgctgttatctattataaagtttgagagaaataaatcttttttacaggttaaatataggttttgccacatacttttatctttattcatttgattttcagttccaattgtgtccaagtggatgttgaataacatagtttgcctacctatataaatcaaatgttctcaaagtgtggtcgctaaaccggtagcatcatcatctccttggagattgtttgaaatgaaaatacaattccataagctcattctagacacacggaatcaaaaatgtcgaaatagaaccctgaatctgttttaccaacccctccagggaattctatgcacacttctgtgtgagaagcattgctatagtctattatcactacacatggacctgaaactctctgatgaattttgcattgttcagcatagtatccttaatcattggcaattaaattatctgaagttatttttattattatagacttattttcttttatttttccacatctccaatttagatcctttgattaaccattcttcttctctactaacttgggtaattttcaaaatgtgtttttaaatctttgcttattcactaagaaaatgcctatttgtgtttatttttaagaggctaaaatgtataagcaggatgattgcaaacaaaaatctggtatcacataatctatttatgctgactttttgcattttataaattaatgttaaataaatagaactggtaatatttgtttactcaaactcaaagagagatatccaggaaaactttcgtttacactggcttccagaagggaaaaataaaggtctatcagtgttctagcgaaggatgaagaagaaatttaaaacatcaaagcttgtacctgacaaaaaatagtttcatgtcttttcttcaatattacatttaaatttattaaaatcaacaaaatatttgatgagattgtctacttattttaaattcgtcttgaaacatatttgtaactgtattagttgatttgctactcaaaatgaacactaggtggaaccacttcttttttttctactcagacacttcctgtgtgaatccgcccacagtacaaaatgctcatatactgtcgagacagatgagtaaatatccatctggtgagagagtacgttatgaatgtaggagcccttatgaaatgtttggggatgaagaagtgatgtgtttaaatggaaactggacagaaccacctcaatgcaaaggtagagtattatatttcttttaacattttgggggagtatagcagggttaaaatatgttgatttaaacaaaatgaagtcatttttattaatagatttttcaaatgcaaataaaatgattgatggtgcttaaaattcaattcttcctgtgaacagaacacaagtaatagggtgtattatttttgagaaagattcgaccaaattaaaagagttggaacctgaaaaacaatactttttaagcatcacaacacttagttccttctcaggaatacgtgtaataaaagatacattatgtgcatttgacagccataagtgatgtgcattctaagatatggaataggcagttgaagagagatcatagactgtgatataaatgtgggcatcttcagtatatggattatatttaaaggtgtgtgactgactgtatttataaaaagaagtccgagcacatagtcctgggtcattctaataaatagagatggagtaagggaaaccagaaaaggaaattgtatcttacttacctttatgttttaaaattaatgttgtcctgtgtttttttttttttttcactattttacttagactctacctatgtttattattgaagtgagtttttgtagacagcatatagttgggtcatgtttacatatccattcatcctttcatggcctgttaactggtgcacttggaccaattacacttaacataattattgatatataggacttaaacctctgtcatttatttgtttctgtctgttccctctgggtttcagtcctatttccctattcctccattccctgtagggaaaattattaaggagattaattttgattcatatgtattgttttccattgtatctctttgcatagcttttcttctccttttaaaaagttgttgctctagctaatactatatatatgtaataatatattactgtctactggcactgacatttaaatcaacaactggaatatggaaagcttactttcatgtagatccatttatactctccacattgtaagtataaatgccagtcgtattttctctgcatgcattgagcaccatattaaactcatttgcttcaaatatcaaacataattgaaaaaacttatgaggaaaaagatatcgtgttatattgactcctctttttatccattatatcgttctattttttcaggatcctgaagtctcaagctctttcttttatctgttttattttaatttgaagaattcctttagttatctttaggcataggtctactggagacaaattctcttggtttccctttctctgagaatgtctatatttacccctttacttgtaaaagatcgtgtcactggatatcaaatttggagttgacagttctttgaacacttgaaaactgtgccacatggttatagatgaaaaacttaccatcatttgaattgttgatcccctcaaggaaaagcatagtttttgtctagttgctttcaaggtatttttttctttttttaaagtagttttattttaatgtatattggtataaattccaatgtttttatcctctttggagttcactcagcttcttaaatataagtttatgccttattgtcaaaatgggaagttttcaggtatccttttatttattcatttttccagcccaatatcctttctcttctttttctgcatctgcattatttgttgttgtatttttctgaatgtctcagttcagttttttgttttcagtctattttcagagtgggtaatttatattgctgtatgttcaagttcatggatttatttgtctgtcagctccccatgtattattaagtatattcagtgtttttaaaaaatttttatcatacttttccattttataattcctacgggatttttaagaaccatcatcaatttcaaaacccgtgtcctcttagtgttactccaaagaatgttgaatatgaaataagaaactttctttgtcatagttttctatgtttagcatgtattcattcggaaagatatttcttaatcctgatctaccataagcagcaatatttgttaatgttttatgtgttccttcagtaaggagaaaagaacttaaatatattactttcagtttaaaggattaaaatttcttccaggactcatttcttttaccagaaatcacaaaactgttgatattatataaagtgctgtgtttgtatttgccttatttgaacttgtattttgatttgctctcacaataaatcaagtgatgaaatgatgttttttagattctacgggaaaatgtgggccccctccacctattgacaatggggacattacttcattcccgttgtcagtatatgctccagcttcatcagttgagtaccaatgccagaacttgtatcaacttgagggtaacaagcgaataacatgtagaaatggacaatggtcagaaccaccaaaatgcttacgtaagtactttaatattcacgtggctggaaaaatcagtgtgatgagtctgatattttgctgttggtaacaaaataatcacagattattgaacaaccattctgctgaatgcctgcctaccaaaaatttcttttagaaagtaaagtttagaaattttctctttagggctgggtgtggtggctcacacctgtaatcccagcactttgggaggccgaggcgggcagatcacgaggtcaggagattgagaccatcctggctaacatggtgaaaccccgtctctactaaaaatacagaataataataataaccggcatggtgacgggcacctgtagtcccagctagtcgggagtctgaggcaggaaaatggcgggaacccgggaggcggagcttgcagtgagccgagttcgcgccactgcactccagcctgggcgacagagcgagactccgtctcaataaaaacaacacaaaaaagtaatttttctctttatatttatattttattttaaagaatttagttgataaataaaaatatactttcatgtttgacaatatgctgttttgatatatttatgctacaatgattaccacaaattaattagcacattcttcatcacctatgcttagcattgggtgtaggtgggtgtgtgagtatgtgtgtgtgtgtttgtggtgaggacacttaaaatctgctttcttgccaattttcagataaacaatacaatattattagctctaaatatcactagatctctatgtttgattccaagttcttattcatattatagctgaaagtttgtactctttgaccaatatcttaatcaaacaaaagcagcaatgataagttctaaaatgcagggatcctaaaatgacaactgatgtaatgaatcattgataatacacccctaattctcatacattaaacataaaacctcattttcacatcgattaccattttaagtttatttaaatcaatatgatgtttttacatagtcggtttggacagtgttttgagaaataattcctgaaccatcatataacattctacttgaaaacctgaaagtctatgaagatttgcatactacttaatgttttatgtttactgttttttattttcagatccgtgtgtaatatcccgagaaattatggaaaattataacatagcattaaggtggacagccaaacagaagctttatttgagaacaggtgaatcagctgaatttgtgtgtaaacggggatatcgtctttcatcacgttctcacacattgcgaacaacatgttgggatgggaaactggagtatccaacttgtgcaaaaagatagaatcaatcataaaatgcacacctttattcagaactttagtattaaatcagttcttaatttcatttttaagtattgttttactcctttttattcatacgtaaaattttggattaatttgtgaaaatgtaattataagctgagaccggtggctctcttcttaaaagcaccatattaaaacttggaaaactaactgttgtgtccagttcataaaatgtttgtggcaagaaattagatgcaatttttcagactttatttctgttcatcactcttaaatctctcaaagctttctccacagcttctgaggctcattgttttacagtaaacggaaaacatatcattgtctctgatttcaaaattatatcactttacaaagatgtaaaaaccaagtcaagtcttaattcatgttggtaatgagatataagtaattacaatttatcaatacataaatgcaccaaaaatgatatcaatacattaatgcaccagaactgatgaaatgtagatacttctacaagatgacaatctagcacacatgataatgcaaactaatcataagaattaaaacgtaattgggtatataaatattacaacataaacatacaaaaaataaaaatacagtatcagttataacatgctcacttgcatgcactcacttgcaaacatagaaacatgatacttttgccctgatttaatgtttatagaaaaaatattgccaggaaattcaaaactatagttaaatgtgtgtgtatatatatatatttatatgtatgtgtatgtgtgtgtgtgtatgcgtgtgcgtgtgtgtgtgtgtgtttagagatagtcggggtaaaagttagggtttaattcttttgtatatatcggtatcctctgatttttctacctttaacatatatcactttggaaacaaaagtacaatttattttaaaataatgatgtctaacaagcaaggcggtgcatgttgagaatgataaagatttcatcagtaatgatcttaacatcaaatagcctcttaagtatttttggagtagaagagttttggaaatttcaatagtaaggttctgaaatgtaatttttatattcattctttttaatcagcactagttaggtaaaatcatttttgattaggaacattttaaactcataaaggaggtgaagccattatgtgaaaaataaagatatcaataatacaacacaaatattatttaatgataccttattacttcttaccatataaaatcaggtggcttatatactcaggctgtctccttgttagtgatcctgatttagataaattgcttgagttgaggaaagccagatttcaaaaatctaaaggacatttgttataattagcaacttatgttgatagaaatgttaacacttaggaatatatgtttattcctaaattgttttagtacatttgggccactataagaaattaccataaactggctagtttataaaaaatagaaatttatttcatacagttttagaggctgagattttccagcttaagataccaactgatttgatgtcttgtaagggcttgctccctgttttggtgccttcccactatggtgccttcctactatgtccttacaatgtggaaggggcaagggagttccatgactcttctttgtaaaaagactaatccaatgtattagggtggaatcctcatgacctaatcacctaaaaagtccttactttctgatattatcaccatagtgatgaggatgtaacatacaaattttgaaagggtactactatgcacaccatagcacagcatagggataaacaaatatgttccatgtaaatggaaaccaaaagcaagcaggggggctatactaacattaactaaaattgaatttcaagtcaaatctgtaaaaagaaacaaggaaggccattatacagtaataaaggagtcaattcacaaatagattataactattgcaaatatatatgcactcaacatgggagcaatgaaacttataaagcaagcattaatacatctaaaggaagaaataaacaatgcagtaatagtaggggacttcaataacccacattcaacaatggatagacagtctatacagaaatcaataaaaacattggacttgagctctatgttagaccaaatggacctatcagacctatatagaacattccatttgacaacagtagaataaacattcttctcaagcacacaaggtataatctccaatatagatcatatgttgggccacaaaacaagtcttaaaaaattttaaaaagattgaaattacataaatttttttaacattgtcatatgaaattagaaaacaatagcagaagaaatgttaggaaattcacaaatacatggaaattaaacaacatgatcctgaacaaccaatggggcaatgaagaaattcaaagggaaatttaaaaatatcttgagaaaaacaaaaatggaaaagcaacatactaaaaaacatatggtatgcaacaaaagcagtataaagggatgtctagagatatgaatgactccatgaagatcctaataaagcaagtaactttgtatctcaggaaactagaaaatgaagaaaaaaattaacccaaagctactggaaagaaaaaaatagtaaggtacagaacagaagtaaataaaacagactggaaaaataatagaggatccacaaaactagaagttggcttttgaaaatataaacaagattgacaaacctttagctgaactaaaaaagagagaaggaacaaataaaattagaaatgaaacaggaaacattgtaactgatagcacagaaatacaaaaaaacagaagagaccgctataaacagttatatgccaacatataactgttggataacctaatagaaacagatacattcatagacatctacaacctaccatgattactgaaacataatgaaatacaaaattaatacagaacagtaatgagtaagaaaaatgaacaagtaataaaaagtctctcatcaaaaacaaaacaaaacaaaaaaaaaactcgtggcttcatgacagatggaatcctaccaaacatttaaagaatcaatcctaatccttcccaaattctgtcaaaaatttaagagtgaactctcagttttattatatgagggcaaaaatcgtactgacaccaaagccacacatggatactaaaaaaaacaattagaggtcaatattcttcatgaatatagaggtaaaaatgctcaacaaaatacctccaaagtgaacacaacacattaaaagaatcactcgccataatgaaaggggatgtatatctgggatgtaaagatagtatacatacaccaatcaattactgttccacaccgaattaaaagaatgaaaagcaaaaattgtatattcatctcaatagatacagaaaaagcatttaacaaaatcaacatcctttcatgataaaaagtctcaacaaattagccataaaagaaattaccccaagacaataaaggctacatatcacaagctcacatttaacattatactcaagagtgaaaagttgaaacatttttgtctatgatcagaaaaaaaaaaaaaaaacaaggaggctcactctcaccacttctgttcaacatagtgctggaaatcctggctagagctattaggcatggaaattggaaaagaagacagttgtctctgtttgcagatgacatgatctcattatatacatggaaaacccaaggacttcaccaaactttgctaaaagtaataaccaattcagtaaagttgcagggtacaagatctacagacagagccagttacatttctatacactaacagcaagctattgaaataagaaattgaaaacaaacatctaatttacaatagcatcaaaaataataaaatacttgagactaaatcaaagcaaggagatgagagttctgtacactgaaaactataaaatattgatgaaagaattgaagaaaacacaaataaatgaaaagatgtcctgtcttcaaggatcaaaagaatcaatattataaaattgtcttcaatacctaaaactccagattccatgcaatattgtcaatattctaaacacatctttcacagaaatggaaaaaaaattctaaaattaatatagaacaagagacaccaaatagctaaagcagtcttacaagacaaaaaaggaagagacagcacactatcatgctctctggtttcaaattacactacaaatctataataatcagaacagtttagtcctgatacaaaaaagatacatagaattaaaagctccgaaataaaatcatgcatatataaaggcacttccaaatattcatggaaaattgaattaaaataagaaaattttaaaactacactttatttcttaacataagctccatcaagttcaacacacttttgaaaacagtgatacaagccatttagtccatccctaaagactcgatggttctgggactatatccatgttaagcagtctttttcacataattaactgaaacaatgggtaccctttgtaagattttttaaaattaggcaaaataaagaagtcaggagaaggcaaaccaggactttaatgtaggaatgctcaaagatttcccataaaaattctcacaaaattgtttttgtctgttgagaggaatgagcaggagcattgttctggtggaggaggactctctgatgaagttttcctgggcatttttctgctaaagctttgaaaactttctcaaaacattctcttaagaagcaaatgtttctctttggccttccagaactcaactagtaaaatgccttggccatctcacaaactgttgccatgatgttttctcctgactggcctgcttttgctttcatcggaccacttccacctttggtatgccattgctttgattatgttttgtattcaggatcatactgataaactcatgtttcagctcttgttacaaatctttgaagaaatgtttcaggttcttattcccacttgtttaatacactttccgttaaaaactattcccttgctggccgggcgccgtggctcacgcctgtaatcccagcactttgggaggccgaagcgtgaggatcacgaggtcaggagatcgagactatcctggctaacacggtgaaaccccgtctctactaaaaataaaaaaaaaatctgcgggcgaggtggtgggcgcctgtagtcccagctactggggaggctgaggcaggagaatggcctgaacccggcaggcggagcttccagtgaactgagattgccccacagcactccagcctgggcaacggagccagactcagtctcaaaaacaaaacactcttctcttgtctactacacctcatctgggtgcaatggtcttgggtctcactgaatggaaattttgctataacattgattttcccatcagaatttgtaagatgaactaattatggtgttgactattgattctgctcttagtcatcagtcgtctttaatccagatgtgagcaaaattatttttttctcacaaattagtgtggctagtctgccgctgtgggcttcatccttaacattgtcttgcctctgcctaaaatgagttatctgtttctaaatggctgatttcttttggggtgttgtccccataaatttttcaataatttcactgaagctccatgacaagtgttggttaggatgtggaaaaaaggaaacacttgtacattatgggtgggaatgtagattgttacagccattgtagaaaactatatggaggttcctcaaaatattaaacatagaactatcgtatgactcagcaattccacttctgggtgtataaacaaagaaaacaaaatcagtatgtctaagaaatatctgcactctcatgttttttgcaggattgttcacaatagctatgatatggaaacaacttatgtttctgtcaaagatgattgaataaagaaaatgtggtgcatatatacagtggaatacattaaattctgcctttaaaaagaaggcaaatctgtcttttttaacaacattgataaacatggcagatattaagtaagtgaagtaaaccagacacagaaagacaaatgctgcatgatgtcatttatatttggaatctaaaaaacacctgagctcatagatatggagagtagaagtatagttaccaggggttgcacagtgggagaaatagagagatgtcagtcagaggatacaagttttaagacaaataatttctggagacctagtgtaaagcatgatgactatagttattaataatatattatatatttgaaattacaaagacaatagttcttaagtgttctgatgtcattcatacaaaaggtaacaaggtgagatattggatatttgattagcttcattatgataatcattataaaatgttatgtatatcaaaataatatgttgtataacgtgaatataaaaatttgtatttgccaatgatacttttataggggtgaaaaaattgattacattaatcagtaaaaatggaagttaatggaccaaaatattacttctaggttttgaaatataaatatgtctttttgtaaaaacagaaaggttttttgtttgttgtagttgtttgtatcaccttggagtcgtgtattttgatttattcaatctggatatctctggaaactggctcctcattgcttctcatgtgccctaattttatctgagtatttctctctttttttttcagcataacatgttctaagttcactttatatttcctctgcccaacattcaaaatcatacacctttcctagaaagtctgattatttttaaagcagaataaaatttagaactcaagaaccatgaagtattggtaatagatgggaatgtccaatactttggaaatataattattttcagggatttttggtggtaaaatctttgaaatataaataaaatataaaagtttgttgttctcactggattttacaattcaaatttaataatacatctgtgaaaacaactttagtatatacatgttttcatttttgtgagtatatggtacgtctatgtatgtatgaggtacataaaatattttgatacaggcatacaaggtgtaataatcacatcagggtaaatgaggtattcatcatctctagcatttatactttctttgtgttacaaacaatccaattatccctcttattttaaaatgtgcaataaattacttttgactatagtcaccctgttgtgctatcaaatactagatcttatttattctatctaactatatgtttatgctcattaaatatattcttctctcatttgtctttactgactcattcatgaaaatgtcaaaagtgtaatgaaacgttgctattagtagttaaactactaagtgaaaattaaaatttctttgtgtttattttgcccctagatagctgactctgagtgcgaatcttcttttcaaaaatgatttaaatacttcttatctctggttcaccctattaccgaatccatagagttgtatattaattttcacttgttttcttcattcttagattttgcttttttcattcttatatactaacaataaactgtctgaaaaagaaatttaaagatctattccttttctgataacaccaaaaaataaaattaggagtaaatttaaccaaggatctcaaaaatctatatattttaaacaatacaatattgatgaaacaaattgaagaagacacacataaacagaaaaatagcccatgttcagggactgcaagatttaatatgggtaaaatgttcatattacacaaaaagatgtaaggattcaatgcagtccccatcaaaattctaatgtcatttttcacagaaaaatgaaaaacagttcaaaaatatgtatgaaatgacaagagatcccgaaggtcaaagtaattttgattaaaaagaacaaagctggaggcattacacttctaaattttgaattatgatataatgctattataggcaagatagcatgacattggcataaaacaagacaccaataaaacagaatagaattcaatatattttcaataaagatgacaagaactcacatagggaaaataatagtctcttcaatacatcttgctgggaaaatcggatattcacacatagaagaatgtaattgatccgctgtttcacactacataaaactactcagaatatatgtaagactgacatgtaaagcttgaaactataaaactgctagaggaaaataaaagagaaaaaaatacatgacattggtctgggctatgatttcttggattggttccccaagcataggcaacaaaaggaaaaatacacacattgtattacatcaaactaaaaagcttctgcacagcaaagtaaacaatgcccagagtgaagagacaactcatgagttggaaaaatatttgcaagccatatatctgataaagcgttaatattcaaaatatataaggaactcaactcaatggctaataaaaaggaattaaccaatttaaaaataggcaatgtacctgaatggacatttctcaaaagaagacgtaccaatggccaacaagtattattatcaacaatacaaaaaatcatcaagtgttatcaaacatgtggagaaaaggacacacttgcacattgttgatggaaatgtatattagtatagccattatggaagatactatagagtttgtcaaaaatgaaaagcagaacatataatcaatccagtaatcctactactgaatatatgtacaaagaaaaaggaatcagtatgtcaaagagttatctgcattcccatgttcattacagcattatttataatagccaaaatgtggaatcaacttaagtatccattacagatgaatagataaagaaaatgtggtctatatacacaacgtaatactattcagctttgaaaaaaggaaatcctgcattttcaagaacatagaataaacagggaggacattaagttaggtggaataagacagacaaaaccacatgattgcacttatacgtgcaatccgttgtaaaatatggtgactttagttaacaataatatgttgtattcttgaaaactacttagtgtagattttaagcagtctcaccacacacaaaaatgagaagtatgtgaagtaaagcatatatttattagcttaatttagccattatctaatgtatacatatttcaacacaatatgttttacataataaatatatgcaattttatttgccaataaaaaataaatgaaaatgtttacaaaaagagaatatgtggtatagatacacagtagaatactatacaaactaaaaagaagacaattttgtcaatagggaaaacgtggatgaatctagtggacattatgctatctaaaataaagtcaacacaaagaaaaatcctgcatgatcttattgatatgtggaatctaaaaaattcaaatttacagaaggtgagagtagagtggtggttaccagaagctgaagggatggcggtgtttctaggaggtgttggtcaaagggtataaattttcagttagactagaggaatacattttactatctatttcacagcatggtgttcacacttaataataataatagtgataatattatatatttcaatattgctgagtacatatattctatttaatatatttaagcctagcctttctaactactacagaaagagaagctaaatgtctgttgtaagtatgcttatcttacaaaaaataagttcatttgatattcatgtaataaatctaatctttgttttattgattttcagattaacaaagaccttatctgaatactctttacaacttttatgtaaatctaaaattattccataggagaaattttatgtaaaaaaagataaaagtatgaagcatgtttcagtttgggtatttcactttgtattcactgaatattgaaaaaattaaaatactatcaactaatacataaagtcatataaactcctaaataaccgctgaggaacctacttacttttgtgtgtcattttggatagtcaaggttttttgctatgctatactttaaaaagtaattaatgaaggggctgactctttttttgttaatagcacacttaacaatattagtggattcctggtgttcttcactaaggtccttggtcagtaatttctgattatattttatgcaaagaactttgaaaacaccttgtgctgtattttaaagtttattatcatccatatttctgaccaatcacagatgttgcaaaaggttgggacacttggaaaaataaaattattttcaaaaatatttatttctcctttttatagaatttcaaaatcaaccatctttaaaatactaacaatagttttaaaaattacaatacttttataaagtttttacgaacactacttacagatagagtaaaatttcattataactgaaaatgttttcagtaacctgttatacttggctaagtgtcattattcaactgaaattccacctctcttcaacatttacgtatatattttcctgaagatttttgtcttatgttttgcagttattttaaagttatggaggaggttttgcttattttactatatttactatatggtttgtctttagcattattgatagatctttttcttctaaatatgggccgtattttctgcttctttacatatctagtagtgttttattctactctggtcaatgccaataacacattgtgatgacagccatggaatataaaagttacctatgggtttgtcatatatgctatttatggtattggggtacttttcttctatacatatgtttttaaattttcatgtgcacatcataggtgtacagtaggtgtatgtattgatggagtacttagaatgttttgatacaggcatacaatgtgaaataagcacatcatggggaatggggtatacatgccctcaagtatctttcctttgagttccaaccatccaataatactgtataagttattttaaaatgtacaagtaagttatcattgactatagccaaccgattgtgctgtcaaatagatggacttatttattttttctatttttttttcgtacacattgaccatccccatctcccctctagccctataccacccttcacagtctctagtaaccatccttcaactttctatgtccaagagttcaattgttttgatttttagatgccacagataagtgagaacatgtgaggtttgtatttctgtgcctggctaattccacttaaaataatgatctccagttccatccatgttgttgcaaatgattggatctcattctttattatggcaaagtagtactccattgtgtatgtgtgccacattttatttattcattcatctgttgatggacactttggtggcttccaaatcgtagctattgtatacagtgaggcaacaaacataggtgtgcagatatcgcttccatacactgatttccatacactgctgatgtatacacagcattaggatggctggatcataaggtagctcaatttttagttttctaagaaacctccaaactgttctccatagtggttgtattaatttacattcccaccaacagtgtacaagatttccctattctccacatcctcattagcatctgttattttctctcttttccatataagccattttcactggagtgagatgatatctcactgtagttctgatttgcatttctctgatgatcagttatgttgatcatcttttcacatgtctgttttccatttgaatgtatccttttaagaaatctatattcagatcttttgcccttttttgatctgattattagatgatttctgatagagttgtttgagctctttaattattctggttattaatcccttgtcagatgggtagtttgcaatattttgtcccactcagtgttatttcttcactttgttcattgtgtcctttgctgtgcagaacatttttaacttgatgtgatctcatttgtccatttctgctttgcttgcctgtgcttgtgagttattgctgaagaaatttttgcccagaacaaagtccttgagattttccccaatgttttctggtagaagtttcatagtttgaggtcttagacttaagtctttatccatttgatttgatttttggatatggtgaaacatagaggtctagtttcattcttctgcatatgaaaatccagttttcctagaactgttaattgcagagactcttttccacagcgttcctttgtcaaaaatgcattcactgtagatgtgtaaatttgtttctgtgttttctattctgttccattagactgtatgtctgtttttatgccagtactatcctgttttagttactacaactctgtagtataatttgaagtcaggtaatgttattccttcagttttgtttttattgcttaggatagctttagctatttttggtacctttagcttttgtggtaccataaaaattttaggattgtttttctctattactgtgaagaatgtccctggtattttcatagtgatttcttgaatctgtagattgccttgggtagtatggacattataacaatattgatccttccagtccatgatcatgaaatatctttttttttttggtgtcctcttctacttctatttttagtgttttactctttttcttatagagatctttgacttctttggttaatatctaattatttatttttatctgtggttactgtaaatgggattacctttaggatttttttcagattgtttgctgtcaacatatacaagtgctactggttttttatgttgatattatatcttgcacccttactggacttatcagttctaatagttttctggtgattaccttacgtttatcgaaaaaaacttataccatctgcaaacaaagataatttggcttctttcgtttcaatttggatacctttatatccctctcttgtctaactgctgtagccaggacttccagtattatgttgaataacagtggtgaagtgggtatccttgtcatgttccagtactttgaggaaattatttcagactttctccattcagtatgatagtagctgtgtgtctgtcaaatgcagctttgattatgtttgggtgtgttccttctatcttcagttttctttagtgttttatcatgaaggattttgaattttatcaaatgcctttttggaatcaattgaaataatcatgtggtttatatccttcattgtgttggtatgatgtattacattgattgagttgtgtatgttgagccatctttgcatctcaaggataaatcccatttggtcatgttgaatgatctttctagtatgctgttaaatttgttgctattcttttgttgagaatttttacaattacatttgtcagagatattgacctgtagtattctttttttaatgtgtctttgtctgattttcttttcagggtaatattagcctcacattggaagtatttgctcctcctcctcctctatttttcaaaatagttagagtagaattggtactagttcttctttaaacgttagggagaattcaacagtgaagccaatatgtcctgagcttttctttactatgaaactttttattctggctttgatctcattacttgaattaataattgatctgttcaggttttggatttctttctgcttcaatcttagtaggttttatgtgtctaggaatttgtccatttcttctagattttccaatttattggaatatcattccacatagtggctaataatgattctttgaatttctccaggatcagatgtaatgtttccttttcatttctgattttatttatttgaattctcactctttttctcttagtctggataaaggttgatcagcatgtttagtattttaaaataagaacttatgtttcattgatctttgtattttattcatttcaatttcaagtttatctgctgtgatatttattatttattttcttctaataattttggatttggattgcccttccttttctagttcattaacataaatcaccaaattgtttatttgaagtttttcctttcttttttatgtagtcacttatagctataaatttttctcttggtactaaaactgctatatcccataggttttgtgtttccattatcatttgtttcacaaaatattttaatttcttcattgatccacagtgcattcaggggcatattctttaatttccagattctttaattttttgtttcaacttaccatatggattgcaaatactatcttaaaaccagaaaacataacactgtttgcataaacaaacaagccaaagtaaactcataaatactttccaccttaattttcccttctgctttcaaactttttgttgtttctatttttatcttattttacagactatgtcttgaaaatctgtagttattatgtttcattagttcattatttagtctttctacttaggatattagcttacacaacccagttgcagtgttttaatattctgtatttttctatgtacttactattaccagtgagatttgtgtcttcaggtgattatttattgttcatgaatttcgttttttgattgaaatattccctttagcatttcttgtaggacaggtctggcataataaaattcctcaccttttccttatctgagaatgtctttatttcttctttatgtttaagggatattttcaccagatattctactctaggataaacgtcatttttctgtcagcatgtgtcatatcactcctgtaaggattcctctaaaaagcctgctaccagatgtattggtgctccgttgtatgttatttatttctttgttcttactgattttagaatagtctctttatccttgaccttagagaatttgattattaaatgagttgaggtagtcttctttgggttaaatctgcttggcattctataaccttcttgtacttgatatagatctcattctctaggtttgggaagttctttgtgattatccatttgaataaactttctactcctatctcgttctctacttcttccttaaggtgaatactctcagatttgctttttggaggttattttttagatcctgtaggcatacttcattgtttttaattctttatttttttgtctcctctgactgtgtattttcacatagcttgtcttcaagctcaacaattctttcttctgcttgatctattctgctattaaagaatagcacatgtaatatcttcttcagtatgtcaattgcatgtttcggctccagaatctctgcttgattttttaaaattatttcaatctctttgttcaatttatctgatagagttcagaattccttctctgtgttatcttgattttctttgagtttcttcaacaaaactattttgaattcgttgtttgaaaggtgacataactcagtttctctaggattgttccctggtgctttgtttagttcatttggtgaggtcgggttttcctggatggcgttaatgctagcagatattcttctgtgtctgggcactgaagagttaggtatttattgttttcttcactgtctgggcttaattgtaaccatccttcttggcaagatgttccacatgtttgaaaggacttgggtgttgtgacctaagctgtaacttctttacagggtgtcaaaatcccagcaatgcagtggttcttgcagacttctaggggtactgtattgatggtcttgcacatgatctgagagaattcagggtgatgagggcccctggaccagggtggtttccaggggaccagtttcaaaaaccttagatgtctgcttgatgttatatggtactgtatctgggctggcagtcatattgcaagttaaaatgttgtggggtggggtggggggatgggggagggatagcatttggagatatacctaatgttaaatgacgagttactgggttcagcacaccaacatggcacatgtatacataggtaactaacctgcacgttgtgcacatgtaccctaaaccttaaagtataataataaaaaaaaatcctcctcactgttccctcccctttccaaagtcagaggagcctcaccctatggtctaacaccactccaggccatgaggagtactgccagacaactgctgatgttcccttaaggtttaggtgctcctaagtcagtttgtggtgaatgctggctagcctaggattcacccttctgggaactgggctcccatctggtccacggtatgtccaaaaatgccacccaccagtcaagtccaggaactggggaccctgggagcccaggtggttctctacccactgtggccatgctggtacctgaagccagcaagtctcagaggctcacctaaggccctcaacatagtatctgggtatcactgcaggttattgagggccaagggctcttcagttaggctgggtgaatgctgccaggactgcatcatttccttcagggcattgggttcccttttggttcagggtatgtcaagaaatgtcatctgggagctagggcttaaagcaggggcctcattcctttgacagttgccctatcctgctttgtctgagctgatatccaagatgtaagacaaagtcttccccgttcttccctctcctctcctcaagcagaaggaaggggtttcttttggagctgtgaaatgtgaagcctggggttaggggttgggtgatgccagcacgctcttggctgcctcagctggtgcagttggtgtctctgaatattctgtgtcttcccccagtccatagtctctgagcctagttcagcactaggactcacatacgtgtgcagtccttatgtcctagactgtctttctagtttatttagagacacaatgcatggtaggtagccctaggtggcaagatttgtgggaacttgatttcagacccctgcggtcagcaataccatcatggctagcattggtttaagtactccctccatgggaaggggttagctgagtttggtttggttttcctttctgctctaacagcacagcattttgttcaatgcctcacaattgctatgttctccctccctcagtgcctagagcaaggctctgtacaccatggcacagctgcaagtgtggggagaggggaaagggtagtgtcagtgattcaagattgtctgacctatctcttacgtgccactttcagggatatgaagttaaaaccatgtactatgagtgctaatctgataatgttttcattttatgaaggtgttttttttttttttttctgtgtacatagttgttaacttagtatctttgaaggggaatggttggtgtctcctattccaccatctggctctgctctgcctaatttgtggaaactctttatcatgaagaaatgtcaaagtttctcaaatgtttttagtacttctatgaaaatgatcatatagttttgttcattctgttattgtgatatgttacatctattggtttgtgtatgtctacccatctttattttatgcatagtttgaaaaacagtactaccagttttttatactgtttggttgaattcagcagtgaagataacaggcgttgggcttttttgataggtgaattttattactgatttaatcaacttactcattatttgtttgttttgattttctatttattcctaatacgatctgtattaggaatttttattttaatttgtatttgtattttacaagctattttatttttagcttgtatttgtatttgtagctgtatttgtattttagcttgcttctcccttagattcccccatgagatgtacctaaagaaaacttggaccaagtgaaagacaaggcattatctggtagcagctgctggtagcagctgagatcaccaacagtagctttccttgcttctggaagttttcctaaaaaacatccactgcagtacaatggataattagtggggcatcactaagattcctgaacttcggaattttctggaaatagcatttttgacctttgttccctcagttcttccaatagttgtggaagcctttcgttccctttattgatactctctttactcaaaaaatgagaaataaaataaattaatgttttatattacttttggattcagtccattactgtccctaaataatattttacaagtacatttcagggaatcaattccacagatggttgtgaaaccactaactggaattattgaagcattttgcaaaactctctgaactttgatatttactaagtgaccttaaaggcctagcttcgtggtagtttcctcaaattcggaatcacccttggtaactaacaatgaaagatttcaaactccaaacagtacaactgaaacttttgcattactatactactgagaatatctaacatgttgttactaattaatgtcattctcaccttgtgggtttcctatgctaatggacaaggtaaattgaaagagatctaaacactcagctcccatcttaaatgtaacttcatgtaatatctagcttcctatgtctccatgtctacaattttttatgaaccaaagaggatttattcattatgctagtagaaatagcatattttgtaagactataacagaaattaattttatgaaatattatctcattttaacttaaacaatgaataatattctctttgtttcataagttctacagtgtaaaagacatttaatattgattatggagatatgtgaatatactcatgaaactttaagtaggaaacatgtcactagacagattctaaccttaaaatgttcagaagtttcttatttgtaatgcaaggggagtgactgatattttcataatcttacagatggtgattttttatagattcatataccaaaacatcaaataatacattttaaattctgcagtttcttttatttctataataccttaagaaagctgctaaaatgaattaacattaatatgaacttaatatttcaacaagattagcaacatgtaaatcacaacatgtaaatcacaacatgaatataatcaaaaagtagactatatgcttaacttacttttaaatgacagtaaattttgcatttctgagctcactagcaaatgttcaataaataaatacataaataattattttttatagctttatgttattgttcactgatttgttttctcctcaacagtcatatattttctatattaactatctttttgaatgcaggccttgcatattaaagaactatatcgtaacattagcagtggaaccacatgagtcaaaaatcatggacaatcaagggtttgtggccattaatgaagaatataaattttgtaattatccgaaacttcataatatttcaacaaatgtagtggagggtaatactggaaatccaattatcaatttatgagagtatcttttccctcagcctctcttctcaaagctatgccactttatttgattctaggtaaagagctttaggttttacagtattatctatcacgatttgctagttttatttgttgtgcaaaatcaaacttgatctgtgccaaaatggaaagaaaaggaaattctcctgttatttcctttgttaactgaactgatacaggtacatttttttcaaataaagattaaatagattaaaatagaatgaaaagaagaaaagtagtaccattttgaaatgactggaattagagaagcatatgcactatactttcttacttactttcttaaaagcactataaaaaaagaatgatgacaaattcttccttatctgatattccagttgaaaacttttctcctccaatgaactttttgtaagagtaaacttgagcaaaatgtcttgtaaatttaggtcgcacctatatttctcaaaggagaaagtaactcattgggttaccttcaacgtcttggttagagagaaacatctttgtgtattcagtagcattggctcaactgcatcccgccaaaattcatttgttaaagtccaaattcccaatacctgagaatgtgactgcatttggagaaggagtgcttaaagatgtaattaagttaaaggtcaatggttcaggtgggtcctactccaatataactggtgtctatataagaagagaaaataagaacacaccatatagagaaagatcacgcaaggcatagaaaggatacaaccatttacaaggcaaaggaagaggtctcagaagaatccaatcctgttgacagctctatctcaaactattagcctccagaactgtgagaaaataaatttctatgaaatcagtggtactttgttatggtagctctagcagatgaataccatgatatttacacaatttattaaaagaacattaataactaaaaataactttttactttttactcaagagtatatatatatatatgtagccaccacacagattttagaggctattcatcagaatttggtaattatatcttgggtgtattttcctgctgatttttgtcttgttgaatactttatgtgtatatatatctgtattcatctatattcagaatctagtaaatcaaatctaagaaagatttttcatatcattaatgaaggacatactttgtgaattgcttatgctaataaaatttttttaatggtagttgatatttcagttctgaacattaaaatcggcacaccaattcttttggaaaccacactatttgaaagacaaactcgacagaaaatttgtaattgtaacctattataatgttcattgaatttgtattggccattatttcttccattaagtcataagttatttatacttatttaaagataggttgtcaagagcattatttttaattatgaatatcctttcagaattgtataaactttatattcatctactagagttgccataacaaagtgtcaagggtgacaattagtaatgtagagcagggttgcttctaaatcccttttaaactgatcattttcagtacccaatgcattacagttaattgccattgtacttctttgggatgctcaaatttgtttcaaatctcactaagaagctggcttttgtgtatatttcatgtgcccccattaagctttggcataacaaaaggtcccatgctttccttgacttttgctactacagactaactttcaataatttctgtatgaaattccagtgccttttagtgggaaaaacgatttttagaaacaaacctaaactatgaaaaactcacttcaggtttgaaattatcgttgactaagaaaaataatatttggccgagtggggtggctcacaccttcatcccagcactttggagggccaaggcgcgcagatcacttgagaccgggagttggagaccaacctggccaacatgatgaaatgctttctctactaaaaattcaaaaaattagcaggatgtagtggcacacacctgtaattccagcttctcaggagactgaggcaggagtatcatttgaacccaggaagcagaggttgaagtgagctgagatcgcgccactgcactctagccttggcaacagagcaagactgttaaaaataaaaataaagaaagatttaaatgatttcctttaattaatgtccctttcttcctcggactaaatatcctgcaatcataagaaaatgtaaaagtatctcaggaggttacacagggcacggaagtttcgattttccaatacggaggagacagcagaaaactgtgcagccatgcttgaggggctgggtcagacaagctgtcatgcgtcacctaacaagcctctagggccagttctgtaactagcaaacgcttccctcaaagtaaagatgtcacgtctatgaacttagtcttctcatctgcacactaaagctgttgtgccactagcttccttcccgttctctctgatttatgatgattcaaacttaaagatttttctttagttatattcttaagttctcataacaaatagaatgtaaatactattttctatcacttgttccataattatagaagaaacataaattatatgctatttaaattgtggtgttgttcaacattctataggtatacatacctatagaatataagaatatatatatatttgtacattcgtctatgcacctattttttatgtcaataatatgtctcatctgatacatgaattctaactatggtaagaatgcatgccatcgcatacaaacaaaatgccacaaaactaaacaaaatgttttatatctggagataatttgctacatttcagatttttttatgctacagtcatatttcttgtctctcttttccaaaacacaatcattgctgatgtgtgcaccctaaactgacagcttgagcttaacttggtatagttgtagataagttcagtttaaattaatgctgataaaacctccagaattgctgaagagaccatactatgttagtagaagtagagaaagtgaaatgagcttcttgtcctgttagctgacttgagttccattaaagattttaagtggagaaataaaatgaccagatgaaaggtcattaatttatacacaggaaaatagattataaagatgagaggtcaggatcaggaaactagttacggttgctgtaatctcagaagaatttggttgagagacgatgatatcaaaggttattgccagggtttttttatgcctgttgtgtttatttgtttgtttgttttgacagaaaaaaattgagtgaaagggaataccacaattgcagaagttcagttattattgagagaggtaatgagaatgattgacatgaatttcccccaaaaaatgttctgtcaataattactatattacgaataaatagagcatggaatatttttacagctgactcagagaaaatagctattacagcaaacctatgtctatattgaaattcatatatacattcaaagaatattactctataccatttatctcaagagaactaatcttcaaagcaaaagaaatcagcaacatgtttttaattaaaattttaacttccttcaaaaatgtcttttgggccaggcgcggtggctcacgcctgtaatcccgacactttgggaggctgaggagggcggatcacgaggtcaggagattgagacgatcctggctaacacggtgaaaccccgtctctactaaaaaatatacaaaaaaaattagctgggcatggtggcgggtgcctgtagtcccagctactcgggaggctaaggctggagcattgcgtgaatccaggaggcagagcttgcagtgagcggagatcgagccactgcactccagcctgggcaactgagcaagactctgtctcaaaaaaaaaaaaaaaaaaaagtcttttttatttatctgttaagaacagataaatcattcatgcggcattcaagtcaaaaaagaattttttgttgttggcagatttacctagtggaaacaacatttgtatttagcttctaaagtaaattaagtggaggaaaatgaagattttcattaataaccttaatattaatagacaatggtggtactgaggagaacatctatctcttttaggcttcatgaggaaatgatgtttttcagtgtcgacaaattaatttcagctgtgtggtttgcccaccaaatatcatgcctgtaataatatactgtacttagcctaccatattttaaaatgattggtttccaactatcaaggcatagaagagaatatatagatagttgaagagttaaagaaattatagcataagaagcatgcaaaaagatacagttatagcattataatgactgtcttgagatatttgaaaacatttatgaaggggagcaagttaacttttgatgaggactgtcacagtcagtgaagcaggtaacagtattatccaacatcgaatcagaggtcaagtgattttctaaaagtgtgacctatacggatattgccatatgtcgggggtgggggtagaagagttgatctcttctgagccctccacgttttaagttgtatgattcaaaattatacatacaaaccttgtttttattacactctattttaaaaactgcagttatcttttgagttgattttataatttatttttgttttaattgctaatgagctcagaagcagttccttggaaaatatatttcactacacaattcagatatcttcacttgtaagcactgttaagaaaaatatgttagacagaagttaatgaggttaaagagtcaccactttctttctccaggctgcgtagatgacatctatgaaatgcgtttgccttgcagttccctgtcaaatttcttctatgtggagccgcctccctcagctcaaaacacacatttcagctctcctgctctctcctacaggaacactgctgttctgtgtaaagaggaggtagggccttgtctttcacgcaagcctggctcaattgggcacctcaccactggggttgcagccaccgctaatccccctagaatgtctgtcctctggtgtgtctgcaccagtctcctttgcgagtgaccacagctatgtccacagaattgggtgcaggggagatgtccccctctctacatctgtgcccaagcactggggccacctgtctcctaggatggatctatactcccttgcaaggcaagcacggtgcctgtgtgcctgctgaaagtggtctagtcactttcagcccacaagcaggtttctcttgcacacaggaaagtggaatgaacaaaattaggaatcaacaaaaaaagtttatcataatcttaactatttggatattaagaaatattcctagtctatttctgcggtttaataaacactggaaatcttggctcagtgacttgtttgaggcgtgaattagctgtgttatttttctgtgcggtattatcaaagaaaaatttttgtgttcctcaatatgtttatattgtccagtaattagaaaagagcctagtgaatttatttgttttctatttttatttttattttttgagatggagcctcactctgtcacccagactggagtggaatggcgcaatctcaattcactgcaaactctgcctcctgggttcaagcgattctcctgcctctgcctcctaagtagctggaattacaagggcgcaccaccaggcccagctaattttttttgtatttttagtagaaacgggtttcatcatgttggccaggctggtctcgaagtcctgacctcaagtgatctgcctgcctcaacctcccaaagagctgggattataggcatgagccaccgtgcgcagcccatgaatttaatccaaaacaataaaaaccttaaatccctcaaaatactacctccttacattgaatttttctgagaagaaaatacagggctctgtttactgatgacagtagaaaagaaaaaaaaaaggaatacctgagctaagtgataaaattgacatatttctcaaccaaaaagctcatttaattagccagaggtagggtatatgtactcaaggggaatacattaaataggtttgtacatttttccttctagagagccttcctacaaatttatgcatcacgtgatccacaagacataatctcatcttcattagcaaagaccttctcgtcacatatcttagtcatctgagttctatcatttgttttgacctagaaaccctaatggaatgtgtaattattctaagaagagaatataattcagtgataaaaaaatttatctctaatatgattatttattacagtaaaaagtattcatacttttttttgttttttattgcaagtgaaatcttgtgattttccagacattaaacatggaggtctatattatgaaagtatgtgtagaccatactttccagtagctgtaggaaaatcttactcctattactgtgatgaatcttttgagactccttcaggaagttactaggattacatttattgcacacaagatgggtggtcgccagcagtaccatgtctcagtaagtaaacctctggacagccatatatgtataaaactttcaaagattgaagagaggagagcacataagtgattacacttgacttatataacagaaatagggccaagaaaagagttgttcaagcaaaatgaccaaaatagatcttttctattatgagttcttaaaaatcacgagaaataaatatagagactttatgagaatatctatataattgatacatattttaattataaaaacttaagtagtattaaatattgatatttctttttgtacaaacctttgttagtaattttagttcatattcagttatacattgtttttggatgtttatgcaatcttatttaaatattttaaaaataattgtaatatactattttgagcacatttttgtgtctcatttactttattcatttatcattgttatcgtccttaggaaaacgttattttccttatttggaaaatggacataatgaaaattacggaagaaagtttgtacagggtaactctgtagaagttgccttccttcctggctgtggtcttccaaatgagcagaccacagttacatgtatggagaatggctggtctcctccttgcagatgcatccgtgtcactaagtacactactctgagatcccagcaagttcatgtctttctaagtaacacagatgacatgctaagactcatctatattaactgcggcaaaatatttatgtcaacttgcttcgccatcggacctatttagttttattttttcaattctgtataaacaaatatacacatttcttgataagttcatagtaaaataaatgctcctattattgggcattagtcaagaatacagtaaaagagtttgaaaacaatacttgttggttaaattaagacatattgaaatggcatcattgtctggagtaaatacccgaggtttctcatctggcactgagaagattaaggacatggacacacacaaggagtgggcgtaggatcgcaggtttaataggcaaaagaaagagaaaggagaacagctctgtctcttgtgagagagaggggcacccaaaagtgaattctggccccggctggggtgcactggattttataaacaggcttgaggaagcagtgtctgatttacatagggcccaaagattgattggaccaggtgtgatatttacataatgtgctaggaagctggctgccccaccctaatcttattatgcaaatgggatctttgcctggccagcgccatgttgccttttccttactgtacacgtggctggcaaagagaagggaagatggagttgccatatgaacatgcctagtcccaggtagccttttcctattggcacaactgctgccattcaccttgcaagcttccaacttgcttgtctatgtttacatctctgttttacaggttccactttgttagaaaaagaaatgatttgggggctcctattattaaaaggaaaactttaccaaggactcctgtaccctcattatctgcctaaataatttcttcttaactcgtgtatcaatattaatatgtactttggaatcaatcatttgactcaaaatgattatacatttatagtttaaaatagaaagtgagtacaatgatagccaataatgtcattcatacattcaaacagtcataggtcacttttacaataaagttatctaactttctctattatatgtaagtacaaatggattttctgggatattgtgcatattcgactctagaaggtttcctatattatttatcccaatatacatttatatcaacagttccttcttaggtgttttacatgttaatgattggtgatgtcacattttaatatttacaaattgagtggctataaaatgttttaccattgtagtgtaaatttgcatttcctttattactaattgggtttggaatatatattcacagtttaattggtatttgattgttctaatctttgaaaatgcaggttttttgacttacctttttgggagttttggtatttattagttggagtcatcttactaattctgaatataaaatctcttttaattatatgtaatccaaatgcattcttttttgtggctagtatttttcttcccttttttgtgtattatgaatataagttgctcgttttactaaataatcatcaatcttttcttatgatgaatattttttgtttctatttaaaggaatacttcaaaaacacagagccattatactatttttattgtaaaaatttacatgctaccttttttcatattttaaaattgtgtgttgattttattcatgataatagctatattttatttttaaataaaatatggcaaactcaacatttccctaacaatttttatagtacctttctcatacagtatatgctatattgtatattttgtcccctcccctcccctcccatcttctttttctctttcacagtgtgtcccctcccctccccttccctcttctttttctttctttctttctttctttctttctttctttctttctttctttctttctttctctttctttctttctttctttctttccttccttccttcctttctttccttccttctttccttccttctctctttctttccttctttttctttctttctttctcttcctctctctttttttttctttcttcctttttgttctcttttttctcttcctttctttcctttctttctctttcttttgttttttctctttctttctttctgctgttaagagtgaactacttttttcccctttcctttcctttccgttcttttctttctttctctttcttctttctttctttctttttttcctttctttccttctttctttctttctttctccttccttcctttcttttttctttcttctggctaataatatgctttgattgaatatgcaatttctcctggtatcaaacaactcaatcaaggtttatgcctcttgttttggatttggagttgtttgaagaatcaactacttattttctttctttctttttctttctttctttctttcttttcctttctttcctttcttttctttctttctgtctttctttctgtctttccttccttccttcattcctttctttcttttttttcttttctttccattttcttcctttcttccttcctttcctttctttatttctttcactatcccaagtgtgcctggctcaagttattcttgagaatgttactgttttactcttcatgctagaccctgtactttagtcaagttatttagctactttatggtggtcatataattaacaagtcttagcttcatcttcagattgcgatatcaacattgtattttcaatgtacagtcaattgtcagtgaatcacagtacttttcaatttaacaaaatctaaattcctcataaccatgttgtgaaaataagcagaaaaatttaaatatacttgtgcgagtacagtagacagatattggagtgtgtcctgcatgagtgcaaactggctgtggtttcctttaaaatagtcacttaaagaaaacatttgccaaatacatcacagaatatcaatttttctggacttgtaaaacttgaaatactggtgccttctgaatgattcttctgaagttagagtagtctgtccttatctgtgggagacaaaagctgcattagtccctcttatccacgtggggtatgttccaagccccccagcagatgcctgaaatagttaatactataaaacccaagtaagctacatttttccatctgataactgtgaagactactaagtgactaacaggcgggaagtataaaatgtgtctacactagacaaagggaggattcatgccctgggcaggatagagttgaatggcaaaggatttcatcacactacctagaatatttttttttattgctaagtattattccattgtatcataggtcacagactgttaatccattcacttgttgaaaggcatttgcatagtttttggcatttgtgaatcatgctggtaagaaaaatattcacctacagtttttatataaacacaaatttattcctcatggcttcatatctaggagtggctttgttggataaatggcatgtctctgtgtgtgctttttttattactatactttaagttctggtttatatgtgcagaatctgcagatttgttacataggtatatatacatgtgccatagtggtttgctgcacccatcaacccataatctaggttgtaagctccacatgcattagctatttgtcctaatgttatctctccccttgcctcccatgtcccaacaggccccagtgtgtgatgttcctctccctgtgtccatgtgttctcattgttcaactcccccttatgagtgagaacatgcagcatttggctttctgttcctgtgttagtgtgctgaagatgatggtttccagcttcatccatgccctgcaagggacgtgaactcattcttttttatggctgcatggtattctatggtgtatatttgccacattttctttatccagtctatcattgatgggcatttaggttggttccaagtctttgctgttgtaaatagtgctgcaataaacatgcgtgcatgtatctttatagtagaatgatttataacactttgtgtatatattcagtaatgggattggtgggtcaaatggtatttctggttctggatgcttgaggaattgccactctgtcttccacaatggttgaactaatttgcactcccacagacagtgtaaaagtattcctatctctccacaccctcgacagcatgtgttgtttacagacgtttttacaatcaccattctaactagtgtgagatggtatctcattgtggttttgatttgcatttctctaatgaccagtgatgatgagctctttttcatgtatttgttggctgcataaatgtcttcttttgagaactatctgttcatatccttgactactttttgatggggttgtttttttcttataaatctgtttaaggtccttgtagattctggatattagccctttgtcagatggatagattgcaaaaattttctcccatcctgtagattgcctgttcactctgatgatggttttttgtttttttctttttgtgctgtgcagaagttctttagtttaattagatcctatttgtcaattttggcttgtgcagcaattgcttttggtgttttagtcatgaagtctttgcctgtgcctatgtcctgaatggtactgcctaggttttcttctaggggttttatggttttaggtcttaaaaccaccttgtgttaatttttgtattaggtgtaaggaaggggcccagtttcaattttctgcatatggctagccaattttcctaacaccatttatccaacagggaatcctttcaacatggcttgtttttgtcaggtttgtcaaagttcagatcgttgtagatgtgtggtgttatttctgaggcctctgttctgttccattggtctatatatttgttttggtaccagtaccatgttgttttagttactgtagccttgtagtatagtttgaagccaggtagcatgatgttttcagctttgtgctttttgcttaggattgtcttggctatatgggatcttttttggttccatatgaaatttaaagtagttccttctagttctgtgaagaaagttaatgataccttgatgggaatagctttgaatctataaattactttgggcagtatagccattttcacgatattgatttttgctatccatgaggatggaatgttttctcatttgtttgtgtcctctctaatttccttgatcagtggtttgtagtcccccttgaagaggtccttcacatcctgtgtaagttgtattccttggtattttattttctttgtaacaattgtgaatggaaattcactcatgatttgactctctgtttgtctattattggtgtataggaatgctcgtgatttttgcacgttgattttgtatcctgagactttgctgaagttgcttaagaacttaaggaatttttgggctgagacgatcgggttttctaaatgtagaatcatgtcatctgcaaacagagacaatttgacttcctttcttcctatttgaatacgttttatttctttcttttgcctgattgcccaggccagaatttccaatactatatcaatactagacagatcggcaagacagaaaattatcaaggatattcaggacttgaactcagctttggaccaggtggacctaatagacatctagagaactctccaccccaaatcaacagaatatacattcttctcagcactacatagcacttattctaaaatcaacctcctaattggaagtaaaaaactcctcagcaaatgcaaaagaaaggaaatcataacaaaccttctctcagaccacagtgcaataaaattagaacacaggattaagaaacttactcaaaaccacacaactacatggaaactgaacaacctgctcctgaataactactgggtaaataacaaaattaaggcagaagtaaataagttccttgaaaccagtgagaaggaagacacaacatacctgaatctctgggacacagcaaaagcagtgtttagagagcaatttacagcactaaatgccacatcagaaagttggaacgttcgaaaatcgacccctaacatcacaattaaaagaactagagaagcaagagcaaacaaattcaaaagctagcagaagataagaagtaactaagaacagtgcagacctgaaggagatagagacacaaaaaacccttcaaaaatcaatgcatccaggagctggttttttgaagattaacacaatagatagaccactagccataccaaaaaagaaaaaaagagagaagaatcaaatagacacaataaaaaatgataaagaggatatcaccactgattccacagaaatacaaactaccatcagagaatattataaacacctctacacaaataaactagaaaatctggaagaaatggataagttcctggacacatacaccctcccaagactaaaccaggaggaagtcgaatccttgaatagcccaacaacaagttctaaatctgaagcagtaattaatagcctaccaaccgaaaatagcccaggtccagatggattcacagacaaattctatcggaggtacaaagaggagctggtaccattccttctgaaactaatccaaacaatagaaaaagaaggattcctccttattttatgaggccaccatcatcctgataccaaaacctgacagagacacaacagaaaaagaaacttttaggccaatatccctgatgaacatcgatgcgaaaatcctcaataaaatactggcaaactgaatccagcagcacatcaaaaagcttgtccaccacgatcatccttgggatgcaaactggctttatccctgggatgcaaactggttcaacatgcaaatcaataaatgtaatccaccgcataaatcaaacccatgacaaaaccacatgattatctcaatagatacagaaaaggctttcgataaaattcaacaccacttcatgctaaaaacactcaataaactaggtatggatgaaacatatctcaaaatagtaagagctatttatgacaaacccatagccaatatcatactgaatgtgtgtgtttatttttataagaaatagacaaactgttttcctgagtgatcatatattctaccttcacatactcagtgtatgcgagttccaattgttctacaacctcaccagcctttgagatagtggttgtttttccattaagttatccattctaatatgcgtgtaatggtatcacattccctagtgactaatgctgctgagcattttctttgtacttatttaccatctatgtacctcctttagtgaggtacctcctttagtccaaattttttgcccatttttcattgggttgtttgattctttactgaattttgagacaacttaatatattgtggctacaagtccttcactgagtaaatattttagaaatatttttcttgcatctctagctttacttttatttctcttagcagtctctttcaatgagcaaatgcatttaattttgatgttatccagtatatcaaatatttcatttatggattatgctctttgtaccatctaaaatttccttggcctaaaccaaggccatgtacagttctagaagttaacattttacacatagttatatgatcgttttgagttaatttttgtatgaggtatgagaaatatgttgagggtttttattttgcatttggatgccttactattccagtatcccttgtttaaaggattgtgttttctttattgaattgcctttgctccactattaaattggaaacatcttcaagaaaatcttgtaaaaacagttaaagaggaaaaagtgaaattcaattaggcttgttggacaatccatggtagtcattaggctagctttcccactggcccatttccttatagcttgtcactgattactagtacaggataacataatctttgtcactagaatctttgttccttttctgttctttagataaaatgtaagacactacgcgatgacaatcttgccatttgagtttctcctttaggttctgcatactaacaaaactactgatgccagccattctgaaagtcttggcaagaaactcacttagggaggactgtagtttccatatcctgatgatttcagtccctgacctgaatcaattgatgacctcaatttccagcccctcacccttcaaagactcttgcccagaaacccttaatgaaatgggtttgagttttgagaattcttcccaagtccttgcttggtgaccttgcaattagtaagttctttctctgttgcaaaccccacagtctcggtgtattgttctgtagctgtgcagccggcatagaaacctgacagtcttgtaaaaattcatggcaagtggccaggtatggtggctcacacctataatcccagcactgtggaaggccaaggcgggcagatcacttgaggtcaggaattcaagaccagcctggctaacatggtgaaaccctgtctctactagaaatacaaaaatgtatctaggcatgatggcatatgcctgtaatcccagcttctcaggaggctgaggctggagaattacttgaacctgggaggcggaggttgcagtgagttgagatcgtgccactgcactccagccagggagacagagtgagactccggctcaaaaaataaataaataaataaaaatcatggcaagtcactctccttgtggttatttatctacagtccagtgccccccatgccactggggctgacccacagacaagcccaggcagctgcttagctatgatgaactaagggcctttgctggggccttctgtgttggcagggcagtgctgactttcagcacataaacttgtctgcagcagagaaaccatttgtggtctcagaagaagtctcaggtgagttttctcagagcagctggcaccccatttccttctgttttttttttgttgttgttgttgtttgtttttgttttttcatcttagaggccttgtgacctattttgaggtcttgttgatcctccctaagtcataggtagggccttatttgaggagacctcccctcagatggaaggagactagagggcattgcttgggagaaatgctcttggattttggaatctgaaactttatatttaaaggtcttttgtttgtgtttgtcttgttataggtatttatgtttgtggaggtgttctctgaagaaattactagtggaagaaattactaactcaggaaactcttcttgtttgtctggtcatttatattcacttagtcctgaaggagttgctagtggaatctcagcaagtctaactcagggtaaccgtctgctcttcaatccttcccagagtccacccactgaactcctgactgaaggtcatccctctccaacttgagtagatcaaatatgatgagggctaatggaaccaagtttgagccttgccaggtcaatacttgggttctgagtacggtgactagtatctgtgtttggttacatgtatataattccagccagaatgtgaaatgttaattcagttcctccctgcagcccagtgagggctggtggctttgagattattactctttctctgctgcaaatcccactgtctcagtgtattgttctgttgctgtgctgcaggcatacaaatctgacagtcttgtaactatttgtggcaagccaggtcgaggttactctccttgagggcatttactcacagcctagtgcccccttgccactggagcagacccagagacaagcactagcagctgcttagtagttctgatgaactaatggctgtcctttagttctccccatgtaacccacactgtaattttgatgggctgcatcttccaaaattgaaaagcctttgtctatcattccataaagcaaaacaagattatcttattttttaacatggcttgacctcaatacccatggggtttgggagaacagtggccactgcatggttctcatacttacagtaccatcctgtagctagatttgttatgtatgaaggaagagaaatgggataaaatcccttatgtataatgttttatgttgctttggtaaagtagatcaatgtagaaaaaacggaaaaattatgaattagcaagaaattaaaacctgtttggattgatttacaagagaaagaacttatggaggagctgcagtagcactactggcacctaagccagagtccccaccaccaaaaagtcacaaacccagagcaacaggaatttttttttttttttatggagtcttgctctgtcgcccaggctggagtgcagtggcacgatcttgctcactacaacctcaactgcctgtgttcaagagattctcctacctcagcttcctgagcagctgggactacagacacgtgccaccaagcccagctcatttttgtatttttagtagagatggggtttcaccatactggcgagcctggtctcgaactcctgacctcaggtgaaccacccccccccttggcctcccaaagtgctgggattacaagcgtgagccaccgtgcccggcctttatctctgcttcttctacccaacaggtgactccttttagctagggtatcacttatacctaacaggggactcaatttagccaggatttcactctggctctgaaaggcagtttcccctataacaactacctataggaggtgatgctgccacagcccagcctataggatttatgtgggtttattctctgttctccactacccacctatttaattagaaaaataatatgcctatttattgagaagatctaaagtttatggaagaaaaaggataaaaaaaaaatccaaagcatatggagaatctattctcctctgtatttgccacccacaatcctacctgagcagatacctaaaatttgctcaatattttgttgagttcagagaagcaaagaatggttttagaaaaagctaaggaaaaggctgatcttattcacactgactctcccagtaatccagtaagggcagctgctcagattgcagttcccacctctgtcctgggatggaatataaacactggagatagatctaacctcgaacactatcaaaactgcattttggccagcctctgcaagggagtgcccaaggaaagcggcctcagtaaggtccaggagatcaagcagaagcctaatgagtgtgcctttggaatttttagaacaagtctttgaagctttcagacaataaatggatattgactcagaagcctcagaaaatttaaagttagctaatacgatgtttatccaacaaagtgccccagctatgcagggaaagttacaaaatgtagatgaggctttggacatgtttatgtctcaattagtgaagattgtttttaatgtatttactgatcacaattttaaaaagtgaaaaataaaaacacaaggaataatgaagagaaaagctgacttgttagctgtggctctgaccctagtagtccctggaccacaacaagggccctcatcagatgctccatctaaggtaggaccacctgggcccccaaaagccaaaaaaaagggacatcccattgcaggtcccaagcagtgtgcttactgcaacaggggggacactgaaaggaaaattgcccatgccttacaaagcctgatgttaaacacagtcagtcttctgcccaccaaatgcctgggatagctggggagcttgagagagatactgaagaaaaagaccagaaatgatggcacccaggggcttatcctgactcaaacaacaccctccatatttcccacatggggcttgagatcctgatgatggtgagaaatcagcttctggacttcctagtagacatggtgccacctatttggtgttaaatatctggttgtctaaactttcctcagaaactatgaaggtgactgaaatctcaggaaaaatactgatgagatcattcctcccaattttggattctcagctagagtaaggtaatttaaagcagtttttctatacatgtgtgaatgtcccatccctttgttggggcaagtcctcttaaccaaactaaatgttaagattactttttctctgagatgattggacatccaggtgccttcagaccaagcatgtgctctgcaggccacattattacaactggaagtccttgaaagtgccctcatccctgaagagatactccaaaatgttagtccgggagcatgggaaatggaaggccagggaaaacaaaaactgcatctccagtacaagtcaagttttgtgcaggagtagcgctgccaaatctaaaacagtatcctttgagagaaaaggcacagcaatgcatttagcctctgctaatggccttcctgcaatacaggaagacttcatcattccccatgtaatgtcctaaagacacagtcctgggtcaattgaagggtggcatgcctgccatactgtgtggtatcatgtacgtgtttgatgatatctgtcgtgagatacttgggtaccagaaccttttcttctgtgttacatatctactcaggaatattgattcatacaggatttgagggctactagccaaattttcaaagtcatttatctggtggtacccgatgcttatacattattcatgactttaaccagtgagttgtactggtgttcagtcttggatttgaaagatgccttcatttgtattcctctgagtccagagtcccatgaagtgtttgcctttgaatatgaagacactgacactaaagcaaaccaacagtattgctggacaatgcttcctcaaggcttcaaaaactcactaattggttgggaggaaatacgtgctaaagagtttgggaccttcgattgaaaaatgggactttgtttatttatgttgatgacatatccatagcccccaaaactaaggcaaactgaccagaatactatactgactttacatttcttgtctgaattgggatccaaggtatccaagaaaaaggcacaaatcttgaaaccctcagttacatatcttggatttgaactttctcaggagcagagcaatctgctttcggactgcagagaagctcttgtcagggtggccagactcaggacatggcagcagctgtgaggggtttttaggtatggctggatgttgccttatttgattttcttattttgggcttatagcaaaatctccctataaagccctaagaccagacagttgacttctggaatggaccaaggaatgtcaaaaggcctttctaaccattaaataaaaattgttaatggctctggctactggtaccccctgaactaagaaagccatttaatttgttcatatatgagagagaaggggtgagtttaggagtactaacccaagacttggggaatatcatgaggcctgtagcctacttttcaaaacagctggacattgtccaaaactgggttggacttcttgcctctgagccattggtaccacttgtgatcttctccaggaggcagaagagttcactttgggttaacctagcacagtacacaccccacactatgtatgctctttgtcagagcagaagtggatctactgacttaattctagaagactgaatagatatcaggccatctccctgcataatcccagtgttactctgagagctgtttctactctaaatcctgctaactaaatctatacatgattgcttataaagtattgagcaagtttattctattcaaccagacttgaccaaaattccctttaaaaacctggacttagaaatattcactgaggaaagcagctttatgaaccacagacaacagaaggctgagtatgctatggtaaccctgtgacagatcctagatgcagagacactcactctgggttcatcagcacaaaaggcagaacttagagtcctaaacagggcatcccaactatgtaaagactcctgagtcaccatttactcttattccaggtatgcttttattgttgtccatgcttatggggctactggaaagaaaggggattcttaacctttggtgattaaaaaaaaatgattaagcatgctaaagaatcttagcctgactaaagacagtcttggtacccaagaaagtagctatactacaccaccctggacatcagtggatggacaatttggtagcaagaaaaaaatcactaggcagaccaggccactaaagggatgaccagagaaaaagtacccaaagccttgctaatgccattaatccctgaaataaacttcagcctaaaatctatacctatttggaagaagatctaaaagcacttgattgaggctttgactccaatcaaagaacccaaaatgagtagatatgtaacacagaagaaaaggttcttgtacccaagtatcttaccacagatatcatcaaacacatacatgataccacgcagtatgacaggcatgccacccttcaattgatccaggactacgtctttgggacacacttaaagaaggctatccaacaaataattctaaaatacctactttgtgcccagaacaatcttaagactggtcctccacccccagttccagggattcaagcaagaggtgcagggcaaatagaggactggcaaattgattttaacgtgatgccaagggtagcaggaaattttaaatacttgctgatatttgtagatacattttcaagataaatgaaagcattcccctgcaagaccaagagaatgtatgaggttataaaagacttgttagagaagattaccctcaggtttagatggcctgtcttcatccagtgtgactatagtgcaacttttgtagcctaggacaccatatattccaggccctcagcataatctggaatcctcatacagcctggagactgaagtctactgagaaaactgaaaagttaaatcatactataaaaaacaaaacaaacttttgctaagatttgccaagaaactaacaacctggaataaaattctgtccttctccctgctcagagtaagggtggtccctaaaagtgggcttaaataagccctttataaattttatatgggagattattctgttctcttctcagactaaggaatgccaataatatacacataaagaaattagatattatcaaatatatacaatctttaggtcacactttaattactatttatgagtttgtggttccagcagattgtggtatccaactgacattctcttgcgtcgcatccaaccaagagactggattctgctcaagaccaggaaaagtcaacatcctgaggaccacttgaaaacacagtgaaagaggccatacaatgcatgactggtgactcattcctctgttcgggtgaaggacttagaccctggattcaccacagccatataaaacccaccccgccagactctagtgctatcaagaaatgtagaaaggccaaccctatctgaatggataagtacatctttgatgggcctcaaatatcttttgaagaaaaatatcatataaataacaaacttaaagaaaattagacaaaacacatgtcctcttgacaactacaatagttactttgagcataataggaatttttgttataattattttacataaaaaggtgagataccttcctgtctattccgtgccttactgaatgcttaacccatagatttacctggtcattataattgccttggtcattacaattgctacacttatagattttacttcacaattgccttggtcattacaattgctagacttacagattttccaggcatcctataccatgctgacttagtctcctgcctcccattatttggacattctaaaatttagaaatggtcactcttgttttaaaacttctaataaatttccttttactgcaatgcctagacagggataacaacactgtagttaaactgcttcaaggtattgccactggaagaaacctaccagaatgatggatctgtcagtaactccctcaaacgattcaaaataagcatgttctgttagtcatacttgtcactgactttctgtcccaaatacgactacctatctgcaacagcttctttccatggctaatttccaggtccaactggtagtacaccaagaaatcaccaccccacatctcaatctctctctatatatcataaatggaaagtcattccataacataggccctccacggcccatggcataatgggtagacaaatgcagccaggagaagggaaataaaattaaaagtttctctttgctgcaccaaaaatatttacagtggggaatatcacacaaattttggggagcctgtagaaaaggatccacagttcaattccatttgcctatattccccatgaaaaaaaccatcaatacatgcatctttgagggcttcacttgtgtgtccccttggcaaatgtttatttgtgacacaggatcagaacatcctctgttaggacaagctcactggtgtctcaataacctgtatattgagggctcttacttattgggacactggtcagtccatcctaatgactaaagattctgcccattttcccacggactccaaaagccactgccaggcatatatcaatatatccggtgacagggccttcttgggcatcacaattcctagctatgaagtatacactaactgggccatgatcagaaacttaccggcaactttagaaataattgcaaaagaggctgctaagaacattaaggctgagaaaactctttacatttacttacccagatagttcttaacaatggagctacacttgattttctcttggctttactgaggggagtctgtacagtgatcaataccacctgttatacttatatcaatgcttctggtaaaataaaaaccaagctaaagaaaatatttcagcagtctcgctggagaccatatgtctataccacagaccctaagtctgactagttttttgagcttttcccctcgatactccacgttttccagtccattttccaagggctcttaaagttcaagctcacaattctgtttatagggcttacagtttacatcataggctgctattcaattaaatattacaataaaaccatagactgaagtactaacatgttcatgcagcaccttcagctgggtgtaacgacttgcaggttgttacaatacggtttcattcctctaatcccgactcattctctgactgtgccccttatcagcaaaaagaagctagagtcgtcattgcctgtttcccaccatattagctgttacacctcaagattaagaagggatcaagcctgggaggaactgaaactgtccctaagaaaattacataaaattgattaaggggggaaaattcatctacgctttcaggacaagcagcagtaatcattaggccagctttccctttgtcctacgtctttgtagctggtcatggattactaccaccctaggataatgtagcccttgtcacaagaccttttggtccttttcttttctacagataaaatctaagacattgtgagactataatctttctgcatgagtttctcctttaggttcggcataccaaaaaacctatcaacatactcgtcaacaaggcaaaaccacattttcacaaaaaattaaagaaattaggtcaggcatcatggcacaggtctgtagtaccagctgctcaggagatctgaggtgggaggaccacttgagcctgggaggcagaagttgcagtgagctgaggtcacgctactgcagtgaggtcacgctactgaaatccagttgggcaacagagcaagaccatgtctcaaaaacaaaaaacaaatatacatacacacacacacacacacacatacacacatcagctggtctaaagagcccagcaaaaagctgactcaggaaataatgcaggttccacatcccacatcccggtgatttcatcccccttaccctgaccaattgacaacccaaattttctagcccctcaccctccatgatccccttaaagtcccttgcccagaaccccttcacagaacagatttggggcttgagaatcctcccatttccttgtttggtgcccttgcattgattaaagtttttctttgctgcaaactctactgtctcagtgtattggtctattgctagacagtgggcatgtgaacctgatagtgttataacaaaatagaatagaagctatttacaaaatcgatccatgcatgtgagtctatttctggacaccattttctcttctattcttctgtgtgtttatcctttcaccagtgtcaggagatccttttactcactgtagctttttctaagtcttaaaatttggtaatgtgagcttttcaacttctcttatcttttgaagaattgtgtagctattttagtccctttgcctttctgtatgactttagaatcagcatgtccatatgtgtaaaacattgtgcttggttattcactagaaatgggacacactcatagatgaatctggggagaactgacatgtaacagtattaaattgttcagtccaggccgaccgcggtggctcacgcctgtaatcctagcactttgggaggctgagtcgggtggatcacgaggtcaggagatcgatcgagaccattctggctaactcggtgaaaccccatctctactaaaaatacaaaaaattagccaggggtagtggcgggcgcctgtagtcccagctactcgggaggctgaggcaggagaatggcgtgaacccgagaggcggagcttgcagtgagccgagattgcgccactgcactccaccctgggcgacagagcgagactctgcctcaaaaaaaaaaaaaaaaaaattcagtccatgagcattatatatcctttgatttagtaagatcatacattcttacactagttttttttgtgtgattttcagcatacagatcctgtattttattagatttatcactaaatattttgtttttcatgcttcagctacaaattcaatttgtttaatagatattatttattaatgctacctaatccttcttcagtgagctgtgacagtttgtggctttagtaagtttctagttcattcaagttattgaatttattgacatggcattattcagaatatttctttatttttcttttaatatatgtaaaaaccataatgatgtcatttctgtcattgctgttataagcaatttgtgtcatctttttttctgattcagtctgtctaaggtttctcaattatagagatctaaaataacaagcttttggtttccttgtttatatacatatttacttattatttcatctctgatctttattgtattatttcttctgcttactttgagattaattttttctactttttctaatatctaatggtagaggctaaggttactgaagtggaacactgccattttctgtcccaggtatttagtgacaccaatttatttcatactgctctagtgtcattccacaacttttgatatgtagtttggctggagtagggagtttggctggagtagggtgagtataccataaaagatttactgtgttttttggaggcaggtggggagagggaattattgccaaaaggtgggttattttatgtatttatttttttaactccactctgtattttagctaagagaagcagctttggaacttctgaagtctgtacatctctgtggcccccaaggattacttgttttaaattttgttttaatagtctaagtttatcatgggtcaacttgattctttcaaggcttatttttaagcttttaaaaggctggtttagcggctgcctggagcggagcgctgcgagagctgcgcggcgcgcccaggttccagccggctccgctccgggtcccccagtgctcgctggctccccgcttgagccagcccgcccgcccagcgctaggggccaaggagcgaaccgcacctgcgatccgattgtccggggcacgccgtagaggatgggaggacccatgaggcgctagcctgcgaaggtggcggtgctgctgctccggctgctcttggagttgcatgtacacgacgtggcagactttccaatgggaggattgtggattctgatgacataggaaacttcatcttccagacattgccacagaaagcacacagactttggaaaccagcagacctgaagtcaaatgtcgactttcagcttgctcctgtgtcacctttgtaagttaattcacctctctgagactttagtttgctcatttataaaccacctaactcccagggttcttatgatgttaagtgagatttcatatgaaaagcacctagtggattacaggcattccatgtatggcaactactgtttttgccttctgaatgagctggaattaaaagagtctctacatcattggacatttagggaaatgccaattaaaatcacgatgagctaccagtacagcatcagatggctaatatcaaaaaacagataataagtgttagtgacgatgtagagagaccggagccctcttacattgttgatgggaatgtaaagtaatgcagctgccttggaaaacagtttgacagtctctcaacaagttaggtaaggagttaccgtgtgacctggcagttccactccaggtcttggagtggtcttggagtggcatgtacccattctgcttttcttggtatgtacccaagaaattaagacatttgtccatgcgaagatctgtatgcaaatggatgtagcagccttatacataatagccaaaatgcagtatcaacccagatgcccatgagctggagaatggataaacaaaatgtggtgtcttcatagaatattgctcaacactagaaaggaatgaatttctggtatatgcagcaacatacaatccagacataagagactataagttgtatgattttctttaattgaaccatatagcaaaggcaagactatggataaagatacaaagcagatcagtattgcttgcgggctgggataggagttggaattgactgcagaacaacatgagggaactctgtgaagtgaaggaagggttctgaagttggattggggtgttggaggcacagctgtatacatttcctaaaacacatcaaactataccttgaaaatgggtggttttagagtgtataaagtaaactgagctagaacttggatcacctgatccaagtatcataaattgtgatttatattgataattatgtttaaaagataccatggttttcagaatgcttgtgctcagtgggcatgagtaggagctcctgagtgcccgtgtgtgttgggtattgcagttaatccagtcctttgcactcattgaggactcttacgtgtcccttgtctcttgccacaacagcctctatcaccagaaatgaaggcttcagtagagagatattttaaaaagaaatcacaccatccaaatacaacactgtgaatttaggcttatgctgttacattctttctcctatgaatatgtttatttttacgttgttgaaattaaatatacataatgtgttttaaattaactatatgcaataaacattttccaggatgttaaaaaaataaaaatatattgattcttcctatccaagagcatggaatgttctttcatttgtttgtgtcctcttttattttgttgagcagtggtttgtagttctccttgaagaggtctttcacgtcccttgtaagttggattcctaggtattttattctctttgaagcaattgtgaatgggagttcactcatgatttggctctctgtctgttattggtgtataagaatgcttgtgatttttgcacattgattttgtatcctgagactttgctgaagttgtttatcaacctaaggagattttgggctgagacgatggggttttctagatatacaatcatatcatctgcaaacagggacaatttgacttcctcttttcctaattgaatacccttgatttctttctcctgcctgattgccctggccagaacttccaacactatgctgaataggagtggtgaaagagggcattcctgtcttgtgctgattttcaaagggaatgcttccagtttttgcccattcagtatgatattggctgtgggtttgtcatgaatagctcttactatttttagatacgtcctatcaatacctaatttattgagagtttttagcatgaagggttgttgaattttgtcaaaggccttttctgcatctatgagataatcatgtggtttttgtctttggttctgtttatatgatggattacgtttattgatttgcgtatgttgaaccagccttgcatcccagggatgaagcccacttgatcatggtggataagctttttgatgtgctgctggattcggtttgccagtattttattgaggatttttgcatggatgttcatcagggatattggtctaaaattctctttttttgttgtgtctctgccaggctttggtaccaggatgatgcgagcctcaaaaaatgagtgagggaggattccctctttttctattgattggaatagtttcagaaggaatggtaccagctcctccttgtacctctggtagaattcggctgtgaatctgtctggtcctggactttttttggttggtaagctattaattattgcctcaatttcagagcctgttattggcctattaagacactcaatttcttcctggtttagtcttgggagggtgtatgtgtggaggaatttatccatttcttctagattttctagtttatttgcgtagaggtgtttatagtattctctgatggtagtttctatttctgtgggattggtggtgatatcccctttatcattttttattgcatctatttgattcttctctcttttcttctttattagtcttgctagcggtctatcaattttcttgatcttttcaaaaaaccagctcctggattcattgattttttgaagggtttttttgtgtctctatctccttcagttctgctctgatcttagttatttcttgccttctcctagcttttgaatgtgtttgctattgcttctctaattcttttaattgtgatgttagggtgtcaattttagatctttcctgctttctcttgtgggcatttagtgctataaatttccctctccactgctttaaatgtctcccagagattctgctacattgtgtctttgttctcgttggtgtcgaagaacgtctttatttctgccttcatttcattatgtacccagtagtcattcaggagcaggttgttcagtttccatgtagttgagcggttttgagtgagtttcttaatcctgagttctagtttgattgcactgtggtctgagagacagtttgttgtaatttcagttcttttacatttgctgaggagtgctttacttccaactatgtggtcaattttggaataggtgcagtgtggtgctgaggagaatgtatattctgttgattttggccataatgcccaaggtaaattatagattcaatgccatccccatcaagctaccaatgactttcttcacagaattggaaaaaattactttaaagttcacatggaaccaaaaaaaatcccgcatttcctagtcaatcctaagacaaaagaacaaagctggaggcatcacgctacctgactttaaactatactgcaatgctacagtaaccaaaacagcatggtactggtaccaaaacagagatacagaccaatggaacagaacagagtcctcagaaataataccacacatctacaactatctgatctttggcaaacctgacaaaaacaagaaatgggggaaggattccctatttaataaatggtgcttggaaaactggctagccatatgtagaaagctgaaactggatcccttccttacaccttatacaaaaattaattcaagatggattaaagacttaaatgttagacctaaaaaccataaaaaccctagaagaaaacctaggcgataccattcaggacataggcatgggcaaggacttcatgtctaaaacaccaaaagcaatggcaacaaaagccaaaattggcaaatgggatctaattaaactaaagagcttctgcactgcaaaagaaactacaatcagattgaacaggcaacctacagaatgggagaaaatttttgcaatctactcatctgacaaagggctaatatccagaatctacaaagaactcaaacaaatttacaagagaaaaactaccccatcgaaaagtgggcaaaggatatgaacagacacttctcaaaagaagacatttatgcagccaacagacacatgaaaaaatgctcatcttcactagccgtaagagaaatgcaaatcaaaaccacaatgagatatcatctcacaccagttagaatggggatctttaaaaagtcaggaaataacaggtgctggagaggatgtggagaaatagaaacacttttacactgttggtgggactgtaaactagttcaacaattgtggaggacagtgtggtgattcctcagggatctagaactagaaataccatttgacccagccatcccattattgggtatatacccaaaggtgtgaagagggtattattgccaaaatgtggattttttttttttaactacactctgtattttggctaagagaagcagctttggaacttctcaagtctgtacatctgtgagaccccaaggattacttgttttaattttttttttaagtctaagtttgttatgggtcaacttagttctttcaaggcttatttttaagcttttaaaaagctggtttagggaggctagaactgtgtcccagttctagcctctgggtaaaccgcagagatagtttgttcagaatattaagctgcttctgatgtctctactaaatgacctagatgttcaaacgagtctttctactccgattgattccatttaaatgtctccctgtgttgtgtgtgctctgcgaatcctttacctttttgttctctggtagtgttcttcatctgataggtatccttggtccattcttggggagttttactctactctccagagtgtcaatattcatccaaataatctagggagttgttgtggaaatttgtagagccctttcactccatagtttcttcttttctgactctctttcctgcagattctagtgacctcatcttctttgggaacattgagttttgtttcttctactcagcaagtctgccattttctgcttgaattctccttctccgtgcggctgtttggaaattttctcccagcataaagtcactttgatgatggaattcatctcattgtcactttttatctggaattaggtgcttcctgctttccaatgtctgaaaatgttattttcatctatttggttccatttccttatttgtggctggaactctgttttacttgattattcttgcctgagcttttacctttttaaattgtctctactgtttgttttctatttgatttctacttatatttgaatttgtttcaaaatttatactcatgctgtattttgtttgctttctttgttataatttattataaataataatttattttcagttttactcttttcttttatagctatgtaatgataaatttccctctaagcactatttgagtgtcatctcaccaagttttatttaatatgtttttattatcattcaattcaaaatatttgatgtttcctcttccaattttctccttatccatgagttatttataaatgaagctgatttctgggaggcaacctaggaaccaacagtaatttctatcatcagtttacagagacagtaatgtccactctttcaagttaagtactacataatttgaggaatcatcattttggcctttcaagataaataaatctgttactgtctctcatcttctttgaactccacatgtccatttactttgaagcacacagtaagaatggcatttcaaattcttggagccaaaggctatgacaattattttggcagattttctaagatcatcacgggatctcagacactccaattggttaaatgagttttggaattgcctaaaagatctaaaataggcaagattaaaaagtcttaagaaataatactcattgtctattgagttctgacatgctgtagaattccaaatccattagaccaacagatttccaataatttcttagaaataattgtaagagtcttaaataatgccttgttttagaaaatgatggagagtcttgatgtaatgtctttggcaactcagaacttattttctttgacttaagtatctgaatgcttatgattatccaagttttcagttacaaatcactcattattttttatatttgcatattatttacattcttataaaatgttattgaacatatgcttgtctttttcttattctcttcctttttagaaacatgttccaaatcaagtatcgatattgagaatgggtttatttctgaatctcagtatatatatgacttacataaacaagcaaaatatcaatgcaaactaggatatataacagcagatggtgaaacatcaggatcaattacatgtcagaaaaatggatggtcagctcaacccacatgcgttagtaatttattatgtttgtattgattatccagatgatacacaaaagtttactaactttagtctttttatgggggctgatataatttcatttgaaaacataagaaaaaaactttgaggaacaaagcagacatcaatttttttttccttttcacattaattactcaaatattagtgtgcttttccattcaggcttttcccactctaaagcattctgtgttacagagacgagttagggagctttatgtgtattctggtttaaacttatttctttttagctgagacctttataactgttgtatatacctgttttatgtgattagccttctatatcaaagtctttctcctagatataaaagtaatgtttttaatgaagatatggaggcatagtgcataatatcaaaataatttaaactctataatttgtagatttggcactgtaggatatgtccaattctgaatatcttcccccttagaaattttttgcaaatatataggtagtagagagacaaaatatttctagatggtacccatttctgctctattgaaagatttccctaccatactatctaaatatttatgaagattttctaggaacagttggctcagtttgtgctattttttgcaaagccactcggtaatatatgtatatttatatatatatatatcatatatataaagatatatatattatatatttatatttatatatatatgatatatatgatatatatcatatatatatgatatatatatgatatatatcatatatatgatatatatatatgatatatatcatatatatatatatatatagagagagagagagagagagggagagagagagagagagagagagtcttgctctgtcatcgtccaggatggagcacagtggcatgatcttggctcactgcaacttctgccttccatgttcaagcaattctcctgcctcaacctcctgaatagctgggattacaggcacctgccatcttacacccacctaatttttgtatttttagtagagacagggttttgccatgttagccaggctggtcttgaactcctgacctccagtgatctgcctgcctctcagtaatattagtgaagtaatgtttaatatactcacattaagtgaagttaatatttaggatattcatgcatactgttttcatttcttttttaaatgtctatgcttaatatgaggtctagtttacaaaaatgttactcatcataaaaaaatcttagtaaatttttattaattattcttttaagattttcttattatgaaagagaaaatgtcttgtataacaaaggaattcatctttttaatcctttttttccctttttacatatgtctcaactacaatttagcctggacttttaatgtataaaattctgttatgattttctttaaaatgtaatatacacctgtagtgacctgttttattactagcattgtcataaatgctttagtataaatgaattaagaaaaatgctcttaaaatagattttggggcttatcgggggaaaccagcccctggcaattcaatgtaggttcttttctatttccctaagtgtcagctggtctgagaaataaagggaaagagtacaaaagagagaaattttaaagctgggtgtccaggggagacatcacatgttggcagattccgtgatgccccccaagctgcaaaaccagcaagtttttattagtgattttcaaaggggagggaatgtacgaatagggtgtgggtcacagagatcacatgcttcacaagccaataaaatatcacaaggcaaatgggggcagagcaccaggacaaaattaaaattgctaatgaattttcaggcatgcattgtcattgataacatcttatcaggaggcagggtttgagagcaaacaacccgtctgactaaaatttactgggcgggatttcctcgtcctaataagcctgggagcactacccaaaaccagggcttatttcatcccttatctgcaaccgtataagacagacattcccagagcagccatttcagagatctccccctagtaatgcattctctttctcagggctgttccttgctgagagaaagaattcagtgatatttctcctatttgcttttgtaagaagagaaatgtggctctgttcttcccagctctcaggcagccagacctaatggttatctccattgttccttattgtaccttaaaataatacataccccaaaacacaagtttaaaaagattgagatatcaagaatatgctgaaacttttgtactcagtatgatccattgtgagttatcaaaatcagtatgctactctaaacacatgaaaatacagacagtggaatggggtccagacatactggtttgttttcatacgatccttaaataattaagttgggtattgggaagcaaaggacgatagaatattaaagtaacatggaccctgagagatattcatttatgattcatctgcttgtggaagaacttcaaacaattttccagtctttaattttaaaattagtgttctcgttgtaagaagagtatgtgtgtgataggagatagtattatgaccatttgtggaaaaaaaacaacctaccatgctcaaacagcaggattttcagaagtagaatagtgtgccagatgtttattttcaacgtgatgtcaacacggctcctatcttcattttcttctccattgcagaagataagtctgaaactacagtttctgaagcctgtttctccataacttgcttcttccttagattcccccatgagatgtacttaaagaagacttggaagaagagaaagacaaggcattatctgtcagcagctgctggtagcagctgagatcaccaacagtagctttccttgcttctggaagttttcctgagaaacatccactgcagcaccatggataattagtgagggcatcactaagattcctgaacttcagaattttctggaaatagcatttctgacctttgtccctcaatgcttccaatagttgcagaagcctttcattccctgtattaaaactctctttacttaaaaaataagaaataaaaatgaattaatgttttatgttacttttggagttggtccattactgtcactaaataaagctgtacatgtacataccagggaatcaattccagagatgattgtgaaaccactaacaagaatcattgaagcattttgcaaaactctctgaactttgatatttactaagtgaccttaaagccctagctttgtggtagtgcacttaaattcagaatcacacttggtaactaataatgaaagatttcaaaccccaaacagtgcaactgaaacttttgcattactatactactgagaatatctaacatgttgttactaatcaatgtcattctgaccttgtgggtttcctgtgctaatggacaaggtaagttgaaagagatctaaacactcagcttccctcttaaatgtaacttcgtgtaatatctaacttcatatgtctataatttttttataaatctgataggatatattcactatgctagcagaagtagcatattttgtgagagtataacagaaattaattttatgaaaaaatatctcataatttaaagaaaaaatgaataatattttctttgttttacaaattctacagtgtaaaaagcatctaatattcattatggagatatatgaatatactcataaaactttaagtaggaaacatgtcattagatagattctaaccttaaaatgttcagaattttcttattcataatacaagggaaactttgggagtgattgatactttcataatcttacatacagtgattttttattgattcatatatcaaaacagcaaataaaatattttaaattatgccatttcttatatttctattataccttaagaaagctgctacatctaattaacattaatatgaatttaatatttcaacaagattagcaatatgtaaatcacaacatatatgtaatcaaaaagcagaatatatacttaacttacattggaatgacagtaaattttaatttgcatttctgagttcactagcaaatgttcaataaataaatacataaataattttcatagctttatgtcattgttctctgatatgttttctcctcgatagtcatgtattttctatattaactatctctttgaatgcaggccttgcatattaaagaactatattgtatgtaacattagcagtggaaccacatgggtcaaaaatcatggacaatcaaaggtgtgtcaccattaatgaagaaaacaaattttataattatccaaaactttataatattccaacaaatgtaatggaggataatattggaaatcccactatcaattattgagagtatcttttccctcagcctctcctctcaaagctatgccactttatttgattctaagtaaacagctttaggttttacagtattatctatcacatgattcgctagttttaattgctgtgcaaaatcaaccttgatttgtgccaaaatgaaaaaaaaggaatttctcttgttattccctttgttaactaaactgctacaggcacattttttaaaataaggattacatagattaaagtagaatgcaaagcagaaaaatagagaaaaacagtactattttgaaatgactgaaattagattagaataagctctactttcttagttactttctcaaaagcagtataagaaaagaatgctgacaaattctttcttatttgatattccagttgaaaacttttctcctccaatgaactctttgtaagagtaaacttgagaaaaatgtcttgtaaatttgggtcacacctatatttctcaaaggagaaagtaactcatttagtggaataacatcttgggtagtgagaaacatctttgtgaattcagtagcattggctcaactgcatccctccaaaatttatttgtaaaagtccaaattcccaatacctgagaatgtgactgcatttgaagaaggagagcttaaagatgtaattaagttaaaggtcaatgattcaggtgggacctactccaatataactggtgtcaataagaagagaaaataaggacacaccatatagagaaagaccacgtaaggcatagagagaatacaaccatttacaaggcaaaggaagaggcctcagaagaatgcagccctgttgacagccacatctcaaagtattagcctccagaactgtaagaaaataaatttctatgaaatctgtggtactttcttatggtagcactagaagataaatacaatgattttacacaatttattaaaagaatattaacttaaaataattttttactctttactcatggatacgtatatacccaccatacatattttagagggtatttatcagaatttgataattatatcttggctgtattgtcttcgctgagttttgtctagttgaatactttatgtttatatatacctgtattcatatctattcagaatctggcaaagcaaacctgagaaatatttttcatatgattaatgaaggacatactttgtgagttgcctatgctaagaaactttgtttttaatggtagttgatgtttcagttctgaataataattcttttggaagccacgctatttgaaagataaacttgacagaaaattagtaattgtaacctattataatgttcattgaatttgtattgagcattatttcttccatcaacttgtaagttatttacatttaatttaaaataggttgtcaggaaaattattttaattatgaatatccttttaaaattgtataaatatttcattcatctattagagttgccataacaaagtatcaaaggtgacaattagtattttagagcaggattgcttctaaatctctttcaaactagatcattttcaatacccagtgcattacactctgttgccattgtacttctttgggatgctcaaattagtttcaaatctcactaagaagctggtttctgtgtgtatttcacgtgcccccattaagctttcgcataacaaaaggttccaggctttccttgacttttcctactacacacccagttctaataacttctctatgaaactccagtgccttctagtgggagaaacgatttttagaaatgaacctaaactatgaaaacctcacttcaggttcgaaaatgtcgtttattaagaaaaagaatttttggccagtcatggtggctgtaatcccagcaatttggaggccaagtcggggagatcacttgaggccaggagtttgggaccagcctggccaacatggtgaaacactgtctctactaaaaattcaaaaaattagccaggtgtggtggcaaacacgtgtaatttcagctactcaggagcctgaggcaggagaatcacttgaacccgggaggtggaggttgcagtgagccaagatcactctactgaactccagccttggcgacagagcaagactgtctcaataaataaataagtaaataaaatgatttcctttagtttacgtctctttcttccttggactaaatatcctgcaatcataagaaaatgtaagagtatctcaggatgttacacagagcagggatggttagattttccaatacggaggagacactcagcaaaaaactgtgcatccgtgcttgacggactgggtcagagaagctgtcatgcgtcacccaacaagcctctggagccagttctgtaactagcaaacgcctcccagaaagtaaagatgtcacttctctgaacttagtcttctcatctacacactaaagctgttgtgtcactagcctccttccagttctctctgatttatgatgattcaaacttaatttttctttagttatattcttaagatttcataacaaatagaacgtaaatattaatttctctcatgtttcagaattataaagaacttgatataaagaaacttgtttcaaaattataaagaaacataaattatttgctatttaaattgtggtagtgttcaatgttctctttgtatatacatatacatatataaatatacatatagaatgtatgaatatatatgtatattcgtgtgtggacctatatttttatatcaataatatgtctcacctgatacatgaattctaactatggtaagaatgtatgccatctaatacaaacaaaatgccacaaaactcaacaaaatgttttatttctggagataatttgctacatttcagattttttcttatgttatagtaatatttcttttctctattttccaaaaaacaattattgctaatgtgtgcacctgaactgacagctttagcataacttggtatagttttagataagctgagtttaaattaacgc

SEQ ID NO: 118 - DNA, 4937 bp, Homo sapiens
aaaagagatctgccttaacgaagttctacaaattcagcagaggatagattactgtggattaaaataaacaatcagggaaagctttgtagagagggtgacgtgagctggacttaaaagatgtatagaatatgaatagaccgatgtgatgtaaggccattcctggcagaggcacagaggaagaaggggcacagcctaagtggaacaattaagtaaacaagaagaccagagtttgaatgtgtgagtgagaattggtgacagcagacaatggagggtcatggatgctggttcttctattaatagtcctccatatccatcttctcgggcttgggtaattttagtagcctctgcgtctctctcttgtgtcttgttattatggcccagtattgcacactactcctaaagtcccgtcctgtcgctctgttggttaagaatctctagcggctcctcctgccaaccacatcgaattcaaacctcattcaagctcagctcacttgagaccagacgttcgggaccagcctgggcagcacagcaagaccgcatctctacaaaaaataaaataaaataaatagctgggcgtggtggtgcacgcctgtagtccaagctacttgaaaggctgaggtgggaggattgtttgagcccaggagttccaggctgcagtgagccaagattgtgccactccagcttaggtgacagaacaaggccctgtctctaaaaagaaaaaaaaaaaaggttaaaaaaagtttgtaaaaacagaggaaatgttagtcattttctctgaggggcagaattttcttttgatttaccagtattttctagttttttcttaagtgaatatgtattactccatactaaagttattaataaaaaactgatttagtttttctctctgtaaaatgaggattaagacatagtatagaagcatggtgagacatgaaaaagtatagaaggtgattggctagagtcaactgactgtggtttgcagcttctttaaaattagcttaggagagatacatacatttcaaggtcattgaaaataatcatggcatcttcttttaagaaagttcaggctaggcatagtggctcacacctgtaatcccaacactttggaggccaagaagggaatcaattgcttgaggccaggagtttgaaagcagcctgggcatcataaggagaccttgtctgaaagaaagaaagaaagagagagaagaggagggctactaaaaaagaaagttttctctttctactttcctggatctagattcaaatgaaacagaaagaactctaacctgcagcagaaatctgaatctggggtccttggatgagctcctgaaattgtatgctaatttgcacatgtgcacacttttcaggagaaaattgttggttttaaaagaagttaagaactaaaatttaagacctggagagtctttcttctttcagaggattttgagacacagcccttgcttccagtgctaaggccacttatattggacagttttacaactgaacaagttaaaaatgacagtaaggaacaaagatcaaggtactacttttatacagaaacactctgaagtgcaatgtgtgactgattaaaaaattaccagaaacaaataatacattccaagtggatgttatcttatatgaaagttctttgatgatcttgattggtagatctttggaatttccttcagtgctcgagacttgttaatgtgaattacttcaatgatggcaaatttgggttgaatttgggttttatcattttgccaaatgttacctaaaatgaatacctgtgaataaagaggtaaccaagtttgggcagatacccattttaggctgcaaatgagtaaagacaaatcacaagatgtttcttggttgatttacttatttgacttttaagcacttccaaaaacatccttaacaacggtgacatcaccagaataagtatgtaactttcaaaggcaactgctttgaaagataatagttaaatatacttaacaaatatggggctctttataggcaaacctcctatgcacatactagttttcatctaatgtgctatatataggcttactttttgtattgcatccctttagacttgtaatgcctgttagccattattcttttcacctcagttaatttcttctttttattctgtgaaactgccaggtatatcgatacagcaaatgctttggagcaagaaactaaactggggttacgacggtttgaagtttgtgacaacattgatcttgaaactattttgatggaatatgagagttattattttgtaaaatttcagaaataccccaaaattgtcaaaaagtcatcagacacaggtacatgcctattttctagagataaggctttgtctcatctgtaagattagtgtttctttctcatcttattcccagatagatggagaccctcaccctgcaccaaaggagtaggccaggaggattgtgtagccattctcatatccagcacagacaactgaaatatgattacctggacactgatatccctttaggcactttggcatttgtttgagaaaatgtgttttcaggcaatgaaagcaaaaccccagtgtatcataggtacttttcagatgattagcattactttaatttccttagagatgaaaagaactgttggaagaggataaatgacagaagactttttttgtttttaggagacctattatctgtcttgaaaataactacaaaaatgagtattggggaagctaatagctcatgtatagataatgaaaagcttttgaaagccatcaatccagataatgatcaatataatataaaaacccagtataggttagcagtcaacaaggctggctggaggaaagatctaaagtgggggccctgtgctttgtagtaacattgactgagaagtctgtaagtgggggaagtaattataaaccaagggagatcattgtcctgtttacaagccacttgttaagccacagactttaacatttcatgtagggaccgggaaaccaagaggaacatcaatttaaaatagccagggccagatctcagagctagaaaaggtcaaagaggtattttatctgagctcccttccaatgcagcattcagagcttgacttccttggcaggtggttagatgtgggccttgaagagacagcccagactcctaaacacagggtgatcagcactgttagtgacatgatctcacttccagatggctagttcccatctagcatgatacccaaattctcctatgatattggacacgttatttttattttaactagcagagtatgacttcagtgttccctgccagattcgtgcaatcatcctggtgtcccatgtaatgcagcaaaatggtgtcaagttcatgaaagcgtaatgaaatggtagctgtaaagctagcctatattggagttgccaccaggtccacagtctctgacatgtttaatatctgagccctttgcaatcttcctctgtgaggagatgctggagaagctcaggcctctttctcttcgctggtaatttcagttctctctagatgagaatagcttaaagtctctagattccaattggttaaaactcaaattttaagaacaatgcaaaaaggggaaacatacctgaaaaaaatcactttgtcactcttaaaattattttctttccctcccaatgtctgttttgtcacagcagaaaataatttaccgcaaagaagtagagggaagaccagaaggtaaagtgaatggtaattcttcttaatcgactcggctcgaggagcttgtggaatccctttccagaagctttaccatcacagctctgtgactgtctcccagcaatactgactgcagtcatgtgacctggcccagcccaggacttctctcattacagctgccccagatttgggccaatgtccgtctactctcctggttttactgtaaataagtatatcctgtgatgctctgtctttccaggccatgtggtatgaaaagtcttaacctcaaaggttaaaagacccaggttcaactcctggctctgctatttacaagcatggagcaagttttggacacatagtgagttcctggcacacagtgagcacccaagatataatattttccctcttttcatcatttagttaatttcaagcactcccagatcagatgtcctgacctgtctgaagatcaacaatgagccaggaggtgtgagctcaggcttctggcttcgccagtcctgaccagtggggacccattcttctcttgcttttccctcctgttcacagctcatcttgcattcctttctccagcttctcaagtccaaatctcatttggggcttgtagcctctgatgggagcccctctgtctctggacctttttgggtgcacatattctctcacaaggccccctactcttgccagtgtccttcgcattcctctcgccccactcccatagacccctccactgtcagagctgttcagaaatacccaggggaacaagggtgctgctgccggctgccagtgagggccagctctggggcatcgcaacctgtgggctgttgctattacagtagggcctaaacctcatggaaagacacagccatccaagcagtcaacaaagtgtttaaagtcttaaaatgctcttggaaaaagaaaagttagattgtaatcacatgcaacttattaggccctcaagaggtatggattctgttatgcctccgctacatttcccacccctgcgactccagttcccttgttccagcctcagaaggaagggcctaggacactttacagggctggtgggcacagcttgcaaaaatggctgtggagcccacgcacgctccacgatcctacttgttataatacttggcctcgggctacctttgctttgtgctattctgcaggaagagttttatcgctttgacaaaagtgttattcttttatttatagtttccacaa

SEQ ID NO: 119 - DNA, 16696 bp, Homo sapiens
gtctgaactgtggttgttgctgctataggagtcgagactgagaccaccggtcagggaatgggagccagcccaggggctcggcgtgcaccggccatggcgggggctgtgcaggaggcggtgccgagcgagagcccggcttacttgggatagaaccgaaagtcccgcgccgaggtggtcagatagagctggcggcggttcaggacgccccggtcggatactgtgaagggtgggccagacagcgcggggttcttcgtgcaggcgattagagcctgagcaagattgggggaggaggcatacccaagacatagatttcataccccatcccaagtcctgggtcccgagttcagaatccctctccttcggcctcgacagccatgacggccacggccctcacaccccgccccagggtcagagcccttcctgccacccacgccagggaacttcagcttcctttctcatacccgaacccttcccagcctcacctccctaaatccaagccctcctgctggtcaaggaactcaaatgcaggcccccagccaccacaaaatccccctggttctgcccccggtctcaagccttcttggtgtggccactggagctgagctgcatcttgggcaacaactccaggttacctctcctaactcccaccctaccacgtctcagaatattctagtctcctccccacccacagcccgccgtctagctccgcagcagcttaggagccctgaaggcgagtttccagcccctggtccttctggcctggcgtggatgcccagcccttcctcccgctcctctaacctcccgatcccgccccagatcctttagccacgccccaaagctgtgatttccttctggccccgccccaggctcccggagctccgctggtctcgccagcgccggcttccacccagacacctgggaaggccccccgcggtggtggtccgagagttgtgaggggctggggcccgacgtatttgggggcgcgcgcgtccgggccgggagagcaagtgtactgcgccctcgtctcgctgctctggtactttgtggtcagtaggagggttcagctgcggtgtctgagctgcggaaaggcaacccagagactcatgtgaaggagcaggggactcaaatgcagtcccccgcagactccggcgctccccaaatcttaccttttctcctgaatccttgatccccacagtccgcgtggggtctgcaggctctggggctctgggctgggcgcagggcccgccatgggtcttgggcacgtaggccgagccagaggttgtctcccatctgctgaggacctcgtcgaaagcccagatgcgagaatcctgctttgcagtcggaggtagagggtccgcgaccgtggactggagagaaggcgccgcacatcagctagaaagactcaggagtccctatcaccccccaccccaaactctgacctcttccagtcggcccccagccctttcctctgcagtccctggcatccaaattccctggcgcctcctctctcagacccaggactccaggaccctcctccttcagagaggagtccaagctcccaatccccttttctcagcccccatctttctgggtccccaggccccgcagggcttcagcctagggtctgcccacctgcaccgtgggcggggggaagggtacgggtgggataatgccatgggtaacgtagctgctggtgagatgccagttgggccaggattcaggcatctcggttgcagagatgaaagaccacggggggccacagcgcacagccagggtgccactggccatggttccaccccctccctgtagccaagcaggagctggtttgttgctgttgccccaggtgacagaacccgcccaccccaatccagccaatgaaaggcctgcaggcacatggatggatggagtgattaagagacccagagacagagagacagggactccaagaggggcacagagaaacacggagtgggggatggagagtcagaaagaggcggacagaaggggatggagaagttcaggatttcagagacccagggggtgggggagacagagacacagaaagaaggacagagacctgggggtgtcagagatacagacagagacccctgcactgcccccagcacctcaggacatccatgagaaacacccccctttgctccagggtccagaacctcctggctgcttcctccctctgccaggcctgcccacctcggggtaacgatttccagatgtccccggggctccccaacccttcccgcacgtgctgaaggagtcagcgctggtgtcagctgtcctgcctgcctttgatttggttgaaaacttccacctgggtaggctgggtggggaaagagaaagggatctagagagaagtgcaccggaccatagcgaaaaagatgggctttgatgagtgaggaataaatacaacaagaaaggggagagacagggaggaagaaagagaccacgatggaaagggagctattagtactacccagaggcgacagacactggaagttagagacagagatgaaggtggcaaaaacgaccaaagtcacagatggaaaacaaggagacgtagaaactgaggcagccacgccccaccctgcccaggggcctggtctgtatagatgcggggagaagttgcctatgtcctttgctcaaagctggacctgagagagagagagagagttggtggggcgatgggtaacatgtgaagggctattgtgaaggcctgtggtctgtccctggcttcccttgtcacttcttcactataaacagcttttgatcaccgggcgcagtggctcatgcccgtaatcccagcactttgggaggccgaggcatgcggatcacttgaggtcaggagtttgagaccagcccggccaacatggcgaaaccctgtctctaccaaaaaatacaaaaagtagccgggcgtggtggcgcacacctgtaatcccaactaaggcagaagaatcacttcaacccgggaggtgaaggctgcagtgagctcagatcacaccactgcactccagcctgggtgacagagcgagactccatctcaaaaaaaaaaaaaaaaaaaaaaaaaaaaaaaaagcttttggtcaaggcctctgactgctcaacccccattatctcatcctaccagcccattctgcagacaaggaaaactgaggctactttctgcagccatgcccaggatcccacttacccctcctcccccattcaggcttctggggcctttctgttggattttgctggccctactcaacagctctcaatggacagtgaccccctgatcctagccagggggccgatgagttagtcagaaactcatgccccactcaagctggacaaaatttttttcttttttttgaaatggagtttcgctctttttgccaaggctggagtgcaatggtacagtcttggcttactgcaacctctgcctcctgagttcaagcaattctcctacctcacccttcagagtagcttggattacaggcatccgccaccacgaccagctaatttctttatataattttagtagagtcgggttttcaccatgttggccaggctagtctcgaactcctgacctcaggtgattcacccacctcggcctcccaaagtgctgggattacaggaatgagccatcgcacctggccatcaagctggaaaattttaaggtctgtttctttcccaatgtagagtaaaggttgggacagggaagagggctagaaacctgacttcagctccctgccgagggctgaactctccagcatcctgatcacttctcattcaaccttgcttgtactcctctgtgatcggtagcttattacctcaaaacagaatattctaagtcaacctttgccccctcttaccaagtaagatttcccatttgaaccccatctcccagatacttaaaggccttctgtgggccacgttctcaaggtcccctggccatctgcttgcctgttctagtttctctcctcctccacccacatcgtgaaatgtcccctcccactccccagcaaggtggtgtcctctgagactgagtagtcagcaacttaacaccaagggccaccaatgatcaaatccatgagagttgatctgaggagttatgtattagggataagaaacagtaaacactcagtaaatagtggctattattattatatcatcatcattattaccctcaagttgctccaggagaactcctattcaacctccaaaaccccatgtggtttcacccatcctgcagagattgagctcaaaatcagagaattgtgattttgtgattatttgatgagttcccaaactggggtccttagatcagctgggccatccctgaggtctctcagcatccagctctgttattttcctgggcatgggtctcaggcccggccagtccggctgaggagtgtgcagacgcaggcagtgtcaattcgaatccatcgccagcccacacggccctgggcatcagcggtcaatgcccgcacataggactgcttggccttgcactcagatacccagtgcctcctgtccactccccggcagccccctccacctgcccccgggccaccttcctcagcgttatcagccttgcagcgggtttcaaagaagtactggcggaggggactgccgccagctgcaggcacctcgcccaacacctccacctcgcgcccacgcaagtccacagcggtccggcggtctgtcacccagccactgactgcatcgcacacagccagctcaccccgacgactcgctggtgcagtttcgctcaccccacgccggctgcggttggccggggcacctgctgactcccgaaaggccccagcctccagcaggaagagcagagggggcccagcaggggcacccctagacaggactactcggggggagagaaggtcccactcaggggccagaaaagggggcaatgttgagggtgggggttgggactcaattggcacactggggaggaggaaaaggaggaggatggggagggagcatgaggggagagggagcatctctcggagcacctggagacagaaagagggaggctgggattagagaagggggtaaaaacttcagtggggaaagaagttgggaaccccaggggaggcttgcctgccaggattgtggggaagcccttgttctagaagtttgggggaccctatatctagggcttgcgtaatgcgcaacttgtagattaataataaatattcaactactacaggccaggcactgtgccccacacctctaatcccagcactctgggaggctgaggcaggtggatgacttgaggtcaggagttccagagcagcctggccaacatggtgaaacctcatctctaccaaaaataccaaaattaaccgggcatagtgctgcacgcctgtaatcccagctactcagtaggctgaggcaggagaatcacttgaacccaggaggccgaggttgcagtgagcagagagtgcaccactcccctgccacctgggcgacaagagtgagactctgtctcaaaagtaaaaataaggccaggcatggtggctcacacctgtaatcccggcactttgggaggccgagatgggcggctcacctgaggtgaggagttccagaccagcttggtcaacatggtgaaaccccttctctactaaaaatacagaattacccgggtgtggtggcgcatgtctgtaatcccagttacttgggaggctgaggcagggcaatcacttgaacccaggaggtggaggttgtggtgggctgagattgaaccattgcactccagcctgggcaacaagagcgaaactccgtcttaaaaaacaataataataataaaataaaaataaaaataattcaactactattacttaacagtaacagatgttgaaatacaggctcagagaagttaatgatttgtgcccggtcacacagccagcaaatggcagagatgggacttcacctctgggcaactgcactctgccgtccttcctgtgcaactctgaggaaccgacagtcttgcatcttggaggatgttccaaacaattttttttttttgagacagaatctcactctgttggccaggctggagtacagtggcacaatcctggctcactgcaatgtctgcctcctgggttcaagtgattctcctgcctcagccttctgagtaggtgggattacaagcacctgccactgtgcccagctaatttttgtatttttaatagagatggggtttcaccatgttggccagactggtcttgaactcccaacctcaagcaatagtcgtgtcctggcctcccaaagtgctgggattacaagcataagccaccatgcctggtcccaaacaaaatttttttttttttttttttgagatggaatctccctctgtcgcccaggctggagtgcagtggcacgatcttggctcactgcaagctccgcctcccaagttcatggcattctcctgcctcagcctcctgagtagctgggactacagactcaagccaccacgcctggccacattccacaatttagagaaaggtcacaacctggaatcctagggagaccccagttcacctcaaaactgccactaaggaggtaaaacgctgcccctctgaggcaggcttcagtttccctgtgtgtgaaattgacctggcgctgggagaggctggtggaggcgcggattttgcagtttccctacaacattctggaagcctgtggttctgggaaagggtggcgtggagaagactgggaaacagtcagtagttaccagacctgtcagcacctcctccgcctcggagctctggggctgggagtccccaggcttcggggggcccctgtggaggacacaggtggccccctccttcctgacatctcaggagagggagggggcaaccacctaggggaagaaaagaatagacaggttatagaggcaggtggggaaggggccaaatccctgaacaaccccttcccagagttcctcttcaagtgcagggtacccaagagtcaaggccccgccccctttccagaggccccttttctacccaggtgatggctcctggctgggatgggaagcagatggagggaggggaagggagaataggggaagggagaggcagtggatgaaggaggctggaagagattacatccccctcggcccattcatctcccagatggggcggaactggcctggacacccgggtccctgagggcccacactcaagaagccctggttccccaagctgcttcctggaatgttccctcctcacaggacaggccagggcccgcccaagacttctgcacatacctggagtggctgcctgccctggctcctcggtacaggaaaggggaagggtggagagtgaaaggagcccaggctgacccaaccaggaccgccttctccctcagaccgagtagtgcagaccccagggcctccaccttcagacccaggagttcagatccccagcgccctcctccctcagacccaggagtagtccaggcccccagcgccctcctctctcagacccagaagtccaggcccccagcacccttctccctcagacccaggaggagtccaggcccaggcccccagcacccttctccctcagaccctggagtccaggtccccagcgccctcctccttcagacccaggagtccatgcccccagcgcccttctccctcagacccaggaatccaggcccccagtgccctcctctctcagacccaggagttctggaattcaggcccctccttctcggatactaagaaatgcagactccgggttcctcatcctccagatttgggttgggggttccggactccgagacccctcaggggaaaccggctgcatatctgggacacttccctcttgcctcagtttcctccgccaagccccgccccggtcggccccgcccccgtccctccccacccgagggcagggcgaccaggacgccggaatcccgagggaggaggagtggagatcttacctggggcgccctcttcggctcccgcggctgccctccgcccggcagcagctcctcctcctgctcgctggctgcagggacgctcgctggcccgccgggtgctagctgctcacgctccgcagggcccgggtcgggggcgggggcggggcggcgccgggcggcagaggaggggccgggggatcctgccttgcactcgcgtgccgggaccttggaagccaggcctggctcgttcaacgcggccgccttggtcacaggagtcccagtttccagctgcctcctcctttggacctagcagtccaggcccccagcccctcctcccttcagacccaggagtccaggcatccggcccctcctccctcagacccaggacttgcgaccccagccacctctccccccagccccaggcgcctgagtactaagcccacagttccccccaccacctcccaaccccgccccgtctcagactcaggagtccagcccccagcctcctcctccattagccccaggagtctgggcctgagattcctttgccgtcttttgccaattgcgtgtcaatcccggggcagattcccaccctctgctctcctccccacttcccaggagctccacgccagacattaaccagctgggcttgggcagtgataaggccccaggcccggggagacagtggatgtgggggctcccgcatactcctctcccctggaatttcctggctggggaccggggagaaggtcttgtcctgagctcagataagagacgtgcaaggtatcataggaccagagatagacagatgtgtcttaagaacaatcagctaccttgagaaatggtgcgcggtgacatgaagggagagatagggagaagacatggaaaagtggggagagaccaaaagaaagagggggaccgagactagagagagtgggggagggcaggagcccagagagaagacagaggcccagagagcgtgagggcagacccccccacccccccgagaaggggacagagcccctgagagaccctgagaaagacagggatgggaccggagccggagtgtctcaggacagtcatgagggcagcggggctcctcaccccaccacacctctaccctgagactccgctcccctccgcctgcgctattttcagaaggaaaactgacacctgcctcgagggtcatcccacaccccctcagcctaaatatagcatggcaaggtggcaggagggtgtccccggttagggtgtttcctgctcctcaccatcccagccaaggcaacacacaaggccgctccagttatttattgggggtggggggaagggccacttcccaggctttgggtgtgcattcaggtcacctctccggcttctccacccttcccctgttcctaaacagccaatacatcctgccgcatagcaggaggactctagcttctagcttctagcttctagtcctggaggggatagtagggatgaggtttccaaacagagtgactgggaaacagtctctgtccccctatctccaggtctctgttcccctccctctggatttctgtctccctccaactctgggtctgtccttctctctctgagtctctgtccccctctctctctgggtctctgtccctctctctctgggtctctgtccccctctctctctgggtctctgtccccttctgtctgtgggtctctgtccctctctctctgggtctctgtccccctctctctctgggtctctgtccccttcactctctgggtctctgtctctctctctgtctctggatctctgtcccccctctctctgggtctctgttcccccccaggtctctgtccccccttctctctgggtctctgtccccctctttctaggtcccagttttcttctctctggatatctgtccaccctctctgggtcccagtctccttcttgctgagcctcttgcatcctctctcttggggtcactgtctgcttctctttcccctcgtgggggtctctgttcccgctcccggccatctgccctcttcccccttgcccttggatttctctcttttgctctgtgcctctcctccctcctggcctcagttcctgtctgtgtctcctctttaggtctctgtgctggagtccaacctgtctcttgtcactgtgaggtccgtctccattctgtccctaaatctggctttctctccatttcagagagaagtgactacctaaagcttctattaatttcaaccattatcaaactcctctcaccatctgtaccttctctttagctgtatgaaaaggtgctcagatgaaaccaggggtttccacactgaattcctgagctgcattttgagttgccaagaggaggcgtgttctcctccaaccagttcccttcccatgcttcccactggtgtctctaaggaagatttatttgacccaaaaaaggggtgggtatggctaaaaataacaacaacagtctgtaaaccactggataggttttaataaattaacccaagtaaagtactttgataccaaaggaagccctatatgtgttagtgatttcagccttcttcctctaaatgccctttgagttctgaaagatttctgaaaatgttcggccttgtgaccttgggtaacacctgctgctctgagcctcagtttccccgtctgtaagaaatgaggctacgggactcaggaggacccgtgtgtcccagcaggctgatggggacatgtgaagcagacagacagcctgcctggcccctggggacaagctgtgagaccttgggaagccactcccctgctctgagactcaggtttctcccctggaaaacagagtgaggcccccagcctgtctgacagccttcctgagctgcagggagggtaggtgacaggcctggttcaggattgttctgtgattctatggaatagactgtacatcactcttgggttcaggggcaccaactttttctggctttttcttttcttttctttttttttttgagacagagtgttgctctgctgcccaggctggagtgcagtggcgcaatctcggctcactgcaagctccgcctcccaggttcatgccattctcctgcctcagcctcccgagtagctgggactacaggtgcccgccaccgcacccggctaatttttttgtatttttagtagagacggggtttcaccgtgttagccaggatggtctggatctcctgacctcgtaatttgcccacctcggcctcccaaagtgctggggttacaggcatgagccaccgcgcccggccttttctgcctttttctattgtggttctctttccctgagactctgttgttctgtctccaactctgggtgtctgacgctgccctctgggtctctgtccctccctcccccactggctctttttgtttgtttgttgagacgggggctccctctgttgcccaggctggagtgcagtggtgcaatcatggctcaatgcagcctctacctctcagggtcaagggatctttctgcctcagcttcctgagtagctgggatcacaggcatgtgccaccacactcagctaatttttgtattttttgtagagatggggtctcaccatgttgcccaggctggtcttgaactcctggcctcaatcaatcccccttcctcggtctcccagagtgctgagattacaggcatgggccacttcgcccggcttctatcccctgctcttggtctctgtctccccactctggatttctgttcctctcttctgcgtctctgccataccccaccctccaggtcattgtctccctctccctgagtctctgtttctctccctttgggtctctgtctctctgggtttccacctcttcctttttctgggtctctttctctatccttttggctctgtccctctatcatgtctggacagagtacagttttctccccctctcccctttcccttgtggctctgacctccatgtctgagcataaaactgtaggggagaatgggagtgaacagcacaatgaagtggatgtggggtaaacaggaggagcatccacctcttcctaatttacccagtcgcctctggatgaacacccaatcccatggatacagaatccagtcccgccccctacagcgagctggggagccagctcggcacacctcccagagccctcgccactgcatgctcccagatacatgatgcttccccactgctatttcctttgggtcctggtgctaccactaaatgcaaaacagcccgatgtggccctatggaactcgttcgcacagtccaactcaacccaacttcctgtaggactcacatagtgacacaactcaatggaactcaattcagcatggccctatgagactcaaacagtggcatgacccaactgaactggccttacaaggctcatatggttgtacaattcaacacaactcaactcgctgtggccacgaaaaatgtccagccacacacctctacacagttaagcccaacagaaccctacaagattcatttggtcatacaaacttaacccaatgtgacctagaaagctcaaattctaccactggactcttcacatttctacatgactcgcaagttcacagaacctaaaataacatgcccctggaagaatcacagagctacacaatttccaccatgtctcaacgaaacttaacaccacacacattcgatctcaacaatgccatgggggaccatctaacttgacccaacatggccctaggggacccaccaaaccacagaatcctacacaatgcagctggaccacactatcccagactcacaacccaaccaaacccaacactgacctaggaaactcacaaaatgatacgaccaaacctatctcaacactaccccaaaaggctccatgagctttgcacaactcagagtaatatgaaccaattgagtcttcattaacacaacacaacccattgccattcgctgctgcttcaggaggtacccacaggagctaccaaaccacacaacccaagacccaacaagactcagtgtttccccactcgttacgacttaacctagctcttcctaaacccaatcccctccccccagccttgccctccaccctgccctccctccctccctctagggaggtgtgaggtcctgcagacctcaactgttcctcacacttcggtgaccaggtgtttccctgggggtgcccagagtggaggtggtagctcaggtacctccccgtccaccagccccccattggccttgccctccagtgggccacaaggctgcatgtccacatggctgaacatcccagcctcttcgccctctgtctcccggtgataaaagtagctgaaattggagacaatgacgggcactggcagggaaatagtcagcacgcccgcaatggcacacagagagcccactatcttgccacccacagtgacgggtgccatgtctccatagccaactgtagtcatggtgactaccgcccaccagaaggactcagggatgctagtgaaatgggagtccacccggtcaacttcggcaaagtagacggcgctggaaaagaggaccacaccgatgaagaggaaaaagatgaggaggcccagctcacgcatggaggcccgaagcgtctggcccaagatttgcaggccctttgagtgccgggacagcttgaagatgcggaagacacgcaccaatcggatgactctcaggatggccagtgacatggcctgctggcccacccctcgctgccgggccagctcggtgcccagtgccacaaagtagggaaggatagccacaaaatcgatgaggttcatcacgttcttgaagaagatagccttgcttggacagaccaggaggcgtaccagcagctcaaaggagaaccaacaaatacacagcgtctccaccacgaagaacgggtcattgaagggcaggcggggtggatttccaggcatttggctggagccattcagcggagcggggaactgcagggaggaaagtgttcagggagggtcaggctggggctaggacacggggacagccttaatcatcatttaaatacccagctcctctttacacattggtcagtagccgctgcgccaaggccctccgtgacctggttatcccagacttcctcccaggatcccagggatcatccctgggccgctgactttctggttgcctgacctggtgggtggctggagacgtggtccctgccccttcatgcgtgggaactcatgtttgagtagggtgcaacctcttctctctcaaagtcccgcctccagtgttgattttctagatggggagcatccctgccctggccccaccaccttgtgcctagcttttccttgccctccacagtcccagcccagagtataatgcggctgggcgcggtggctcacgtctgtaatcccagcactttgggaagccgaggcgggcggatcacgaggtcaggaaatagagaccatcctggccaacacggtgaaaccccatctctactaaaaatacaaaaattagccgggcgtggtggcctgcacctgtaatcccagctacttgggaggctaaggcaggagaatcgcttgaacccgggaggcagaccttgcagtgagccgagatagcgccattgcactccagcctgggcgacagagcaagactctgtctcacaggaaataaaaaaaaaaagaccttctctgcaagccgagccctaggccccctcctctggcccctcaacctggctttctttccatagattcctcctactgtcgcccctcgggctccagcaccctcagctggagttattcagggcctggctttcaccacccagccgcacagactccggagttttcaggctctccttggcccccctcagctgtgatttttaaggttcctgtcctcctaccccttgcatcaagggccctgccctcttcacgccgggtttctcactgacctcaaccccaccttctgatggggcaggtcctccgacccggatcctcaggccccgcctcccgcccaccctgtcttcggctggcccacccctcgcagcccctggccccgccttatgattggccaggtcccctctggaccccgcccatctcctcccaaaccccgcccgtctccacccacgccccgcctctcaccgggccggctgcggctgcagcagcaagccccgtgccgtcgcggtcgtcgcggaagtcaggcagcgtctcgaggcagaagacgacgatggagacgaggatgaccagcacggagactacggcgagcacgcgcgcggcctgagagctctcgggaaactcgaaaagcagccacagctggcgggcgaaggcgcggcggggcagggggcgctcgggcggcaccgggcagccctcgtcctcgcgcaggcgtgccagggccgccgcgcccagcccgtagaaggccacctcttccaggaagacgtcgagcggcacgtgcgccggccgccgcagccgcccaccggactggtagtagtagagcacggcgtcgaagctgggccggtgccggtcgaagaaatactcgcggcgcgcgtcgtcgtagaagcggccgcggcgcgctgggtcccctagcagagtgtccgggaagcggcccagcgtgcgcgcccgcgtctcgaagcgcagcccggccacgttgagcaccagccgctcgcagcagccgcacggcggcgggcaccgcggctccatggcgcgcgcagccccggcgacccgcgaaccgacgtgtggccccgacgcccggccccggtgcggccccgcctcggccgcctcggccgccgccgccgccgccccagcccggtgtccggtgtccggtgtccgcgcgtaaaaatagcccggcagggcggctagggcgcgagggagggggcactgtgaccccggcggggcggagggcgacagggcgaccgcgcgccctctgccgggacgcccgccctgccctgccccgccgccgccgccgcccgcgcctgctctgcgcctttcccgtcccggggtcccctttctctccgtccttctgccgccgggatcctgtcctgcgtctctccaagtttccgtgtgcgtgtgtttcgtcagaatcaggcttcagttgcagtcgcctcttttcttttctctttcttctttctttctgtctttttttttttttttttttttgagacacagtttccctctgtcgcccgggctggagtgcagtggcgcgatctcggctcactgcaacaacctccacctcccgggatcaagcgattctcgtgcctcagcctccctagtagctggaattacaggcgccaccaagcccagctaattttttttcttttttcttttttagttgagaaggggtttcaccatgttggccaggcaggtctggtactcccgacctcaagtgatctgccctccttggcctcccgaattgctggggttacaagcgtgagccacggcgcccggcctggagtcgccctgtttgcacctttgtctctcactctcttgtgtgtctgtgtccggctgtcccctctgggtctctgtctcttttgggatgtatctctgagtatctctatgggtcatttatttctgagattcgtcgttctgggggcctctgtatgggtccctctgccagcctctacgtctcggtctccgcctttattttgactcttggtctgtctccgtttatctcttgtctctcttggtctctttgtctctcctctctaggtctctttttgctcattatctcttagccctccatgtctctgtctcagggttcctcggccgctcccctttgggtctccccttgggg

SEQ ID NO: 120 - DNA, 49702 bp, Homo sapiens
ggcagatgtaattaacaataagcacagtataaagtcttagcatggcagtttacatagtcatagaatgttgcaatagttaacatattggttagatattacaataaagtaacagtggatttaataaaataagaggattatttcttctctcatagaagtctgagctggtaggtggtccaaaggtggtaggtggtaggcagctctgctttatgagtttgtacaggacccagataccttctatcttgttcaactaccatctagggttgaagatgactcactaccaccatgtccaacctccaatttgaaggaaaatggaaaggggaaagttgaaccaacagtacctttatgaaggcatggcctgaaaatggaagattatcacttctctttgcatcacactggcaggtaattggttgcttggccacatgtagctgcaataaaggctgggaactgcagtctctagttgagcggggtatgtttagctagagtttggggtgttattgccaaggggaagaagagaagaatggatagtggtgaacaattagtcaactgtcatagatgtttatctctatcatttgatcctctcaacaaccttgttagaaagcaggcacagattatttaccatcctcatttttgcagatgagaaaattgaggtggaagattaagggactccatcaatatcatacaacgaagccacatggcatagtgggacaactgcaaaaacttggtcaggaggtgccctggttgggcacagtattaaccactgagttttctgaaatgtattcctcagcctgggaacagaatttcccagtgcttgcagcttctttcaagaaaaagcttcccggtaatcacgggttagaggtcggaggagcacaaattcaagggcattttgaacatggccccacatggatgtgatctggctaacccatctttttttttaaattatttattattattattatactttaagttctaaggtacatgtgcacaacgtgcaggttcgttacatatgtatacatgtgccatgttggtgtgctgcacccgttaactcgtcatttacattaggtatatctcctaatgctatccctcccccttccccccaccccatgacaggccccagtgtgtgatgttccccaccctgtgtccacgtgttctcattgttcaattcccacctatgagtgagaatatgcagtgtttcgctttctgtccttgcgatagtttgcccagaatgatggtttccagcttcatccatgtccctacaaaggacatgaacgcatccctttttatggctgcatagtattccatggtgtatatgtgccacattttcttaatccagtctatcattgttggacatttgggttggttccaagtctttgctattgtgaatagtgccgcaataaacatacgtttacatgtgtctttatagcagcatgatttataatcctttggatatatacccagtaatgggatggctgggtcaaatggtatttctagttctagatccttgaggaatcgccacactgacttccacaatggttgaactagtttacagtcccgccaacagtgtaaaagcattcctatttctccatgtcttctccagcacctgttgtttcctgactttttaaagattgccattctaactggtgtgagatggtatttcattgtgcttttgatttgcatttctctgatggcctgtgatagtgagcattttttcatgtgtctgttggctgcataaatgtcttcttttgagaagtgtctgttcatatcctttgcccactttttgatggggttgtttgattttttcttgtaaatttgtgtaagttctttgtagattctgggtattagccttttgtcagatgggtaggttgtaaaaattttctcccattctgtagtggctaacccatctttgcctcttccagtccaagcacagacaatgagcagagaggaggacaatgtgggttaatggaaagaacactggattggggtcaggagaccccaagaacattgaattggagtcatttttagctcacatcaattgcatgcctgtgaagtgacagctactgagcttgacactggcatgtcttctcatttaatctcagaacaacactgtgaggtagatgttactatgtatatcttacagaagacaaaactgaggcccaaagagctgagtggcccaaagttatatagcttgtgagaggtagggctggaattctaacctagaccttctgactgctaaccccaagcccttctacaaaatcatactgttctttacgccaagtaactgctgggcaagctggaactgaaatgggatatgtcaccagtcacacggatgacccgtaacacgtctacctggggcccaggtacttaggttgtgtactttgtgagtctgctttttgtgtgtgaaggaaacccgtatatcagaggttggatcccctaaattggccttacccacacattctgcttgatctaccttctctgggctatgcttttttctttgttaattttcttctcttttcaaaattgctgaaggaatgtatgttcataaaattcaaataatgtagaaaagtcagagatcaattaggatgcttccctaacctctctaactccttttccagtccctttccagaggagaccactttcagcagtctggggagcacctttggatgtttcttgtctaagcatttatttttgtcaagatttttaaaaagtaaaaatgggaatgtgtgtgctgttttgcagttcactttttccacttcacaataccttgggtttatctttctataccagtatattaaaactgatctcattattgctggtggacatgtgttgcactagacacacacctgacttcaggtcctgctccgtttggtattttatgatgtgtggttaatggtgtggagtttagatccattcaacctccgtcctgaatcctggatccatcacttattagctgcgtgatcctgggaaactgacttaatggctccatgcctcagtttcttcgcctgtaaagtggggttaatatcggtaacctacctcataggatgctaggaggactgagttaacgcatgtaacacatttacaacagagcctgcaacatatgctatatgagtgctagatgaggtttagctattcttttcacacctgaatactatttcataatatatttagtctattacttgacatataagttgtttgtgattcttttttttttttttttttgctaaaacaaacactgttgtgatcagtatacgtttacatatccctttgtgcacatgtggaagtgtttctgtagaataaatttcttggaatagcattagtgggcctgagggtgtggggattttcagtggtaacatcagttggtgggctctgcttgaccatgcttttcttggttcactcatatcagctcacccagtagcagctgttgggcatcctgccagtgtccttccgtcacatgtccagtggttggcagagctatgtggcagtaagcattcctctttgtcttcccagggcctggccctttgtcagcgttcattagactggatggcttggcttcctggtgatcctgatggagattctgaattgctactttatgtaaagcatggtgcccgggggagacatgcccagggccaagaaccttgatcagacccacatgcccagcgtaaggctgaggatgagattgtacaagtggtcaagagaatcaacatggtttcacccttgaatcagtccaggttcactaggggttccatgacatggcactttttaacttggcgatcatgtctttgctcagtgatatggggtaggtgtggatgtgatgattcacacgatgcagggatcgagtgcacctcccaaaaaacaggaagtgaaataaagcggcactgtgtattgctgctatgacatttctcttgatcttattaacacaggaggggctaagcaataaatgtgataatctcacttggggaatttggggttggttgtttatccaatccttgaacatttattgaacagttattttgtgtcagacacggttattgatgttggggtatggaactatggactaaggcataatttcaacctttgaaaactccacagaagctttaagaacccttgaggagacttaatttttcaagaacaatgggaatgaagatataatactgcaggtggggcctgagctccaccctggatgaggctgggggatgggtatgcatgggattattggggtcccttcacacagaaatgctcactggagaggctttcctgtacaaatattagaaatgtaaaattacatgttaatttctttttctgtgcttagaaaaggtgcaggatatataatttagaaaaatgtaaaggaaagttaaagatcacctataactgtctcatcccaatgcaaccattgtggaatgtacgtgtatttatttctttatcatgtttgtatgtaggtgcattttaaaagcaaaattaggaatcatacttcatattctgctttgtgacttgctttgtcactcaaactgcattagaagcatttcacaaatctttgaatattcctttactacatgatatgtaatggattatggtgttctgttatatattatagtcaagttagtcaattaatgatttgaaagggcacactggttaattattgttgtcttttctcctacgcctcctggttttggcttttattattttgtaaagatgcaggagaaatcttgagttctgagtggttatcccatcctttgtgaacactgctgtcaggcacacaaaacaacatgggctgggcatggtggcgggcgcctgcagtcgagaggctgaggcaagagaatctcttgaacctgggaagtggaggttgcagtgagccgagatcgtgccactgcattccagcctgggcgacaagagcaagactccatctcaaaaaacaaacaaacaaacacacacacacacacacacacacacacacacaaacccacaacatgattccagtttctatgctcattttagaatcctgcacctgaccaccacgcaaaaattcctctggataacttcatctgggccttccctccggtggaactggaagattgttttccaaactccactccttttccatttgtgttgtccactcaccgagtgccccttcttctttcatttttagacacctcggctgcagctgactccagaaacatattccctctttaagtctcggctccacaggttgcctcttctcctcatcatttctcgtttctcaccgtgaaaatctttgctttctctctttatggcttcctgagacccgaaaatagaggtaatttaaatttggtaattatgatgacaacaaaacaacttatgttgaaatgcagagtttaaaatgccagagtttcctactgttgagatctctctgccttcattctgtggataccgctgtgggagcttacctgagtctgccccagatcaggaggccaagcatgaggcgatgagaaacagcttctgcacagaggtggtgacttctacctcttgggggatgggggctggtcagccagagctaccacattcaggttcagccccttcagaccttcctaagctccaggtggaatctttgccttcccaccttctggaccctgcacggggagggtctcgggctgtagccacgaggcggcattaggcagctagaatcacagagtggggactgggggatggggtttcttctctgacagtggttaggtgagtcactctctgtgggctgctcatggcagcctcttcctccatccttgaagcgggccttccaaagacttcacctgctccgttataaaaggctttgagttctgcaagaggcagctgtgaatgtattagcatcctgctttctgtatgaacatcctgctttctggcacatggctaggccaccgcttaaacaaccggcgccaattcacagtgaaaaaagatctgctcaaagctggtttcagaaggaggacacgggaggcgtataatatcgagcccgtctcccgacggtgccatctgttctcattaaggcagccacagcgccgaaggaagggcctccaggtgcacacaaggaagcctgctcgccttgttatcctctcagagactttgccttttgttttgtttagttttgtttttgtctggcaggctcaaaaagacactgttctactttccgcagaagaatcactctcacattttaagaaattaagtctctgggaaaaaaaatattgtttgagagggcttgtaatggctccttgaccacatgctgtgcctgccaatttataacagagaaatattacagaagttgggatccaaggttggtgtgcacagccattgcttaaagagggatggatgcttcctggggacaatgatcttcccccgggccccccagcatttattcaatctggagagaattgtctgccaggctcccactcctacatcccaggaagagctgggcacattcatcatcttgtgtattcagaaagtgatgataattcctctgagagccaactgggctggggagggtgtgatcaaacttctgctggcaatcagactgcctttggggaggggagtctccattttgcaggtatgtctctactgccagtctgcagggaagcctacccagtcaacaatatgttaccatgaaaatctccttttgggggtatcttatatcacattatagggaaaggcagaggaaatatcaaaagcatttggccctgaatttaaaatgatctttccgtagatttttatagactttgttttacaagattggtgtaaggcctaaagcatgtcttcaggcctcttacatatcctccttctctctgggggtttccttcctgcctgccctcaacatcccttaccacacacctattctgtttctccccacatgcatggtttgtatattatgtcctgtcagtcaattcctactaaaatgttagctgatgttagggtattctcgtgggaagatatttgcattttaataggtggcttgaatatagaaaagcttcatcctaaagttgcaaaactttaggggaaaaacaggcaattttggatagagtgagggatgaggggatgagaagggggaatgtatgtgaggtcagagacattctcacatctcactgtgcatcatccatagaacttgcctttcttttctctcttttttttctttgtccctgacctcagagtaaatggcacctcacacactcttgtgggccagaaagaaagtctttcataggcagataggaaataagacagcagtttttccaagagtactgaaatgcaacaagtctactggtctgttgagttaaaaaatggtcagtttggttgttcttgttcatctagttcagctgattggttcggtagaagcaatagagtactgtactacagtatagtaaaactgttgcttcacagcagccatccctaaactttttggcaccagggactggtttcatggaagacgtttttttttccacagaaggggcgggagatggttttgggatgaaactgttccacctcagacaagatcatcagctattagcatattagattctcataaggagaacacaaccgaaatcccttgcatgagcaattcacaatagggcttgcacccctatgagaatctaatgcagctgctgatccgacaggaggcggagctcaggtggtaatgctgctcacttcctgctgtggggccctgttcctaactcataccagtttgtggaccaggggctggggacccctgatttacagcactaagttaccagtttccacgtcggtgggattggcggaaacttttcaagctctgtgtgatggagtaacacagggtagaaagagtacccttgtgaaaagcctggctgcatctgcccctttataaaggagacaattgaagctaatttatttttaaaacacaaaatgaaatttggtttgaaatttgaggaggagatacattgatgttgcctctgagaaggagtcaaagaccaataaaaggtggttctttctgttcccaaacccagaagccaataggggccacagaaggagcacagtgccacggtgaccatgctgcagcattgtcagatttagcaagaagaaatacagggtgcccagggaagtttgaatttctgatgaacactgaagactcttttagtatgtatgatttttggaacatatttatagaaaaaaattatttatctgaattcaaactgagtgtcctatatttttgtctggcaatctggtaccatactgcccctttgtaattccttgtatatgttgttaaagaataatttttctgaagggtaaaattataactcttgtatgattataaaatgaacatgtgtcaaagatttttttagttcactgattaatgagcgaatcagtaagatgtcacaactggttagaagaattcagaacacacacacacacacacacacacgcacgcacacacacaatcaggaaaggctgaactgaatttgttaatagttgcaaaactacccaaattcctaggacaataatcaactgcattccactgggcaaaattaatttgcgtttctatggacaagaatcatttgcattactctcagttttctacaacttgcagtagttgtaaaataggccaaagacaatgaacactacagaataaccaggaagggtgtgttagaacatccatgaatcatctttgcctatttcaaagcctttcacaatggaaacatttgacagtgttgtgctctctcctatctcgggcctttgcacctgatggttcctccacttttttagttgtcttgaacttacccttgactgtgggagatcaggatatgccactccaaaatatgcctctttggcatgaggattgttgagctgaccgcaaataaggagaaacacatgcaggaaagcaccctgctctttccctatttgcctcaaatcaggacatacatttatgaagacaaaagacatcccacctcctcttgctccccaggcaaacagagattaaccacttaagacaactttggatccttacatgcctggagagagcaccagaggaacctacattaacaagcttcaccaactagcctttatctgccaattatttgcctttccaaaagttgctgcccctaaggactcaaagttcttttcctttgtgtcacaaatctaaaaacgtactgttccttgttgaagatactatataaattggtattcaaagccacctcttcgaaagtttcttattctctgggtttctcccatgtatgtatgaaatatacgtacatcaaacaaacatctgtttgtttttctctcgttaacctttttttttttgtttgttacaggggactgttctaagaacttataagagttaagaaaaaaaattatcttcaaacatcattacctctggaaagctcttcctgacccacaaactaggttgggttcatgtgctacaagctctcacaggaccatgtttccttcattagggcatttatgtgagtttataattcatcctccttactgaggtttctaagtccttgcatgatctgacccctgcacccatcagcttccctttcaataactgtgctctggtcatacttctctcccttctgttcctcgaccataacaagttcttccctgccttaaggactttgcacctgttgttccctgtgcccggaatattttttctcttggctcttgcaaggcatgtttcttttcatccgtcaggtctcagtttgaatgtcagaaaagcctctcctgattatcttatctaaagatgctcccttctccaccctcactttctattctagtgattcctcagccttagcacagattagaatcacctggcaggcctgataaaacaaaggttgctggggcccatggccagagtttttgattcagcaggtttggaagcagcatgaagttctgtgttttaccaagttctcagttgatgctgatgctgccaggatgggcatcactcttggagaaacactgctctgagtgttttctttcaacacctgacattattttccccctttgctgatttgctttctgtctcccatagagctgaaagttccacacgagcagagatagtgatgctcctattttctgattcatctacggtactaagaacagtgccttatataaaagaagtttaatgattatttgatgaatgaatgaatgaaccattttctatttttttgttttgtattgtaacaaagggtttgcttaccaaattactgttgaactgaggtgccagaaccaagttatagagattggctttcatcactaagatatgtttgtggaagagtagttgtcttaatttaataaaccacaacaatatttgaccagtaacttgaataaagacaagtgcctactgcggcctacactttccattagcacgccttcctgcttagggtcaatgtcattaaccaacagttggttagatgacatcagggctttaggtgctattgacaggtctcaagaagatatgagttttgccaagactggtagctatgatgagcattcagaagacatatatggcaagtggggtgagggaagggcttgtgctttggctttaagcatgcctcatggatgaagcagcttgggtaaaggaagggagagagaggaagcagggagaatccttcctccaagctaggttataggcagtgctctcacatccctggtcttggcaggtcctaactccaggcctcctgatgcccatattctgttccaaagaccacagtccaggctttagggcatagcctcaggctctcctacccactaaccctctaggttctgtttgtttccccccttctactctcttctatgccattcctctaggcttttaccttgccatgtgacaggcttatgtggtaaactaatgggtcctaatgactgccacacacacacacacacacacacacacacacacacacacccctatatataaggccacatgcggtggttcacgcctgtaatcccagcactttgtgaggccgaggcgagtggattgcttgagctcaggagcttgagaccagcctgggcaacatagtgaatccctgtctctacaaaaaagttcaaaaattagccaggcatggcggcgctcacatgtagtcccagctacttgggagtctgaggcaggaggattgcttgagtccaggaggtcgaggctgtagtgagccatgttcatggcctgggtgacaaagtgagaccctgtctcaaaaaaatatttatatatccatatgtatctccttggggtgtgtgtgtgtagtgagacacaatatggcatagtgcctaaaagcatatactctgaagccaatcctatgtttgaatcttttttctgctaaatactgtgtgtccctgagaaagttgcttacccattctgttcttcatattacggggttaacaacagcactaaatcatagggttgttgtagatataaaagcgataataattgtaaagggtttagttcctgtgccttgtagctaccaggataataggcctaatagacagcaccctatggaaacagctttccattttaacaagggactttggtaaacacatgcgctgagtacaacactcttggaagatcagatatttgatggcattcagatgacagcatgtgagcagatgcctattctgtctgggtgttaggggacagagcactaggtgacttggctgctgtctctgatcttaaaaattgctcagaccctggcaattgaggataagacaataatagcaatgttgtattcaggagcgttgctttaaataatccttctccctaatagctttgcccctggcgtgtgacaggtgtttacattattaagtaaaagcatttaaacagcgacctccttggtataagggtgaaggagattaaaatccaagcagtgctccagctatttaaatcaatgagacttgtcagatctgtaacacatgagctacttagagggcgcaggcacctattgttttggagcttcgactaatatctcaatatgctccctccctccaagtctagccaggccctgggatgctcattaaaggctggtctgaccacggcctctttccctgtggaagcagcattaactaactcttggctagatgcgtggcaaatagttatgctattagggaggatcagagcttgagttgattcctgcttagagaaatgaccttgcacggaattccagcggttaagttccttagctaaccagaagcagggaccataaacattgtccccttcttccgctagggggtgctaaaccaggctgcttggctttgcccacagccatcctttcttgagttgtgttttcccagtctttagctatgacattgacaacttcaggtccacctgctgcattgaggaaccaagtttctgaaacttaaatctctctcttttttaaagcttcatgctctcatcatgaacaagaaacctctctcttccttagtaatcaaacttagatccttcatttgtgtcaacggaagggaagtctccacgtaagaagagcagctggaccttaaagatccaactcttattcctcaagatttattgtccccttggaggtctctagctaatttctgcaggtcctacaaggctggcttcagagggagctgattcattattaattctccagttctaagcaggcgaacaaggtgggggacacttgaaccttttaattccttggattcacagctgagccaggctggccacaaaaggaactgcacacaggcagggttacaaggcaaagtttacttttcttcaatttatggcctcatatgtctgcctgtctgactcatggaatgttgccaggtggagggttcctgatgccaagagaccgcttaagcctcatctgtggaagtgctggttcagcagagggtgaagcactttcttcctgggtggtctcaagttctcttttcctggtgattgactttgggaagttcttcctgtcacaggaaagccctacttctatccatagcagcaggtgaggccacagcctttagtctctacatgacttctttgtcaaaatgcaacatcaaagggttcacaaggaaaagagacccatgcaaataatccctggctgctcacagtgtcaggaccagcagcacaagtatcccctgggagcctattagaaatgcagaatctcaggcccccagcccttttgaaacagaatttgcattttaacaagctgcctagatagtttgtgtgcatgctgcagcttgggaaatagtgacagagcagagagacagccttttgtctacactgtctctttccaccacaagaaacaactgcattaaagcttggttcaaggaaaagtcctgtgatgtccctgtcctttggagctgaggaattaacatgggctctgtggggtttttctggaggatggcagaattgttggggatgcttgaacttctgaaaatgtttgaagggagaaggaatgtaacgaaccttctgctcagagcaaagcaatgagaccgcatcatgggttagagaccactgcacaagttgctttgcttatttctataattgtggtcagtacctctgccatctgccatcttcctacagcagtgtgtaggcctctaggaggctttagcaagatcagcacccaggtggaggcctcttagaagaaaaaaccctgtcaaagtgcaggggactcccagacaatgcaacattcatttaggccaatcaattctgtcaaaaattcattcgatgaaaatagtaccaagtgggtactcaactgcttagccaatttagtctccacagcaactctgaggctacaggtaaatacagtctcaggcacggaaggaaatctggtatttattcagagaggcagtagacatccctctgtccctgacttgctagctatgtgacccaaggcaagttacttaccttccccaaccagtagcttctccattttaaaatgggttatcagaaggtattgatcttctgggtgtgttgtaaatgctaagcttactattcattctaggccagccaggcatggtggctcatgcctgtaatcccagcactttgggaggcccaagcgaggggattgcttgagccctggagtttgagaccagcctaggaaacatagtgagacccagtcccagcaaaaaataaaaaaaaattagctgagtgtggtggtgcatgcttgtagtcacagctacttaggaggatgaaataggagaatcacttgagcccaagagctcaaggctgcagtaagccatgattgtgctatttcactccagcctgagtgacagagcaagactctgtttaaaaaaaaaaaagcaccctgtaatgctattactcacacgtaaagtcttctctataggaggtaagaatgatatttcaggagtgtaaagaatcttgatgtcaccttatggaaaggggatgaaaaagaagatgaaaaaggcttgttttcattttgccagagtcatggattccagttccaggtctgttttgcatcaccatagtcccaaacaagtgtaacatccagagcccaggaggaattctggatgaaatatcagccaggagcaggagtgtgacagctgtaggtcacttgggccataaagttagttaatggggaagacagatgaatgagtgtattgtggcaacatatcagaaggtctgaggcataaatagtgttggaaaataataagacagttggttcttgaggatcaacattgcagggaaggagaaatgcacaacaaaagaccatgttgtgtttttggatggtggccggggatgcacattcactgcccctcccctcttcaaccccactctccacatcccgtgacctggtgggatgccagtggtcatgagatcccatcacatacatgagtttcaagagtcactaacaagcttgtaaagaacaggtactttctaaggaatattcactcttgcagctgtattcctagggcttaaatagcacactgttttccactgacaaatgatttcgggtagggtgatctcatgaacttgtactaatggcagacacatttgaatttcttttttattctgaaagttaactgctgaaagcaaatgtgaaaaaaaaattatctccctctgttttatctctgggagaagataaaaatacgaggtgttttaatttggcagtgatctgggcgccttccgctggcctgtttttcttttgcgaagagctcccactttcaggactgccgtttctttgatcttatattctgtctgtgttcaggtacccctttgtgcctacctgaatcgtgtgtaacaaatcatcttaattacttcaggcctggcttcctcctccagttctcattttctgaaattcctgcgatggttaccaaataaatcagtgtggggctccagcccttggaaacagcacggaggcaccagcagcagccagaggaatttcaaagttagttaaaaggcacaggaggagtgagggaattgattgagaacctccctacccaccatgattttcagcctggagagttagtgctgcctgtactccaattccatgtgctttgcggggctcagccctcacacttttccccgtagaagagagaataattaatgccgtgaccccttggcgtggtagctagagccctgctgtcatcagcagtgccccaaacgcagtaggaacacgtaccgtatttcaaagcccaggcaggcagagaagggggaaggaactggtggcgcgctgtgacctgcgggagctccccagcgcagccagcaggaggcccaagctaggcggagagagggtcgtggggaagcgggccgctcccgggactcgtcactgggttggagctggcccgcttgagtggctccagttccaggaaggccgggtggcgtggggctgtgtttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccggggctgtgttttaagtggccgtttgtaagaagaacctctggcggagaggtgctgaggcaggctgggctgtgatcctgcacgccaggcggcctaaggggaggtaattgggaaccgcgagctgacactgcggaaaaaccaaacaccgcatattctcactcataggtgggaattgaacaatgagaacacatggacacaggaaggggaacatcacactctggggactgttgtggggtggggggaggggggagggatagatttaggagatatacctaatgttaaatgacgagttaatgggtgcagcacaccagctagcacatgtatacatatgtaactaacatgcacattgtgcacatgtaccctaaaacttaaagtataataataataataataataaaagaaattggtatttactaagaaaaaaagtgagagttctgtgtaggcctttgaaaaacacaaatctcttacttggggagacattccagtttaagtattatatttgacaaagtcctaaattatgtttaaactatggttatgaattttactaggaaaggaagaatttttatagcaaacaaattacaggaatttcaaagaccaaaaagaaaaaaaagaaaatgtaagccgcgaagccgcatcaacgccttcctgacagcggtgtctgttagtccacggcgtcccctcctaaggggagctgcgaaagacccattccggaggcatttcacggggccccgtaacacccgggcgagtgagctactgagaactgcatggctccttctggggccaggcggtcctaggagagccggctgggaggcggattgcttggacgtcccccgcccgcccccgcaactctgcgtgcggcgacgttgggaggtcccattagaagctccttgggcgggatctgtccaccatgccgcggcgcggagtgggagaggtttcggtctctgccaagggaagttgctgttgagtgcatcgccgtgaacacgacgcagcacatcctacagcccctgtggatatgtggatgctgtgggggcctgttgggtccgatagaagtttcaaaatcaaaatttttcaccatcctcgttgggtgatggtttgtagaatatttttgagggagtcttgtttgaggcggacagactcactcatctggtacactctttttcgagaacatggtgataaaataggttggctctaacgagaaggtgtcattccgccactccctttcccaagagggcttcgagggacactcaagtgaccaggatgtggcttatcctgtgatagccatctgagaacgttgttctctgttctttacttgcttctagtcagaaaacatggcctgtgttaggcaccctaggggataaagtgaattagacctggacctgactccagttttttcttttaaaactcactcgttttttcttcaaaaaataactcccccggtgtttctaatgtacagctgttttttgttgggaattactacattaaattatctctaagactcttctcatttcagatattttttggtttcctaattgtctaaaatttttaattatttttatttttattttttatttttttgcagacgtgaggcctccctatgtcgcccaggctagtctcgaactcctgggcttaagcgatcctgccacttcagcttcccaaagtgttgggattacaggcccgagtcactgtgccagcttcccctagttcttgagctcttctagggccactagattctctttcaccagcatgaagtaggatcattttagttagggtcaaattataaccttaaatcccaagtgacactgttcttttgtgaccactaacccctcaaaagatttttttttttctgatttcaaaacttctcctcctaaatcatcctgcaaattttactgaatctctactgcatgccagaggccccattctaggcattggggaaaaatacagtggtgcagacaaggagcctgttctcatggagcttacattctagaatcggatccagatcgttatgaatttcccctttattttgttttagtctctttcttaaactttcaactgtattcttctggttactcaatcccagttcatcctagggcagaaacataaattaagtccacttttatacttggtattacgcactgaatgtttttgtctctttcaaattcatatgttgaaatcgaatccctaatgtgatggtatttggaggtgaggcctttgggaggtaattaggtcatgaggaaagaaccctcatgaatggaattagtgccttttagaaagaggcaggagagctagctcatttgcttgccaccttgggaggatacaacacgaagttggcagtttgcaacctggaagagagtcctcgccagcacctgaccatgctggcaccctgatcgctgactttcagcctccagaaatatgggaaatttctgttctttataagtcacccagtctatactactttattatagcagctggaactaaggcacttgtttatccttcatctgtaggaaaatgctaaatcagataatggcaaccactgtgaactatattatctctagggtattatggggtctccatggcaggtgagagaaatatctttttataactaaaaatgttgagcactctaaccatttggatgcatattttttactctctgtatttaaaagttaagtctcattttctacttgtagttgacatctgttgttatcatttacttctctgttacatgcagggaggatacattccctagtcttccatttttgtgtgtagggactttttcagaaaacactcctagctccttggtttcctgtatcccccttttcccttcccctcaagggaggaagcgtgagctacttgatgggtgagtttgggtgcagtggctgagcatgtgactctcagcccctttctattttctctttgtcacctacaagtgtgcaaacagctttctatgctcttccatgccatacatgacaggagcaggcccccatgggagactgcatgtccgtgatggggcaggcccatctaattcaggaagcaagctcatttggttaacagacctaaagccatgttgtaaggctgacattttagggcttttctacttggctcctgggtctttctctcaactggctccaaactaaggtggggcattgagctttctcaaaccccaacagtacccatatctcaattccctagagaaccaccttctccagctcatagtaagtttgaattaagtgaaactgactctacacatgagacccacaattagctccccttggctacaagatttgtttaaggatgaacatagggcccagtcagatctaatgaatcacagtgatgttttcctcgttgaggaactcttaattttatctgctggacctaaaggagggtgtagggattacagccattgctgccatcccattacaacatgaagccaagagatgtagaaaaatgctcctgatgccattggttgagttcaggtttcagccacatctgaaatgtattctacccctggacttttcatcttaagtgaaacaataagttccctttgtgcttaagctagtttgggtccgtttcctactgctttcaatggtaaatggatcattctttatattattttcatattgttagttttaattgattttagatcaccacagatcacctcaattactcacgttagatcccaggagctagaagcgattttagaaagtgttaatagcaggaggatacttaggttttaatgttgagatgttaattattttaggcaccttttattacctatttactttgtctatttatttgttattttttggtaaacaaatctgatggggtacttgactatagtaagtctttaatcaaactttaacaatgcaatcagttcattttttccttttgattaactggagaagagcaactcttggtctttaaagtcatagtgatcattataaatatcctcaaggaaacaacaaactcttgaggaaagttatttcagttacatcccaacataagagactggaaattttttaccaagaattctggtagaggtgtaatataaccaggagggtgttgtggtttggatggacaatgagaagagagaagggccttctgggaatggggaagaaaatcagtggagttaagagtgaggcacattcatagctgctgaggtggagatggcaagctgtccaaaaaaaaaaaaaaaaaatgtgagctttccctttcatttttcatagcattgctgctgggaggtggctgctcatccagggactatatttttcaacactctttgcatctagatatggtcatgtgacttgttctcaccagtgaaatgtgagtggaagctacttctatgccaaggcttttaaaaagtagcctactttcctggtacgtttcctcctttcatccctacattgtccttctagtggttagtaggggcataaactcgaagcttggctttctgaatcactgaatgagagaaaacttgctttgattttttttttttttttcaagagacaggttcttgctgtgtcacccaggttggaatgcagtggggtgaccgtagcttactgcagcctcgtactcctgggctcaagtgatccttctgcctaggcctcccaaaggtgctaggattacaggcatgagctatcacgcccagactggactattttgtgaaagggaaataaagttctattgtgtttggccactgtattaggctgttcttacattgccataaagaaatacctgagactgggtaatttataagaaaagagatttaattggctcatggttctgcaggctgtacaggaagtatgacactggcatctgcttctggggaggcctcaggaagctttcccttgtggcaaaaggtgaagcaggagtaggcacttcacatagagaaagcaggagcaagccagaaagagagagaggcagggggagatgccacacacttttaaacaaccagatctcttgaaaactcactcactatcgcacggacagcactaagccatgagggatccacccccatgatccaaacacctcccaccaggccccaacgctagcagtggggattacatttcaacatgagatttgggcagggacaaatatccaaacaatatcggtcagtgtgcatttacagatatatttgatacaaaaagatctcagtgcttctcaaagtgcggtttccagaccaggaacatcagcctcgctggagacttgttagacatgaaaattctcaggccccactcttgacctactgaattagaatctcggatccagagatctgtgtatctgacaagccctccaggtggtcctaatgcacactcaagtttgaggaccactgccttgtgccgtccctaccaacttcatcaccgctctaactgatcagtagacatgggttgtttctctcctcagctttgccttttctggattaaactctcaaagtgtctaaagtttctgagcttcattagcaatggtgctgaaagttaaggataatgttgaaaaatcttgtgcatgagggaagacatttggtgagtttgaagttctgatgaattttgagaaaaagaaacatcctgaaagcttaagatagcttaaaaacaacttttgttcagttctaaatattagcactttttataaaagggcatatatcctacctagaacaggggtcacaacccagatgccccccaggtaatctaatccaggggagtgggccaagtggagggcagcgaacagtatgaagcaacagctgattgttaagagtatgggcccagtgacttcaggtctaaacattattaaaaagaactgcagatttgcattttcattttacatcttctggtttgtaaatgttaactcacattacaaaaaatccaaatccaagaaacaaaaccaaaaattttgtatgggttgaacatgcctgagtgtttaatttggcccctgggctgccagttttacaacctttgtctggaagtaccagggaagcagtcaggttgctaatgtctcctcttactcattaggaggcaaaataacttttacacaatcatgagctccaaaagggagacgaataagagctgtacaaagtagttgccaaggtaacatcttgctgatcagaaaggggcgacaattgggttttatgtagacgcagtgggagaatgaaacataatctttctctgtcttctttctgtttaagatcagtgtggaaatggatgtggacgcggtgctgctgcctgagattagcaggaagcaattcttttcccatttggagagaccccggtgagacctgatcaactagcaacatgcggaagtcacaccattaagtcttccaatttgctagcagcaaatcaatgaactctgatagctgctgccctaagctagcatccagggaactgtggacaagctatttgatacctgaattttagtgaaggaaagttaaattttttcttaaagcagggtgggagtggggttgtgtggggaagattatattaagcagtgagagaagacagatggagttttgtagaaagagagctggttgttttaaattgtatcttaaatttattgtagagctattggtaattagtgttttgttgttgtgtgtttataccaaccaattaataagaaaggcttttatttttatttcatcagttggagctgaactttattttttattataaatataaggcattattctagggcctggcaaacataggcagccactttttttttctggggaagattataccttggtatgttttcaccactgtgagatgaaaatttgagaacagtgagagacagatgcttgcctgaggagttttattttccctttaatccttatcaaatatccagatattacctatattgccttgatctgctgtctgaaggtgggtttctttgattgtttgaagagttctgggcactagaggtgcttactttgtgacgggagcaaataacaaggtgttgcccatgacatggtcaagcctcttcttcaattagccacctatcttgggcatgttttcatagagatatatctcatcccttttaataactgcagaatcttggacatttagaggtctccaaatattggttgtcatttatggtgtatcgtgtttttgttattataataacgttgcaataaataccctagcaacctatttttgcttacaagtagagtattttcgaagaacaaattccttcatgtgaaactgacgggtcaaaatataaaaggattaaagtttcaatagttagttaattgccttacaatggaattacaacaatttatacttccaccagtaattcatgaactctgccttaccacataatatttctaatctttcccaatctgatatggagaaacatgttttattattctatttttttttcactaaaagagagactttgaacacccctccatatgtttcaaaaacacttgtagaccaggtgtggtggctcactcctgtaattccagcactttgggaagtgagaagattgcttgagcccaggagttcgagaccaacttaggcaacaaatctagacaagggagaccttgtctctacgaaaaaatgaaaacattaactgggcatggtggtgtgtgctgtggtgctagctgctcaggaggctgaagatgggaggactgcttgagcctgggaagttgaggctgcagtgagctgtgtgatggcaccactgcactccagcctgggcaacagagtgagaccctgtctcaaaacaaaacaaaacaatacaaaacaaaacttttttttttcagtgaatgtttctttatagatttcaacttctaaaaattgttggcactttttttgattgactgaagagctcattatatattaagcaatgtagactttttttttttttttttgagacagggtctcgctccgtcgcccaggctggagtgcattggtgcgatctgggctcactgcaacctctgtctcccaggttcaagcaattctccccgctcagcctcctgagtacctgggattgcaggcacctaccatcatgcccggctaatttttgtatttttgtagagatagggttttaccatgttgttcaggctggtcttgaactcctgatctcagatgatctacccgccacggcttcccaaagtgctgggattacaggtgtgagccgccgcgcttggcccaatttagactttttaaaccaacttttgaaggttggtttttaaaaaataaatgactggatcatgttctaactactcatagtctcagccaaacacaattgcggaaggcctagccaaaggctctttgctcagtgaaagtcccatgaatctcaggcacagaggatagtctggaaagacctaacctgcacatgcaaatctattaagaaagatgaagtcttaggcttatatggagctaaataattgcatgtttaatgcaatgccagggtacaggtaatggtgattggagttggaggggtgatgtgtgtggtgggtgaggaagtcagggctgagtcctaggtgagatctataagagtgatgtttatttatgcatctgagggctgggactctcatgacaggatttattttcattctctttcaaggagagccatgctgccttgctgcttcttgctcgtgtacacagagcacttggtgtcttgcgaatcccctttgacgccggtgcctttccaggccagtgctttgcttgtgttcagaggatgcatgctcaggccctaccagactatcttagggatgaggggcaaattttgtttccaatgctctgtgtgggccctccatggcattttcttcattttgggttccatcctggcctaaagcttcccattaaagctaatggccattggagttaacccaaattttctcctttggtatttataaaaagcaacactgaaaaaccttgaaattaactaacaataaaaaaaccattgatcggttctttcctggagatggttctttcttctcaaataggccactttgcagactggaaatcaccccaatcctcaaatagcctaatatttttcacatgtgattccagcaaattgctgtttgcattaacaccttggtggggactcacttaagagctagatttgttagtgtatttactgacattttcacatgatgttttcagctgcctgaataattgtaatattcaccagaaaaaaatcaaagtaatgaaaggtgcctacaattattcatatctcaacattgtaagccttaatttcctgcctgaagtgtggtaaattactcatttttaaagtcatctctagccactgagagtttatggtgatgtatatagatgttttgtagattccaaaaaaaatcaatgactatgaatatcacagactgtcaaaacagctggtgtgattataaaataatgagatcaactaaagacatcagctctcagacatccaaattgtaagaggaaaatgaagacgaggaaggggaaagtgaattgcttaatgtcttgtaggtaccaaataatagagtcagtatctgccactgccatgctgaagattttgcactgttacttacacagattcattcccctttttgcaggctttgttgggccaggagatggttttgcagcagcagaagactatgaactgggctttgggagataggatctctggttgtattctggctatccacactctgaaagaggaccgtgacaggtattgtcattattggtggctgagtttctaggttagccaacctatggcagattgggaagactttataatgcgaataaacagaagaaagtttacttgatcaaaaaagattttttctcctggtggaaactgcaattattagggcaactctttaagtgtccatcaatattaggatgcattttaacaggttaagtactcttctaactgggatgaatagggcattgacaggaaaattaacacacaagttcttatatcctccttcccttatatctggtcgcataacctaatgtgaattttttatgcctttaagtgctgatattatggaaaaaccttctaaaactggataaatatcattttccaagactcagatcaaatatcacatctttctctgattttcttgatccttcctgccaaaaagaaatagcaccatatatgcattagtataatctatttgtaattaacataaaatttctcattttacagagaatttgagtatcctaccaatatacctacaaaaggatgaaagaagatttggagtcaagggaaaacaagggcaataaaatagaagcttaccacctgctctcatacagttgctagaagaggactgcatatttggttctaagtttctggaagataaagccaaaatagaaacacaactcattataaaattttggtgtatccataaaataaaaacaaatgacctgtttgagaaaactctttctgagtttgagctctaaaaggaacttctctatggaatccttagaatatgagaaggctgtgatataggggagaaaccccttgacattcctatattgggtttaggtctaatttcactcagtagtttttaaatgttactccttgtagacagatgatgagacgccaaagtacagctgagtgaaagcggttcctttgaaaactaaaggctgtaaaaacaaggctgtggatcatgttgtttcagttctttatagattttttaaactgaattttgcatctgtgtacatgaagaataaattgtagaatatctaaggaaatggatgggctgcttatcttttagaacctccataaattatttattgtaagtatgtttgataaggattgtacagctgagagttcaaggttgcatttttttccccagcaagaaccaaaagtgcagataacatgcagccaattaaggacaaatctgtatggtttgtcaatcaatctgtcaggatgtccctgaattgtagcacttatcacttggtattatagacatctgtgtccctggcataactgcatcctcttcaagggcaggaattgcttcttttccatttttgcactctagcatccagcattatgtttgagacctagcatctatatgagagactttgttgaacggaatcaattgaaaggcttcccattatcatgcagtactacttgacaaagatcagaaccctgagcaatcaagggcaggaaacataggctagctgagctttgaaggaagtgaaaagaaaaagaggcagcaaagatgggaacatggaggacagtctgagaaaacaagctcagggttgaagggggtgttccagtgaaggggtgatgagtgggacctcacacatggagcagataacattggtgcatcagttgatttaaatgagcagaatggaaagtgtctaaaagagagatgtggaaatgagtagaaacatccctttcctgttgggccagctattgtctatggttagtccttttcccatccttatttcctctcctctgaattgcaagttgctggaaacatgagaagtgcattccttgctcccttggttactgggcttcagttagcatttgccaatgagggtgagcactcatgggagactggaaagtggtagaaagggaaagccattcagctggctgtgacagtggcagcagcgggcagtaccgtgggctccaacagcattggtggtggctccagcatcatcactgggagcttgggctcctgggttcctgctcagcagctatggtcagtaccttctgagatggcctcctctgatcctcacctcttggtattcatggccttgtgaaatcccctttgcttgagtaacttgctgccaaccaatagaatatggcaatgttgagggttgctacctttctgactaggttgcaaatgattgtgacttctgtcttgctggcaggctctctctatttgccttttggtttgtgtgctctgaggatgcaaactgccatgttcgtgagacctgcatggcgaggaattgagggcagactctgtccaacagccagtgagaaactgaggtccaacagcctacacggagctgaatcttaccaataactacatgaacttgaaagtgtatccttcccttcagatgagtgtagcctgagtgacaccttaactgaagcctatgagaggccctgaagcagaggaaggacccagctagctcacacctagatttctgatgcatagaaactgtgagatagcatgtgttattttaagccagttttgagatgatttgttatacaatagcaatagataacaaatatgatggcagagctctgttccaacagcagtagcaagcgtgtgcttgccgactctggatcactccacattcacctctttgcttctacagctatgggacaatagcagcagcgtcctacagttgccaatttctaggtaatgccattttccacttgacctgtgttttcaaaacctttgtcaccattttcctatattaaattccttcataataacagaagagtggctaacatatgcacacaactatttttcttgatagggagataaagagagcattgctgtatattaaatgtagttatgtctttttagatgtttaagaaaatgaaatgcaccttttttcaagtgaataaatgtttgcctctctgtagttcttggtttttgggagaaggtcaacttcaaaagatagagtcattggcaccttctttctgtagtgtgcttgactgtatatccctgcccacccacaggcagcaaaggcaatgcatgagggattttgaaggacacacagtagctgcttctgttttcatgtgggagtccaaggaagtataaatgctgcatgctccctgtaactagaataaaatattatggtgtgtgtataagggcaaactcctaactcagcaggtgaacaaccatatcgacttcattccccctggagactgaaattagaaagaaacctacatatcaggccacagcagcccttgatgaagctcaaaagagaggtggcaaactcacagctacacagcaaaaaccaagtcagaggcagcaaaagctgtagtttgagaacaaagggaaagaaaaagactagtcaaagaggccatatctacccacccacagaaaacccagagaagaaaataagttacatttctcccactggaaggcttgggggaggagacattcaggaaagccacaggggcagaaaattagatagtttatctgaaaaaggaaaaatgaactaaagtgtgcttttgatagatggctggaagtgagcacaaaggcaaaacaccaacatacacttggcgtctgaagaatgtcttttatccaaagatcttagagcagtttgagtgtattaatttacttgtgagacagttaaattattattcgttcatttttatgtggcattttattctaaaatttgctaaggattttataactcaagtacattggttattccccaaacagccctgtagatgcagtgtggccattactgtatgacacatgtggacactgagcctcagagatgtcaggaaacagagagaatcagaggaggctggaagatcagcgatgactgtatgaacactgaataaggaatggggaactctgtggagacaactcagtcttttctatggctatttcttcatggcttctgtggtagatagaatgatggtcctccaaagatgtccacatcctaactcgtggaacctgtggatatgttatctaatatggtggaaaggactttgcagatatataagttaagaatattgagaggggaaaattctcctgggttatctgggtgggcccaatgtaatcacaaagatgtaagggagagagggagacatgagagtcagagaaggagatgtgatgatgggcagggattgcaatgatgtggggccatgagccaaggaatgtgggaagggcaatggaacacgttcttcatctaaaactggaaagggtaaggttacatcttctcctctagagtttcttgacaacccatcttagacttctgacttatagctgcaagatcataagtttgtgatgttttaatccactaagtttgtggtaatttgttatagaagccacagaaaactcatacagcatctttgaggagtggggggctgcactgtaaacctaaaattttattttttgagttatttgggtaacacaattttagaggattttttttaagaactgtttggatatgtattaataacaattatgggtttagtggcttgaaggaaaaatacagtggcagtaacaacagcaatagtaatgggttatagttattaaggttgtgtgtgccaagtgctgggtaggggtgtggatgttccttctctctcattttctaaaacaattatatgggataattaccttcattttacagaggaggaaactgagtctgagagagccatgcaattagtggtggagctggcatttgcacacaagcatatctgactcttgactacgacctgaagtggtttttctatatacttaattcattgatgggaaaggacaagtcatgtgtgaaagcagggacatgagcaggtgatgacagaaagttgagacaggcctccggtggcactggggatgtgtattgactctgcctcagccatgacagaggtgagggacactgtctcctttccgtcttttctcttctacccatgccagccagccacttttataaagtacccaccatcggtgggcagcacttttccccattctttcttgccaagtgtgactcttctcttgaaagaaagcacacaatttcacactgtataatgagtgtctttcctgccagaaacaacaaggatggagaggctgtggggctactttagctgccataagttagaagggggtcaagtgagtgggatcaggaggatgtaagatgagaagaccaaaattttaatgagatgctgctggaatcagcataaccaagtatggtatcagagctgaaataacttaaaatattacaagtgccattgtaaaatgcaatactccctacttcctagggtggctgtgagaatggagttaataaatgcagagtgctttggatggtgctatagaagtgtagctgttactccactgcacccatcccgcaactactcctgctgctaccagcgccctgttattatcgccactgccaggattactaccactatcacaattactcttactactgccattgactacctttgctaccatcacattatttcaactgctaccattgctgctgctattactactactgtaccgttgctatgacaattattaccattactactgttactgtcaatctgtaggcatagaaagtgcttctgttgtaataaataggccaacagacttctgtaccttcaacaagggtggctagagcacatcctcaggtcatcctgggattgcctggcaatagttcccagtctgattcttttctttgggctgttggcattcttttgctactgctcaggtttggacaaagtggctgtcattgccccaagctctctgaggtaggaactctgcctgcttcactaattcttctcagtgacaaatgctcctcaaatctattccccagtggccatttgaagtggacaaacaactccacagccatgaaatatcatgttttaaatagaaggcactgtgtcaaatgccaccagcaactcagccttggagctgctgatctcagactgattcagattcttggagataatcataagaactaacctttaacaagtgcttattgtgtcttatcaggtgctgttctaggcacttaacaaagatttaattatttgactctccaaaaaagtcttcgaaatagttactgctatgaattatgttttacaaatgagaaaactgagacacagagaagttaagacatttgctcaagataatacagcaaatgggaaagctgggatttgaacacattcagtctaactccagagatgctgctgctggccaatgtaaaccaacacattggcttcacagtacacagcattttagtcagagaagatcaaggcctagcaaagacagctgcccatagttggtgctcaataaatgctagactagtgaaggaatgaatcaacaatgaatggaagaatgagagtaacatggtgtttgtgtgagtgaagaaagaaggcagtatgagtattctaaaccaaacagtcaactcagttattgtcaagaacagattgaaaaggaagtcaaggtagtcaagaaggaattgataaggaattatgcatagagacctggtttgctggaggatctagggaattgtctctaaggattttccagggcctggggaagacagttcagtggagggaggtgggaggacttctagaacacttggccttttcttagaccaggggtccctgaacccctgggccatggactggtactggtcagtggcttgttaggaactgggcaggacagcaggaggtgaatggaaggtgagcgagagaagctacgtccatgtttacagccacttgccatcacttgcattactgcctgagcgccacctcctgtcagatcagcggtagcattagattctcataggaacatgaaccctattgtgaactaggttgtgtgctcctcatgagaatctaatgcctgatgatctgaggtggggctgaggtgatgatgctagcgctggggagtggctgcaaatacagataaacattagcagagagggttgactgcccacaataaatcagttgcttgcagactcatatcaaaaccctatcaatgtgtggcaaatgaccagccgcatctggtggcaggctttatagtggcaagtgagttgaaaaaaagtgcacaataaatgtaatgtgcttgagtcatctcaaacccaccataccccttacctctttcctgtggaaaaattgtcttccatgaaactggcccctggtgccaaaaagttggtgactgctgccttagacctttctggtgtacctcatgatatagttccagtctctacaaccagtcagcacctttctctgatgcagagtgatttgtttgcttcttttagttattaaaaattgtgtgtcataggattttagtgctagaaatctctctagaggtcaagccccctcatttcactgattaggatactgagtcccaaaggggttacgggtcttgacaaggccacaacaatagggatttgctaggccccaacatgcacctttaattctgattcattcatttgttcaccccaatctggtgacagtctcttgtgttgtcttgaatgtcttggtatttcagataaaaagcctggcttaagtttttgatcatagccattctaacaggcatgtcatgaaaaaagacaagagatgaatgtggacgaggtcgtagagaaagggagcccctacacactgttggtggggatgtaaaaggtgcggccgctataggaaacagtatggagtttcctcaaaaaattaaaaatagaactgccgtatgatccagcaattcctctgctgggtctatacctgaaggaaatgacatcagtatgttgaagaggtatccgcactccagtgttcactgcagcatgattcacaatagccaagatatgcgatcaccctaaatgtccatcagtggatgaatggataaagaaaatgtgatattgtacaaactggaatactattaagccttaaaaagaagaaagttctgtcatttgcaacaacacgaatgaatctggaggatattacgctacatgaaataagccaggcatagaaagacaaacactgcatgatctcactcatatgtgacatctcaaaaaatcgacctcacagaagcagggaatagaatggtcattgccaggggctgaggggctggggtggaaataggaagatgtcagtcaaaaagtgcgaaggttcagcagctagaaaatgaatcatttctggagactagtgtacaacatggtgactaccgttaatatgcattgcatacttgaaaattgctaagggagtagatcttaaacattctcactacaaaaaataataagtatgtgaggtgatgaatatgctaattagcttgattgtggtacaatgtatacatatatcaaaacatggtgttgtgtgccttgaatacatacaatttttatttgtcaattatactttaatgaggtagggaaagaaaaaaaagaagggagagaaagagagaaatctaaaattaaaaaaaaatggaaaaaaggtcggcttgggccagggccataggcaaactttgtttttcataacactggatatgacaatgatctaattagctaattaatttgcactgtattcttttgctacaacgtcatataactttcgtctttaagatggacaaactaaggtaacttgcattttccttcatttaatatttaaaacctctttataagaaaaagcagccccaaagaattgtttgtactcatattaatatcacttaattaaaaacatttttcagcattgtaacaaatagaacaaccttagctgtaatatatgttcttcttgcagcaaagttttgcctctttacaccatcaataaatgtgagcattataagattataataaattatttagattatacttacttttaatcattattttctcagtaaattctaaaattcaatgcaaaaggaactaagatgacttagttacatatgtttcacactggactcattatagctttctgggagtgactatgttactttattaaaaatttcttttacctttaataagggagaaagacagagaccattatgtcatctagtttctcattctgtcctgcttagcatataacttcttcattattgtactctccatagttcctcctgaatagaaagtatcaaatctcctcttcacgtcttcactgtaattatcattcttatctgacataaaacagtgattaaagtaacccatctctagaactaatttgatatataacaataaaaacttcttgacaaatttcaatgtcatctgggtggtttagatatgtacacactctgttattgattttccctcctttgataatacagcactacttatttttaggttttctctaactcaaaaggaaaaaaatgctgtttttattcttactctcactaaacgcttttatttaaagtgtaagtgaccatttggtagaagtcacatagattgtgcaatattttaatccaagtgagcaatctggttctaataccttttgcttgtgggtggggacacccatttttgctacttcaatggcctacaattcaacctgatcccaagacttttgctattcatctctcctcccgcatttagctgttccgttattccattgttatattattgtgggatttatatgaattagcacagaaaatggaactcaagtgttcagatttaagcctctttctttctttgtagagcccaaggcagagaaaaatgtagatccaggaatctttttcttttctttgtgacattactaaggagatgctatttttccattttataagtggaaatattaaggcagagccaacttcggggacttgcttcaggttatatagtcaatctgggttgtagtcaagaggaacaaaacataaaaataaaagttggtgaaataaagaaactgatggccccaaacagtattagctgaaattgctagtataaaagaactcaaggaaagtttaagtaaaattgtggttgattgcactttaataggaacttaaggacatttaggagttgtttctaagcttgtgaggccttgattatgaaggaagttgcaactatttcctacaaaatgcctcttggtactattgtcagacagttggtctaagccagtgtggcaattcttactttattatgtttccccaagccccttttggtgttttatctagtggagcattcatctgagacaaacagcttatgtactctttctcgccaagcagaagctagaatgaatgagaaaatcgcataagaaaatctgtcctcctgatttcccacatgaaactggcttggagagtcactgttcccttgacaggagccttctgcaggctccaccaatacttgtcaaccgcctggcttgttgtgggggtggcggcagctgctacttctgcttcttcaaaataaaaaccgcaaataagtatatttagaaagtgtgtccatcctagttcatcttcccagctgttttcctggtggaattagattagcagtgtaagtgaaatcttttctgaacctcatcgaaatccagacttgcctagtaaatggcttcattcattattttcatttacctacattctaatttagtttttcttatttttatgaacagttactatataccaagtactgtgcaaaaggctttacagacaatatctcatttaatctcaaaacagccttacaaagtgggtgttaccacccgtatatggcaacaccaggtttaagtgactcacctaggtcactcagcagggtgtcataatctagtctggctgattccagggcctatgttccaggatacgccatggccccagctgaggactttattaaatagtctatggtcttgcagagtcaaacctattctctggttcttaaagatggaccacttgaaggcaggtccttgaagagccatgggcactgacagtttttgctcactagggattggtggtaatgtctcaggttttctgtgagttcaattttcatgagcccagtttcgcttcagtaagtattgatctggccctagaactcatggtttgtgtgtgtgtgcgtgtgtgtgagtgtgtgtgcgtgtgtgtatgcacacctgtgttctctggcttggagagttagcaattactgatgatcagggtttccttaatctctcttaggaagacttcttagtctttatttatttggaggtcaaattgtgtacagtatttctcccagagattccttcttaattcaacaaagggaatgttttagaagaaaacaaagggaaaaacaatcaacaccaatccccaaacacccatatacatgcacatgaagaaaatgtgcaacatagctagagatgcattatcagagcacagattaattatttgaagcaaggtagactattagtttctgttagccttgctgggacttatttctgagcttctaattctagatatgagccccatgattacctcctttggccctgcttaggccctcttccatctctacagtcactctggttcctgggcaagtcttccttaatgcgcaaggcatttctcactgtggttccatgactcctgtctggaatacgggctatctggtctacttgcagtctgagtgacgcttaacttctttactcattggcataaggagtggctgagtttgctttctcttgaggttctggagtcccaatagttgaagaattcatcctcggagactcttcgctccagtccagcttcctgccatgcagcaaaagcctgcatttcttctagtttcaagcctttgcatcacctgttagatttcttactatgttcctccttcagccttaaaaggtatctcttgtgctcatttgtaggactggagttctaaaagaattctgccctggtaccaatcattccacctccctagttactctatgggacttactccagttgaaaccagtagaaaaatacctcacacatacagtggcaatagtaaacatacaagagaaagaatattcattttctatatgcctttctcctattttataagatataaaataagaaccttgaatgacaatgagcttttgggggaacatactttattcccacaggatgttccctgttctgggcctctcacattcatggacatctcatacatatgggcatcaggtacgatactttcagttgcaagtaacagagatcaactctgactctgaagctggtatagtggaggctgggagatcatgtctagaaaatgaacatgaaccagagagtcaagaaacacaagaatctggccacaccactgctgtggtcatgctgatgccatgaatgcatttaaacaagactttgtctttgcttcaccttctgcaaagtcagatgagtgagaacatctgataggcagggcttgatatgtgtcagccttgcctatcaggtcatgaagacaggacggatcacgactctttggcttcctctgtgggaacctgtgggaagcctgtatgcccaggggggtttgtgttcctcaaaaccaggctggatgtggtggctcacatctgtaatcccagcactttgggaagctgaggtggaactcctggctcacttgagtccaggagctcaagaccagcctgtgcaacatagtgagaccctgtcttaaaaaaaaaaaaaaattagttaggtgtattagtgcttgcctgtggtcccggatacttgggaaagtggaaagattgcttgagcctgggagtttgaggccacagtaagctgtgcttgtgccactgccctttagcctgggctacagagctagaccctatttcaaaacaaacaaacaaacaaacaaacaaacaagaaagggggcaggttgactgctagactgccatagaaaaatccaatggccagttcaatgaattttcctcagtatttaaaaaaaaaatctcaattagtttttcttaacactattctcaatctagccctccctttcgttcttttcaaaatatataccttttaggttagcagttgccttaatactgttaacattttataccgagaccacagagttgctgctaaagtgtatagtcagaattgaattcagaagattgatgttctcttcaggctgcagaccatctgattactggatctcctctgggcaatgaagctgcctcctttttctcctctctcgaccgtcaagcttgcaccacagtaataatatttaataagagcagcagtgaaactatgtcattgcttctctgatggtcagagtggaacacagctccaaataaaacaggagtgattgtcatacagataatacagttgttttagttctttcaccttgagaaaggatgaggtagcttgaatgctgattgatgcttgtctctcatagtctactggaatatacattaggtatttgggtgaaactgtgagttgcacttgatcatgtattaaacattttgcaagctatttgctgctgtatattctgactggatcttgaaaaacacccttgctatttcaggataaaagaaataaagcttttgtggttttggctgctctacctaagtcaggagactctttttctgagaatatttaaacattttgccacattcatctgtctttttctcacactatcccagaataactgaagatatgtaatacagggaaaccttattaaaaaaaaaacttctacctaaagaaatctgaatttatataacagaaaaattgtggagagattatttatattaaaaaagattttcttttttttttcacaaaagtgttcacgttaggctttctttaaatagcaaagtcccttactggattaaaatatgactgaatttctctttcagaaatgcatctactgtttaaaacaagccatgttttatgtcatccaattttataactgaagaactgagaataattcagaaaaaagtcacagaaactttgtgtggatctaggaagataattcagggctaacgatcactcctatactctcctagaaagagagtagcttccatggaaatgaactgagacccttccttcctagaacctggaagattcctgcattaagtcacgtcatagtcataaggtcattcaactattgatgacattttctaactacgtgtggataagcttttatgttgatggttcagattttctgctttggaaaaaaggaattttagtgtatttgacttctaacaataaaatatatgcaaagaaaagtctgtcattagattccctagtttgtaatttaggggaagatatttcacttcaacctttctgggccttagtttcttcacttataaaatgaaggttttgaactagataatctctgagtccttttatagctcccaaacttgcttcttagttgtttcttttatttttaaataagagtaacacaaatcctgtaattctgagagtctagatcacagactgatctcatctatgctttatcttttcattttataaatgctcttggtgtttgtaaagcttatgtccagacttgaagccagttagaggcctaaagaacagtgcaaaagaatgttagatatacctggatactcttcctcttctttttaaaaaaatttaatgaggaacaaaatcttagattgttacacagcagaggtgcaataaagaataaaaatgcaagggaggaaaagtcacaaagccaatgaacaaaaattcccctgtggtgagggtcttaaagcaggtgtagtggtttatcattttactgaatgagctctgggtctggtgggttaaaacaagatcctctggttaagtgggacaatgaaacatagatggggaagcaatagccctgctaaagactgaatatttatatcccctcaagttcatatgttaaaatctaatctccaatgtggtggtatttggaggtagggcctttgggagtgattaggtcatgaggatggagccctcatgaatgagattagtgccctaccaaccagggagctcacctaaacatctgtgtccagagcttttattggggcttcattatataggcatgattgattgaagtattggccaaaatattgaatacaatctccagccctcctccttataggtcaggctaatatcacatggctcaaagcctcaattctctaatcacatgattggtctttctggcatgaccagcctccatcctgagtaatctctttggcttaagctattataggcgtcagaagtcacctcattagcataaaccttcagggcccaccatgaataacaaagacactcatgtcactctggaaattctaaggatttagaggattccttctaggaaccagggaatagaaccaaccaaactctttattatgtaacatattgcttttggcttttgtctgttctgtagcttttgtaaggaatatgactagcaagttgttaaatctctctctttctctgacgagacttcaagactgaattgaagtcattaattggtttagagtcagagtagcagaatggttaacagtgtgggtttggagatcaggctgcttgggttaatcttggtttcacatcttactagcttggtggtcctggacaagtttcttaacctctctaagcctcagtttcctcttcagtaaaatgataggttatcatgatgaattaagctaatgtctgtaatgtgcttagcatggtgctgggcacacagaagcagtcaaggtttgctactaacgattgcgttaggattttagaaaagctgttgactatttctaaatgtttactttctaaaggtggcatgccctaaatatattcaggccagtggttgtatcagatttttagtttttaggcactgattctttgttaaaggaaatctttcacaaaatccgaatctagaaagccgatgaaatctatattaagctgaactcctctagtcaaagagggtcaggcacatctagccaccttttaatctctggggaattaagatctgtttgaggaagttagtttgaaaactggtctagaccacaaccagtcacctcaccttcaacctcccctccaccagctcccatagcagggttaacagagcaaatctgtgtgtgtcaaagtcaggctataattttcttatttcagtttctccatgagcaaaatggggaagataatgccagctttgttgtggcagtgaattagataatgtctgtaaactattttgagtctttagagatcagttttagggacaaagacctttgccatctttaatttttagcttactttaaaaataagatatcctaaacacaccacttaaaaatgggtcaaacagtcgttttgtctattcttgggataaggtggaagcaatgatttaatcaccacagaagaaatgtgctctgattaattgggaagaaagattttaaaattagagttattcagaaagcctgtcaggagaccaggaagagaggaaaggatgtgtgtcaacacctacagaaagctgtctgtgaagctgggttataacctgatacttctggtcttccctgtaactaaatgtcctttgctgaggcctgaggcagacccttactctgggtttcctgttcctgtatgactagtttcagtcaggctttacgtagtcattctgccctgcagagcaatcacaggaggtaagaaggcatggtcgttaatagcatgggctatgctgttggacttgaatttggtcttgtttctatcacattctgtaatttagttgaaaaatggaaataacacctatctcaagggtttgttgcaaagactacatgagattatacatgcacagcgcttagtacagtgtctgatacatagtaaatgttcttttttttttttttttttttttttttattatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccacctcagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgagtaaatgttctttagcagctgtcattatcattttagagacagagtcttgctggcattatcttccccattttgctcatggagaaactgaaataagaaaattatagtctgactttgacaagcacagatttgctctgttaaccctgctatgggagctggtggagggaaggttggaggtgaggtgattggctgtggtctagaccagttttcaaactaacttcctcaaacagatcttaataggtggctagatgtgcctgaccttctttgactgcaatccaggctggagtgcagtggcgtgatcataactcactgcagcatccaactcctgggctcaagggatcctcccactactgcctcccaagtagctgggagtacaggcatgcaccactatacctgacttatcttttaaaacacttttttttttttttttttttttgtagagacagggtctcactttatttcctaggctggtcttgaactcttggccgcaagaaatcctcccacctaggcctcccaatgtgctgggattgcaggcatgagccaccgtgcctagccccatcagcagttatttaaaacatcattggtatttattatcattattaattatgtttgctatcatggatactaaatatctgcccatctagatctattaccctgatctaaaattctaagttctaacattaccaaaaagaacttgagaagaaatgcctttccatagccagaaaacttgaagctgaagggattttgatttgctcaaaggtattctgtgagtcctttttatctgtcttcatgatctggaccctatagctataagctttcatgtggggaatagtgcttcaaaatgaagtgaccatttacaatatgagtccccagtgcaatatccctccttgggtaatattaggtactatcttggctcatttcatcaatatcttttttgactagtcttttactgattgccccaagttgttaacttcagatgatacaattaaaacacaaagaaaactggttgcaaagaaaaactgcaaaattgttttaaatgtttttctttttttaattttaagagctttaggggtacaggtgttttttggttacatggttgaattgtatagtggtgaagtctgggattttaatgtacctgacacctgagtggtatacatggtacccaaaaggtagtttttcgttccttacctccctccgaacgtcctcctttatgagttttcaaagtccattataccactgtgtatgcctttgcatactcatagcttagctccacttatgagaacatgcagcatttgattttccatttgagtacatcacttaggaaaatggtccccagttccattcaagttgctacaaaggacatagcataaaaaacatcctttttggcgattgagtagtatcacatgatgtgtatgtacaccgcattttcttgatctacttgttgggctcttaagttgattccatatctttgcaattgtgaattgtattatcataaacacacatgtgcaggcaactttttgatataacggcttttgttttctttgggtagatactcagaagtgggattgctggatcaaatggtagttcctttagttctttaaaaaatctctatactgctttccatagaggttgtactagtttacattcccaccaacagtgtataagcattccctttttactacatctatctgggccaacatctatcatttcttgactttttaataatggccattttggctggggtaaggtggtatctcattgtggttttaatttacatttctctgatgattagtgatgttgaacatttttttcatgtatttttggccatttgtatattttcttttgagaaatgtctattcatatcacttgcccacttttaaatttaatcgtttttctttttttgctgatttatttgagttccttgtagattttggatatcagtcctttgtttgatgtaaagattttcccccagcccatagattttgtctgtttactctgatgattatttcttttgctgttcagaagctttttagtgcaattaagtcccatatatttatttatttaacattttgcttcatttgcttttggggtcctagtcataattttttttgcctaagccaatgtccagaagagtttttcccagattttggtctagaattttgatggtttcagttcttagatttaaatctttaatccagtcccctctcccctctcccctctcccctctcccctctccccacggtctccctctccctctctttccacagtctccctctgatgccgagccaaagctggactgtactgctgccatctgggctcattgcaacctccctgcctgattctcctgcctcagcctgccgagtgcctgcgattgcaggcacgtgccgccacgcctgactggttttcgtatttttttggtggagacggggtttcgctgtgttggccaggctggtctccagctcctaaccgctagtgatccgccagcctcggcctcccgaggtgccgggattgcagacggagtctcgttcactcagtgctcaatggtgcccaggctggagtgcagtggtgtgatctcggctcgctacaatcacctcccagccgcctgccttggcctcccaaagagccgagattgcagcctctgcccggcagtcaccccgtctgggaagtgaggagcgtctctgcccggccgcccatcgtctgggatgtggggagcgcctctgccccgccgccccgtctgggatgtgaggagcgcctctgcccggccgcgaccccgtctgggaggtgaggagcgtctctgcccggccgccccgtctgagaagtgaggagaccctctgcctggcatccgccccgtctgagaagtgaggagcccctccgtccggcagccaccccgtctgggaagtgaggagcgtctccgcccggcagccaccccgtccgggagggaggtgggggtcagcccccgccaggccagctgccccgtcagggagggaagtggggggggtcagccccccgcccggccagctgccccgtccgggaggtgaggggcgcctctgcccagccgcccctactgggaagtgaggagcccctctgcccggccatgaccccgtctgggaggtgtacccaacagctcattgagaacgggccatgatgacaatggcggttttgtggaatagaaaggcgggaaaggtggggaaaagattgagaaatcggatggttgccgtgtctgtgtagagaagtagacatgggagacttttcattttgttctgtactaagaaaaattcttctgccttgggatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcaccactccctaatctcaagtacccagggacacaaacactgcggaaggccgcagggtcctctgcctaggaaaaccagagacctttgttcacttgtttatctgctgacattccctccactattgtcctgtgaccctgccaaatctccctctgcgagaaacacccaagaatgatcaataaaaaaataaattaaaaaaaaatctttaatccatcttgagttcatttttttatatggtgagtgatagggatccagtttcattcttctagatgtggcttgccaattttttagcactgattattgagtagggtgtccttcccccagtttatgtttgtgtatgctttgtcaaagggaggccgaggcgggtggatcatgaggtcaggagatcaagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgtgccactgcagtccgcagtccggcctgggcgacagagcgagactccgtctcaaaaaaaaaaaaaaaaaaaggtcagttggttgtaagtatttggctttatcttggggttcttttttctgtatcactggtctatgtatacacttttataccagtaccttactgttttggttactattgccttgtagtataatttgaagtcaggcaatgcgatggctccagatttatttttcaagcttaggattgctttggctatttgggttcttttttggtttcatattaattttaggatgttttttctaagtctgtgaaaaatgatattggcattttaataggaactacactgaatctacagattgttttgggcagtgtggtaattttcacaatattgattcttccaatctatcagcaatgagatgtatttccatttgttcgtatcaactatgatttctttcagcagtgttttgtagttcttgtaaatatctttcaactccttgcttaaatatattcctaagtattatataatttttttggtagcaattgtaaaaggaattgagtccttgatttgattctcagcttgctcgttgttggtgcatagcagtgctactgatttgtgtacatttatcttgtaacctgagactttactgaattcattgatcaaatctaggagtcttttggatgtgtcattagggttttctatgtgaatgatcatatatcagtgaacagcgatggttacacttcctcttttccagtttgaatgccatttatttctgtctcttgcctgattgctccagccagaacttccagtagtatgttgaatagaagtggtgaaagctggcatcttcgtcttgttccagttcttagggggaatgctttcaacttttccccattcagtatgatattggctatgggtttgtcatatatgggtttgtcttattttgtggtatgttctttctatgcctagcttattgaggctttttatcataaagggatgttcattgtattgaattttttctgcgtctattgagatgatcatatggtttttgtttttaattctgtttatgtgatgaatcgcatttattgaattgcgtatattgaaccatccctccatccctgggatgaaacccacttaagcctggtgaattttttttatatgttgttagattcattttgctagcattttgttgaggatttttgtatctatgttcataaggaatattggcctgtgatttcctttttttgttatgtcctttcctggctttgatactggctttataggatgagtaaggatgattccttccttctgaatagtttgtaatagtttcaactattgagaaggagtaatattaataccagttcttctttgaatgtctggtagaatttgtgaatccatttggtcctggggctttttatttgttggcagattttaaaaattaccgattcaatctcagtgcttgtcattggtcttttcaggatttttatttcttcctgattcaagctaggggggttgtatgtttccagtaattcatccatttcctctagtttttccactttatttgtgtagaacttttcatagtagtcttgaaccatcttttgtatttccatggcgtcagatgtaatgccctattttcatttctaactgagcttatttgaatcttctctccttggttaatctagctagtgatctaccaattctgtttactttttcgaagaaccacctttttttttttttttctcttttagtcagagtctggctctgttgcccaggctggaatgcagtggcatgatctcagctcattgcaacctccggttcccaggttcaagccattctcgtgcctcagcctcctgagtagctgggattaccgatgtgtaccaccatgcctggctaatttttgaatttttagtatagacagggtttcaccatgttggccaggctggtttcgaactcctaacctcaagtgatccacccacctcagcctcctaaaatgctgggattataggcatgagccatcatgccctgcccaactttttgtttcactggtttttttttttttttttttttttttttttttttggttttcatttcattttgttctgttctgatttttgtatttcttttcttctgctagctttgggtttggtttgttcttggaaaactgcaaattttttaaaggaagcaagatttcatgaaggtgattaaagtgatattggggaactgttgaatcagtcattaatttaagaaatacttattgggtacctacttgggtgtccaaattgggtaccattttctaggtactaagtgttagagattaacgttgactattccagccttcatggacctgacatgccaaacttccataaaaccactggcaaatggatctggtgaagttgaaccagttaacaatcagaagagataatcaaaaatatgatgtgatagatgctttcagtggatttaaaacatttctgcaaattctttgacattcttcctacaaaaggtgaaacgtaatctttctctccttgaagatgggtggactttagaagtttgcttccaaagacgagagtttagcagaagtgatgctgtatgacttcacaagctaggtcataaaagtgaaatggcgtctgccttctctttcaggggcccacctgaagctgccatgctgggaagaccatgtggtgagatcagagagaaatggagaaagatgcttaaggagtgcttgttgttttgttccccagctgttggagtcttcccaggccagatgccagatgtatgagttaacaagccgacaggtgacaccgctcccagactgaccccatcagctgggacgagtggagaaagggtgagctattcccactgtgccctgctcaaactgcccatttttgagcaaaataggtgttattctaagccagtaagttttggggaaatttgtcacagagttattttccaataactggaaaaatgcctcaagtgagcatgataggaatatcaaaggattaatagagatccatgagaaaactgaagaaacctttgcatattttttgcagaaata

SEQ ID NO: 121 - DNA, 46980 bp, Homo sapiens
ctgttttgcagttcactttttccacttcacaataccttgggtttatctttctataccagtatattaaaactgatctcattattgctggtggacatgtgttgcactagacacacacctgacttcaggtcctgctccgtttggtattttatgatgtgtggttaatggtgtggagtttagatccattcaacctccgtcctgaatcctggatccatcacttattagctgcgtgatcctgggaaactgacttaatggctccatgcctcagtttcttcgcctgtaaagtggggttaatatcggtaacctacctcataggatgctaggaggactgagttaacgcatgtaacacatttacaacagagcctgcaacatatgctatatgagtgctagatgaggtttagctattcttttcacacctgaatactatttcataatatatttagtctattacttgacatataagttgtttgtgattcttttttttttttttttttgctaaaacaaacactgttgtgatcagtatacgtttacatatccctttgtgcacatgtggaagtgtttctgtagaataaatttcttggaatagcattagtgggcctgagggtgtggggattttcagtggtaacatcagttggtgggctctgcttgaccatgcttttcttggttcactcatatcagctcacccagtagcagctgttgggcatcctgccagtgtccttccgtcacatgtccagtggttggcagagctatgtggcagtaagcattcctctttgtcttcccagggcctggccctttgtcagcgttcattagactggatggcttggcttcctggtgatcctgatggagattctgaattgctactttatgtaaagcatggtgcccgggggagacatgcccagggccaagaaccttgatcagacccacatgcccagcgtaaggctgaggatgagattgtacaagtggtcaagagaatcaacatggtttcacccttgaatcagtccaggttcactaggggttccatgacatggcactttttaacttggcgatcatgtctttgctcagtgatatggggtaggtgtggatgtgatgattcacacgatgcagggatcgagtgcacctcccaaaaaacaggaagtgaaataaagcggcactgtgtattgctgctatgacatttctcttgatcttattaacacaggaggggctaagcaataaatgtgataatctcacttggggaatttggggttggttgtttatccaatccttgaacatttattgaacagttattttgtgtcagacacggttattgatgttggggtatggaactatggactaaggcataatttcaacctttgaaaactccacagaagctttaagaacccttgaggagacttaatttttcaagaacaatgggaatgaagatataatactgcaggtggggcctgagctccaccctggatgaggctgggggatgggtatgcatgggattattggggtcccttcacacagaaatgctcactggagaggctttcctgtacaaatattagaaatgtaaaattacatgttaatttctttttctgtgcttagaaaaggtgcaggatatataatttagaaaaatgtaaaggaaagttaaagatcacctataactgtctcatcccaatgcaaccattgtggaatgtacgtgtatttatttctttatcatgtttgtatgtaggtgcattttaaaagcaaaattaggaatcatacttcatattctgctttgtgacttgctttgtcactcaaactgcattagaagcatttcacaaatctttgaatattcctttactacatgatatgtaatggattatggtgttctgttatatattatagtcaagttagtcaattaatgatttgaaagggcacactggttaattattgttgtcttttctcctacgcctcctggttttggcttttattattttgtaaagatgcaggagaaatcttgagttctgagtggttatcccatcctttgtgaacactgctgtcaggcacacaaaacaacatgggctgggcatggtggcgggcgcctgcagtcgagaggctgaggcaagagaatctcttgaacctgggaagtggaggttgcagtgagccgagatcgtgccactgcattccagcctgggcgacaagagcaagactccatctcaaaaaacaaacaaacaaacacacacacacacacacacacacacacacacaaacccacaacatgattccagtttctatgctcattttagaatcctgcacctgaccaccacgcaaaaattcctctggataacttcatctgggccttccctccggtggaactggaagattgttttccaaactccactccttttccatttgtgttgtccactcaccgagtgccccttcttctttcatttttagacacctcggctgcagctgactccagaaacatattccctctttaagtctcggctccacaggttgcctcttctcctcatcatttctcgtttctcaccgtgaaaatctttgctttctctctttatggcttcctgagacccgaaaatagaggtaatttaaatttggtaattatgatgacaacaaaacaacttatgttgaaatgcagagtttaaaatgccagagtttcctactgttgagatctctctgccttcattctgtggataccgctgtgggagcttacctgagtctgccccagatcaggaggccaagcatgaggcgatgagaaacagcttctgcacagaggtggtgacttctacctcttgggggatgggggctggtcagccagagctaccacattcaggttcagccccttcagaccttcctaagctccaggtggaatctttgccttcccaccttctggaccctgcacggggagggtctcgggctgtagccacgaggcggcattaggcagctagaatcacagagtggggactgggggatggggtttcttctctgacagtggttaggtgagtcactctctgtgggctgctcatggcagcctcttcctccatccttgaagcgggccttccaaagacttcacctgctccgttataaaaggctttgagttctgcaagaggcagctgtgaatgtattagcatcctgctttctgtatgaacatcctgctttctggcacatggctaggccaccgcttaaacaaccggcgccaattcacagtgaaaaaagatctgctcaaagctggtttcagaaggaggacacgggaggcgtataatatcgagcccgtctcccgacggtgccatctgttctcattaaggcagccacagcgccgaaggaagggcctccaggtgcacacaaggaagcctgctcgccttgttatcctctcagagactttgccttttgttttgtttagttttgtttttgtctggcaggctcaaaaagacactgttctactttccgcagaagaatcactctcacattttaagaaattaagtctctgggaaaaaaaatattgtttgagagggcttgtaatggctccttgaccacatgctgtgcctgccaatttataacagagaaatattacagaagttgggatccaaggttggtgtgcacagccattgcttaaagagggatggatgcttcctggggacaatgatcttcccccgggccccccagcatttattcaatctggagagaattgtctgccaggctcccactcctacatcccaggaagagctgggcacattcatcatcttgtgtattcagaaagtgatgataattcctctgagagccaactgggctggggagggtgtgatcaaacttctgctggcaatcagactgcctttggggaggggagtctccattttgcaggtatgtctctactgccagtctgcagggaagcctacccagtcaacaatatgttaccatgaaaatctccttttgggggtatcttatatcacattatagggaaaggcagaggaaatatcaaaagcatttggccctgaatttaaaatgatctttccgtagatttttatagactttgttttacaagattggtgtaaggcctaaagcatgtcttcaggcctcttacatatcctccttctctctgggggtttccttcctgcctgccctcaacatcccttaccacacacctattctgtttctccccacatgcatggtttgtatattatgtcctgtcagtcaattcctactaaaatgttagctgatgttagggtattctcgtgggaagatatttgcattttaataggtggcttgaatatagaaaagcttcatcctaaagttgcaaaactttaggggaaaaacaggcaattttggatagagtgagggatgaggggatgagaagggggaatgtatgtgaggtcagagacattctcacatctcactgtgcatcatccatagaacttgcctttcttttctctcttttttttctttgtccctgacctcagagtaaatggcacctcacacactcttgtgggccagaaagaaagtctttcataggcagataggaaataagacagcagtttttccaagagtactgaaatgcaacaagtctactggtctgttgagttaaaaaatggtcagtttggttgttcttgttcatctagttcagctgattggttcggtagaagcaatagagtactgtactacagtatagtaaaactgttgcttcacagcagccatccctaaactttttggcaccagggactggtttcatggaagacgtttttttttccacagaaggggcgggagatggttttgggatgaaactgttccacctcagacaagatcatcagctattagcatattagattctcataaggagaacacaaccgaaatcccttgcatgagcaattcacaatagggcttgcacccctatgagaatctaatgcagctgctgatccgacaggaggcggagctcaggtggtaatgctgctcacttcctgctgtggggccctgttcctaactcataccagtttgtggaccaggggctggggacccctgatttacagcactaagttaccagtttccacgtcggtgggattggcggaaacttttcaagctctgtgtgatggagtaacacagggtagaaagagtacccttgtgaaaagcctggctgcatctgcccctttataaaggagacaattgaagctaatttatttttaaaacacaaaatgaaatttggtttgaaatttgaggaggagatacattgatgttgcctctgagaaggagtcaaagaccaataaaaggtggttctttctgttcccaaacccagaagccaataggggccacagaaggagcacagtgccacggtgaccatgctgcagcattgtcagatttagcaagaagaaatacagggtgcccagggaagtttgaatttctgatgaacactgaagactcttttagtatgtatgatttttggaacatatttatagaaaaaaattatttatctgaattcaaactgagtgtcctatatttttgtctggcaatctggtaccatactgcccctttgtaattccttgtatatgttgttaaagaataatttttctgaagggtaaaattataactcttgtatgattataaaatgaacatgtgtcaaagatttttttagttcactgattaatgagcgaatcagtaagatgtcacaactggttagaagaattcagaacacacacacacacacacacacacgcacgcacacacacaatcaggaaaggctgaactgaatttgttaatagttgcaaaactacccaaattcctaggacaataatcaactgcattccactgggcaaaattaatttgcgtttctatggacaagaatcatttgcattactctcagttttctacaacttgcagtagttgtaaaataggccaaagacaatgaacactacagaataaccaggaagggtgtgttagaacatccatgaatcatctttgcctatttcaaagcctttcacaatggaaacatttgacagtgttgtgctctctcctatctcgggcctttgcacctgatggttcctccacttttttagttgtcttgaacttacccttgactgtgggagatcaggatatgccactccaaaatatgcctctttggcatgaggattgttgagctgaccgcaaataaggagaaacacatgcaggaaagcaccctgctctttccctatttgcctcaaatcaggacatacatttatgaagacaaaagacatcccacctcctcttgctccccaggcaaacagagattaaccacttaagacaactttggatccttacatgcctggagagagcaccagaggaacctacattaacaagcttcaccaactagcctttatctgccaattatttgcctttccaaaagttgctgcccctaaggactcaaagttcttttcctttgtgtcacaaatctaaaaacgtactgttccttgttgaagatactatataaattggtattcaaagccacctcttcgaaagtttcttattctctgggtttctcccatgtatgtatgaaatatacgtacatcaaacaaacatctgtttgtttttctctcgttaacctttttttttttgtttgttacaggggactgttctaagaacttataagagttaagaaaaaaaattatcttcaaacatcattacctctggaaagctcttcctgacccacaaactaggttgggttcatgtgctacaagctctcacaggaccatgtttccttcattagggcatttatgtgagtttataattcatcctccttactgaggtttctaagtccttgcatgatctgacccctgcacccatcagcttccctttcaataactgtgctctggtcatacttctctcccttctgttcctcgaccataacaagttcttccctgccttaaggactttgcacctgttgttccctgtgcccggaatattttttctcttggctcttgcaaggcatgtttcttttcatccgtcaggtctcagtttgaatgtcagaaaagcctctcctgattatcttatctaaagatgctcccttctccaccctcactttctattctagtgattcctcagccttagcacagattagaatcacctggcaggcctgataaaacaaaggttgctggggcccatggccagagtttttgattcagcaggtttggaagcagcatgaagttctgtgttttaccaagttctcagttgatgctgatgctgccaggatgggcatcactcttggagaaacactgctctgagtgttttctttcaacacctgacattattttccccctttgctgatttgctttctgtctcccatagagctgaaagttccacacgagcagagatagtgatgctcctattttctgattcatctacggtactaagaacagtgccttatataaaagaagtttaatgattatttgatgaatgaatgaatgaaccattttctatttttttgttttgtattgtaacaaagggtttgcttaccaaattactgttgaactgaggtgccagaaccaagttatagagattggctttcatcactaagatatgtttgtggaagagtagttgtcttaatttaataaaccacaacaatatttgaccagtaacttgaataaagacaagtgcctactgcggcctacactttccattagcacgccttcctgcttagggtcaatgtcattaaccaacagttggttagatgacatcagggctttaggtgctattgacaggtctcaagaagatatgagttttgccaagactggtagctatgatgagcattcagaagacatatatggcaagtggggtgagggaagggcttgtgctttggctttaagcatgcctcatggatgaagcagcttgggtaaaggaagggagagagaggaagcagggagaatccttcctccaagctaggttataggcagtgctctcacatccctggtcttggcaggtcctaactccaggcctcctgatgcccatattctgttccaaagaccacagtccaggctttagggcatagcctcaggctctcctacccactaaccctctaggttctgtttgtttccccccttctactctcttctatgccattcctctaggcttttaccttgccatgtgacaggcttatgtggtaaactaatgggtcctaatgactgccacacacacacacacacacacacacacacacacacacacccctatatataaggccacatgcggtggttcacgcctgtaatcccagcactttgtgaggccgaggcgagtggattgcttgagctcaggagcttgagaccagcctgggcaacatagtgaatccctgtctctacaaaaaagttcaaaaattagccaggcatggcggcgctcacatgtagtcccagctacttgggagtctgaggcaggaggattgcttgagtccaggaggtcgaggctgtagtgagccatgttcatggcctgggtgacaaagtgagaccctgtctcaaaaaaatatttatatatccatatgtatctccttggggtgtgtgtgtgtagtgagacacaatatggcatagtgcctaaaagcatatactctgaagccaatcctatgtttgaatcttttttctgctaaatactgtgtgtccctgagaaagttgcttacccattctgttcttcatattacggggttaacaacagcactaaatcatagggttgttgtagatataaaagcgataataattgtaaagggtttagttcctgtgccttgtagctaccaggataataggcctaatagacagcaccctatggaaacagctttccattttaacaagggactttggtaaacacatgcgctgagtacaacactcttggaagatcagatatttgatggcattcagatgacagcatgtgagcagatgcctattctgtctgggtgttaggggacagagcactaggtgacttggctgctgtctctgatcttaaaaattgctcagaccctggcaattgaggataagacaataatagcaatgttgtattcaggagcgttgctttaaataatccttctccctaatagctttgcccctggcgtgtgacaggtgtttacattattaagtaaaagcatttaaacagcgacctccttggtataagggtgaaggagattaaaatccaagcagtgctccagctatttaaatcaatgagacttgtcagatctgtaacacatgagctacttagagggcgcaggcacctattgttttggagcttcgactaatatctcaatatgctccctccctccaagtctagccaggccctgggatgctcattaaaggctggtctgaccacggcctctttccctgtggaagcagcattaactaactcttggctagatgcgtggcaaatagttatgctattagggaggatcagagcttgagttgattcctgcttagagaaatgaccttgcacggaattccagcggttaagttccttagctaaccagaagcagggaccataaacattgtccccttcttccgctagggggtgctaaaccaggctgcttggctttgcccacagccatcctttcttgagttgtgttttcccagtctttagctatgacattgacaacttcaggtccacctgctgcattgaggaaccaagtttctgaaacttaaatctctctcttttttaaagcttcatgctctcatcatgaacaagaaacctctctcttccttagtaatcaaacttagatccttcatttgtgtcaacggaagggaagtctccacgtaagaagagcagctggaccttaaagatccaactcttattcctcaagatttattgtccccttggaggtctctagctaatttctgcaggtcctacaaggctggcttcagagggagctgattcattattaattctccagttctaagcaggcgaacaaggtgggggacacttgaaccttttaattccttggattcacagctgagccaggctggccacaaaaggaactgcacacaggcagggttacaaggcaaagtttacttttcttcaatttatggcctcatatgtctgcctgtctgactcatggaatgttgccaggtggagggttcctgatgccaagagaccgcttaagcctcatctgtggaagtgctggttcagcagagggtgaagcactttcttcctgggtggtctcaagttctcttttcctggtgattgactttgggaagttcttcctgtcacaggaaagccctacttctatccatagcagcaggtgaggccacagcctttagtctctacatgacttctttgtcaaaatgcaacatcaaagggttcacaaggaaaagagacccatgcaaataatccctggctgctcacagtgtcaggaccagcagcacaagtatcccctgggagcctattagaaatgcagaatctcaggcccccagcccttttgaaacagaatttgcattttaacaagctgcctagatagtttgtgtgcatgctgcagcttgggaaatagtgacagagcagagagacagccttttgtctacactgtctctttccaccacaagaaacaactgcattaaagcttggttcaaggaaaagtcctgtgatgtccctgtcctttggagctgaggaattaacatgggctctgtggggtttttctggaggatggcagaattgttggggatgcttgaacttctgaaaatgtttgaagggagaaggaatgtaacgaaccttctgctcagagcaaagcaatgagaccgcatcatgggttagagaccactgcacaagttgctttgcttatttctataattgtggtcagtacctctgccatctgccatcttcctacagcagtgtgtaggcctctaggaggctttagcaagatcagcacccaggtggaggcctcttagaagaaaaaaccctgtcaaagtgcaggggactcccagacaatgcaacattcatttaggccaatcaattctgtcaaaaattcattcgatgaaaatagtaccaagtgggtactcaactgcttagccaatttagtctccacagcaactctgaggctacaggtaaatacagtctcaggcacggaaggaaatctggtatttattcagagaggcagtagacatccctctgtccctgacttgctagctatgtgacccaaggcaagttacttaccttccccaaccagtagcttctccattttaaaatgggttatcagaaggtattgatcttctgggtgtgttgtaaatgctaagcttactattcattctaggccagccaggcatggtggctcatgcctgtaatcccagcactttgggaggcccaagcgaggggattgcttgagccctggagtttgagaccagcctaggaaacatagtgagacccagtcccagcaaaaaataaaaaaaaattagctgagtgtggtggtgcatgcttgtagtcacagctacttaggaggatgaaataggagaatcacttgagcccaagagctcaaggctgcagtaagccatgattgtgctatttcactccagcctgagtgacagagcaagactctgtttaaaaaaaaaaaagcaccctgtaatgctattactcacacgtaaagtcttctctataggaggtaagaatgatatttcaggagtgtaaagaatcttgatgtcaccttatggaaaggggatgaaaaagaagatgaaaaaggcttgttttcattttgccagagtcatggattccagttccaggtctgttttgcatcaccatagtcccaaacaagtgtaacatccagagcccaggaggaattctggatgaaatatcagccaggagcaggagtgtgacagctgtaggtcacttgggccataaagttagttaatggggaagacagatgaatgagtgtattgtggcaacatatcagaaggtctgaggcataaatagtgttggaaaataataagacagttggttcttgaggatcaacattgcagggaaggagaaatgcacaacaaaagaccatgttgtgtttttggatggtggccggggatgcacattcactgcccctcccctcttcaaccccactctccacatcccgtgacctggtgggatgccagtggtcatgagatcccatcacatacatgagtttcaagagtcactaacaagcttgtaaagaacaggtactttctaaggaatattcactcttgcagctgtattcctagggcttaaatagcacactgttttccactgacaaatgatttcgggtagggtgatctcatgaacttgtactaatggcagacacatttgaatttcttttttattctgaaagttaactgctgaaagcaaatgtgaaaaaaaaattatctccctctgttttatctctgggagaagataaaaatacgaggtgttttaatttggcagtgatctgggcgccttccgctggcctgtttttcttttgcgaagagctcccactttcaggactgccgtttctttgatcttatattctgtctgtgttcaggtacccctttgtgcctacctgaatcgtgtgtaacaaatcatcttaattacttcaggcctggcttcctcctccagttctcattttctgaaattcctgcgatggttaccaaataaatcagtgtggggctccagcccttggaaacagcacggaggcaccagcagcagccagaggaatttcaaagttagttaaaaggcacaggaggagtgagggaattgattgagaacctccctacccaccatgattttcagcctggagagttagtgctgcctgtactccaattccatgtgctttgcggggctcagccctcacacttttccccgtagaagagagaataattaatgccgtgaccccttggcgtggtagctagagccctgctgtcatcagcagtgccccaaacgcagtaggaacacgtaccgtatttcaaagcccaggcaggcagagaagggggaaggaactggtggcgcgctgtgacctgcgggagctccccagcgcagccagcaggaggcccaagctaggcggagagagggtcgtggggaagcgggccgctcccgggactcgtcactgggttggagctggcccgcttgagtggctccagttccaggaaggccgggtggcgtggggctgtgtttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccggggctgtgttttaagtggccgtttgtaagaagaacctctggcggagaggtgctgaggcaggctgggctgtgatcctgcacgccaggcggcctaaggggaggtaattgggaaccgcgagctgacactgcggaaaaaccaaacaccgcatattctcactcataggtgggaattgaacaatgagaacacatggacacaggaaggggaacatcacactctggggactgttgtggggtggggggaggggggagggatagatttaggagatatacctaatgttaaatgacgagttaatgggtgcagcacaccagctagcacatgtatacatatgtaactaacatgcacattgtgcacatgtaccctaaaacttaaagtataataataataataataataaaagaaattggtatttactaagaaaaaaagtgagagttctgtgtaggcctttgaaaaacacaaatctcttacttggggagacattccagtttaagtattatatttgacaaagtcctaaattatgtttaaactatggttatgaattttactaggaaaggaagaatttttatagcaaacaaattacaggaatttcaaagaccaaaaagaaaaaaaagaaaatgtaagccgcgaagccgcatcaacgccttcctgacagcggtgtctgttagtccacggcgtcccctcctaaggggagctgcgaaagacccattccggaggcatttcacggggccccgtaacacccgggcgagtgagctactgagaactgcatggctccttctggggccaggcggtcctaggagagccggctgggaggcggattgcttggacgtcccccgcccgcccccgcaactctgcgtgcggcgacgttgggaggtcccattagaagctccttgggcgggatctgtccaccatgccgcggcgcggagtgggagaggtttcggtctctgccaagggaagttgctgttgagtgcatcgccgtgaacacgacgcagcacatcctacagcccctgtggatatgtggatgctgtgggggcctgttgggtccgatagaagtttcaaaatcaaaatttttcaccatcctcgttgggtgatggtttgtagaatatttttgagggagtcttgtttgaggcggacagactcactcatctggtacactctttttcgagaacatggtgataaaataggttggctctaacgagaaggtgtcattccgccactccctttcccaagagggcttcgagggacactcaagtgaccaggatgtggcttatcctgtgatagccatctgagaacgttgttctctgttctttacttgcttctagtcagaaaacatggcctgtgttaggcaccctaggggataaagtgaattagacctggacctgactccagttttttcttttaaaactcactcgttttttcttcaaaaaataactcccccggtgtttctaatgtacagctgttttttgttgggaattactacattaaattatctctaagactcttctcatttcagatattttttggtttcctaattgtctaaaatttttaattatttttatttttattttttatttttttgcagacgtgaggcctccctatgtcgcccaggctagtctcgaactcctgggcttaagcgatcctgccacttcagcttcccaaagtgttgggattacaggcccgagtcactgtgccagcttcccctagttcttgagctcttctagggccactagattctctttcaccagcatgaagtaggatcattttagttagggtcaaattataaccttaaatcccaagtgacactgttcttttgtgaccactaacccctcaaaagatttttttttttctgatttcaaaacttctcctcctaaatcatcctgcaaattttactgaatctctactgcatgccagaggccccattctaggcattggggaaaaatacagtggtgcagacaaggagcctgttctcatggagcttacattctagaatcggatccagatcgttatgaatttcccctttattttgttttagtctctttcttaaactttcaactgtattcttctggttactcaatcccagttcatcctagggcagaaacataaattaagtccacttttatacttggtattacgcactgaatgtttttgtctctttcaaattcatatgttgaaatcgaatccctaatgtgatggtatttggaggtgaggcctttgggaggtaattaggtcatgaggaaagaaccctcatgaatggaattagtgccttttagaaagaggcaggagagctagctcatttgcttgccaccttgggaggatacaacacgaagttggcagtttgcaacctggaagagagtcctcgccagcacctgaccatgctggcaccctgatcgctgactttcagcctccagaaatatgggaaatttctgttctttataagtcacccagtctatactactttattatagcagctggaactaaggcacttgtttatccttcatctgtaggaaaatgctaaatcagataatggcaaccactgtgaactatattatctctagggtattatggggtctccatggcaggtgagagaaatatctttttataactaaaaatgttgagcactctaaccatttggatgcatattttttactctctgtatttaaaagttaagtctcattttctacttgtagttgacatctgttgttatcatttacttctctgttacatgcagggaggatacattccctagtcttccatttttgtgtgtagggactttttcagaaaacactcctagctccttggtttcctgtatcccccttttcccttcccctcaagggaggaagcgtgagctacttgatgggtgagtttgggtgcagtggctgagcatgtgactctcagcccctttctattttctctttgtcacctacaagtgtgcaaacagctttctatgctcttccatgccatacatgacaggagcaggcccccatgggagactgcatgtccgtgatggggcaggcccatctaattcaggaagcaagctcatttggttaacagacctaaagccatgttgtaaggctgacattttagggcttttctacttggctcctgggtctttctctcaactggctccaaactaaggtggggcattgagctttctcaaaccccaacagtacccatatctcaattccctagagaaccaccttctccagctcatagtaagtttgaattaagtgaaactgactctacacatgagacccacaattagctccccttggctacaagatttgtttaaggatgaacatagggcccagtcagatctaatgaatcacagtgatgttttcctcgttgaggaactcttaattttatctgctggacctaaaggagggtgtagggattacagccattgctgccatcccattacaacatgaagccaagagatgtagaaaaatgctcctgatgccattggttgagttcaggtttcagccacatctgaaatgtattctacccctggacttttcatcttaagtgaaacaataagttccctttgtgcttaagctagtttgggtccgtttcctactgctttcaatggtaaatggatcattctttatattattttcatattgttagttttaattgattttagatcaccacagatcacctcaattactcacgttagatcccaggagctagaagcgattttagaaagtgttaatagcaggaggatacttaggttttaatgttgagatgttaattattttaggcaccttttattacctatttactttgtctatttatttgttattttttggtaaacaaatctgatggggtacttgactatagtaagtctttaatcaaactttaacaatgcaatcagttcattttttccttttgattaactggagaagagcaactcttggtctttaaagtcatagtgatcattataaatatcctcaaggaaacaacaaactcttgaggaaagttatttcagttacatcccaacataagagactggaaattttttaccaagaattctggtagaggtgtaatataaccaggagggtgttgtggtttggatggacaatgagaagagagaagggccttctgggaatggggaagaaaatcagtggagttaagagtgaggcacattcatagctgctgaggtggagatggcaagctgtccaaaaaaaaaaaaaaaaaatgtgagctttccctttcatttttcatagcattgctgctgggaggtggctgctcatccagggactatatttttcaacactctttgcatctagatatggtcatgtgacttgttctcaccagtgaaatgtgagtggaagctacttctatgccaaggcttttaaaaagtagcctactttcctggtacgtttcctcctttcatccctacattgtccttctagtggttagtaggggcataaactcgaagcttggctttctgaatcactgaatgagagaaaacttgctttgattttttttttttttttcaagagacaggttcttgctgtgtcacccaggttggaatgcagtggggtgaccgtagcttactgcagcctcgtactcctgggctcaagtgatccttctgcctaggcctcccaaaggtgctaggattacaggcatgagctatcacgcccagactggactattttgtgaaagggaaataaagttctattgtgtttggccactgtattaggctgttcttacattgccataaagaaatacctgagactgggtaatttataagaaaagagatttaattggctcatggttctgcaggctgtacaggaagtatgacactggcatctgcttctggggaggcctcaggaagctttcccttgtggcaaaaggtgaagcaggagtaggcacttcacatagagaaagcaggagcaagccagaaagagagagaggcagggggagatgccacacacttttaaacaaccagatctcttgaaaactcactcactatcgcacggacagcactaagccatgagggatccacccccatgatccaaacacctcccaccaggccccaacgctagcagtggggattacatttcaacatgagatttgggcagggacaaatatccaaacaatatcggtcagtgtgcatttacagatatatttgatacaaaaagatctcagtgcttctcaaagtgcggtttccagaccaggaacatcagcctcgctggagacttgttagacatgaaaattctcaggccccactcttgacctactgaattagaatctcggatccagagatctgtgtatctgacaagccctccaggtggtcctaatgcacactcaagtttgaggaccactgccttgtgccgtccctaccaacttcatcaccgctctaactgatcagtagacatgggttgtttctctcctcagctttgccttttctggattaaactctcaaagtgtctaaagtttctgagcttcattagcaatggtgctgaaagttaaggataatgttgaaaaatcttgtgcatgagggaagacatttggtgagtttgaagttctgatgaattttgagaaaaagaaacatcctgaaagcttaagatagcttaaaaacaacttttgttcagttctaaatattagcactttttataaaagggcatatatcctacctagaacaggggtcacaacccagatgccccccaggtaatctaatccaggggagtgggccaagtggagggcagcgaacagtatgaagcaacagctgattgttaagagtatgggcccagtgacttcaggtctaaacattattaaaaagaactgcagatttgcattttcattttacatcttctggtttgtaaatgttaactcacattacaaaaaatccaaatccaagaaacaaaaccaaaaattttgtatgggttgaacatgcctgagtgtttaatttggcccctgggctgccagttttacaacctttgtctggaagtaccagggaagcagtcaggttgctaatgtctcctcttactcattaggaggcaaaataacttttacacaatcatgagctccaaaagggagacgaataagagctgtacaaagtagttgccaaggtaacatcttgctgatcagaaaggggcgacaattgggttttatgtagacgcagtgggagaatgaaacataatctttctctgtcttctttctgtttaagatcagtgtggaaatggatgtggacgcggtgctgctgcctgagattagcaggaagcaattcttttcccatttggagagaccccggtgagacctgatcaactagcaacatgcggaagtcacaccattaagtcttccaatttgctagcagcaaatcaatgaactctgatagctgctgccctaagctagcatccagggaactgtggacaagctatttgatacctgaattttagtgaaggaaagttaaattttttcttaaagcagggtgggagtggggttgtgtggggaagattatattaagcagtgagagaagacagatggagttttgtagaaagagagctggttgttttaaattgtatcttaaatttattgtagagctattggtaattagtgttttgttgttgtgtgtttataccaaccaattaataagaaaggcttttatttttatttcatcagttggagctgaactttattttttattataaatataaggcattattctagggcctggcaaacataggcagccactttttttttctggggaagattataccttggtatgttttcaccactgtgagatgaaaatttgagaacagtgagagacagatgcttgcctgaggagttttattttccctttaatccttatcaaatatccagatattacctatattgccttgatctgctgtctgaaggtgggtttctttgattgtttgaagagttctgggcactagaggtgcttactttgtgacgggagcaaataacaaggtgttgcccatgacatggtcaagcctcttcttcaattagccacctatcttgggcatgttttcatagagatatatctcatcccttttaataactgcagaatcttggacatttagaggtctccaaatattggttgtcatttatggtgtatcgtgtttttgttattataataacgttgcaataaataccctagcaacctatttttgcttacaagtagagtattttcgaagaacaaattccttcatgtgaaactgacgggtcaaaatataaaaggattaaagtttcaatagttagttaattgccttacaatggaattacaacaatttatacttccaccagtaattcatgaactctgccttaccacataatatttctaatctttcccaatctgatatggagaaacatgttttattattctatttttttttcactaaaagagagactttgaacacccctccatatgtttcaaaaacacttgtagaccaggtgtggtggctcactcctgtaattccagcactttgggaagtgagaagattgcttgagcccaggagttcgagaccaacttaggcaacaaatctagacaagggagaccttgtctctacgaaaaaatgaaaacattaactgggcatggtggtgtgtgctgtggtgctagctgctcaggaggctgaagatgggaggactgcttgagcctgggaagttgaggctgcagtgagctgtgtgatggcaccactgcactccagcctgggcaacagagtgagaccctgtctcaaaacaaaacaaaacaatacaaaacaaaacttttttttttcagtgaatgtttctttatagatttcaacttctaaaaattgttggcactttttttgattgactgaagagctcattatatattaagcaatgtagactttttttttttttttttgagacagggtctcgctccgtcgcccaggctggagtgcattggtgcgatctgggctcactgcaacctctgtctcccaggttcaagcaattctccccgctcagcctcctgagtacctgggattgcaggcacctaccatcatgcccggctaatttttgtatttttgtagagatagggttttaccatgttgttcaggctggtcttgaactcctgatctcagatgatctacccgccacggcttcccaaagtgctgggattacaggtgtgagccgccgcgcttggcccaatttagactttttaaaccaacttttgaaggttggtttttaaaaaataaatgactggatcatgttctaactactcatagtctcagccaaacacaattgcggaaggcctagccaaaggctctttgctcagtgaaagtcccatgaatctcaggcacagaggatagtctggaaagacctaacctgcacatgcaaatctattaagaaagatgaagtcttaggcttatatggagctaaataattgcatgtttaatgcaatgccagggtacaggtaatggtgattggagttggaggggtgatgtgtgtggtgggtgaggaagtcagggctgagtcctaggtgagatctataagagtgatgtttatttatgcatctgagggctgggactctcatgacaggatttattttcattctctttcaaggagagccatgctgccttgctgcttcttgctcgtgtacacagagcacttggtgtcttgcgaatcccctttgacgccggtgcctttccaggccagtgctttgcttgtgttcagaggatgcatgctcaggccctaccagactatcttagggatgaggggcaaattttgtttccaatgctctgtgtgggccctccatggcattttcttcattttgggttccatcctggcctaaagcttcccattaaagctaatggccattggagttaacccaaattttctcctttggtatttataaaaagcaacactgaaaaaccttgaaattaactaacaataaaaaaaccattgatcggttctttcctggagatggttctttcttctcaaataggccactttgcagactggaaatcaccccaatcctcaaatagcctaatatttttcacatgtgattccagcaaattgctgtttgcattaacaccttggtggggactcacttaagagctagatttgttagtgtatttactgacattttcacatgatgttttcagctgcctgaataattgtaatattcaccagaaaaaaatcaaagtaatgaaaggtgcctacaattattcatatctcaacattgtaagccttaatttcctgcctgaagtgtggtaaattactcatttttaaagtcatctctagccactgagagtttatggtgatgtatatagatgttttgtagattccaaaaaaaatcaatgactatgaatatcacagactgtcaaaacagctggtgtgattataaaataatgagatcaactaaagacatcagctctcagacatccaaattgtaagaggaaaatgaagacgaggaaggggaaagtgaattgcttaatgtcttgtaggtaccaaataatagagtcagtatctgccactgccatgctgaagattttgcactgttacttacacagattcattcccctttttgcaggctttgttgggccaggagatggttttgcagcagcagaagactatgaactgggctttgggagataggatctctggttgtattctggctatccacactctgaaagaggaccgtgacaggtattgtcattattggtggctgagtttctaggttagccaacctatggcagattgggaagactttataatgcgaataaacagaagaaagtttacttgatcaaaaaagattttttctcctggtggaaactgcaattattagggcaactctttaagtgtccatcaatattaggatgcattttaacaggttaagtactcttctaactgggatgaatagggcattgacaggaaaattaacacacaagttcttatatcctccttcccttatatctggtcgcataacctaatgtgaattttttatgcctttaagtgctgatattatggaaaaaccttctaaaactggataaatatcattttccaagactcagatcaaatatcacatctttctctgattttcttgatccttcctgccaaaaagaaatagcaccatatatgcattagtataatctatttgtaattaacataaaatttctcattttacagagaatttgagtatcctaccaatatacctacaaaaggatgaaagaagatttggagtcaagggaaaacaagggcaataaaatagaagcttaccacctgctctcatacagttgctagaagaggactgcatatttggttctaagtttctggaagataaagccaaaatagaaacacaactcattataaaattttggtgtatccataaaataaaaacaaatgacctgtttgagaaaactctttctgagtttgagctctaaaaggaacttctctatggaatccttagaatatgagaaggctgtgatataggggagaaaccccttgacattcctatattgggtttaggtctaatttcactcagtagtttttaaatgttactccttgtagacagatgatgagacgccaaagtacagctgagtgaaagcggttcctttgaaaactaaaggctgtaaaaacaaggctgtggatcatgttgtttcagttctttatagattttttaaactgaattttgcatctgtgtacatgaagaataaattgtagaatatctaaggaaatggatgggctgcttatcttttagaacctccataaattatttattgtaagtatgtttgataaggattgtacagctgagagttcaaggttgcatttttttccccagcaagaaccaaaagtgcagataacatgcagccaattaaggacaaatctgtatggtttgtcaatcaatctgtcaggatgtccctgaattgtagcacttatcacttggtattatagacatctgtgtccctggcataactgcatcctcttcaagggcaggaattgcttcttttccatttttgcactctagcatccagcattatgtttgagacctagcatctatatgagagactttgttgaacggaatcaattgaaaggcttcccattatcatgcagtactacttgacaaagatcagaaccctgagcaatcaagggcaggaaacataggctagctgagctttgaaggaagtgaaaagaaaaagaggcagcaaagatgggaacatggaggacagtctgagaaaacaagctcagggttgaagggggtgttccagtgaaggggtgatgagtgggacctcacacatggagcagataacattggtgcatcagttgatttaaatgagcagaatggaaagtgtctaaaagagagatgtggaaatgagtagaaacatccctttcctgttgggccagctattgtctatggttagtccttttcccatccttatttcctctcctctgaattgcaagttgctggaaacatgagaagtgcattccttgctcccttggttactgggcttcagttagcatttgccaatgagggtgagcactcatgggagactggaaagtggtagaaagggaaagccattcagctggctgtgacagtggcagcagcgggcagtaccgtgggctccaacagcattggtggtggctccagcatcatcactgggagcttgggctcctgggttcctgctcagcagctatggtcagtaccttctgagatggcctcctctgatcctcacctcttggtattcatggccttgtgaaatcccctttgcttgagtaacttgctgccaaccaatagaatatggcaatgttgagggttgctacctttctgactaggttgcaaatgattgtgacttctgtcttgctggcaggctctctctatttgccttttggtttgtgtgctctgaggatgcaaactgccatgttcgtgagacctgcatggcgaggaattgagggcagactctgtccaacagccagtgagaaactgaggtccaacagcctacacggagctgaatcttaccaataactacatgaacttgaaagtgtatccttcccttcagatgagtgtagcctgagtgacaccttaactgaagcctatgagaggccctgaagcagaggaaggacccagctagctcacacctagatttctgatgcatagaaactgtgagatagcatgtgttattttaagccagttttgagatgatttgttatacaatagcaatagataacaaatatgatggcagagctctgttccaacagcagtagcaagcgtgtgcttgccgactctggatcactccacattcacctctttgcttctacagctatgggacaatagcagcagcgtcctacagttgccaatttctaggtaatgccattttccacttgacctgtgttttcaaaacctttgtcaccattttcctatattaaattccttcataataacagaagagtggctaacatatgcacacaactatttttcttgatagggagataaagagagcattgctgtatattaaatgtagttatgtctttttagatgtttaagaaaatgaaatgcaccttttttcaagtgaataaatgtttgcctctctgtagttcttggtttttgggagaaggtcaacttcaaaagatagagtcattggcaccttctttctgtagtgtgcttgactgtatatccctgcccacccacaggcagcaaaggcaatgcatgagggattttgaaggacacacagtagctgcttctgttttcatgtgggagtccaaggaagtataaatgctgcatgctccctgtaactagaataaaatattatggtgtgtgtataagggcaaactcctaactcagcaggtgaacaaccatatcgacttcattccccctggagactgaaattagaaagaaacctacatatcaggccacagcagcccttgatgaagctcaaaagagaggtggcaaactcacagctacacagcaaaaaccaagtcagaggcagcaaaagctgtagtttgagaacaaagggaaagaaaaagactagtcaaagaggccatatctacccacccacagaaaacccagagaagaaaataagttacatttctcccactggaaggcttgggggaggagacattcaggaaagccacaggggcagaaaattagatagtttatctgaaaaaggaaaaatgaactaaagtgtgcttttgatagatggctggaagtgagcacaaaggcaaaacaccaacatacacttggcgtctgaagaatgtcttttatccaaagatcttagagcagtttgagtgtattaatttacttgtgagacagttaaattattattcgttcatttttatgtggcattttattctaaaatttgctaaggattttataactcaagtacattggttattccccaaacagccctgtagatgcagtgtggccattactgtatgacacatgtggacactgagcctcagagatgtcaggaaacagagagaatcagaggaggctggaagatcagcgatgactgtatgaacactgaataaggaatggggaactctgtggagacaactcagtcttttctatggctatttcttcatggcttctgtggtagatagaatgatggtcctccaaagatgtccacatcctaactcgtggaacctgtggatatgttatctaatatggtggaaaggactttgcagatatataagttaagaatattgagaggggaaaattctcctgggttatctgggtgggcccaatgtaatcacaaagatgtaagggagagagggagacatgagagtcagagaaggagatgtgatgatgggcagggattgcaatgatgtggggccatgagccaaggaatgtgggaagggcaatggaacacgttcttcatctaaaactggaaagggtaaggttacatcttctcctctagagtttcttgacaacccatcttagacttctgacttatagctgcaagatcataagtttgtgatgttttaatccactaagtttgtggtaatttgttatagaagccacagaaaactcatacagcatctttgaggagtggggggctgcactgtaaacctaaaattttattttttgagttatttgggtaacacaattttagaggattttttttaagaactgtttggatatgtattaataacaattatgggtttagtggcttgaaggaaaaatacagtggcagtaacaacagcaatagtaatgggttatagttattaaggttgtgtgtgccaagtgctgggtaggggtgtggatgttccttctctctcattttctaaaacaattatatgggataattaccttcattttacagaggaggaaactgagtctgagagagccatgcaattagtggtggagctggcatttgcacacaagcatatctgactcttgactacgacctgaagtggtttttctatatacttaattcattgatgggaaaggacaagtcatgtgtgaaagcagggacatgagcaggtgatgacagaaagttgagacaggcctccggtggcactggggatgtgtattgactctgcctcagccatgacagaggtgagggacactgtctcctttccgtcttttctcttctacccatgccagccagccacttttataaagtacccaccatcggtgggcagcacttttccccattctttcttgccaagtgtgactcttctcttgaaagaaagcacacaatttcacactgtataatgagtgtctttcctgccagaaacaacaaggatggagaggctgtggggctactttagctgccataagttagaagggggtcaagtgagtgggatcaggaggatgtaagatgagaagaccaaaattttaatgagatgctgctggaatcagcataaccaagtatggtatcagagctgaaataacttaaaatattacaagtgccattgtaaaatgcaatactccctacttcctagggtggctgtgagaatggagttaataaatgcagagtgctttggatggtgctatagaagtgtagctgttactccactgcacccatcccgcaactactcctgctgctaccagcgccctgttattatcgccactgccaggattactaccactatcacaattactcttactactgccattgactacctttgctaccatcacattatttcaactgctaccattgctgctgctattactactactgtaccgttgctatgacaattattaccattactactgttactgtcaatctgtaggcatagaaagtgcttctgttgtaataaataggccaacagacttctgtaccttcaacaagggtggctagagcacatcctcaggtcatcctgggattgcctggcaatagttcccagtctgattcttttctttgggctgttggcattcttttgctactgctcaggtttggacaaagtggctgtcattgccccaagctctctgaggtaggaactctgcctgcttcactaattcttctcagtgacaaatgctcctcaaatctattccccagtggccatttgaagtggacaaacaactccacagccatgaaatatcatgttttaaatagaaggcactgtgtcaaatgccaccagcaactcagccttggagctgctgatctcagactgattcagattcttggagataatcataagaactaacctttaacaagtgcttattgtgtcttatcaggtgctgttctaggcacttaacaaagatttaattatttgactctccaaaaaagtcttcgaaatagttactgctatgaattatgttttacaaatgagaaaactgagacacagagaagttaagacatttgctcaagataatacagcaaatgggaaagctgggatttgaacacattcagtctaactccagagatgctgctgctggccaatgtaaaccaacacattggcttcacagtacacagcattttagtcagagaagatcaaggcctagcaaagacagctgcccatagttggtgctcaataaatgctagactagtgaaggaatgaatcaacaatgaatggaagaatgagagtaacatggtgtttgtgtgagtgaagaaagaaggcagtatgagtattctaaaccaaacagtcaactcagttattgtcaagaacagattgaaaaggaagtcaaggtagtcaagaaggaattgataaggaattatgcatagagacctggtttgctggaggatctagggaattgtctctaaggattttccagggcctggggaagacagttcagtggagggaggtgggaggacttctagaacacttggccttttcttagaccaggggtccctgaacccctgggccatggactggtactggtcagtggcttgttaggaactgggcaggacagcaggaggtgaatggaaggtgagcgagagaagctacgtccatgtttacagccacttgccatcacttgcattactgcctgagcgccacctcctgtcagatcagcggtagcattagattctcataggaacatgaaccctattgtgaactaggttgtgtgctcctcatgagaatctaatgcctgatgatctgaggtggggctgaggtgatgatgctagcgctggggagtggctgcaaatacagataaacattagcagagagggttgactgcccacaataaatcagttgcttgcagactcatatcaaaaccctatcaatgtgtggcaaatgaccagccgcatctggtggcaggctttatagtggcaagtgagttgaaaaaaagtgcacaataaatgtaatgtgcttgagtcatctcaaacccaccataccccttacctctttcctgtggaaaaattgtcttccatgaaactggcccctggtgccaaaaagttggtgactgctgccttagacctttctggtgtacctcatgatatagttccagtctctacaaccagtcagcacctttctctgatgcagagtgatttgtttgcttcttttagttattaaaaattgtgtgtcataggattttagtgctagaaatctctctagaggtcaagccccctcatttcactgattaggatactgagtcccaaaggggttacgggtcttgacaaggccacaacaatagggatttgctaggccccaacatgcacctttaattctgattcattcatttgttcaccccaatctggtgacagtctcttgtgttgtcttgaatgtcttggtatttcagataaaaagcctggcttaagtttttgatcatagccattctaacaggcatgtcatgaaaaaagacaagagatgaatgtggacgaggtcgtagagaaagggagcccctacacactgttggtggggatgtaaaaggtgcggccgctataggaaacagtatggagtttcctcaaaaaattaaaaatagaactgccgtatgatccagcaattcctctgctgggtctatacctgaaggaaatgacatcagtatgttgaagaggtatccgcactccagtgttcactgcagcatgattcacaatagccaagatatgcgatcaccctaaatgtccatcagtggatgaatggataaagaaaatgtgatattgtacaaactggaatactattaagccttaaaaagaagaaagttctgtcatttgcaacaacacgaatgaatctggaggatattacgctacatgaaataagccaggcatagaaagacaaacactgcatgatctcactcatatgtgacatctcaaaaaatcgacctcacagaagcagggaatagaatggtcattgccaggggctgaggggctggggtggaaataggaagatgtcagtcaaaaagtgcgaaggttcagcagctagaaaatgaatcatttctggagactagtgtacaacatggtgactaccgttaatatgcattgcatacttgaaaattgctaagggagtagatcttaaacattctcactacaaaaaataataagtatgtgaggtgatgaatatgctaattagcttgattgtggtacaatgtatacatatatcaaaacatggtgttgtgtgccttgaatacatacaatttttatttgtcaattatactttaatgaggtagggaaagaaaaaaaagaagggagagaaagagagaaatctaaaattaaaaaaaaatggaaaaaaggtcggcttgggccagggccataggcaaactttgtttttcataacactggatatgacaatgatctaattagctaattaatttgcactgtattcttttgctacaacgtcatataactttcgtctttaagatggacaaactaaggtaacttgcattttccttcatttaatatttaaaacctctttataagaaaaagcagccccaaagaattgtttgtactcatattaatatcacttaattaaaaacatttttcagcattgtaacaaatagaacaaccttagctgtaatatatgttcttcttgcagcaaagttttgcctctttacaccatcaataaatgtgagcattataagattataataaattatttagattatacttacttttaatcattattttctcagtaaattctaaaattcaatgcaaaaggaactaagatgacttagttacatatgtttcacactggactcattatagctttctgggagtgactatgttactttattaaaaatttcttttacctttaataagggagaaagacagagaccattatgtcatctagtttctcattctgtcctgcttagcatataacttcttcattattgtactctccatagttcctcctgaatagaaagtatcaaatctcctcttcacgtcttcactgtaattatcattcttatctgacataaaacagtgattaaagtaacccatctctagaactaatttgatatataacaataaaaacttcttgacaaatttcaatgtcatctgggtggtttagatatgtacacactctgttattgattttccctcctttgataatacagcactacttatttttaggttttctctaactcaaaaggaaaaaaatgctgtttttattcttactctcactaaacgcttttatttaaagtgtaagtgaccatttggtagaagtcacatagattgtgcaatattttaatccaagtgagcaatctggttctaataccttttgcttgtgggtggggacacccatttttgctacttcaatggcctacaattcaacctgatcccaagacttttgctattcatctctcctcccgcatttagctgttccgttattccattgttatattattgtgggatttatatgaattagcacagaaaatggaactcaagtgttcagatttaagcctctttctttctttgtagagcccaaggcagagaaaaatgtagatccaggaatctttttcttttctttgtgacattactaaggagatgctatttttccattttataagtggaaatattaaggcagagccaacttcggggacttgcttcaggttatatagtcaatctgggttgtagtcaagaggaacaaaacataaaaataaaagttggtgaaataaagaaactgatggccccaaacagtattagctgaaattgctagtataaaagaactcaaggaaagtttaagtaaaattgtggttgattgcactttaataggaacttaaggacatttaggagttgtttctaagcttgtgaggccttgattatgaaggaagttgcaactatttcctacaaaatgcctcttggtactattgtcagacagttggtctaagccagtgtggcaattcttactttattatgtttccccaagccccttttggtgttttatctagtggagcattcatctgagacaaacagcttatgtactctttctcgccaagcagaagctagaatgaatgagaaaatcgcataagaaaatctgtcctcctgatttcccacatgaaactggcttggagagtcactgttcccttgacaggagccttctgcaggctccaccaatacttgtcaaccgcctggcttgttgtgggggtggcggcagctgctacttctgcttcttcaaaataaaaaccgcaaataagtatatttagaaagtgtgtccatcctagttcatcttcccagctgttttcctggtggaattagattagcagtgtaagtgaaatcttttctgaacctcatcgaaatccagacttgcctagtaaatggcttcattcattattttcatttacctacattctaatttagtttttcttatttttatgaacagttactatataccaagtactgtgcaaaaggctttacagacaatatctcatttaatctcaaaacagccttacaaagtgggtgttaccacccgtatatggcaacaccaggtttaagtgactcacctaggtcactcagcagggtgtcataatctagtctggctgattccagggcctatgttccaggatacgccatggccccagctgaggactttattaaatagtctatggtcttgcagagtcaaacctattctctggttcttaaagatggaccacttgaaggcaggtccttgaagagccatgggcactgacagtttttgctcactagggattggtggtaatgtctcaggttttctgtgagttcaattttcatgagcccagtttcgcttcagtaagtattgatctggccctagaactcatggtttgtgtgtgtgtgcgtgtgtgtgagtgtgtgtgcgtgtgtgtatgcacacctgtgttctctggcttggagagttagcaattactgatgatcagggtttccttaatctctcttaggaagacttcttagtctttatttatttggaggtcaaattgtgtacagtatttctcccagagattccttcttaattcaacaaagggaatgttttagaagaaaacaaagggaaaaacaatcaacaccaatccccaaacacccatatacatgcacatgaagaaaatgtgcaacatagctagagatgcattatcagagcacagattaattatttgaagcaaggtagactattagtttctgttagccttgctgggacttatttctgagcttctaattctagatatgagccccatgattacctcctttggccctgcttaggccctcttccatctctacagtcactctggttcctgggcaagtcttccttaatgcgcaaggcatttctcactgtggttccatgactcctgtctggaatacgggctatctggtctacttgcagtctgagtgacgcttaacttctttactcattggcataaggagtggctgagtttgctttctcttgaggttctggagtcccaatagttgaagaattcatcctcggagactcttcgctccagtccagcttcctgccatgcagcaaaagcctgcatttcttctagtttcaagcctttgcatcacctgttagatttcttactatgttcctccttcagccttaaaaggtatctcttgtgctcatttgtaggactggagttctaaaagaattctgccctggtaccaatcattccacctccctagttactctatgggacttactccagttgaaaccagtagaaaaatacctcacacatacagtggcaatagtaaacatacaagagaaagaatattcattttctatatgcctttctcctattttataagatataaaataagaaccttgaatgacaatgagcttttgggggaacatactttattcccacaggatgttccctgttctgggcctctcacattcatggacatctcatacatatgggcatcaggtacgatactttcagttgcaagtaacagagatcaactctgactctgaagctggtatagtggaggctgggagatcatgtctagaaaatgaacatgaaccagagagtcaagaaacacaagaatctggccacaccactgctgtggtcatgctgatgccatgaatgcatttaaacaagactttgtctttgcttcaccttctgcaaagtcagatgagtgagaacatctgataggcagggcttgatatgtgtcagccttgcctatcaggtcatgaagacaggacggatcacgactctttggcttcctctgtgggaacctgtgggaagcctgtatgcccaggggggtttgtgttcctcaaaaccaggctggatgtggtggctcacatctgtaatcccagcactttgggaagctgaggtggaactcctggctcacttgagtccaggagctcaagaccagcctgtgcaacatagtgagaccctgtcttaaaaaaaaaaaaaaattagttaggtgtattagtgcttgcctgtggtcccggatacttgggaaagtggaaagattgcttgagcctgggagtttgaggccacagtaagctgtgcttgtgccactgccctttagcctgggctacagagctagaccctatttcaaaacaaacaaacaaacaaacaaacaaacaagaaagggggcaggttgactgctagactgccatagaaaaatccaatggccagttcaatgaattttcctcagtatttaaaaaaaaaatctcaattagtttttcttaacactattctcaatctagccctccctttcgttcttttcaaaatatataccttttaggttagcagttgccttaatactgttaacattttataccgagaccacagagttgctgctaaagtgtatagtcagaattgaattcagaagattgatgttctcttcaggctgcagaccatctgattactggatctcctctgggcaatgaagctgcctcctttttctcctctctcgaccgtcaagcttgcaccacagtaataatatttaataagagcagcagtgaaactatgtcattgcttctctgatggtcagagtggaacacagctccaaataaaacaggagtgattgtcatacagataatacagttgttttagttctttcaccttgagaaaggatgaggtagcttgaatgctgattgatgcttgtctctcatagtctactggaatatacattaggtatttgggtgaaactgtgagttgcacttgatcatgtattaaacattttgcaagctatttgctgctgtatattctgactggatcttgaaaaacacccttgctatttcaggataaaagaaataaagcttttgtggttttggctgctctacctaagtcaggagactctttttctgagaatatttaaacattttgccacattcatctgtctttttctcacactatcccagaataactgaagatatgtaatacagggaaaccttattaaaaaaaaaacttctacctaaagaaatctgaatttatataacagaaaaattgtggagagattatttatattaaaaaagattttcttttttttttcacaaaagtgttcacgttaggctttctttaaatagcaaagtcccttactggattaaaatatgactgaatttctctttcagaaatgcatctactgtttaaaacaagccatgttttatgtcatccaattttataactgaagaactgagaataattcagaaaaaagtcacagaaactttgtgtggatctaggaagataattcagggctaacgatcactcctatactctcctagaaagagagtagcttccatggaaatgaactgagacccttccttcctagaacctggaagattcctgcattaagtcacgtcatagtcataaggtcattcaactattgatgacattttctaactacgtgtggataagcttttatgttgatggttcagattttctgctttggaaaaaaggaattttagtgtatttgacttctaacaataaaatatatgcaaagaaaagtctgtcattagattccctagtttgtaatttaggggaagatatttcacttcaacctttctgggccttagtttcttcacttataaaatgaaggttttgaactagataatctctgagtccttttatagctcccaaacttgcttcttagttgtttcttttatttttaaataagagtaacacaaatcctgtaattctgagagtctagatcacagactgatctcatctatgctttatcttttcattttataaatgctcttggtgtttgtaaagcttatgtccagacttgaagccagttagaggcctaaagaacagtgcaaaagaatgttagatatacctggatactcttcctcttctttttaaaaaaatttaatgaggaacaaaatcttagattgttacacagcagaggtgcaataaagaataaaaatgcaagggaggaaaagtcacaaagccaatgaacaaaaattcccctgtggtgagggtcttaaagcaggtgtagtggtttatcattttactgaatgagctctgggtctggtgggttaaaacaagatcctctggttaagtgggacaatgaaacatagatggggaagcaatagccctgctaaagactgaatatttatatcccctcaagttcatatgttaaaatctaatctccaatgtggtggtatttggaggtagggcctttgggagtgattaggtcatgaggatggagccctcatgaatgagattagtgccctaccaaccagggagctcacctaaacatctgtgtccagagcttttattggggcttcattatataggcatgattgattgaagtattggccaaaatattgaatacaatctccagccctcctccttataggtcaggctaatatcacatggctcaaagcctcaattctctaatcacatgattggtctttctggcatgaccagcctccatcctgagtaatctctttggcttaagctattataggcgtcagaagtcacctcattagcataaaccttcagggcccaccatgaataacaaagacactcatgtcactctggaaattctaaggatttagaggattccttctaggaaccagggaatagaaccaaccaaactctttattatgtaacatattgcttttggcttttgtctgttctgtagcttttgtaaggaatatgactagcaagttgttaaatctctctctttctctgacgagacttcaagactgaattgaagtcattaattggtttagagtcagagtagcagaatggttaacagtgtgggtttggagatcaggctgcttgggttaatcttggtttcacatcttactagcttggtggtcctggacaagtttcttaacctctctaagcctcagtttcctcttcagtaaaatgataggttatcatgatgaattaagctaatgtctgtaatgtgcttagcatggtgctgggcacacagaagcagtcaaggtttgctactaacgattgcgttaggattttagaaaagctgttgactatttctaaatgtttactttctaaaggtggcatgccctaaatatattcaggccagtggttgtatcagatttttagtttttaggcactgattctttgttaaaggaaatctttcacaaaatccgaatctagaaagccgatgaaatctatattaagctgaactcctctagtcaaagagggtcaggcacatctagccaccttttaatctctggggaattaagatctgtttgaggaagttagtttgaaaactggtctagaccacaaccagtcacctcaccttcaacctcccctccaccagctcccatagcagggttaacagagcaaatctgtgtgtgtcaaagtcaggctataattttcttatttcagtttctccatgagcaaaatggggaagataatgccagctttgttgtggcagtgaattagataatgtctgtaaactattttgagtctttagagatcagttttagggacaaagacctttgccatctttaatttttagcttactttaaaaataagatatcctaaacacaccacttaaaaatgggtcaaacagtcgttttgtctattcttgggataaggtggaagcaatgatttaatcaccacagaagaaatgtgctctgattaattgggaagaaagattttaaaattagagttattcagaaagcctgtcaggagaccaggaagagaggaaaggatgtgtgtcaacacctacagaaagctgtctgtgaagctgggttataacctgatacttctggtcttccctgtaactaaatgtcctttgctgaggcctgaggcagacccttactctgggtttcctgttcctgtatgactagtttcagtcaggctttacgtagtcattctgccctgcagagcaatcacaggaggtaagaaggcatggtcgttaatagcatgggctatgctgttggacttgaatttggtcttgtttctatcacattctgtaatttagttgaaaaatggaaataacacctatctcaagggtttgttgcaaagactacatgagattatacatgcacagcgcttagtacagtgtctgatacatagtaaatgttcttttttttttttttttttttttttttattatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccacctcagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgagtaaatgttctttagcagctgtcattatcattttagagacagagtcttgctggcattatcttccccattttgctcatggagaaactgaaataagaaaattatagtctgactttgacaagcacagatttgctctgttaaccctgctatgggagctggtggagggaaggttggaggtgaggtgattggctgtggtctagaccagttttcaaactaacttcctcaaacagatcttaataggtggctagatgtgcctgaccttctttgactgcaatccaggctggagtgcagtggcgtgatcataactcactgcagcatccaactcctgggctcaagggatcctcccactactgcctcccaagtagctgggagtacaggcatgcaccactatacctgacttatcttttaaaacacttttttttttttttttttttttgtagagacagggtctcactttatttcctaggctggtcttgaactcttggccgcaagaaatcctcccacctaggcctcccaatgtgctgggattgcaggcatgagccaccgtgcctagccccatcagcagttatttaaaacatcattggtatttattatcattattaattatgtttgctatcatggatactaaatatctgcccatctagatctattaccctgatctaaaattctaagttctaacattaccaaaaagaacttgagaagaaatgcctttccatagccagaaaacttgaagctgaagggattttgatttgctcaaaggtattctgtgagtcctttttatctgtcttcatgatctggaccctatagctataagctttcatgtggggaatagtgcttcaaaatgaagtgaccatttacaatatgagtccccagtgcaatatccctccttgggtaatattaggtactatcttggctcatttcatcaatatcttttttgactagtcttttactgattgccccaagttgttaacttcagatgatacaattaaaacacaaagaaaactggttgcaaagaaaaactgcaaaattgttttaaatgtttttctttttttaattttaagagctttaggggtacaggtgttttttggttacatggttgaattgtatagtggtgaagtctgggattttaatgtacctgacacctgagtggtatacatggtacccaaaaggtagtttttcgttccttacctccctccgaacgtcctcctttatgagttttcaaagtccattataccactgtgtatgcctttgcatactcatagcttagctccacttatgagaacatgcagcatttgattttccatttgagtacatcacttaggaaaatggtccccagttccattcaagttgctacaaaggacatagcataaaaaacatcctttttggcgattgagtagtatcacatgatgtgtatgtacaccgcattttcttgatctacttgttgggctcttaagttgattccatatctttgcaattgtgaattgtattatcataaacacacatgtgcaggcaactttttgatataacggcttttgttttctttgggtagatactcagaagtgggattgctggatcaaatggtagttcctttagttctttaaaaaatctctatactgctttccatagaggttgtactagtttacattcccaccaacagtgtataagcattccctttttactacatctatctgggccaacatctatcatttcttgactttttaataatggccattttggctggggtaaggtggtatctcattgtggttttaatttacatttctctgatgattagtgatgttgaacatttttttcatgtatttttggccatttgtatattttcttttgagaaatgtctattcatatcacttgcccacttttaaatttaatcgtttttctttttttgctgatttatttgagttccttgtagattttggatatcagtcctttgtttgatgtaaagattttcccccagcccatagattttgtctgtttactctgatgattatttcttttgctgttcagaagctttttagtgcaattaagtcccatatatttatttatttaacattttgcttcatttgcttttggggtcctagtcataattttttttgcctaagccaatgtccagaagagtttttcccagattttggtctagaattttgatggtttcagttcttagatttaaatctttaatccagtcccctctcccctctcccctctcccctctcccctctccccacggtctccctctccctctctttccacagtctccctctgatgccgagccaaagctggactgtactgctgccatctgggctcattgcaacctccctgcctgattctcctgcctcagcctgccgagtgcctgcgattgcaggcacgtgccgccacgcctgactggttttcgtatttttttggtggagacggggtttcgctgtgttggccaggctggtctccagctcctaaccgctagtgatccgccagcctcggcctcccgaggtgccgggattgcagacggagtctcgttcactcagtgctcaatggtgcccaggctggagtgcagtggtgtgatctcggctcgctacaatcacctcccagccgcctgccttggcctcccaaagagccgagattgcagcctctgcccggcagtcaccccgtctgggaagtgaggagcgtctctgcccggccgcccatcgtctgggatgtggggagcgcctctgccccgccgccccgtctgggatgtgaggagcgcctctgcccggccgcgaccccgtctgggaggtgaggagcgtctctgcccggccgccccgtctgagaagtgaggagaccctctgcctggcatccgccccgtctgagaagtgaggagcccctccgtccggcagccaccccgtctgggaagtgaggagcgtctccgcccggcagccaccccgtccgggagggaggtgggggtcagcccccgccaggccagctgccccgtcagggagggaagtggggggggtcagccccccgcccggccagctgccccgtccgggaggtgaggggcgcctctgcccagccgcccctactgggaagtgaggagcccctctgcccggccatgaccccgtctgggaggtgtacccaacagctcattgagaacgggccatgatgacaatggcggttttgtggaatagaaaggcgggaaaggtggggaaaagattgagaaatcggatggttgccgtgtctgtgtagagaagtagacatgggagacttttcattttgttctgtactaagaaaaattcttctgccttgggatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcaccactccctaatctcaagtacccagggacacaaacactgcggaaggccgcagggtcctctgcctaggaaaaccagagacctttgttcacttgtttatctgctgacattccctccactattgtcctgtgaccctgccaaatctccctctgcgagaaacacccaagaatgatcaataaaaaaataaattaaaaaaaaatctttaatccatcttgagttcatttttttatatggtgagtgatagggatccagtttcattcttctagatgtggcttgccaattttttagcactgattattgagtagggtgtccttcccccagtttatgtttgtgtatgctttgtcaaagggaggccgaggcgggtggatcatgaggtcaggagatcaagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgtgccactgcagtccgcagtccggcctgggcgacagagcgagactccgtctcaaaaaaaaaaaaaaaaaaaggtcagttggttgtaagtatttggctttatcttggggttcttttttctgtatcactggtctatgtatacacttttataccagtaccttactgttttggttactattgccttgtagtataatttgaagtcaggcaatgcgatggctccagatttatttttcaagcttaggattgctttggctatttgggttcttttttggtttcatattaattttaggatgttttttctaagtctgtgaaaaatgatattggcattttaataggaactacactgaatctacagattgttttgggcagtgtggtaattttcacaatattgattcttccaatctatcagcaatgagatgtatttccatttgttcgtatcaactatgatttctttcagcagtgttttgtagttcttgtaaatatctttcaactccttgcttaaatatattcctaagtattatataatttttttggtagcaattgtaaaaggaattgagtccttgatttgattctcagcttgctcgttgttggtgcatagcagtgctactgatttgtgtacatttatcttgtaacctgagactttactgaattcattgatcaaatctaggagtcttttggatgtgtcattagggttttctatgtgaatgatcatatatcagtgaacagcgatggttacacttcctcttttccagtttgaatgccatttatttctgtctcttgcctgattgctccagccagaacttccagtagtatgttgaatagaagtggtgaaagctggcatcttcgtcttgttccagttcttagggggaatgctttcaacttttccccattcagtatgatattggctatgggtttgtcatatatgggtttgtcttattttgtggtatgttctttctatgcctagcttattgaggctttttatcataaagggatgttcattgtattgaattttttctgcgtctattgagatgatcatatggtttttgtttttaattctgtttatgtgatgaatcgcatttattgaattgcgtatattgaaccatccctccatccctgggatgaaacccacttaagcctggtgaattttttttatatgttgttagattcattttgctagcattttgttgaggatttttgtatctatgttcataaggaatattggcctgtgatttcctttttttgttatgtcctttcctggctttgatactggctttataggatgagtaaggatgattccttccttctgaatagtttgtaatagtttcaactattgagaaggagtaatattaataccagttcttctttgaatgtctggtagaatttgtgaatccatttggtcctggggctttttatttgttggcagattttaaaaattaccgattcaatctcagtgcttgtcattggtcttttcaggatttttatttcttcctgattcaagctaggggggttgtatgtttccagtaattcatccatttcctctagtttttccactttatttgtgtagaacttttcatagtagtcttgaaccatcttttgtatttccatggcgtcagatgtaatgccctattttcatttctaactgagcttatttgaatcttctctccttggttaatctagctagtgatctaccaattctgtttactttttcgaagaaccacctttttttttttttttctcttttagtcagagtctggctctgttgcccaggctggaatgcagtggcatgatctcagctcattgcaacctccggttcccaggttcaagccattctcgtgcctcagcctcctgagtagctgggattaccgatgtgtaccaccatgcctggctaatttttgaatttttagtatagacagggtttcaccatgttggccaggctggtttcgaactcctaacctcaagtgatccacccacctcagcctcctaaaatgctgggattataggcatgagccatcatgccctgcccaactttttgtttcactggtttttttttttttttttttttttttttttttttggttttcatttcattttgttctgttctgatttttgtatttcttttcttctgctagctttgggtttggtttgttcttggaaaactgcaaattttttaaaggaagcaagatttcatgaaggtgattaaagtgatattggggaactgttgaatcagtcattaatttaagaaatacttattgggtacctacttgggtgtccaaattgggtaccattttctaggtactaagtgttagagattaacgttgactattccagccttcatggacctgacatgccaaacttccataaaaccactggcaaatggatctggtgaagttgaaccagttaacaatcagaagagataatcaaaaatatgatgtgatagatgctttcagtggatttaaaacatttctgcaaattctttgacattcttcctacaaaaggtgaaacgtaatctttctctccttgaagatgggtggactttagaagtttgcttccaaagacgagagtttagcagaagtgatgctgtatgacttcacaagctaggtcataaaagtgaaatggcgtctgccttctctttcaggggcccacctgaagctgccatgctgggaagaccatgtggtgagatcagagagaaatggagaaagatgcttaaggagtgcttgttgttttgttccccagctgttggagtcttcccaggccagatgccagatgtatgagttaacaagccgacaggtgacaccgctcccagactgaccccatcagctgggacgagtggagaaagggtgagctattcccactgtgccctgctcaaactgcccatttttgagcaaaataggtgttattctaagccagtaagttttggggaaatttgtcacagagttattttccaataactggaaaaatgcctcaagtgagcatgataggaatatcaaaggattaatagagatccatgagaaaactgaagaaacctttgcatattttttgcagaaata

SEQ ID NO: 122 - DNA, 40914 bp, Homo sapiens
ctgttttgcagttcactttttccacttcacaataccttgggtttatctttctataccagtatattaaaactgatctcattattgctggtggacatgtgttgcactagacacacacctgacttcaggtcctgctccgtttggtattttatgatgtgtggttaatggtgtggagtttagatccattcaacctccgtcctgaatcctggatccatcacttattagctgcgtgatcctgggaaactgacttaatggctccatgcctcagtttcttcgcctgtaaagtggggttaatatcggtaacctacctcataggatgctaggaggactgagttaacgcatgtaacacatttacaacagagcctgcaacatatgctatatgagtgctagatgaggtttagctattcttttcacacctgaatactatttcataatatatttagtctattacttgacatataagttgtttgtgattcttttttttttttttttttgctaaaacaaacactgttgtgatcagtatacgtttacatatccctttgtgcacatgtggaagtgtttctgtagaataaatttcttggaatagcattagtgggcctgagggtgtggggattttcagtggtaacatcagttggtgggctctgcttgaccatgcttttcttggttcactcatatcagctcacccagtagcagctgttgggcatcctgccagtgtccttccgtcacatgtccagtggttggcagagctatgtggcagtaagcattcctctttgtcttcccagggcctggccctttgtcagcgttcattagactggatggcttggcttcctggtgatcctgatggagattctgaattgctactttatgtaaagcatggtgcccgggggagacatgcccagggccaagaaccttgatcagacccacatgcccagcgtaaggctgaggatgagattgtacaagtggtcaagagaatcaacatggtttcacccttgaatcagtccaggttcactaggggttccatgacatggcactttttaacttggcgatcatgtctttgctcagtgatatggggtaggtgtggatgtgatgattcacacgatgcagggatcgagtgcacctcccaaaaaacaggaagtgaaataaagcggcactgtgtattgctgctatgacatttctcttgatcttattaacacaggaggggctaagcaataaatgtgataatctcacttggggaatttggggttggttgtttatccaatccttgaacatttattgaacagttattttgtgtcagacacggttattgatgttggggtatggaactatggactaaggcataatttcaacctttgaaaactccacagaagctttaagaacccttgaggagacttaatttttcaagaacaatgggaatgaagatataatactgcaggtggggcctgagctccaccctggatgaggctgggggatgggtatgcatgggattattggggtcccttcacacagaaatgctcactggagaggctttcctgtacaaatattagaaatgtaaaattacatgttaatttctttttctgtgcttagaaaaggtgcaggatatataatttagaaaaatgtaaaggaaagttaaagatcacctataactgtctcatcccaatgcaaccattgtggaatgtacgtgtatttatttctttatcatgtttgtatgtaggtgcattttaaaagcaaaattaggaatcatacttcatattctgctttgtgacttgctttgtcactcaaactgcattagaagcatttcacaaatctttgaatattcctttactacatgatatgtaatggattatggtgttctgttatatattatagtcaagttagtcaattaatgatttgaaagggcacactggttaattattgttgtcttttctcctacgcctcctggttttggcttttattattttgtaaagatgcaggagaaatcttgagttctgagtggttatcccatcctttgtgaacactgctgtcaggcacacaaaacaacatgggctgggcatggtggcgggcgcctgcagtcgagaggctgaggcaagagaatctcttgaacctgggaagtggaggttgcagtgagccgagatcgtgccactgcattccagcctgggcgacaagagcaagactccatctcaaaaaacaaacaaacaaacacacacacacacacacacacacacacacacaaacccacaacatgattccagtttctatgctcattttagaatcctgcacctgaccaccacgcaaaaattcctctggataacttcatctgggccttccctccggtggaactggaagattgttttccaaactccactccttttccatttgtgttgtccactcaccgagtgccccttcttctttcatttttagacacctcggctgcagctgactccagaaacatattccctctttaagtctcggctccacaggttgcctcttctcctcatcatttctcgtttctcaccgtgaaaatctttgctttctctctttatggcttcctgagacccgaaaatagaggtaatttaaatttggtaattatgatgacaacaaaacaacttatgttgaaatgcagagtttaaaatgccagagtttcctactgttgagatctctctgccttcattctgtggataccgctgtgggagcttacctgagtctgccccagatcaggaggccaagcatgaggcgatgagaaacagcttctgcacagaggtggtgacttctacctcttgggggatgggggctggtcagccagagctaccacattcaggttcagccccttcagaccttcctaagctccaggtggaatctttgccttcccaccttctggaccctgcacggggagggtctcgggctgtagccacgaggcggcattaggcagctagaatcacagagtggggactgggggatggggtttcttctctgacagtggttaggtgagtcactctctgtgggctgctcatggcagcctcttcctccatccttgaagcgggccttccaaagacttcacctgctccgttataaaaggctttgagttctgcaagaggcagctgtgaatgtattagcatcctgctttctgtatgaacatcctgctttctggcacatggctaggccaccgcttaaacaaccggcgccaattcacagtgaaaaaagatctgctcaaagctggtttcagaaggaggacacgggaggcgtataatatcgagcccgtctcccgacggtgccatctgttctcattaaggcagccacagcgccgaaggaagggcctccaggtgcacacaaggaagcctgctcgccttgttatcctctcagagactttgccttttgttttgtttagttttgtttttgtctggcaggctcaaaaagacactgttctactttccgcagaagaatcactctcacattttaagaaattaagtctctgggaaaaaaaatattgtttgagagggcttgtaatggctccttgaccacatgctgtgcctgccaatttataacagagaaatattacagaagttgggatccaaggttggtgtgcacagccattgcttaaagagggatggatgcttcctggggacaatgatcttcccccgggccccccagcatttattcaatctggagagaattgtctgccaggctcccactcctacatcccaggaagagctgggcacattcatcatcttgtgtattcagaaagtgatgataattcctctgagagccaactgggctggggagggtgtgatcaaacttctgctggcaatcagactgcctttggggaggggagtctccattttgcaggtatgtctctactgccagtctgcagggaagcctacccagtcaacaatatgttaccatgaaaatctccttttgggggtatcttatatcacattatagggaaaggcagaggaaatatcaaaagcatttggccctgaatttaaaatgatctttccgtagatttttatagactttgttttacaagattggtgtaaggcctaaagcatgtcttcaggcctcttacatatcctccttctctctgggggtttccttcctgcctgccctcaacatcccttaccacacacctattctgtttctccccacatgcatggtttgtatattatgtcctgtcagtcaattcctactaaaatgttagctgatgttagggtattctcgtgggaagatatttgcattttaataggtggcttgaatatagaaaagcttcatcctaaagttgcaaaactttaggggaaaaacaggcaattttggatagagtgagggatgaggggatgagaagggggaatgtatgtgaggtcagagacattctcacatctcactgtgcatcatccatagaacttgcctttcttttctctcttttttttctttgtccctgacctcagagtaaatggcacctcacacactcttgtgggccagaaagaaagtctttcataggcagataggaaataagacagcagtttttccaagagtactgaaatgcaacaagtctactggtctgttgagttaaaaaatggtcagtttggttgttcttgttcatctagttcagctgattggttcggtagaagcaatagagtactgtactacagtatagtaaaactgttgcttcacagcagccatccctaaactttttggcaccagggactggtttcatggaagacgtttttttttccacagaaggggcgggagatggttttgggatgaaactgttccacctcagacaagatcatcagctattagcatattagattctcataaggagaacacaaccgaaatcccttgcatgagcaattcacaatagggcttgcacccctatgagaatctaatgcagctgctgatccgacaggaggcggagctcaggtggtaatgctgctcacttcctgctgtggggccctgttcctaactcataccagtttgtggaccaggggctggggacccctgatttacagcactaagttaccagtttccacgtcggtgggattggcggaaacttttcaagctctgtgtgatggagtaacacagggtagaaagagtacccttgtgaaaagcctggctgcatctgcccctttataaaggagacaattgaagctaatttatttttaaaacacaaaatgaaatttggtttgaaatttgaggaggagatacattgatgttgcctctgagaaggagtcaaagaccaataaaaggtggttctttctgttcccaaacccagaagccaataggggccacagaaggagcacagtgccacggtgaccatgctgcagcattgtcagatttagcaagaagaaatacagggtgcccagggaagtttgaatttctgatgaacactgaagactcttttagtatgtatgatttttggaacatatttatagaaaaaaattatttatctgaattcaaactgagtgtcctatatttttgtctggcaatctggtaccatactgcccctttgtaattccttgtatatgttgttaaagaataatttttctgaagggtaaaattataactcttgtatgattataaaatgaacatgtgtcaaagatttttttagttcactgattaatgagcgaatcagtaagatgtcacaactggttagaagaattcagaacacacacacacacacacacacacgcacgcacacacacaatcaggaaaggctgaactgaatttgttaatagttgcaaaactacccaaattcctaggacaataatcaactgcattccactgggcaaaattaatttgcgtttctatggacaagaatcatttgcattactctcagttttctacaacttgcagtagttgtaaaataggccaaagacaatgaacactacagaataaccaggaagggtgtgttagaacatccatgaatcatctttgcctatttcaaagcctttcacaatggaaacatttgacagtgttgtgctctctcctatctcgggcctttgcacctgatggttcctccacttttttagttgtcttgaacttacccttgactgtgggagatcaggatatgccactccaaaatatgcctctttggcatgaggattgttgagctgaccgcaaataaggagaaacacatgcaggaaagcaccctgctctttccctatttgcctcaaatcaggacatacatttatgaagacaaaagacatcccacctcctcttgctccccaggcaaacagagattaaccacttaagacaactttggatccttacatgcctggagagagcaccagaggaacctacattaacaagcttcaccaactagcctttatctgccaattatttgcctttccaaaagttgctgcccctaaggactcaaagttcttttcctttgtgtcacaaatctaaaaacgtactgttccttgttgaagatactatataaattggtattcaaagccacctcttcgaaagtttcttattctctgggtttctcccatgtatgtatgaaatatacgtacatcaaacaaacatctgtttgtttttctctcgttaacctttttttttttgtttgttacaggggactgttctaagaacttataagagttaagaaaaaaaattatcttcaaacatcattacctctggaaagctcttcctgacccacaaactaggttgggttcatgtgctacaagctctcacaggaccatgtttccttcattagggcatttatgtgagtttataattcatcctccttactgaggtttctaagtccttgcatgatctgacccctgcacccatcagcttccctttcaataactgtgctctggtcatacttctctcccttctgttcctcgaccataacaagttcttccctgccttaaggactttgcacctgttgttccctgtgcccggaatattttttctcttggctcttgcaaggcatgtttcttttcatccgtcaggtctcagtttgaatgtcagaaaagcctctcctgattatcttatctaaagatgctcccttctccaccctcactttctattctagtgattcctcagccttagcacagattagaatcacctggcaggcctgataaaacaaaggttgctggggcccatggccagagtttttgattcagcaggtttggaagcagcatgaagttctgtgttttaccaagttctcagttgatgctgatgctgccaggatgggcatcactcttggagaaacactgctctgagtgttttctttcaacacctgacattattttccccctttgctgatttgctttctgtctcccatagagctgaaagttccacacgagcagagatagtgatgctcctattttctgattcatctacggtactaagaacagtgccttatataaaagaagtttaatgattatttgatgaatgaatgaatgaaccattttctatttttttgttttgtattgtaacaaagggtttgcttaccaaattactgttgaactgaggtgccagaaccaagttatagagattggctttcatcactaagatatgtttgtggaagagtagttgtcttaatttaataaaccacaacaatatttgaccagtaacttgaataaagacaagtgcctactgcggcctacactttccattagcacgccttcctgcttagggtcaatgtcattaaccaacagttggttagatgacatcagggctttaggtgctattgacaggtctcaagaagatatgagttttgccaagactggtagctatgatgagcattcagaagacatatatggcaagtggggtgagggaagggcttgtgctttggctttaagcatgcctcatggatgaagcagcttgggtaaaggaagggagagagaggaagcagggagaatccttcctccaagctaggttataggcagtgctctcacatccctggtcttggcaggtcctaactccaggcctcctgatgcccatattctgttccaaagaccacagtccaggctttagggcatagcctcaggctctcctacccactaaccctctaggttctgtttgtttccccccttctactctcttctatgccattcctctaggcttttaccttgccatgtgacaggcttatgtggtaaactaatgggtcctaatgactgccacacacacacacacacacacacacacacacacacacacccctatatataaggccacatgcggtggttcacgcctgtaatcccagcactttgtgaggccgaggcgagtggattgcttgagctcaggagcttgagaccagcctgggcaacatagtgaatccctgtctctacaaaaaagttcaaaaattagccaggcatggcggcgctcacatgtagtcccagctacttgggagtctgaggcaggaggattgcttgagtccaggaggtcgaggctgtagtgagccatgttcatggcctgggtgacaaagtgagaccctgtctcaaaaaaatatttatatatccatatgtatctccttggggtgtgtgtgtgtagtgagacacaatatggcatagtgcctaaaagcatatactctgaagccaatcctatgtttgaatcttttttctgctaaatactgtgtgtccctgagaaagttgcttacccattctgttcttcatattacggggttaacaacagcactaaatcatagggttgttgtagatataaaagcgataataattgtaaagggtttagttcctgtgccttgtagctaccaggataataggcctaatagacagcaccctatggaaacagctttccattttaacaagggactttggtaaacacatgcgctgagtacaacactcttggaagatcagatatttgatggcattcagatgacagcatgtgagcagatgcctattctgtctgggtgttaggggacagagcactaggtgacttggctgctgtctctgatcttaaaaattgctcagaccctggcaattgaggataagacaataatagcaatgttgtattcaggagcgttgctttaaataatccttctccctaatagctttgcccctggcgtgtgacaggtgtttacattattaagtaaaagcatttaaacagcgacctccttggtataagggtgaaggagattaaaatccaagcagtgctccagctatttaaatcaatgagacttgtcagatctgtaacacatgagctacttagagggcgcaggcacctattgttttggagcttcgactaatatctcaatatgctccctccctccaagtctagccaggccctgggatgctcattaaaggctggtctgaccacggcctctttccctgtggaagcagcattaactaactcttggctagatgcgtggcaaatagttatgctattagggaggatcagagcttgagttgattcctgcttagagaaatgaccttgcacggaattccagcggttaagttccttagctaaccagaagcagggaccataaacattgtccccttcttccgctagggggtgctaaaccaggctgcttggctttgcccacagccatcctttcttgagttgtgttttcccagtctttagctatgacattgacaacttcaggtccacctgctgcattgaggaaccaagtttctgaaacttaaatctctctcttttttaaagcttcatgctctcatcatgaacaagaaacctctctcttccttagtaatcaaacttagatccttcatttgtgtcaacggaagggaagtctccacgtaagaagagcagctggaccttaaagatccaactcttattcctcaagatttattgtccccttggaggtctctagctaatttctgcaggtcctacaaggctggcttcagagggagctgattcattattaattctccagttctaagcaggcgaacaaggtgggggacacttgaaccttttaattccttggattcacagctgagccaggctggccacaaaaggaactgcacacaggcagggttacaaggcaaagtttacttttcttcaatttatggcctcatatgtctgcctgtctgactcatggaatgttgccaggtggagggttcctgatgccaagagaccgcttaagcctcatctgtggaagtgctggttcagcagagggtgaagcactttcttcctgggtggtctcaagttctcttttcctggtgattgactttgggaagttcttcctgtcacaggaaagccctacttctatccatagcagcaggtgaggccacagcctttagtctctacatgacttctttgtcaaaatgcaacatcaaagggttcacaaggaaaagagacccatgcaaataatccctggctgctcacagtgtcaggaccagcagcacaagtatcccctgggagcctattagaaatgcagaatctcaggcccccagcccttttgaaacagaatttgcattttaacaagctgcctagatagtttgtgtgcatgctgcagcttgggaaatagtgacagagcagagagacagccttttgtctacactgtctctttccaccacaagaaacaactgcattaaagcttggttcaaggaaaagtcctgtgatgtccctgtcctttggagctgaggaattaacatgggctctgtggggtttttctggaggatggcagaattgttggggatgcttgaacttctgaaaatgtttgaagggagaaggaatgtaacgaaccttctgctcagagcaaagcaatgagaccgcatcatgggttagagaccactgcacaagttgctttgcttatttctataattgtggtcagtacctctgccatctgccatcttcctacagcagtgtgtaggcctctaggaggctttagcaagatcagcacccaggtggaggcctcttagaagaaaaaaccctgtcaaagtgcaggggactcccagacaatgcaacattcatttaggccaatcaattctgtcaaaaattcattcgatgaaaatagtaccaagtgggtactcaactgcttagccaatttagtctccacagcaactctgaggctacaggtaaatacagtctcaggcacggaaggaaatctggtatttattcagagaggcagtagacatccctctgtccctgacttgctagctatgtgacccaaggcaagttacttaccttccccaaccagtagcttctccattttaaaatgggttatcagaaggtattgatcttctgggtgtgttgtaaatgctaagcttactattcattctaggccagccaggcatggtggctcatgcctgtaatcccagcactttgggaggcccaagcgaggggattgcttgagccctggagtttgagaccagcctaggaaacatagtgagacccagtcccagcaaaaaataaaaaaaaattagctgagtgtggtggtgcatgcttgtagtcacagctacttaggaggatgaaataggagaatcacttgagcccaagagctcaaggctgcagtaagccatgattgtgctatttcactccagcctgagtgacagagcaagactctgtttaaaaaaaaaaaagcaccctgtaatgctattactcacacgtaaagtcttctctataggaggtaagaatgatatttcaggagtgtaaagaatcttgatgtcaccttatggaaaggggatgaaaaagaagatgaaaaaggcttgttttcattttgccagagtcatggattccagttccaggtctgttttgcatcaccatagtcccaaacaagtgtaacatccagagcccaggaggaattctggatgaaatatcagccaggagcaggagtgtgacagctgtaggtcacttgggccataaagttagttaatggggaagacagatgaatgagtgtattgtggcaacatatcagaaggtctgaggcataaatagtgttggaaaataataagacagttggttcttgaggatcaacattgcagggaaggagaaatgcacaacaaaagaccatgttgtgtttttggatggtggccggggatgcacattcactgcccctcccctcttcaaccccactctccacatcccgtgacctggtgggatgccagtggtcatgagatcccatcacatacatgagtttcaagagtcactaacaagcttgtaaagaacaggtactttctaaggaatattcactcttgcagctgtattcctagggcttaaatagcacactgttttccactgacaaatgatttcgggtagggtgatctcatgaacttgtactaatggcagacacatttgaatttcttttttattctgaaagttaactgctgaaagcaaatgtgaaaaaaaaattatctccctctgttttatctctgggagaagataaaaatacgaggtgttttaatttggcagtgatctgggcgccttccgctggcctgtttttcttttgcgaagagctcccactttcaggactgccgtttctttgatcttatattctgtctgtgttcaggtacccctttgtgcctacctgaatcgtgtgtaacaaatcatcttaattacttcaggcctggcttcctcctccagttctcattttctgaaattcctgcgatggttaccaaataaatcagtgtggggctccagcccttggaaacagcacggaggcaccagcagcagccagaggaatttcaaagttagttaaaaggcacaggaggagtgagggaattgattgagaacctccctacccaccatgattttcagcctggagagttagtgctgcctgtactccaattccatgtgctttgcggggctcagccctcacacttttccccgtagaagagagaataattaatgccgtgaccccttggcgtggtagctagagccctgctgtcatcagcagtgccccaaacgcagtaggaacacgtaccgtatttcaaagcccaggcaggcagagaagggggaaggaactggtggcgcgctgtgacctgcgggagctccccagcgcagccagcaggaggcccaagctaggcggagagagggtcgtggggaagcgggccgctcccgggactcgtcactgggttggagctggcccgcttgagtggctccagttccaggaaggccgggtggcgtggggctgtgtttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccggggctgtgttttaagtggccgtttgtaagaagaacctctggcggagaggtgctgaggcaggctgggctgtgatcctgcacgccaggcggcctaaggggaggtaattgggaaccgcgagctgacactgcggaaaaaccaaacaccgcatattctcactcataggtgggaattgaacaatgagaacacatggacacaggaaggggaacatcacactctggggactgttgtggggtggggggaggggggagggatagatttaggagatatacctaatgttaaatgacgagttaatgggtgcagcacaccagctagcacatgtatacatatgtaactaacatgcacattgtgcacatgtaccctaaaacttaaagtataataataataataataataaaagaaattggtatttactaagaaaaaaagtgagagttctgtgtaggcctttgaaaaacacaaatctcttacttggggagacattccagtttaagtattatatttgacaaagtcctaaattatgtttaaactatggttatgaattttactaggaaaggaagaatttttatagcaaacaaattacaggaatttcaaagaccaaaaagaaaaaaaagaaaatgtaagccgcgaagccgcatcaacgccttcctgacagcggtgtctgttagtccacggcgtcccctcctaaggggagctgcgaaagacccattccggaggcatttcacggggccccgtaacacccgggcgagtgagctactgagaactgcatggctccttctggggccaggcggtcctaggagagccggctgggaggcggattgcttggacgtcccccgcccgcccccgcaactctgcgtgcggcgacgttgggaggtcccattagaagctccttgggcgggatctgtccaccatgccgcggcgcggagtgggagaggtttcggtctctgccaagggaagttgctgttgagtgcatcgccgtgaacacgacgcagcacatcctacagcccctgtggatatgtggatgctgtgggggcctgttgggtccgatagaagtttcaaaatcaaaatttttcaccatcctcgttgggtgatggtttgtagaatatttttgagggagtcttgtttgaggcggacagactcactcatctggtacactctttttcgagaacatggtgataaaataggttggctctaacgagaaggtgtcattccgccactccctttcccaagagggcttcgagggacactcaagtgaccaggatgtggcttatcctgtgatagccatctgagaacgttgttctctgttctttacttgcttctagtcagaaaacatggcctgtgttaggcaccctaggggataaagtgaattagacctggacctgactccagttttttcttttaaaactcactcgttttttcttcaaaaaataactcccccggtgtttctaatgtacagctgttttttgttgggaattactacattaaattatctctaagactcttctcatttcagatattttttggtttcctaattgtctaaaatttttaattatttttatttttattttttatttttttgcagacgtgaggcctccctatgtcgcccaggctagtctcgaactcctgggcttaagcgatcctgccacttcagcttcccaaagtgttgggattacaggcccgagtcactgtgccagcttcccctagttcttgagctcttctagggccactagattctctttcaccagcatgaagtaggatcattttagttagggtcaaattataaccttaaatcccaagtgacactgttcttttgtgaccactaacccctcaaaagatttttttttttctgatttcaaaacttctcctcctaaatcatcctgcaaattttactgaatctctactgcatgccagaggccccattctaggcattggggaaaaatacagtggtgcagacaaggagcctgttctcatggagcttacattctagaatcggatccagatcgttatgaatttcccctttattttgttttagtctctttcttaaactttcaactgtattcttctggttactcaatcccagttcatcctagggcagaaacataaattaagtccacttttatacttggtattacgcactgaatgtttttgtctctttcaaattcatatgttgaaatcgaatccctaatgtgatggtatttggaggtgaggcctttgggaggtaattaggtcatgaggaaagaaccctcatgaatggaattagtgccttttagaaagaggcaggagagctagctcatttgcttgccaccttgggaggatacaacacgaagttggcagtttgcaacctggaagagagtcctcgccagcacctgaccatgctggcaccctgatcgctgactttcagcctccagaaatatgggaaatttctgttctttataagtcacccagtctatactactttattatagcagctggaactaaggcacttgtttatccttcatctgtaggaaaatgctaaatcagataatggcaaccactgtgaactatattatctctagggtattatggggtctccatggcaggtgagagaaatatctttttataactaaaaatgttgagcactctaaccatttggatgcatattttttactctctgtatttaaaagttaagtctcattttctacttgtagttgacatctgttgttatcatttacttctctgttacatgcagggaggatacattccctagtcttccatttttgtgtgtagggactttttcagaaaacactcctagctccttggtttcctgtatcccccttttcccttcccctcaagggaggaagcgtgagctacttgatgggtgagtttgggtgcagtggctgagcatgtgactctcagcccctttctattttctctttgtcacctacaagtgtgcaaacagctttctatgctcttccatgccatacatgacaggagcaggcccccatgggagactgcatgtccgtgatggggcaggcccatctaattcaggaagcaagctcatttggttaacagacctaaagccatgttgtaaggctgacattttagggcttttctacttggctcctgggtctttctctcaactggctccaaactaaggtggggcattgagctttctcaaaccccaacagtacccatatctcaattccctagagaaccaccttctccagctcatagtaagtttgaattaagtgaaactgactctacacatgagacccacaattagctccccttggctacaagatttgtttaaggatgaacatagggcccagtcagatctaatgaatcacagtgatgttttcctcgttgaggaactcttaattttatctgctggacctaaaggagggtgtagggattacagccattgctgccatcccattacaacatgaagccaagagatgtagaaaaatgctcctgatgccattggttgagttcaggtttcagccacatctgaaatgtattctacccctggacttttcatcttaagtgaaacaataagttccctttgtgcttaagctagtttgggtccgtttcctactgctttcaatggtaaatggatcattctttatattattttcatattgttagttttaattgattttagatcaccacagatcacctcaattactcacgttagatcccaggagctagaagcgattttagaaagtgttaatagcaggaggatacttaggttttaatgttgagatgttaattattttaggcaccttttattacctatttactttgtctatttatttgttattttttggtaaacaaatctgatggggtacttgactatagtaagtctttaatcaaactttaacaatgcaatcagttcattttttccttttgattaactggagaagagcaactcttggtctttaaagtcatagtgatcattataaatatcctcaaggaaacaacaaactcttgaggaaagttatttcagttacatcccaacataagagactggaaattttttaccaagaattctggtagaggtgtaatataaccaggagggtgttgtggtttggatggacaatgagaagagagaagggccttctgggaatggggaagaaaatcagtggagttaagagtgaggcacattcatagctgctgaggtggagatggcaagctgtccaaaaaaaaaaaaaaaaaatgtgagctttccctttcatttttcatagcattgctgctgggaggtggctgctcatccagggactatatttttcaacactctttgcatctagatatggtcatgtgacttgttctcaccagtgaaatgtgagtggaagctacttctatgccaaggcttttaaaaagtagcctactttcctggtacgtttcctcctttcatccctacattgtccttctagtggttagtaggggcataaactcgaagcttggctttctgaatcactgaatgagagaaaacttgctttgattttttttttttttttcaagagacaggttcttgctgtgtcacccaggttggaatgcagtggggtgaccgtagcttactgcagcctcgtactcctgggctcaagtgatccttctgcctaggcctcccaaaggtgctaggattacaggcatgagctatcacgcccagactggactattttgtgaaagggaaataaagttctattgtgtttggccactgtattaggctgttcttacattgccataaagaaatacctgagactgggtaatttataagaaaagagatttaattggctcatggttctgcaggctgtacaggaagtatgacactggcatctgcttctggggaggcctcaggaagctttcccttgtggcaaaaggtgaagcaggagtaggcacttcacatagagaaagcaggagcaagccagaaagagagagaggcagggggagatgccacacacttttaaacaaccagatctcttgaaaactcactcactatcgcacggacagcactaagccatgagggatccacccccatgatccaaacacctcccaccaggccccaacgctagcagtggggattacatttcaacatgagatttgggcagggacaaatatccaaacaatatcggtcagtgtgcatttacagatatatttgatacaaaaagatctcagtgcttctcaaagtgcggtttccagaccaggaacatcagcctcgctggagacttgttagacatgaaaattctcaggccccactcttgacctactgaattagaatctcggatccagagatctgtgtatctgacaagccctccaggtggtcctaatgcacactcaagtttgaggaccactgccttgtgccgtccctaccaacttcatcaccgctctaactgatcagtagacatgggttgtttctctcctcagctttgccttttctggattaaactctcaaagtgtctaaagtttctgagcttcattagcaatggtgctgaaagttaaggataatgttgaaaaatcttgtgcatgagggaagacatttggtgagtttgaagttctgatgaattttgagaaaaagaaacatcctgaaagcttaagatagcttaaaaacaacttttgttcagttctaaatattagcactttttataaaagggcatatatcctacctagaacaggggtcacaacccagatgccccccaggtaatctaatccaggggagtgggccaagtggagggcagcgaacagtatgaagcaacagctgattgttaagagtatgggcccagtgacttcaggtctaaacattattaaaaagaactgcagatttgcattttcattttacatcttctggtttgtaaatgttaactcacattacaaaaaatccaaatccaagaaacaaaaccaaaaattttgtatgggttgaacatgcctgagtgtttaatttggcccctgggctgccagttttacaacctttgtctggaagtaccagggaagcagtcaggttgctaatgtctcctcttactcattaggaggcaaaataacttttacacaatcatgagctccaaaagggagacgaataagagctgtacaaagtagttgccaaggtaacatcttgctgatcagaaaggggcgacaattgggttttatgtagacgcagtgggagaatgaaacataatctttctctgtcttctttctgtttaagatcagtgtggaaatggatgtggacgcggtgctgctgcctgagattagcaggaagcaattcttttcccatttggagagaccccggtgagacctgatcaactagcaacatgcggaagtcacaccattaagtcttccaatttgctagcagcaaatcaatgaactctgatagctgctgccctaagctagcatccagggaactgtggacaagctatttgatacctgaattttagtgaaggaaagttaaattttttcttaaagcagggtgggagtggggttgtgtggggaagattatattaagcagtgagagaagacagatggagttttgtagaaagagagctggttgttttaaattgtatcttaaatttattgtagagctattggtaattagtgttttgttgttgtgtgtttataccaaccaattaataagaaaggcttttatttttatttcatcagttggagctgaactttattttttattataaatataaggcattattctagggcctggcaaacataggcagccactttttttttctggggaagattataccttggtatgttttcaccactgtgagatgaaaatttgagaacagtgagagacagatgcttgcctgaggagttttattttccctttaatccttatcaaatatccagatattacctatattgccttgatctgctgtctgaaggtgggtttctttgattgtttgaagagttctgggcactagaggtgcttactttgtgacgggagcaaataacaaggtgttgcccatgacatggtcaagcctcttcttcaattagccacctatcttgggcatgttttcatagagatatatctcatcccttttaataactgcagaatcttggacatttagaggtctccaaatattggttgtcatttatggtgtatcgtgtttttgttattataataacgttgcaataaataccctagcaacctatttttgcttacaagtagagtattttcgaagaacaaattccttcatgtgaaactgacgggtcaaaatataaaaggattaaagtttcaatagttagttaattgccttacaatggaattacaacaatttatacttccaccagtaattcatgaactctgccttaccacataatatttctaatctttcccaatctgatatggagaaacatgttttattattctatttttttttcactaaaagagagactttgaacacccctccatatgtttcaaaaacacttgtagaccaggtgtggtggctcactcctgtaattccagcactttgggaagtgagaagattgcttgagcccaggagttcgagaccaacttaggcaacaaatctagacaagggagaccttgtctctacgaaaaaatgaaaacattaactgggcatggtggtgtgtgctgtggtgctagctgctcaggaggctgaagatgggaggactgcttgagcctgggaagttgaggctgcagtgagctgtgtgatggcaccactgcactccagcctgggcaacagagtgagaccctgtctcaaaacaaaacaaaacaatacaaaacaaaacttttttttttcagtgaatgtttctttatagatttcaacttctaaaaattgttggcactttttttgattgactgaagagctcattatatattaagcaatgtagactttttttttttttttttgagacagggtctcgctccgtcgcccaggctggagtgcattggtgcgatctgggctcactgcaacctctgtctcccaggttcaagcaattctccccgctcagcctcctgagtacctgggattgcaggcacctaccatcatgcccggctaatttttgtatttttgtagagatagggttttaccatgttgttcaggctggtcttgaactcctgatctcagatgatctacccgccacggcttcccaaagtgctgggattacaggtgtgagccgccgcgcttggcccaatttagactttttaaaccaacttttgaaggttggtttttaaaaaataaatgactggatcatgttctaactactcatagtctcagccaaacacaattgcggaaggcctagccaaaggctctttgctcagtgaaagtcccatgaatctcaggcacagaggatagtctggaaagacctaacctgcacatgcaaatctattaagaaagatgaagtcttaggcttatatggagctaaataattgcatgtttaatgcaatgccagggtacaggtaatggtgattggagttggaggggtgatgtgtgtggtgggtgaggaagtcagggctgagtcctaggtgagatctataagagtgatgtttatttatgcatctgagggctgggactctcatgacaggatttattttcattctctttcaaggagagccatgctgccttgctgcttcttgctcgtgtacacagagcacttggtgtcttgcgaatcccctttgacgccggtgcctttccaggccagtgctttgcttgtgttcagaggatgcatgctcaggccctaccagactatcttagggatgaggggcaaattttgtttccaatgctctgtgtgggccctccatggcattttcttcattttgggttccatcctggcctaaagcttcccattaaagctaatggccattggagttaacccaaattttctcctttggtatttataaaaagcaacactgaaaaaccttgaaattaactaacaataaaaaaaccattgatcggttctttcctggagatggttctttcttctcaaataggccactttgcagactggaaatcaccccaatcctcaaatagcctaatatttttcacatgtgattccagcaaattgctgtttgcattaacaccttggtggggactcacttaagagctagatttgttagtgtatttactgacattttcacatgatgttttcagctgcctgaataattgtaatattcaccagaaaaaaatcaaagtaatgaaaggtgcctacaattattcatatctcaacattgtaagccttaatttcctgcctgaagtgtggtaaattactcatttttaaagtcatctctagccactgagagtttatggtgatgtatatagatgttttgtagattccaaaaaaaatcaatgactatgaatatcacagactgtcaaaacagctggtgtgattataaaataatgagatcaactaaagacatcagctctcagacatccaaattgtaagaggaaaatgaagacgaggaaggggaaagtgaattgcttaatgtcttgtaggtaccaaataatagagtcagtatctgccactgccatgctgaagattttgcactgttacttacacagattcattcccctttttgcaggctttgttgggccaggagatggttttgcagcagcagaagactatgaactgggctttgggagataggatctctggttgtattctggctatccacactctgaaagaggaccgtgacaggtattgtcattattggtggctgagtttctaggttagccaacctatggcagattgggaagactttataatgcgaataaacagaagaaagtttacttgatcaaaaaagattttttctcctggtggaaactgcaattattagggcaactctttaagtgtccatcaatattaggatgcattttaacaggttaagtactcttctaactgggatgaatagggcattgacaggaaaattaacacacaagttcttatatcctccttcccttatatctggtcgcataacctaatgtgaattttttatgcctttaagtgctgatattatggaaaaaccttctaaaactggataaatatcattttccaagactcagatcaaatatcacatctttctctgattttcttgatccttcctgccaaaaagaaatagcaccatatatgcattagtataatctatttgtaattaacataaaatttctcattttacagagaatttgagtatcctaccaatatacctacaaaaggatgaaagaagatttggagtcaagggaaaacaagggcaataaaatagaagcttaccacctgctctcatacagttgctagaagaggactgcatatttggttctaagtttctggaagataaagccaaaatagaaacacaactcattataaaattttggtgtatccataaaataaaaacaaatgacctgtttgagaaaactctttctgagtttgagctctaaaaggaacttctctatggaatccttagaatatgagaaggctgtgatataggggagaaaccccttgacattcctatattgggtttaggtctaatttcactcagtagtttttaaatgttactccttgtagacagatgatgagacgccaaagtacagctgagtgaaagcggttcctttgaaaactaaaggctgtaaaaacaaggctgtggatcatgttgtttcagttctttatagattttttaaactgaattttgcatctgtgtacatgaagaataaattgtagaatatctaaggaaatggatgggctgcttatcttttagaacctccataaattatttattgtaagtatgtttgataaggattgtacagctgagagttcaaggttgcatttttttccccagcaagaaccaaaagtgcagataacatgcagccaattaaggacaaatctgtatggtttgtcaatcaatctgtcaggatgtccctgaattgtagcacttatcacttggtattatagacatctgtgtccctggcataactgcatcctcttcaagggcaggaattgcttcttttccatttttgcactctagcatccagcattatgtttgagacctagcatctatatgagagactttgttgaacggaatcaattgaaaggcttcccattatcatgcagtactacttgacaaagatcagaaccctgagcaatcaagggcaggaaacataggctagctgagctttgaaggaagtgaaaagaaaaagaggcagcaaagatgggaacatggaggacagtctgagaaaacaagctcagggttgaagggggtgttccagtgaaggggtgatgagtgggacctcacacatggagcagataacattggtgcatcagttgatttaaatgagcagaatggaaagtgtctaaaagagagatgtggaaatgagtagaaacatccctttcctgttgggccagctattgtctatggttagtccttttcccatccttatttcctctcctctgaattgcaagttgctggaaacatgagaagtgcattccttgctcccttggttactgggcttcagttagcatttgccaatgagggtgagcactcatgggagactggaaagtggtagaaagggaaagccattcagctggctgtgacagtggcagcagcgggcagtaccgtgggctccaacagcattggtggtggctccagcatcatcactgggagcttgggctcctgggttcctgctcagcagctatggtcagtaccttctgagatggcctcctctgatcctcacctcttggtattcatggccttgtgaaatcccctttgcttgagtaacttgctgccaaccaatagaatatggcaatgttgagggttgctacctttctgactaggttgcaaatgattgtgacttctgtcttgctggcaggctctctctatttgccttttggtttgtgtgctctgaggatgcaaactgccatgttcgtgagacctgcatggcgaggaattgagggcagactctgtccaacagccagtgagaaactgaggtccaacagcctacacggagctgaatcttaccaataactacatgaacttgaaagtgtatccttcccttcagatgagtgtagcctgagtgacaccttaactgaagcctatgagaggccctgaagcagaggaaggacccagctagctcacacctagatttctgatgcatagaaactgtgagatagcatgtgttattttaagccagttttgagatgatttgttatacaatagcaatagataacaaatatgatggcagagctctgttccaacagcagtagcaagcgtgtgcttgccgactctggatcactccacattcacctctttgcttctacagctatgggacaatagcagcagcgtcctacagttgccaatttctaggtaatgccattttccacttgacctgtgttttcaaaacctttgtcaccattttcctatattaaattccttcataataacagaagagtggctaacatatgcacacaactatttttcttgatagggagataaagagagcattgctgtatattaaatgtagttatgtctttttagatgtttaagaaaatgaaatgcaccttttttcaagtgaataaatgtttgcctctctgtagttcttggtttttgggagaaggtcaacttcaaaagatagagtcattggcaccttctttctgtagtgtgcttgactgtatatccctgcccacccacaggcagcaaaggcaatgcatgagggattttgaaggacacacagtagctgcttctgttttcatgtgggagtccaaggaagtataaatgctgcatgctccctgtaactagaataaaatattatggtgtgtgtataagggcaaactcctaactcagcaggtgaacaaccatatcgacttcattccccctggagactgaaattagaaagaaacctacatatcaggccacagcagcccttgatgaagctcaaaagagaggtggcaaactcacagctacacagcaaaaaccaagtcagaggcagcaaaagctgtagtttgagaacaaagggaaagaaaaagactagtcaaagaggccatatctacccacccacagaaaacccagagaagaaaataagttacatttctcccactggaaggcttgggggaggagacattcaggaaagccacaggggcagaaaattagatagtttatctgaaaaaggaaaaatgaactaaagtgtgcttttgatagatggctggaagtgagcacaaaggcaaaacaccaacatacacttggcgtctgaagaatgtcttttatccaaagatcttagagcagtttgagtgtattaatttacttgtgagacagttaaattattattcgttcatttttatgtggcattttattctaaaatttgctaaggattttataactcaagtacattggttattccccaaacagccctgtagatgcagtgtggccattactgtatgacacatgtggacactgagcctcagagatgtcaggaaacagagagaatcagaggaggctggaagatcagcgatgactgtatgaacactgaataaggaatggggaactctgtggagacaactcagtcttttctatggctatttcttcatggcttctgtggtagatagaatgatggtcctccaaagatgtccacatcctaactcgtggaacctgtggatatgttatctaatatggtggaaaggactttgcagatatataagttaagaatattgagaggggaaaattctcctgggttatctgggtgggcccaatgtaatcacaaagatgtaagggagagagggagacatgagagtcagagaaggagatgtgatgatgggcagggattgcaatgatgtggggccatgagccaaggaatgtgggaagggcaatggaacacgttcttcatctaaaactggaaagggtaaggttacatcttctcctctagagtttcttgacaacccatcttagacttctgacttatagctgcaagatcataagtttgtgatgttttaatccactaagtttgtggtaatttgttatagaagccacagaaaactcatacagcatctttgaggagtggggggctgcactgtaaacctaaaattttattttttgagttatttgggtaacacaattttagaggattttttttaagaactgtttggatatgtattaataacaattatgggtttagtggcttgaaggaaaaatacagtggcagtaacaacagcaatagtaatgggttatagttattaaggttgtgtgtgccaagtgctgggtaggggtgtggatgttccttctctctcattttctaaaacaattatatgggataattaccttcattttacagaggaggaaactgagtctgagagagccatgcaattagtggtggagctggcatttgcacacaagcatatctgactcttgactacgacctgaagtggtttttctatatacttaattcattgatgggaaaggacaagtcatgtgtgaaagcagggacatgagcaggtgatgacagaaagttgagacaggcctccggtggcactggggatgtgtattgactctgcctcagccatgacagaggtgagggacactgtctcctttccgtcttttctcttctacccatgccagccagccacttttataaagtacccaccatcggtgggcagcacttttccccattctttcttgccaagtgtgactcttctcttgaaagaaagcacacaatttcacactgtataatgagtgtctttcctgccagaaacaacaaggatggagaggctgtggggctactttagctgccataagttagaagggggtcaagtgagtgggatcaggaggatgtaagatgagaagaccaaaattttaatgagatgctgctggaatcagcataaccaagtatggtatcagagctgaaataacttaaaatattacaagtgccattgtaaaatgcaatactccctacttcctagggtggctgtgagaatggagttaataaatgcagagtgctttggatggtgctatagaagtgtagctgttactccactgcacccatcccgcaactactcctgctgctaccagcgccctgttattatcgccactgccaggattactaccactatcacaattactcttactactgccattgactacctttgctaccatcacattatttcaactgctaccattgctgctgctattactactactgtaccgttgctatgacaattattaccattactactgttactgtcaatctgtaggcatagaaagtgcttctgttgtaataaataggccaacagacttctgtaccttcaacaagggtggctagagcacatcctcaggtcatcctgggattgcctggcaatagttcccagtctgattcttttctttgggctgttggcattcttttgctactgctcaggtttggacaaagtggctgtcattgccccaagctctctgaggtaggaactctgcctgcttcactaattcttctcagtgacaaatgctcctcaaatctattccccagtggccatttgaagtggacaaacaactccacagccatgaaatatcatgttttaaatagaaggcactgtgtcaaatgccaccagcaactcagccttggagctgctgatctcagactgattcagattcttggagataatcataagaactaacctttaacaagtgcttattgtgtcttatcaggtgctgttctaggcacttaacaaagatttaattatttgactctccaaaaaagtcttcgaaatagttactgctatgaattatgttttacaaatgagaaaactgagacacagagaagttaagacatttgctcaagataatacagcaaatgggaaagctgggatttgaacacattcagtctaactccagagatgctgctgctggccaatgtaaaccaacacattggcttcacagtacacagcattttagtcagagaagatcaaggcctagcaaagacagctgcccatagttggtgctcaataaatgctagactagtgaaggaatgaatcaacaatgaatggaagaatgagagtaacatggtgtttgtgtgagtgaagaaagaaggcagtatgagtattctaaaccaaacagtcaactcagttattgtcaagaacagattgaaaaggaagtcaaggtagtcaagaaggaattgataaggaattatgcatagagacctggtttgctggaggatctagggaattgtctctaaggattttccagggcctggggaagacagttcagtggagggaggtgggaggacttctagaacacttggccttttcttagaccaggggtccctgaacccctgggccatggactggtactggtcagtggcttgttaggaactgggcaggacagcaggaggtgaatggaaggtgagcgagagaagctacgtccatgtttacagccacttgccatcacttgcattactgcctgagcgccacctcctgtcagatcagcggtagcattagattctcataggaacatgaaccctattgtgaactaggttgtgtgctcctcatgagaatctaatgcctgatgatctgaggtggggctgaggtgatgatgctagcgctggggagtggctgcaaatacagataaacattagcagagagggttgactgcccacaataaatcagttgcttgcagactcatatcaaaaccctatcaatgtgtggcaaatgaccagccgcatctggtggcaggctttatagtggcaagtgagttgaaaaaaagtgcacaataaatgtaatgtgcttgagtcatctcaaacccaccataccccttacctctttcctgtggaaaaattgtcttccatgaaactggcccctggtgccaaaaagttggtgactgctgccttagacctttctggtgtacctcatgatatagttccagtctctacaaccagtcagcacctttctctgatgcagagtgatttgtttgcttcttttagttattaaaaattgtgtgtcataggattttagtgctagaaatctctctagaggtcaagccccctcatttcactgattaggatactgagtcccaaaggggttacgggtcttgacaaggccacaacaatagggatttgctaggccccaacatgcacctttaattctgattcattcatttgttcaccccaatctggtgacagtctcttgtgttgtcttgaatgtcttggtatttcagataaaaagcctggcttaagtttttgatcatagccattctaacaggcatgtcatgaaaaaagacaagagatgaatgtggacgaggtcgtagagaaagggagcccctacacactgttggtggggatgtaaaaggtgcggccgctataggaaacagtatggagtttcctcaaaaaattaaaaatagaactgccgtatgatccagcaattcctctgctgggtctatacctgaaggaaatgacatcagtatgttgaagaggtatccgcactccagtgttcactgcagcatgattcacaatagccaagatatgcgatcaccctaaatgtccatcagtggatgaatggataaagaaaatgtgatattgtacaaactggaatactattaagccttaaaaagaagaaagttctgtcatttgcaacaacacgaatgaatctggaggatattacgctacatgaaataagccaggcatagaaagacaaacactgcatgatctcactcatatgtgacatctcaaaaaatcgacctcacagaagcagggaatagaatggtcattgccaggggctgaggggctggggtggaaataggaagatgtcagtcaaaaagtgcgaaggttcagcagctagaaaatgaatcatttctggagactagtgtacaacatggtgactaccgttaatatgcattgcatacttgaaaattgctaagggagtagatcttaaacattctcactacaaaaaataataagtatgtgaggtgatgaatatgctaattagcttgattgtggtacaatgtatacatatatcaaaacatggtgttgtgtgccttgaatacatacaatttttatttgtcaattatactttaatgaggtagggaaagaaaaaaaagaagggagagaaagagagaaatctaaaattaaaaaaaaatggaaaaaaggtcggcttgggccagggccataggcaaactttgtttttcataacactggatatgacaatgatctaattagctaattaatttgcactgtattcttttgctacaacgtcatataactttcgtctttaagatggacaaactaaggtaacttgcattttccttcatttaatatttaaaacctctttataagaaaaagcagccccaaagaattgtttgtactcatattaatatcacttaattaaaaacatttttcagcattgtaacaaatagaacaaccttagctgtaatatatgttcttcttgcagcaaagttttgcctctttacaccatcaataaatgtgagcattataagattataataaattatttagattatacttacttttaatcattattttctcagtaaattctaaaattcaatgcaaaaggaactaagatgacttagttacatatgtttcacactggactcattatagctttctgggagtgactatgttactttattaaaaatttcttttacctttaataagggagaaagacagagaccattatgtcatctagtttctcattctgtcctgcttagcatataacttcttcattattgtactctccatagttcctcctgaatagaaagtatcaaatctcctcttcacgtcttcactgtaattatcattcttatctgacataaaacagtgattaaagtaacccatctctagaactaatttgatatataacaataaaaacttcttgacaaatttcaatgtcatctgggtggtttagatatgtacacactctgttattgattttccctcctttgataatacagcactacttatttttaggttttctctaactcaaaaggaaaaaaatgctgtttttattcttactctcactaaacgcttttatttaaagtgtaagtgaccatttggtagaagtcacatagattgtgcaatattttaatccaagtgagcaatctggttctaataccttttgcttgtgggtggggacacccatttttgctacttcaatggcctacaattcaacctgatcccaagacttttgctattcatctctcctcccgcatttagctgttccgttattccattgttatattattgtgggatttatatgaattagcacagaaaatggaactcaagtgttcagatttaagcctctttctttctttgtagagcccaaggcagagaaaaatgtagatccaggaatctttttcttttctttgtgacattactaaggagatgctatttttccattttataagtggaaatattaaggcagagccaacttcggggacttgcttcaggttatatagtcaatctgggttgtagtcaagaggaacaaaacataaaaataaaagttggtgaaataaagaaactgatggccccaaacagtattagctgaaattgctagtataaaagaactcaaggaaagtttaagtaaaattgtggttgattgcactttaataggaacttaaggacatttaggagttgtttctaagcttgtgaggccttgattatgaaggaagttgcaactatttcctacaaaatgcctcttggtactattgtcagacagttggtctaagccagtgtggcaattcttactttattatgtttccccaagccccttttggtgttttatctagtggagcattcatctgagacaaacagcttatgtactctttctcgccaagcagaagctagaatgaatgagaaaatcgcataagaaaatctgtcctcctgatttcccacatgaaactggcttggagagtcactgttcccttgacaggagccttctgcaggctccaccaatacttgtcaaccgcctggcttgttgtgggggtggcggcagctgctacttctgcttcttcaaaataaaaaccgcaaataagtatatttagaaagtgtgtccatcctagttcatcttcccagctgttttcctggtggaattagattagcagtgtaagtgaaatcttttctgaacctcatcgaaatccagacttgcctagtaaatggcttcattcattattttcatttacctacattctaatttagtttttcttatttttatgaacagttactatataccaagtactgtgcaaaaggctttacagacaatatctcatttaatctcaaaacagccttacaaagtgggtgttaccacccgtatatggcaacaccaggtttaagtgactcacctaggtcactcagcagggtgtcataatctagtctggctgattccagggcctatgttccaggatacgccatggccccagctgaggactttattaaatagtctatggtcttgcagagtcaaacctattctctggttcttaaagatggaccacttgaaggcaggtccttgaagagccatgggcactgacagtttttgctcactagggattggtggtaatgtctcaggttttctgtgagttcaattttcatgagcccagtttcgcttcagtaagtattgatctggccctagaactcatggtttgtgtgtgtgtgcgtgtgtgtgagtgtgtgtgcgtgtgtgtatgcacacctgtgttctctggcttggagagttagcaattactgatgatcagggtttccttaatctctcttaggaagacttcttagtctttatttatttggaggtcaaattgtgtacagtatttctcccagagattccttcttaattcaacaaagggaatgttttagaagaaaacaaagggaaaaacaatcaacaccaatccccaaacacccatatacatgcacatgaagaaaatgtgcaacatagctagagatgcattatcagagcacagattaattatttgaagcaaggtagactattagtttctgttagccttgctgggacttatttctgagcttctaattctagatatgagccccatgattacctcctttggccctgcttaggccctcttccatctctacagtcactctggttcctgggcaagtcttccttaatgcgcaaggcatttctcactgtggttccatgactcctgtctggaatacgggctatctggtctacttgcagtctgagtgacgcttaacttctttactcattggcataaggagtggctgagtttgctttctcttgaggttctggagtcccaatagttgaagaattcatcctcggagactcttcgctccagtccagcttcctgccatgcagcaaaagcctgcatttcttctagtttcaagcctttgcatcacctgttagatttcttactatgttcctccttcagccttaaaaggtatctcttgtgctcatttgtaggactggagttctaaaagaattctgccctggtaccaatcattccacctccctagttactctatgggacttactccagttgaaaccagtagaaaaatacctcacacatacagtggcaatagtaaacatacaagagaaagaatattcattttctatatgcctttctcctattttataagatataaaataagaaccttgaatgacaatgagcttttgggggaacatactttattcccacaggatgttccctgttctgggcctctcacattcatggacatctcatacatatgggcatcaggtacgatactttcagttgcaagtaacagagatcaactctgactctgaagctggtatagtggaggctgggagatcatgtctagaaaatgaacatgaaccagagagtcaagaaacacaagaatctggccacaccactgctgtggtcatgctgatgccatgaatgcatttaaacaagactttgtctttgcttcaccttctgcaaagtcagatgagtgagaacatctgataggcagggcttgatatgtgtcagccttgcctatcaggtcatgaagacaggacggatcacgactctttggcttcctctgtgggaacctgtgggaagcctgtatgcccaggggggtttgtgttcctcaaaaccaggctggatgtggtggctcacatctgtaatcccagcactttgggaagctgaggtggaactcctggctcacttgagtccaggagctcaagaccagcctgtgcaacatagtgagaccctgtcttaaaaaaaaaaaaaaattagttaggtgtattagtgcttgcctgtggtcccggatacttgggaaagtggaaagattgcttgagcctgggagtttgaggccacagtaagctgtgcttgtgccactgccctttagcctgggctacagagctagaccctatttcaaaacaaacaaacaaacaaacaaacaaacaagaaagggggcaggttgactgctagactgccatagaaaaatccaatggccagttcaatgaattttcctcagtatttaaaaaaaaaatctcaattagtttttcttaacactattctcaatctagccctccctttcgttcttttcaaaatatataccttttaggttagcagttgccttaatactgttaacattttataccgagaccacagagttgctgctaaagtgtatagtcagaattgaattcagaagattgatgttctcttcaggctgcagaccatctgattactggatctcctctgggcaatgaagctgcctcctttttctcctctctcgaccgtcaagcttgcaccacagtaataatatttaataagagcagcagtgaaactatgtcattgcttctctgatggtcagagtggaacacagctccaaataaaacaggagtgattgtcatacagataatacagttgttttagttctttcaccttgagaaaggatgaggtagcttgaatgctgattgatgcttgtctctcatagtctactggaatatacattaggtatttgggtgaaactgtgagttgcacttgatcatgtattaaacattttgcaagctatttgctgctgtatattctgactggatcttgaaaaacacccttgctatttcaggataaaagaaataaagcttttgtggttttggctgctctacctaagtcaggagactctttttctgagaatatttaaacattttgccacattcatctgtctttttctcacactatcccagaataactgaagatatgtaatacagggaaaccttattaaaaaaaaaacttctacctaaagaaatctgaatttatataacagaaaaattgtggagagattatttatattaaaaaagattttcttttttttttcacaaaagtgttcacgttaggctttctttaaatagcaaagtcccttactggattaaaatatgactgaatttctctttcagaaatgcatctactgtttaaaacaagccatgttttatgtcatccaattttataactgaagaactgagaataattcagaaaaaagtcacagaaactttgtgtggatctaggaagataattcagggctaacgatcactcctatactctcctagaaagagagtagcttccatggaaatgaactgagacccttccttcctagaacctggaagattcctgcattaagtcacgtcatagtcataaggtcattcaactattgatgacattttctaactacgtgtggataagcttttatgttgatggttcagattttctgctttggaaaaaaggaattttagtgtatttgacttctaacaataaaatatatgcaaagaaaagtctgtcattagattccctagtttgtaatttaggggaagatatttcacttcaacctttctgggccttagtttcttcacttataaaatgaaggttttgaactagataatctctgagtccttttatagctcccaaacttgcttcttagttgtttcttttatttttaaataagagtaacacaaatcctgtaattctgagagtctagatcacagactgatctcatctatgctttatcttttcattttataaatgctcttggtgtttgtaaagcttatgtccagacttgaagccagttagaggcctaaagaacagtgcaaaagaatgttagatatacctggatactcttcctcttctttttaaaaaaatttaatgaggaacaaaatcttagattgttacacagcagaggtgcaataaagaataaaaatgcaagggaggaaaagtcacaaagccaatgaacaaaaattcccctgtggtgagggtcttaaagcaggtgtagtggtttatcattttactgaatgagctctgggtctggtgggttaaaacaagatcctctggttaagtgggacaatgaaacatagatggggaagcaatagccctgctaaagactgaatatttatatcccctcaagttcatatgttaaaatctaatctccaatgtggtggtatttggaggtagggcctttgggagtgattaggtcatgaggatggagccctcatgaatgagattagtgccctaccaaccagggagctcacctaaacatctgtgtccagagcttttattggggcttcattatataggcatgattgattgaagtattggccaaaatattgaatacaatctccagccctcctccttataggtcaggctaatatcacatggctcaaagcctcaattctctaatcacatgattggtctttctggcatgaccagcctccatcctgagtaatctctttggcttaagctattataggcgtcagaagtcacctcattagcataaaccttcagggcccaccatgaataacaaagacactcatgtcactctggaaattctaaggatttagaggattccttctaggaaccagggaatagaaccaaccaaactctttattatgtaacatattgcttttggcttttgtctgttctgtagcttttgtaaggaatatgactagcaagttgttaaatctctctctttctctgacgagacttcaagactgaattgaagtcattaattggtttagagtcagagtagcagaatggttaacagtgtgggtttggagatcaggctgcttgggttaatcttggtttcacatcttactagcttggtggtcctggacaagtttcttaacctctctaagcctcagtttcctcttcagtaaaatgataggttatcatgatgaattaagctaatgtctgtaatgtgcttagcatggtgctgggcacacagaagcagtcaaggtttgctactaacgattgcgttaggattttagaaaagctgttgactatttctaaatgtttactttctaaaggtggcatgccctaaatatattcaggccagtggttgtatcagatttttagtttttaggcactgattctttgttaaaggaaatctttcacaaaatccgaatctagaaagccgatgaaatctatattaagctgaactcctctagtcaaagagggtcaggcacatctagccaccttttaatctctggggaattaagatctgtttgaggaagttagtttgaaaactggtctagaccacaaccagtcacctcaccttcaacctcccctccaccagctcccatagcagggttaacagagcaaatctgtgtgtgtcaaagtcaggctataattttcttatttcagtttctccatgagcaaaatggggaagataatgccagctttgttgtggcagtgaattagataatgtctgtaaactattttgagtctttagagatcagttttagggacaaagacctttgccatctttaatttttagcttactttaaaaataagatatcctaaacacaccacttaaaaatgggtcaaacagtcgttttgtctattcttgggataaggtggaagcaatgatttaatcaccacagaagaaatgtgctctgattaattgggaagaaagattttaaaattagagttattcagaaagcctgtcaggagaccaggaagagaggaaaggatgtgtgtcaacacctacagaaagctgtctgtgaagctgggttataacctgatacttctggtcttccctgtaactaaatgtcctttgctgaggcctgaggcagacccttactctgggtttcctgttcctgtatgactagtttcagtcaggctttacgtagtcattctgccctgcagagcaatcacaggaggtaagaaggcatggtcgttaatagcatgggctatgctgttggacttgaatttggtcttgtttctatcacattctgtaatttagttgaaaaatggaaataacacctatctcaagggtttgttgcaaagactacatgagattatacatgcacagcgcttagtacagtgtctgatacatagtaaatgttcttttttttttttttttttttttttttattatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccacctcagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgagtaaatgttctttagcagctgtcattatcattttagagacagagtcttgctggcattatcttccccattttgctcatggagaaactgaaataagaaaattatagtctgactttgacaagcacagatttgctctgttaaccctgctatgggagctggtggagggaaggttggaggtgaggtgattggctgtggtctagaccagttttcaaactaacttcctcaaacagatcttaataggtggctagatgtgcctgaccttctttgactgcaatccaggctggagtgcagtggcgtgatcataactcactgcagcatccaactcctgggctcaagggatcctcccactactgcctcccaagtagctgggagtacaggcatgcaccactatacctgacttatcttttaaaacacttttttttttttttttttttttgtagagacagggtctcactttatttcctaggctggtcttgaactcttggccgcaagaaatcctcccacctaggcctcccaatgtgctgggattgcaggcatgagccaccgtgcctagccccatcagcagttatttaaaacatcattggtatttattatcattattaattatgtttgctatcatggatactaaatatctgcccatctagatctattaccctgatctaaaattctaagttctaacattaccaaaaagaacttgagaagaaatgcctttccatagccagaaaacttgaagctgaagggattttgatttgctcaaaggtattctgtgagtcctttttatctgtcttcatgatctggaccctatagctataagctttcatgtggggaatagtgcttcaaaatgaagtgaccatttacaatatgagtccccagtgcaatatccctccttgggtaatattaggtactatcttggctcatttcatcaatatcttttttgactagtcttttactgatt

SEQ ID NO: 123 - DNA, 21529 bp, Homo sapiens
gcctaagatcaaccacaaagtgacaaaatcaaatcacgatataaattaaatgatcccattatcataaaaatggatataagtacatacacatacatagaaatagcaaaggtatacccataacaaaagtcaaggatacagtaattgtctctgaaatgtggggcaaaacagggaaaagagggtctttcacattttttgttttttattttagataagaggctcactctgtcacccagtgaaacacatgttgcccaggctggcctcaaactcctggcctcaagtgatcctcctacctcggccttcccaagtattgagattataagcgtgagccccctgcacccagccccttttactttttaagttatgccctcctgtgctctttatttttaccagaatgtattacattcataactttttatgtgacatcttctaatcttccacatactgtaaaaggcttaacacacataatgagtactcagttttgttttggagacagggtttcagctctgtcacccaggctggagtgcaacagcacaatcttgactcaatgcaacctccacctcctgggctcaagggatcctcccacctcagcctctgagtaggtaggactacaggttcgcaccaccaagcccagctaatttttgtgggatttttttaggggtagggtttcaccatgttgcccaggctggtctccaactcctgagctcaagcgatccacccaccttggcttctcaaagtgctgggatttcaggcgctcaccaccgcacccagccagtactcgcttttataaacacgcaaaacacctcctacaccacttaaagctgctattatatttctacaacctaacacattctgaaacactggataaataaatatctaaataattattagtttttggtctagtccagtttgagaactgaaagagattctctggctcaaatagcagatcaaacatatacatttatctctcttcagcaaaagaccattttaaacagtagtttaaaaaaatttaaagccaaattattattaaaaaacaaagtaaaattaatggaaagagatctcttctaaagtaaagaaactggagtctgggagagaggaaactagtgaacctagcatgggagttggcactttggggtaaaacaatggactcttgaatgtcagaatacaaaagactaattaacagcttaaccctaaagtaaagcctgcctgccaaccattaattcccaccaagagctcattgtgaacccttctactaaatcttaaagctgagtgatatccaaggtcagcagatatttggttaaaagcctacaatataaatgagactaagataacaacaaaaattacaatagagttgacaggtaagagggagggcaacaaaatttaaaaaaaaaataaaccttattaacattttcagagactcaagaagattattaatccataaaatgagaaaagatattggcgggggaggaaatgaaggagaaatctcaaacatttaaaatataacttccaatataaaattaaaaggtccaagaataaataaagtagaagagatggccagaccaaaaaaaaacaaacaaacaaacagacaaaaatattggggaggattaattcagtaagtctaataatccaactaaaagcagctatagagaaaacaaagaaaagatcactagaggccgggcgtgggggttcacgcctgtaatcccagcactttgggaggccgagatgggcggatcacgaggtcaggagatcaaaaccatcctggctaacaaacacggtgaaaccccctctctactaaaaatacaaaaacttagccaggtgtggtagcaggtgcctgtagtcccagttacctgggaggctgaagaagaatagcttgaacccaggaggcagaggttgcaatgtgccaagatggtaccactgcactccagcctgggcaacagagcaagactccgtctcaaaaaaataaaaaaaagaaagatcactaaagccgtaacatgaaaactttcaagaagtgaagcacataaagtattttgcttattgtaatggagaagaaaacacatctggacatctttgagaaatttcagtttaatgaggataaaagaaggctctaaagggatggatgaaaatatgaaacacatcacccacaaaggaagaagaatcacacagtatccgacttttcctcaccaacaacaatggacatagaagacactggagcaatcccttcaaaactctgagggaaaacaattttcagcttaattgcacttgaataaaataataccagtcaactgtaagggctaatgaggacttttacagataagcaaggattcaaaactttatttctcacatattctttcttagctatttatgtgggtgtactgcattaaaacaagttagtaactcaagaaatgataaagctctaataacagtagtagcactgtgcaaaaagagtaaggaaaagttcagcacaaaaacaaggcaacaggtctaaatacttctagcccaaactgaaggaaataggactaagggaaagcaggggagggtgggagggacttgatatgcataaaataagtaataatgacaaaccacagaaaaagattgataaaatgaatcgtgaaaatatgacaagaaaaatgcagttacagattcaaaaaccaagaaacaatacaaagaaatgtaattacatactacttgcctctgctgtgaaaaatattacatgatcataataatgtagaaactattcattaactttttttttttttttttcactctgtcacccaggctggagtgcaatggcaccatctcggctcactgcaacctccgcctccggggttcaagcaattctccctgcctcagcctcccaagtagccgggataacaggcatacgccaccacgaatttttgtatttttagtagagacggggtttcaccatgttggccagactggtctcggcctcccgccctcaggtgatcagcccgcctcagcctcccgaagtgctgggattacaggtgtgagccaccacgtccagcccattaactttcaagtattaaagtcataccggccaggtgcagtggctcacacctgtaatcccagcactttgagaggccgaggcaagtggatcagttgaggtcaggagttaaagaccagcctggccaacatggagaagccccgtctctactaaaaatacaaaaatttgccaagcacggtggtacgcacctgtagtcccagctacttggaaggctgaggtaggagaatagcttgaacctaggaagcggaggttgcagtgaaccaagatcgcaccactgcactcaagcctgggcaacagagcaagactgtctcaaaaaaataaataaataaacaaacaaagtagtaaggagtacaatacagcgcataactgttctcaaccttgacaatgtcaatgtcagaaatgacagatgtaagcacataaagggaaaaggaaaggtaaaaagaagagttgcagccgggcgtggtggctcacacctataatcccagcactctgggaggctgaggcaggtggatcacctgaggttgggagttcaagaccagcctgaccaacacggtgaaacctcatctctactaaaaatacaaaattagccaggcatggtggcgcctgcctgtaatcctagctactcgggaggctgagacaggagaatcgcttgaacccgggcggcagaggttgcagcaagccgagatcgcgccattgcactccagcctgggcaacaagagtgaaactccgtctcaaaaaaacaaacaaacaaacaaaagttactgcttggtacatcaagatcaacagtctatataacatgaaggaaagttctgatataaactgcagagataactagcagagaaattaaaagtgatttttaaaaaatctattggggaagcagatgtaaagaagccaaatcctcctttatcagagcagaaatcaatcataaatcataacatatgtatattatatagtcacgacaataccacaggaagaaataatttgaaagtttcctttggaaattggacccctatctttcaccatatacaaaaatcaactcaagaaggattaaagacttcatccaaagacctgaaactataaaaaccattagaagaaaacctaggaaaaactctcctggacactgatctatacaattcatgactaagaattcatgaatttaaagaattcatgactaagacctcaaaagcacaagcaaaaaaaaaaaaaacaaaaatagacaaatgagacttaagctaaaaagcttctgcatagcaaaagaatcagcagactgaacaaatggcctacagaataggagaaaaaagtttcaaactatgtatctcacagggtactaacatccagaatttacaaggaacacaaataatcccatcaaaaagtaagcaaagggctgttctgaatacctcactactgataactggtagtgagttatcccaattgatggttcactgtcagttaccgatcaaattccttgttctatactctttactcccctttcactactgcacttaactggtcttaagaaaaaattttaataaaaaatttttaagaattttaaagttagcaaaggacattaatagacatttctcaaaagaagacatacaaacagtcaacaggtatgtgaaaaaaatgctcatcactaatcatcgaggaaatgcaaataaaaaccacaatgacatatcatcttacaccaatcagaatggccactattaaagaaacaataataataacagatgttggggaagatgcagacaatggggaacacttaacacactgtgggcgggaatgtaaattagtaccacctgtatggaaaaccatataaagagttctcaaatgactaaaaaataaaactgctggccaggcacggtggctcacgcctgtaagcccagcactttgggaggccaaggcaggtgcatcacctgaggtcaggagttcaagaccagcctggccaacatggtaaaaccctgtctctactaaaaatacaaaaatttgctgggcgtggtggtgtgcacctgtaatcccagctactcgggaggctgaggcaggagaatcacttgaacctggtgggcagaggttgcactgagccgatatcatgtcattgcactccaacctgggcaacaagagcgaaactccatctcaaaaaagtaaaaatgataaaaaataaaactgctattcaatccagcaatcccactattgggtatccacccaaaggaaaataaatcattatatcaaaaagataactgcactcgtacctttatcacagcaacactcacaatagcaaagatagggaatcaatctccatatccatcaacagacgactggataaagaaaaactgggacacatacacacacacacacacacacacacacacacacacacacacacacgaatactattcagccataaaggaagaatgaaatcatgtcttttgtagcaacgtggaaggatggaaggacctggaggccatgttctcacttataagttgaagcaaaataatgtgtacatgtgggcacagtgtggaataacgacactggagactcagaaggttgggaggctgggaggagggtgagtaacaagaaattactgaatgggtacacgtacattatttggatgatggatgcactaaaagcccaaactgcagcactatgcaatgtattcatgtaacaaaactgcacctgtaacccttaaattgatacaaaaaagttgtttggagagtggcaataaggagtgaaacagaattcttgatccttattataagcattctgggctattagacttttttcaaccatgtacatatattactatgcaaagtttttaaatggacttaaaatctgaaagaacattgatcttttaatgaaaaacaaaaccataagatactctgcctaaactttccctcataatgcaatgaataaaactttaatctttctcttcaggataaataatttctgaggctttagaaccaccttaaaaggtatctctaggccgggcgcggtggctgacgcctgtaatcacagcactttgggaggccgaggtgggcagatcttctgaggtcaagagttcaagaccagcctggtcaacatgctgaaaccctgtctctactaaaaatacaaaaattagccaggcgtggtggtgcacatctgtaatccagctactcagaaggcggaggcaggaaaatctgaatccgggaggcagaggttgcagtgagccaggatcgcagcactgcactccagcctgggcaacagagcaagactcaggtctcaaaaaaaaaagatatttgttgacaactaaataagtcaagttacatgatgtatagactatcatcaaaattactgaaccgtcactgcttatcaaagtaaaatgtaaccaaaaatttaatgcacagtacttcgaccagaccaaaacattcaattcatccatagtttcctaattttaatacttattttaccagagcatgaaaatcttttttgtttttttgttttgttttgttttgttttttgagatagggtctccctctgttgcccagtttggagtacagtggcacaatctcagctcactgcaacctctgcctcccacgctcaagcaatcctcccacctcagccttctgaggagctgggaccacaagcgtgtagcactgtgcctggctaatttttgtattttctgtagagatggggtttcttcatattgcccagctggtctcaaactcctgagctcaagcaagccacccgccttggcctcccaaaatggcaggattacaggcatgaggcaccacaccccaccaaaaatgtatctttaacacctgttctctagattgatttaggttttactgatcttagaggtatatacaaccatcatttcaaactcaacagatctaaatttagtttaacttcacttttttttttttttttttttttctgcccaggctggagtagtggctcgatctctgctcactgcaacctccaccttctagggtcaagtgattctcatgcctcagcctcccaagtagctgggattatagacatgcaccaccacacttggctaatttttgtatttttagtagagatggggtttcgccatgttagccagactggtctcaaactcctggtctcatgtgatctgcccaccttggcctcccaaagtgctgggattacaggcaggagccactacacgctgcctagttcactttgcattctattttttcctttgtaccttttagaagaagcttttaaataatataaagattattatttttcaatctgtcagaaattgacagggaaaagaacttaaaagtttaaatacacgatacaaaaagattaaaaagttatcgcaaattggcagggtgcggtggctcacgcctgtaatcccagcactttgggaggccgaagtgggcagatcacccaaggttgggagtttgagaccagcctgaccaacttggaaaaacccagtctctactaaaaataaaaaattagctaggcatggtggtgcatggctgtaattccagctactcgggaggccgagggaggagaatcgcttgaacctgggaggcagaggttgcagtgagtcaagatcatgtgcgccattgcactccaacctgggcaacaaaagcaaaactctgtctcagaaaaaaaaaaaagttatcacaaattattgctcataacagtttagttaaaataaagaatgtatgtaaaactacagagtaatagcttgatagcaagacaaaatagtttttaaaaaaattctaggaaaaatatggctgactaaactatgatgaaagatttgagatatcaaaaatgggctgggtgcagctggcgtatgcctataatcccagcactctggcaggccaaggtgggtggatcacttgagcccaggagttcaagaccactctgggcaacatggcaaaacccagtctctacaaaaaatacaaaaattagctggacatggtggtgtgtgcctgtagtcccagctacttgggaggctgaggtaggagaatcatctgattctgggaagtccagggtgcaatgagccatgatcacaccactgtactcccgcctgagagacagagtgagaacctgtctcaaaaaaaaaaaaggcatcaaaaatggctaaaagaaaatcttaaacaaaccatgagttaacagattaaaaaggtgttcttgtttgttttttgagacacagtcttcctgggctgcccaagctggagtgcagtagtacaatcatggctcactgcagccttgaactcctaggctcaagtgatcctcctgcctcagcctcccaaataactgggactataggtgtatcacgacacacagccatttttttttcttagtagagatgaggtctcctgatgttgcccaggctgggctcgaactcctggtctcaagaggatcccgccttggccttccaaagtgctgggattacaggtgtgagccaaaaaaggtgtggggccaaaaaagggtttttttattttttggttttttttttctgttgttagaggtggaggtggtaatggtttctgttttggagggagaagaggtagtggtggtaatggtttcttcttgggaaggagtattaaggtttacagtgtttaccattttatttaacaatattctactacagaaactgaaacattttagatgttaataaaacatctaaaatcatactatgatttacttctccaaagtacaaattacatcacaagtaagcctccatgcaatgacatttttatctttatggagcatcatcaatatcagttaaataaattagtgcaaattgttcctaaggagaagtttagtttccactttaccattaaaagccaagtgcctatgatgcagatgaatgcattgtacaatatatttcaatcaagtcacagactcacttccccactatccatgaaatataacaaaggactaagaaacattaaaaaataacgtatcaaacttcccacaaaccaaaagacaggaagctactgaataatctgacacttggattacattttcattatcattaaaatgtagcaaaggggccgggcacggaggctcacgcctgtaatcctatcactttgggaggccaagacaggcagatcacttgaggtcaggagttcgaaaccagcctggccaacatgataaaaccggtctctactaaaaatacaaaaacttaaccaggcatggtggcacacgcctgtaatcccagctacttgggaggctgaggccggagactcacttgaacccgaggggcgaaggctgcagtaagccaacatcgcaccactgcactctagcctgggcgacacagcgagactctgtctcaaaaaaaaaaaaaaggtagcaaaggaaaaaaaaaaaataggtcagtgtttagaaaggatacaactatatcacgtcttttacttattttacattttgtattggtctagaagttgaaaatacgtgcccaaaacaactatacaacttgagcaatgattttaaaacaaatatgacactttatattagaagcagcaactatttattcagaaacatatactattagttacatttaaaatttatcttgttagaatacactgtttccaaatcaacagtccttacaaaatatggaacatatacttcagtattatttagctttacttttgtaatagtggccaaggtggccgggtggggtggctcacgcctgtaatcccagcactctgggaggccgaggtgggcagatcacaaggtcaggagttcgagaccagcctggccaatatggcgaaaccccgtttctactaaaaatacaaaaattaggtgggtgtggtgacgtgtgcctgtaatcccagccacctgggaggctgaggcatgagaatcgctgaatccagggaggtagaggttgcagtgagccaaaatcgtgccactgcactccagcctgggtgacagagtgagactccatctcaaaaaaagaaaaaaaaaaatagtggccaaggtggattttgtactctgaatataaactatatagtttatactatacatatgtctacttataaactaggcactactgcttcaatatattaaaaaaattattctagaagatagtttatcgtactcagggttccccccacctatagctgcagaccaataccactcggtagcctgttgggaaccaggccacacagcaggtgagcggcaggcaagccagcattaacctgagctcggcctcctctagatcagcagcggcattagattctcatagaagcacaaaccctattgtgaactgcacaagcaagggacctaggctgcatgcttcttatgagaatctaactaacctaactaatgcctgatgatctaaggtggaagagtttcacccgaaaaccatccactccgtgctccccctggggtctgtggaaaaaactctcttccacaaaactagtccctggtgccaaaaagtttggagaccactaacataaactacaaggttttgttaaaaaaaaaaaaaaaaaaaatgtagccaatgtcccttgagggttaatatcaaatatcttagaataggtaacagtctaatatgaatttaactgtgaacataatgaagttaattctacactatctaaaaaactgtttcacttaacatgcatctaattcatcaaactgggtgggtttctctctcttttttttttgagacagagtttccctctgttacccaggcttagtgttacccaggcttaagtgcagtggcgccatctcaactcactgcagtcttgacctccggagctcaacctgatccttccacctcagcctcccgattagctgggatcacacaagaatgtgccatcacacctggctaatttttgtattttttttagggtcagggtctcactatgttgtccaggctggtcttgaacgccttacctcgagtgatccacctgcctcagcctcccaaagtgctgggattagaggtgtgagccaccaagacccaccttaaaacaagttctttgaaaacatatttgctacgtaatagttatgagctttttaaaaaatttcttctaatgtaattaaattctggtaatcagattttcagaagaaatatgttaaaatgctggttaagtgggccaggtgcagtggctcacgcctgtaatcccagcattttgggaggccgaggcaggtgcatcaggaggtcaggagatcgagaccatcctggctaccacacagtgaaaccccatgtctgctaaaaatacaaaaaaaaaaaaaaaaaattagccaggtgtggtggcgggcgcctgtagtcccagcttcttgggaggctgaggcaggagaatcgcttgaacccaggaggcggagcttgcagtgagctgagatcacgccactgcactccagcctgggtgacagagcaagactccgtctcaaaaaaaataaaataaaataaaaataaataaaataaaatgctggttaagtgaccagaggttttatttcttgggtttttttttaaatcatcatggaattaaacacacatgaagaaatctgttgaaacccctcaaacttgcaatgctatacccgaatcacagtgttctttcagagacttttcaaattatacaaatatttcaaaatgctgagttactctactatagctaataaaactacttaaactaagtggaaaaccttgagaactaaagggggaggggatattatttattctcattactcttaaatcaaccaacttccaaatccagaatataaaacttttatgattatttgttctttccctgtttacaaacctagttctgatttcattattaaaaatataggccgggcacggtggctcatgccggtaatcctagcactttgggaggccaaggtagacagatcacgaggtcagcaattcaagaccagcctgaccaacatggtgaaaccccgtctctactaaaaacacaaaaaaattagctgggcatagtggctggcacctgtaatcccagctactcgggaggctgaggcagaagaatggcgtgaacccaggaggcggagcttgcactgagtcaagatcgcgccctcgcactccagcttgggcgacggaggaagaccctgtctcaaaaaaaaaaaaaaaaattagccaggtgtggaagcacacccctgtaatcccagctactcaggaggctgaggcagcagaatcgcttgaacctgggaggtggaggctgcagtgagccgagacagcgccactgcactccagcctgggcgacagagcaagactccatctcaaataaaataaaattttttttaagttttaatttatatatattatattataaatattatatataatgtataatttttatatatgagattatgtatatatgtatatgtatatgagatgtatatataatatatacatctcagccgggcccagtgactcacgcctataatcccagcattttgggaggttgaggtaggtggatcacttgaacccaggagctcgaggtcagcctgggcaacatcgagagacgccgtctctacaaaaaataaaagataaaaaaattagctggtggtgatggcacatccccacggccccagctacttgggaggctgaggtggaaggatcactggggttggaaggtcgaggctgcagtgagccaagatctcactcctgcacttcagcctggatgacagagcgagaccaagtctcaaaaaaaatatatatatggtgtgtgtatatatgtatatgtgtgtatatgtgtgcatacacacacaattctctataactagtgctgtcatacttaatgctttaataaggttaaatacataataaatacaatagttcattttgtctttaacagtacaatccaagtcaagtcatccttccaaaccagatacaaaaatatcctatgaaaagaaacaaaaactttttatccttaggatattttggggttctggccttttgttgtgccagatataataccacttgataagactttcagcttcatcccatcccatcctgcaacaatgttttcagtagggcgggatccgtggctcccaatcaagtccgacaacctgatctcatggcagggcccacacaagaaaaaaaagagcattttatttcgtgcaacttttatggcccagagaatctctgaccccccaccccctcaacacacaataatcagttgatctccctctccctccctctctcccacctccacaccatctatgagaaagaggagggggaagaaggtggaagaaaaggcacgagtagagaaagtagatccgacgtaaagcaggcacctaaaaaaaggtgggatggatttctccaaagcccagatcagggactctgctacagccagccagtggagaatgcctctaatgttaacgctttagtaaccacttacaagaacttcccctgtctactgcttaatttcaaataacccaacaggtccatttaattactttgtattatttaaagaaatctaggatttctttaaataataaaagggaaacgaacgcgttttaacatcattttgcatcacaatgttaaaatcttgggttaactccctcagtaaatctctaaatcctttccaatctactatctctggccaggaagtcaaaactgaaatattaaccaactaaaatgatcttcattctttggtcaattttgcagagcaaaaaatttaaataaataaataaatagatcttcaatgtgtatcaaggatgtcctacttgggcctcactctcccaaacagagcctattttcttccatttaacaaaggaaaattctcatttaaacaagtctaatgaagatgttgcaacctggccaagagcggtggctcatgcctgtaatcccagcagtttaggaggccaaggcaggctgatcacttgaggcaagagtttgagaccagtctggccaacatggtgaaacccgatctctactaaaaatccaaaaattagccgggcatcgtggcaggaacctgtaatcccagctactcaggaggctgaggcaggagaatggcttgaacccgggaggcggaggttgcagtgagctgagatcctgccactgcactccagcctgggcgacagagcaagactccctctcaaaaaaaaatttttttaatgttgcaaccaatttttcttcctcatatttatagatgtttatcatgttttttcttaaaagttttttaaaccaccttttccaaacctcaaaacaagcatctataattatagacaattattctcctggctccgtaaacaattctatttttccttctccaactttctaatcctctcatgaagctggccaaatgtattctactcctgacaccaaacaacagaaaaagaaacaacgtaactgcagtctacttcttttgttttaataaacaaataaactagcttaaatgcacagtggtcttggatcacataagaatttcaaaataaatgatttaaacactttaaatattgtggtgggggggatggtgctggtaaataagggtcaagttctgactttcttattgaggccaaggtcaagaaattacttttttcagatctataaaatcttaccaactcagaatcctgattatagattatcatctcctactcaatactttccaaatctacaatgatataggaatcccactaaaattcagaataattaaaaggagttaagatttaagacataaccaaaaaccagcccctctacaaggcagttgactgtacagttcatgcttgtatacagatggacagactaagaacaaactctacacttctgagaaaaaaaacaaaactaaactaacaatgtaaatctattcattcattataacaatttcttttttcggagacagggtctcactttgtccaggctggagtgcagtggtgcgattttacctcactgcagcctcgacctcctgggttcacgtcatcttcccacctcagcctcccgagtagctgggactactaacgcgggccaccatagctggataatttacgtattttttgtagagacagggttttgttatgctgcccagactagttgagctcctgagctgaagcaatccgcctgcctcagcctcctaaagtgctaagattacaggtgtaagccactgcgcccagccacaaaatttttaaatatcattccaaagaaccatctataatgaaatgtgaaattatgttaaatacatatgtttagaagatacaatgcaactttctagtttttatttccactgtaactaacttcaactatgaataaaattctacataagtttccatctcaggatttttgttctctttaaaattacaaaaactggccgggcatggtggctcacgcctgtaatcccagcactttgggaggccgaggcaggtggatcacctgaggtcaggagttcgagaccagcctagccaacatagcaaaaccccatctatactaaaaatacaaaaattagccaggtgtggtggcgggcgcctgtaatcccagctacttgggaggctgaggcaggaaaatcgcttgaacccaggaggcggaggttgcagtgagccgagatcgcaccactgcactccagtccgggtgacaagagcaaaactccgtctcaaaaaaaaaaaaaaatttacaaaagtcatttagaaaatgtatgaggccagacgcgatggctcatgcctgtaatcccaactctctgggaggccaaggcgggcggaccactaggtcagaaattcgagaccagcctgaccaacatggtgaaaccctgtctctactaaaaatacaaaatttagctgggcgtggtgtcgcacgcctgtgatcccagctactcaggagactgaggcaggagaattgcttgaacccaggaggcagaggttgcagtgagctaatactgtgccactgcactccagcctgggcgacatagtgagactctgtttcaaaaaaaaaaaaaaatgcatatgaaacacaaaaagctgggtgtggtggctggctcacacctgtaatcccagcattttgggaggccaagggggtgcggatcacctgaggtcaggagttcgagaccagcctgaccaacatggagaaaccccatctctactaaaaatacaaattagccgggcatggtggcgcatgcatgtaatcccagctactcaggaggctgaggcaggagtatcgtttgaacctgggaggcgaaggttgccatgagccgagattgtgccatcacactccagcctgggcaacaagcacgaaactctgtctcaaaaaaagaaagaaacacacagagttgccaatgtgaaaactactcaataagatttaataaaaatactgtatttggaaaaaatctttttttttttttagctgggattacaggcgcccggcatcatgcctggctcatttttgtatttttagtagggaagaggtttcaccatgttggtcaggccgatctcaaattctagacctcaggtgatccacccacctcagcatcccaaagtgctgggattacaggcgtgagccactgcacctggccttaactatttttcattaaggtaatgaaataagttaacttctcaatactttctttctttttttttttctttttgagacagggtcttgctctgctaccaggctagagtgcagtggcatgatcacagctcactacagcctcaatctccaaggctcaagcgatcctccctcctcagtctcccaaacagctgaggcaacaggtgcataccacatgcagctaattttttatttttttgtagagacaggatctcaccattttgcccagactgattttgaaatcctgagctcaagctatcagcctgcctcagcctcaagtgctgggattacaggtgatggcatccggccttcaatattttctggatgaaagagaggacttattactagtcctagattattatgaaaaacagcaatatcatgattaaaattttgttcctcctcccagtactgtgttctattaattagataggaaataggaatgaacaaaaatagacattaaatcaaatgattttactttctaaaagtcaaaaattctaatgctttgtttacctatctacaaatatttatcttactacttctataaataattgaataaaatcttaaatgaactaaaagaaataatgggacttttcactacacaaaagataattacctatacaatgaaatgaggtgaaattcttagagcaaatatgtcatacaacaagcttaaattaatgatacgaaacagttagaatgcccccaccccaataaaccatggacaaaacacgactgggcaattcgcaagaaatacaagtaataaaattcaaaaaaaggctgacgcggtggctcatgcctgtaatcccaacgctttgggaggccgaggcgggtggatcatgagatcaggtgctcgagaccagcctggccaacatagtgaaaacccatttctactaaaaatacaaaaaaatagctgggcgtggtggtggatgcctgtaatcccagctacttgggaggctgaggcaggagaactgcttgaacctgggacgcgaaggttgcagtaagccaagatcgtgccacggcactccagcctgggcaacagtgtaagactcaggtctcaaagaaaaaagaaaaagaaattcaaaatattcattagtcctactaatcaagtaagtaaaagcttagaactactttttttctgttgttaagataaagattttaatatatcatacatgacaaaggtttgataaaactagacctatcacacattgctaatgacattacaaattgatgcaacctttttagggagtggcatttcaaaactttaataaaaataagagatcagggctgggcatggtggcttatgcctgtaatccaagcattctgggaggccaaggcaggggagatcacttgaggtcaggagttcaagaccagcctggccaacatggcgaaaccctgtatttttagtattctactaaaaatacaaaaattagtcaggcgtaggccaggcgcgatggctcacacctgtaatcccagcactttgggaggccgaggcgggcagatcacgaggttaggagatcgagaccatcctagctaacacggtgaaaccccatctctattaaaactacaaaaaattagccgggcatggtggcaggcacctgtagtcccagctactcgggagggaggctgaggcaggagaatggcgtgaacccaggaggcggagtttgcagtgagccgagatcacgccattacactccagcctgggcgacagagcaagactcatctcaaaaaaaaacaaacaacaacaacaaaaaattagccaggcatggtagcgcgcctgtaatcccagctacttgggaggctaagacaggagaaccgcttgatctcaggaggcggaggttgcagtaagcggagatcatgccactgcactccagcctgggtgacagaacaagactctgtatcaaaaaaaaaaaaaaaattcaatgtaatttaaaaaaataagagatcaagccgggcacggtggctcacacctgtaatcccaggactttgggaggctaaagcaggcaggtcacttgagacaggagttcaagactagcctggccaacatggtaaaccttgtctctactaaaatcaaaaaattagccaggcatggtggcacacgcctgtaatcccagctattcagggcgctgacacatgagaatcccttgaacctgggaggcagaggttgtggagagccgagatggcaccactgcactctagcctgggtgacacagtgagacatcatctcaaaaaaaaaaaaaaaaaaaagagtttatatttatctcaaaaaaagagtttatatttattgcttgctaaggcatcaaatataagaaggaaaaaattttaaaaagttcgtatttactaagaacttactaagtaataggcacagctcactgcaaccacttcctcccaggttcaagcgactctcctgccacagcctcccaagtagctgggattacaggtgcccaccaccatgtctggctaatttttgtatttttactagagatgggtttcaccatgttggtcaggctggtctcgaactcctgacctcaggtgatccatccacctcggcctcccaaagtgctagaattacaggcatgagccactgcacctggcctctagcggctttcttaacacatataccctctttaaatcttttaataatcctgtgacaaagatgttattatcatccctattttataggtaacaaacagatacagattgaacagcttatacaaagtccaacaactagaaagtgataagaccagaatttgacaataagcaaatagacattagagcctatatgcttctgaatatctatgaagaatcaaaaaatgcttttttgttgttgttgttgttgagacggagtcttgctctgtcgcccaggctggagtgtagtggcatgatctcggctcactgcaagctccgcctcctgggttcacgccatcctcctgcttcaacctcctgagtagctgggactagaggcgcctgccaccacacccagctaattttttgtatcttttagtagagacggggtttcaccacgttagccaggatggtctcaatctcttcacctcgtcatccacccacctcggcctcccaaagtgctgggattacaggcatgagccaccgcgcccaccctctttcttttaaaaaaaaaaaaaaaaaaaaagatggagtctcactctgtcacctaggctggagtgaagtggcacaatctcggctcactgcaacctttgcctcgatactccttccttagcttcccaagtagctgggactacaggtgtgcgccaccacgcccagctaatttttgtatcttagtagagatggggattcaccatgttggccaggctggtgtcaaactcctgacctcagatgatccacccacctcagcctcccaaagtgctgggattacaggcgtgagccaccatgcccggccaaatgcttattttttaacctaattatcctgcctatggtaatctgtcctataaaaataaccaaaatatgaaaaaggctttatctacaaaaaggtcagccagagcattacacatagtaacaaaaggcagtagggtgagaagaggaaaaggggagacagctgtatggttacataaattatagtgtggttactcagttttttgttgttgttttgagacagagtctcgctctgtcgcccaggctggagtgcaatggtgtggtcttggctcactgcaacctccacctcccggattccagcgattctcctgcctcagcctcctgagcagctgaagactacaggcgcatgccaccacacctggctaatttttgtatttttagtacagagggggtttcactatgttggccaggctggtctcgaactcctgaccttgtgatatgcctgcctcagcctcccaaagggctgggattacagtcgtgagcgacagcactcagccctcagttttactcaatggaaaattaagcacccttcaaaaatgttataaaagattaacaatacggaaattttcttttacatgttacaagggaaagtaggttacaaaactctaaatgtacataagtagtatcacaaaaaaaaaaaaactgtgtatatgaaaaaagtttgaaagagaataggtcaggctgggtgtggtagctgatgtctataatttcggcactttgaaaggccaaggtgggaggatcacttgagcctaggagtttgagaccagcctgggtgacatagtgagacgactgtccctacataaaaagatttgtttttcatttaaaagaaaaaaaatagactgggcatggtggctcatgtctgtaatcccagcattttgggaggccaaggcaggtggatcacaaggtcaggagtttgagaccagcctggccaacatggtggaagcccatctctactaaaaatacaaaaaattagccgggcatggtggcagacgcctgtaatcccagctactcaggaggctgaggcaggagaatcacttgaactcgggaggcggagattgcagtgagccgagatcatgccactgggctccagcctgggcaacagagcgagactctgtctccaaaaaaaaaagtgggggaaagaaaacatttacatttataacaacatcaaaaacaatgaaatacttaggaatcaatttaacaaaaaaagtacaagacctgtgcattgaaaattataaaatactacaaacaaattaaaggagatcagaaattatacttcatttgatacttaatcacatgcaaaaaatcattagttccagttttacagttgttgccggttatttttctaacacagatacaatgtcatacctctgtttaacatcttcaatggctccctattgtttacagttaatattcaaaatgcccaatttactttcccttcctcatttcctcccatattggactgtagtctcttaaaaagcaaaggtcagggtcagacacacctggattcaaatcctgactcaatcacttacaagctatataaaaattcatctttcatttgtaaaacgtactaatgattcaaccccatgtgatcagtaattatcaaaaaggtaacttctggtaagcactagtagtgcctaacacataatagccaggta

SEQ ID NO: 124 - DNA, 16769 bp, Homo sapiens
gcctaagatcaaccacaaagtgacaaaatcaaatcacgatataaattaaatgatcccattatcataaaaatggatataagtacatacacatacatagaaatagcaaaggtatacccataacaaaagtcaaggatacagtaattgtctctgaaatgtggggcaaaacagggaaaagagggtctttcacattttttgttttttattttagataagaggctcactctgtcacccagtgaaacacatgttgcccaggctggcctcaaactcctggcctcaagtgatcctcctacctcggccttcccaagtattgagattataagcgtgagccccctgcacccagccccttttactttttaagttatgccctcctgtgctctttatttttaccagaatgtattacattcataactttttatgtgacatcttctaatcttccacatactgtaaaaggcttaacacacataatgagtactcagttttgttttggagacagggtttcagctctgtcacccaggctggagtgcaacagcacaatcttgactcaatgcaacctccacctcctgggctcaagggatcctcccacctcagcctctgagtaggtaggactacaggttcgcaccaccaagcccagctaatttttgtgggatttttttaggggtagggtttcaccatgttgcccaggctggtctccaactcctgagctcaagcgatccacccaccttggcttctcaaagtgctgggatttcaggcgctcaccaccgcacccagccagtactcgcttttataaacacgcaaaacacctcctacaccacttaaagctgctattatatttctacaacctaacacattctgaaacactggataaataaatatctaaataattattagtttttggtctagtccagtttgagaactgaaagagattctctggctcaaatagcagatcaaacatatacatttatctctcttcagcaaaagaccattttaaacagtagtttaaaaaaatttaaagccaaattattattaaaaaacaaagtaaaattaatggaaagagatctcttctaaagtaaagaaactggagtctgggagagaggaaactagtgaacctagcatgggagttggcactttggggtaaaacaatggactcttgaatgtcagaatacaaaagactaattaacagcttaaccctaaagtaaagcctgcctgccaaccattaattcccaccaagagctcattgtgaacccttctactaaatcttaaagctgagtgatatccaaggtcagcagatatttggttaaaagcctacaatataaatgagactaagataacaacaaaaattacaatagagttgacaggtaagagggagggcaacaaaatttaaaaaaaaaataaaccttattaacattttcagagactcaagaagattattaatccataaaatgagaaaagatattggcgggggaggaaatgaaggagaaatctcaaacatttaaaatataacttccaatataaaattaaaaggtccaagaataaataaagtagaagagatggccagaccaaaaaaaaacaaacaaacaaacagacaaaaatattggggaggattaattcagtaagtctaataatccaactaaaagcagctatagagaaaacaaagaaaagatcactagaggccgggcgtgggggttcacgcctgtaatcccagcactttgggaggccgagatgggcggatcacgaggtcaggagatcaaaaccatcctggctaacaaacacggtgaaaccccctctctactaaaaatacaaaaacttagccaggtgtggtagcaggtgcctgtagtcccagttacctgggaggctgaagaagaatagcttgaacccaggaggcagaggttgcaatgtgccaagatggtaccactgcactccagcctgggcaacagagcaagactccgtctcaaaaaaataaaaaaaagaaagatcactaaagccgtaacatgaaaactttcaagaagtgaagcacataaagtattttgcttattgtaatggagaagaaaacacatctggacatctttgagaaatttcagtttaatgaggataaaagaaggctctaaagggatggatgaaaatatgaaacacatcacccacaaaggaagaagaatcacacagtatccgacttttcctcaccaacaacaatggacatagaagacactggagcaatcccttcaaaactctgagggaaaacaattttcagcttaattgcacttgaataaaataataccagtcaactgtaagggctaatgaggacttttacagataagcaaggattcaaaactttatttctcacatattctttcttagctatttatgtgggtgtactgcattaaaacaagttagtaactcaagaaatgataaagctctaataacagtagtagcactgtgcaaaaagagtaaggaaaagttcagcacaaaaacaaggcaacaggtctaaatacttctagcccaaactgaaggaaataggactaagggaaagcaggggagggtgggagggacttgatatgcataaaataagtaataatgacaaaccacagaaaaagattgataaaatgaatcgtgaaaatatgacaagaaaaatgcagttacagattcaaaaaccaagaaacaatacaaagaaatgtaattacatactacttgcctctgctgtgaaaaatattacatgatcataataatgtagaaactattcattaactttttttttttttttttcactctgtcacccaggctggagtgcaatggcaccatctcggctcactgcaacctccgcctccggggttcaagcaattctccctgcctcagcctcccaagtagccgggataacaggcatacgccaccacgaatttttgtatttttagtagagacggggtttcaccatgttggccagactggtctcggcctcccgccctcaggtgatcagcccgcctcagcctcccgaagtgctgggattacaggtgtgagccaccacgtccagcccattaactttcaagtattaaagtcataccggccaggtgcagtggctcacacctgtaatcccagcactttgagaggccgaggcaagtggatcagttgaggtcaggagttaaagaccagcctggccaacatggagaagccccgtctctactaaaaatacaaaaatttgccaagcacggtggtacgcacctgtagtcccagctacttggaaggctgaggtaggagaatagcttgaacctaggaagcggaggttgcagtgaaccaagatcgcaccactgcactcaagcctgggcaacagagcaagactgtctcaaaaaaataaataaataaacaaacaaagtagtaaggagtacaatacagcgcataactgttctcaaccttgacaatgtcaatgtcagaaatgacagatgtaagcacataaagggaaaaggaaaggtaaaaagaagagttgcagccgggcgtggtggctcacacctataatcccagcactctgggaggctgaggcaggtggatcacctgaggttgggagttcaagaccagcctgaccaacacggtgaaacctcatctctactaaaaatacaaaattagccaggcatggtggcgcctgcctgtaatcctagctactcgggaggctgagacaggagaatcgcttgaacccgggcggcagaggttgcagcaagccgagatcgcgccattgcactccagcctgggcaacaagagtgaaactccgtctcaaaaaaacaaacaaacaaacaaaagttactgcttggtacatcaagatcaacagtctatataacatgaaggaaagttctgatataaactgcagagataactagcagagaaattaaaagtgatttttaaaaaatctattggggaagcagatgtaaagaagccaaatcctcctttatcagagcagaaatcaatcataaatcataacatatgtatattatatagtcacgacaataccacaggaagaaataatttgaaagtttcctttggaaattggacccctatctttcaccatatacaaaaatcaactcaagaaggattaaagacttcatccaaagacctgaaactataaaaaccattagaagaaaacctaggaaaaactctcctggacactgatctatacaattcatgactaagaattcatgaatttaaagaattcatgactaagacctcaaaagcacaagcaaaaaaaaaaaaaacaaaaatagacaaatgagacttaagctaaaaagcttctgcatagcaaaagaatcagcagactgaacaaatggcctacagaataggagaaaaaagtttcaaactatgtatctcacagggtactaacatccagaatttacaaggaacacaaataatcccatcaaaaagtaagcaaagggctgttctgaatacctcactactgataactggtagtgagttatcccaattgatggttcactgtcagttaccgatcaaattccttgttctatactctttactcccctttcactactgcacttaactggtcttaagaaaaaattttaataaaaaatttttaagaattttaaagttagcaaaggacattaatagacatttctcaaaagaagacatacaaacagtcaacaggtatgtgaaaaaaatgctcatcactaatcatcgaggaaatgcaaataaaaaccacaatgacatatcatcttacaccaatcagaatggccactattaaagaaacaataataataacagatgttggggaagatgcagacaatggggaacacttaacacactgtgggcgggaatgtaaattagtaccacctgtatggaaaaccatataaagagttctcaaatgactaaaaaataaaactgctggccaggcacggtggctcacgcctgtaagcccagcactttgggaggccaaggcaggtgcatcacctgaggtcaggagttcaagaccagcctggccaacatggtaaaaccctgtctctactaaaaatacaaaaatttgctgggcgtggtggtgtgcacctgtaatcccagctactcgggaggctgaggcaggagaatcacttgaacctggtgggcagaggttgcactgagccgatatcatgtcattgcactccaacctgggcaacaagagcgaaactccatctcaaaaaagtaaaaatgataaaaaataaaactgctattcaatccagcaatcccactattgggtatccacccaaaggaaaataaatcattatatcaaaaagataactgcactcgtacctttatcacagcaacactcacaatagcaaagatagggaatcaatctccatatccatcaacagacgactggataaagaaaaactgggacacatacacacacacacacacacacacacacacacacacacacacacacgaatactattcagccataaaggaagaatgaaatcatgtcttttgtagcaacgtggaaggatggaaggacctggaggccatgttctcacttataagttgaagcaaaataatgtgtacatgtgggcacagtgtggaataacgacactggagactcagaaggttgggaggctgggaggagggtgagtaacaagaaattactgaatgggtacacgtacattatttggatgatggatgcactaaaagcccaaactgcagcactatgcaatgtattcatgtaacaaaactgcacctgtaacccttaaattgatacaaaaaagttgtttggagagtggcaataaggagtgaaacagaattcttgatccttattataagcattctgggctattagacttttttcaaccatgtacatatattactatgcaaagtttttaaatggacttaaaatctgaaagaacattgatcttttaatgaaaaacaaaaccataagatactctgcctaaactttccctcataatgcaatgaataaaactttaatctttctcttcaggataaataatttctgaggctttagaaccaccttaaaaggtatctctaggccgggcgcggtggctgacgcctgtaatcacagcactttgggaggccgaggtgggcagatcttctgaggtcaagagttcaagaccagcctggtcaacatgctgaaaccctgtctctactaaaaatacaaaaattagccaggcgtggtggtgcacatctgtaatccagctactcagaaggcggaggcaggaaaatctgaatccgggaggcagaggttgcagtgagccaggatcgcagcactgcactccagcctgggcaacagagcaagactcaggtctcaaaaaaaaaagatatttgttgacaactaaataagtcaagttacatgatgtatagactatcatcaaaattactgaaccgtcactgcttatcaaagtaaaatgtaaccaaaaatttaatgcacagtacttcgaccagaccaaaacattcaattcatccatagtttcctaattttaatacttattttaccagagcatgaaaatcttttttgtttttttgttttgttttgttttgttttttgagatagggtctccctctgttgcccagtttggagtacagtggcacaatctcagctcactgcaacctctgcctcccacgctcaagcaatcctcccacctcagccttctgaggagctgggaccacaagcgtgtagcactgtgcctggctaatttttgtattttctgtagagatggggtttcttcatattgcccagctggtctcaaactcctgagctcaagcaagccacccgccttggcctcccaaaatggcaggattacaggcatgaggcaccacaccccaccaaaaatgtatctttaacacctgttctctagattgatttaggttttactgatcttagaggtatatacaaccatcatttcaaactcaacagatctaaatttagtttaacttcacttttttttttttttttttttttctgcccaggctggagtagtggctcgatctctgctcactgcaacctccaccttctagggtcaagtgattctcatgcctcagcctcccaagtagctgggattatagacatgcaccaccacacttggctaatttttgtatttttagtagagatggggtttcgccatgttagccagactggtctcaaactcctggtctcatgtgatctgcccaccttggcctcccaaagtgctgggattacaggcaggagccactacacgctgcctagttcactttgcattctattttttcctttgtaccttttagaagaagcttttaaataatataaagattattatttttcaatctgtcagaaattgacagggaaaagaacttaaaagtttaaatacacgatacaaaaagattaaaaagttatcgcaaattggcagggtgcggtggctcacgcctgtaatcccagcactttgggaggccgaagtgggcagatcacccaaggttgggagtttgagaccagcctgaccaacttggaaaaacccagtctctactaaaaataaaaaattagctaggcatggtggtgcatggctgtaattccagctactcgggaggccgagggaggagaatcgcttgaacctgggaggcagaggttgcagtgagtcaagatcatgtgcgccattgcactccaacctgggcaacaaaagcaaaactctgtctcagaaaaaaaaaaaagttatcacaaattattgctcataacagtttagttaaaataaagaatgtatgtaaaactacagagtaatagcttgatagcaagacaaaatagtttttaaaaaaattctaggaaaaatatggctgactaaactatgatgaaagatttgagatatcaaaaatgggctgggtgcagctggcgtatgcctataatcccagcactctggcaggccaaggtgggtggatcacttgagcccaggagttcaagaccactctgggcaacatggcaaaacccagtctctacaaaaaatacaaaaattagctggacatggtggtgtgtgcctgtagtcccagctacttgggaggctgaggtaggagaatcatctgattctgggaagtccagggtgcaatgagccatgatcacaccactgtactcccgcctgagagacagagtgagaacctgtctcaaaaaaaaaaaaggcatcaaaaatggctaaaagaaaatcttaaacaaaccatgagttaacagattaaaaaggtgttcttgtttgttttttgagacacagtcttcctgggctgcccaagctggagtgcagtagtacaatcatggctcactgcagccttgaactcctaggctcaagtgatcctcctgcctcagcctcccaaataactgggactataggtgtatcacgacacacagccatttttttttcttagtagagatgaggtctcctgatgttgcccaggctgggctcgaactcctggtctcaagaggatcccgccttggccttccaaagtgctgggattacaggtgtgagccaaaaaaggtgtggggccaaaaaagggtttttttattttttggttttttttttctgttgttagaggtggaggtggtaatggtttctgttttggagggagaagaggtagtggtggtaatggtttcttcttgggaaggagtattaaggtttacagtgtttaccattttatttaacaatattctactacagaaactgaaacattttagatgttaataaaacatctaaaatcatactatgatttacttctccaaagtacaaattacatcacaagtaagcctccatgcaatgacatttttatctttatggagcatcatcaatatcagttaaataaattagtgcaaattgttcctaaggagaagtttagtttccactttaccattaaaagccaagtgcctatgatgcagatgaatgcattgtacaatatatttcaatcaagtcacagactcacttccccactatccatgaaatataacaaaggactaagaaacattaaaaaataacgtatcaaacttcccacaaaccaaaagacaggaagctactgaataatctgacacttggattacattttcattatcattaaaatgtagcaaaggggccgggcacggaggctcacgcctgtaatcctatcactttgggaggccaagacaggcagatcacttgaggtcaggagttcgaaaccagcctggccaacatgataaaaccggtctctactaaaaatacaaaaacttaaccaggcatggtggcacacgcctgtaatcccagctacttgggaggctgaggccggagactcacttgaacccgaggggcgaaggctgcagtaagccaacatcgcaccactgcactctagcctgggcgacacagcgagactctgtctcaaaaaaaaaaaaaaggtagcaaaggaaaaaaaaaaaataggtcagtgtttagaaaggatacaactatatcacgtcttttacttattttacattttgtattggtctagaagttgaaaatacgtgcccaaaacaactatacaacttgagcaatgattttaaaacaaatatgacactttatattagaagcagcaactatttattcagaaacatatactattagttacatttaaaatttatcttgttagaatacactgtttccaaatcaacagtccttacaaaatatggaacatatacttcagtattatttagctttacttttgtaatagtggccaaggtggccgggtggggtggctcacgcctgtaatcccagcactctgggaggccgaggtgggcagatcacaaggtcaggagttcgagaccagcctggccaatatggcgaaaccccgtttctactaaaaatacaaaaattaggtgggtgtggtgacgtgtgcctgtaatcccagccacctgggaggctgaggcatgagaatcgctgaatccagggaggtagaggttgcagtgagccaaaatcgtgccactgcactccagcctgggtgacagagtgagactccatctcaaaaaaagaaaaaaaaaaatagtggccaaggtggattttgtactctgaatataaactatatagtttatactatacatatgtctacttataaactaggcactactgcttcaatatattaaaaaaattattctagaagatagtttatcgtactcagggttccccccacctatagctgcagaccaataccactcggtagcctgttgggaaccaggccacacagcaggtgagcggcaggcaagccagcattaacctgagctcggcctcctctagatcagcagcggcattagattctcatagaagcacaaaccctattgtgaactgcacaagcaagggacctaggctgcatgcttcttatgagaatctaactaacctaactaatgcctgatgatctaaggtggaagagtttcacccgaaaaccatccactccgtgctccccctggggtctgtggaaaaaactctcttccacaaaactagtccctggtgccaaaaagtttggagaccactaacataaactacaaggttttgttaaaaaaaaaaaaaaaaaaaatgtagccaatgtcccttgagggttaatatcaaatatcttagaataggtaacagtctaatatgaatttaactgtgaacataatgaagttaattctacactatctaaaaaactgtttcacttaacatgcatctaattcatcaaactgggtgggtttctctctcttttttttttgagacagagtttccctctgttacccaggcttagtgttacccaggcttaagtgcagtggcgccatctcaactcactgcagtcttgacctccggagctcaacctgatccttccacctcagcctcccgattagctgggatcacacaagaatgtgccatcacacctggctaatttttgtattttttttagggtcagggtctcactatgttgtccaggctggtcttgaacgccttacctcgagtgatccacctgcctcagcctcccaaagtgctgggattagaggtgtgagccaccaagacccaccttaaaacaagttctttgaaaacatatttgctacgtaatagttatgagctttttaaaaaatttcttctaatgtaattaaattctggtaatcagattttcagaagaaatatgttaaaatgctggttaagtgggccaggtgcagtggctcacgcctgtaatcccagcattttgggaggccgaggcaggtgcatcaggaggtcaggagatcgagaccatcctggctaccacacagtgaaaccccatgtctgctaaaaatacaaaaaaaaaaaaaaaaaattagccaggtgtggtggcgggcgcctgtagtcccagcttcttgggaggctgaggcaggagaatcgcttgaacccaggaggcggagcttgcagtgagctgagatcacgccactgcactccagcctgggtgacagagcaagactccgtctcaaaaaaaataaaataaaataaaaataaataaaataaaatgctggttaagtgaccagaggttttatttcttgggtttttttttaaatcatcatggaattaaacacacatgaagaaatctgttgaaacccctcaaacttgcaatgctatacccgaatcacagtgttctttcagagacttttcaaattatacaaatatttcaaaatgctgagttactctactatagctaataaaactacttaaactaagtggaaaaccttgagaactaaagggggaggggatattatttattctcattactcttaaatcaaccaacttccaaatccagaatataaaacttttatgattatttgttctttccctgtttacaaacctagttctgatttcattattaaaaatataggccgggcacggtggctcatgccggtaatcctagcactttgggaggccaaggtagacagatcacgaggtcagcaattcaagaccagcctgaccaacatggtgaaaccccgtctctactaaaaacacaaaaaaattagctgggcatagtggctggcacctgtaatcccagctactcgggaggctgaggcagaagaatggcgtgaacccaggaggcggagcttgcactgagtcaagatcgcgccctcgcactccagcttgggcgacggaggaagaccctgtctcaaaaaaaaaaaaaaaaattagccaggtgtggaagcacacccctgtaatcccagctactcaggaggctgaggcagcagaatcgcttgaacctgggaggtggaggctgcagtgagccgagacagcgccactgcactccagcctgggcgacagagcaagactccatctcaaataaaataaaattttttttaagttttaatttatatatattatattataaatattatatataatgtataatttttatatatgagattatgtatatatgtatatgtatatgagatgtatatataatatatacatctcagccgggcccagtgactcacgcctataatcccagcattttgggaggttgaggtaggtggatcacttgaacccaggagctcgaggtcagcctgggcaacatcgagagacgccgtctctacaaaaaataaaagataaaaaaattagctggtggtgatggcacatccccacggccccagctacttgggaggctgaggtggaaggatcactggggttggaaggtcgaggctgcagtgagccaagatctcactcctgcacttcagcctggatgacagagcgagaccaagtctcaaaaaaaatatatatatggtgtgtgtatatatgtatatgtgtgtatatgtgtgcatacacacacaattctctataactagtgctgtcatacttaatgctttaataaggttaaatacataataaatacaatagttcattttgtctttaacagtacaatccaagtcaagtcatccttccaaaccagatacaaaaatatcctatgaaaagaaacaaaaactttttatccttaggatattttggggttctggccttttgttgtgccagatataataccacttgataagactttcagcttcatcccatcccatcctgcaacaatgttttcagtagggcgggatccgtggctcccaatcaagtccgacaacctgatctcatggcagggcccacacaagaaaaaaaagagcattttatttcgtgcaacttttatggcccagagaatctctgaccccccaccccctcaacacacaataatcagttgatctccctctccctccctctctcccacctccacaccatctatgagaaagaggagggggaagaaggtggaagaaaaggcacgagtagagaaagtagatccgacgtaaagcaggcacctaaaaaaaggtgggatggatttctccaaagcccagatcagggactctgctacagccagccagtggagaatgcctctaatgttaacgctttagtaaccacttacaagaacttcccctgtctactgcttaatttcaaataacccaacaggtccatttaattactttgtattatttaaagaaatctaggatttctttaaataataaaagggaaacgaacgcgttttaacatcattttgcatcacaatgttaaaatcttgggttaactccctcagtaaatctctaaatcctttccaatctactatctctggccaggaagtcaaaactgaaatattaaccaactaaaatgatcttcattctttggtcaattttgcagagcaaaaaatttaaataaataaataaatagatcttcaatgtgtatcaaggatgtcctacttgggcctcactctcccaaacagagcctattttcttccatttaacaaaggaaaattctcatttaaacaagtctaatgaagatgttgcaacctggccaagagcggtggctcatgcctgtaatcccagcagtttaggaggccaaggcaggctgatcacttgaggcaagagtttgagaccagtctggccaacatggtgaaacccgatctctactaaaaatccaaaaattagccgggcatcgtggcaggaacctgtaatcccagctactcaggaggctgaggcaggagaatggcttgaacccgggaggcggaggttgcagtgagctgagatcctgccactgcactccagcctgggcgacagagcaagactccctctcaaaaaaaaatttttttaatgttgcaaccaatttttcttcctcatatttatagatgtttatcatgttttttcttaaaagttttttaaaccaccttttccaaacctcaaaacaagcatctataattatagacaattattctcctggctccgtaaacaattctatttttccttctccaactttctaatcctctcatgaagctggccaaatgtattctactcctgacaccaaacaacagaaaaagaaacaacgtaactgcagtctacttcttttgttttaataaacaaataaactagcttaaatgcacagtggtcttggatcacataagaatttcaaaataaatgatttaaacactttaaatattgtggtgggggggatggtgctggtaaataagggtcaagttctgactttcttattgaggccaaggtcaagaaattacttttttcagatctataaaatcttaccaactcagaatcctgattatagattatcatctcctactcaatactttccaaatctacaatgatataggaatcccactaaaattcagaataattaaaaggagttaagatttaagacataaccaaaaaccagcccctctacaaggcagttgactgtacagttcatgcttgtatacagatggacagactaagaacaaactctacacttctgagaaaaaaaacaaaactaaactaacaatgtaaatctattcattcattataacaatttcttttttcggagacagggtctcactttgtccaggctggagtgcagtggtgcgattttacctcactgcagcctcgacctcctgggttcacgtcatcttcccacctcagcctcccgagtagctgggactactaacgcgggccaccatagctggataatttacgtattttttgtagagacagggttttgttatgctgcccagactagttgagctcctgagctgaagcaatccgcctgcctcagcctcctaaagtgctaagattacaggtgtaagccactgcgcccagccacaaaatttttaaatatcattccaaagaaccatctataatgaaatgtgaaattatgttaaatacatatgtttagaagatacaatgcaactttctagtttttatttccactgtaactaacttcaactatgaataaaattctacataagtttccatctcaggatttttgttctctttaaaattacaaaaactggccgggcatggtggctcacgcctgtaatcccagcactttgggaggccgaggcaggtggatcacctgaggtcaggagttcgagaccagcctagccaacatagcaaaaccccatctatactaaaaatacaaaaattagccaggtgtggtggcgggcgcctgtaatcccagctacttgggaggctgaggcaggaaaatcgcttgaacccaggaggcggaggttgcagtgagccgagatcgcaccactgcactccagtccgggtgacaagagcaaaactccgtctcaaaaaaaaaaaaaaatttacaaaagtcatttagaaaatgtatgaggccagacgcgatggctcatgcctgtaatcccaactctctgggaggccaaggcgggcggaccactaggtcagaaattcgagaccagcctgaccaacatggtgaaaccctgtctctactaaaaatacaaaatttagctgggcgtggtgtcgcacgcctgtgatcccagctactcaggagactgaggcaggagaattgcttgaacccaggaggcagaggttgcagtgagctaatactgtgccactgcactccagcctgggcgacatagtgagactctgtttcaaaaaaaaaaaaaaatgcatatgaaacacaaaaagctgggtgtggtggctggctcacacctgtaatcccagcattttgggaggccaagggggtgcggatcacctgaggtcaggagttcgagaccagcctgaccaacatggagaaaccccatctctactaaaaatacaaattagccgggcatggtggcgcatgcatgtaatcccagctactcaggaggctgaggcaggagtatcgtttgaacctgggaggcgaaggttgccatgagccgagattgtgccatcacactccagcctgggcaacaagcacgaaactctgtctcaaaaaaagaaagaaacacacagagttgccaatgtgaaaactactcaataagatttaataaaaatactgtatttggaaaaaatctttttttttttttagctgggattacaggcgcccggcatcatgcctggctcatttttgtatttttagtagggaagaggtttcaccatgttggtcaggccgatctcaaattctagacctcaggtgatccacccacctcagcatcccaaagtgctgggattacaggcgtgagccactgcacctggccttaactatttttcattaaggtaatgaaataagttaacttctcaatactttctttctttttttttttctttttgagacagggtcttgctctgctaccaggctagagtgcagtggcatgatcacagctcactacagcctcaatctccaaggctcaagcgatcctccctcctcagtctcccaaacagctgaggcaacaggtgcataccacatgcagctaattttttatttttttgtagagacaggatctcaccattttgcccagactgattttgaaatcctgagctcaagctatcagcctgcctcagcctcaagtgctgggattacaggtgatgg

SEQ ID NO: 125 - DNA, 14335 bp, Homo sapiens
aaaaagagtaaggaaaagttcagcacaaaaacaaggcaacaggtctaaatacttctagcccaaactgaaggaaataggactaagggaaagcaggggagggtgggagggacttgatatgcataaaataagtaataatgacaaaccacagaaaaagattgataaaatgaatcgtgaaaatatgacaagaaaaatgcagttacagattcaaaaaccaagaaacaatacaaagaaatgtaattacatactacttgcctctgctgtgaaaaatattacatgatcataataatgtagaaactattcattaactttttttttttttttttcactctgtcacccaggctggagtgcaatggcaccatctcggctcactgcaacctccgcctccggggttcaagcaattctccctgcctcagcctcccaagtagccgggataacaggcatacgccaccacgaatttttgtatttttagtagagacggggtttcaccatgttggccagactggtctcggcctcccgccctcaggtgatcagcccgcctcagcctcccgaagtgctgggattacaggtgtgagccaccacgtccagcccattaactttcaagtattaaagtcataccggccaggtgcagtggctcacacctgtaatcccagcactttgagaggccgaggcaagtggatcagttgaggtcaggagttaaagaccagcctggccaacatggagaagccccgtctctactaaaaatacaaaaatttgccaagcacggtggtacgcacctgtagtcccagctacttggaaggctgaggtaggagaatagcttgaacctaggaagcggaggttgcagtgaaccaagatcgcaccactgcactcaagcctgggcaacagagcaagactgtctcaaaaaaataaataaataaacaaacaaagtagtaaggagtacaatacagcgcataactgttctcaaccttgacaatgtcaatgtcagaaatgacagatgtaagcacataaagggaaaaggaaaggtaaaaagaagagttgcagccgggcgtggtggctcacacctataatcccagcactctgggaggctgaggcaggtggatcacctgaggttgggagttcaagaccagcctgaccaacacggtgaaacctcatctctactaaaaatacaaaattagccaggcatggtggcgcctgcctgtaatcctagctactcgggaggctgagacaggagaatcgcttgaacccgggcggcagaggttgcagcaagccgagatcgcgccattgcactccagcctgggcaacaagagtgaaactccgtctcaaaaaaacaaacaaacaaacaaaagttactgcttggtacatcaagatcaacagtctatataacatgaaggaaagttctgatataaactgcagagataactagcagagaaattaaaagtgatttttaaaaaatctattggggaagcagatgtaaagaagccaaatcctcctttatcagagcagaaatcaatcataaatcataacatatgtatattatatagtcacgacaataccacaggaagaaataatttgaaagtttcctttggaaattggacccctatctttcaccatatacaaaaatcaactcaagaaggattaaagacttcatccaaagacctgaaactataaaaaccattagaagaaaacctaggaaaaactctcctggacactgatctatacaattcatgactaagaattcatgaatttaaagaattcatgactaagacctcaaaagcacaagcaaaaaaaaaaaaaacaaaaatagacaaatgagacttaagctaaaaagcttctgcatagcaaaagaatcagcagactgaacaaatggcctacagaataggagaaaaaagtttcaaactatgtatctcacagggtactaacatccagaatttacaaggaacacaaataatcccatcaaaaagtaagcaaagggctgttctgaatacctcactactgataactggtagtgagttatcccaattgatggttcactgtcagttaccgatcaaattccttgttctatactctttactcccctttcactactgcacttaactggtcttaagaaaaaattttaataaaaaatttttaagaattttaaagttagcaaaggacattaatagacatttctcaaaagaagacatacaaacagtcaacaggtatgtgaaaaaaatgctcatcactaatcatcgaggaaatgcaaataaaaaccacaatgacatatcatcttacaccaatcagaatggccactattaaagaaacaataataataacagatgttggggaagatgcagacaatggggaacacttaacacactgtgggcgggaatgtaaattagtaccacctgtatggaaaaccatataaagagttctcaaatgactaaaaaataaaactgctggccaggcacggtggctcacgcctgtaagcccagcactttgggaggccaaggcaggtgcatcacctgaggtcaggagttcaagaccagcctggccaacatggtaaaaccctgtctctactaaaaatacaaaaatttgctgggcgtggtggtgtgcacctgtaatcccagctactcgggaggctgaggcaggagaatcacttgaacctggtgggcagaggttgcactgagccgatatcatgtcattgcactccaacctgggcaacaagagcgaaactccatctcaaaaaagtaaaaatgataaaaaataaaactgctattcaatccagcaatcccactattgggtatccacccaaaggaaaataaatcattatatcaaaaagataactgcactcgtacctttatcacagcaacactcacaatagcaaagatagggaatcaatctccatatccatcaacagacgactggataaagaaaaactgggacacatacacacacacacacacacacacacacacacacacacacacacacgaatactattcagccataaaggaagaatgaaatcatgtcttttgtagcaacgtggaaggatggaaggacctggaggccatgttctcacttataagttgaagcaaaataatgtgtacatgtgggcacagtgtggaataacgacactggagactcagaaggttgggaggctgggaggagggtgagtaacaagaaattactgaatgggtacacgtacattatttggatgatggatgcactaaaagcccaaactgcagcactatgcaatgtattcatgtaacaaaactgcacctgtaacccttaaattgatacaaaaaagttgtttggagagtggcaataaggagtgaaacagaattcttgatccttattataagcattctgggctattagacttttttcaaccatgtacatatattactatgcaaagtttttaaatggacttaaaatctgaaagaacattgatcttttaatgaaaaacaaaaccataagatactctgcctaaactttccctcataatgcaatgaataaaactttaatctttctcttcaggataaataatttctgaggctttagaaccaccttaaaaggtatctctaggccgggcgcggtggctgacgcctgtaatcacagcactttgggaggccgaggtgggcagatcttctgaggtcaagagttcaagaccagcctggtcaacatgctgaaaccctgtctctactaaaaatacaaaaattagccaggcgtggtggtgcacatctgtaatccagctactcagaaggcggaggcaggaaaatctgaatccgggaggcagaggttgcagtgagccaggatcgcagcactgcactccagcctgggcaacagagcaagactcaggtctcaaaaaaaaaagatatttgttgacaactaaataagtcaagttacatgatgtatagactatcatcaaaattactgaaccgtcactgcttatcaaagtaaaatgtaaccaaaaatttaatgcacagtacttcgaccagaccaaaacattcaattcatccatagtttcctaattttaatacttattttaccagagcatgaaaatcttttttgtttttttgttttgttttgttttgttttttgagatagggtctccctctgttgcccagtttggagtacagtggcacaatctcagctcactgcaacctctgcctcccacgctcaagcaatcctcccacctcagccttctgaggagctgggaccacaagcgtgtagcactgtgcctggctaatttttgtattttctgtagagatggggtttcttcatattgcccagctggtctcaaactcctgagctcaagcaagccacccgccttggcctcccaaaatggcaggattacaggcatgaggcaccacaccccaccaaaaatgtatctttaacacctgttctctagattgatttaggttttactgatcttagaggtatatacaaccatcatttcaaactcaacagatctaaatttagtttaacttcacttttttttttttttttttttttctgcccaggctggagtagtggctcgatctctgctcactgcaacctccaccttctagggtcaagtgattctcatgcctcagcctcccaagtagctgggattatagacatgcaccaccacacttggctaatttttgtatttttagtagagatggggtttcgccatgttagccagactggtctcaaactcctggtctcatgtgatctgcccaccttggcctcccaaagtgctgggattacaggcaggagccactacacgctgcctagttcactttgcattctattttttcctttgtaccttttagaagaagcttttaaataatataaagattattatttttcaatctgtcagaaattgacagggaaaagaacttaaaagtttaaatacacgatacaaaaagattaaaaagttatcgcaaattggcagggtgcggtggctcacgcctgtaatcccagcactttgggaggccgaagtgggcagatcacccaaggttgggagtttgagaccagcctgaccaacttggaaaaacccagtctctactaaaaataaaaaattagctaggcatggtggtgcatggctgtaattccagctactcgggaggccgagggaggagaatcgcttgaacctgggaggcagaggttgcagtgagtcaagatcatgtgcgccattgcactccaacctgggcaacaaaagcaaaactctgtctcagaaaaaaaaaaaagttatcacaaattattgctcataacagtttagttaaaataaagaatgtatgtaaaactacagagtaatagcttgatagcaagacaaaatagtttttaaaaaaattctaggaaaaatatggctgactaaactatgatgaaagatttgagatatcaaaaatgggctgggtgcagctggcgtatgcctataatcccagcactctggcaggccaaggtgggtggatcacttgagcccaggagttcaagaccactctgggcaacatggcaaaacccagtctctacaaaaaatacaaaaattagctggacatggtggtgtgtgcctgtagtcccagctacttgggaggctgaggtaggagaatcatctgattctgggaagtccagggtgcaatgagccatgatcacaccactgtactcccgcctgagagacagagtgagaacctgtctcaaaaaaaaaaaaggcatcaaaaatggctaaaagaaaatcttaaacaaaccatgagttaacagattaaaaaggtgttcttgtttgttttttgagacacagtcttcctgggctgcccaagctggagtgcagtagtacaatcatggctcactgcagccttgaactcctaggctcaagtgatcctcctgcctcagcctcccaaataactgggactataggtgtatcacgacacacagccatttttttttcttagtagagatgaggtctcctgatgttgcccaggctgggctcgaactcctggtctcaagaggatcccgccttggccttccaaagtgctgggattacaggtgtgagccaaaaaaggtgtggggccaaaaaagggtttttttattttttggttttttttttctgttgttagaggtggaggtggtaatggtttctgttttggagggagaagaggtagtggtggtaatggtttcttcttgggaaggagtattaaggtttacagtgtttaccattttatttaacaatattctactacagaaactgaaacattttagatgttaataaaacatctaaaatcatactatgatttacttctccaaagtacaaattacatcacaagtaagcctccatgcaatgacatttttatctttatggagcatcatcaatatcagttaaataaattagtgcaaattgttcctaaggagaagtttagtttccactttaccattaaaagccaagtgcctatgatgcagatgaatgcattgtacaatatatttcaatcaagtcacagactcacttccccactatccatgaaatataacaaaggactaagaaacattaaaaaataacgtatcaaacttcccacaaaccaaaagacaggaagctactgaataatctgacacttggattacattttcattatcattaaaatgtagcaaaggggccgggcacggaggctcacgcctgtaatcctatcactttgggaggccaagacaggcagatcacttgaggtcaggagttcgaaaccagcctggccaacatgataaaaccggtctctactaaaaatacaaaaacttaaccaggcatggtggcacacgcctgtaatcccagctacttgggaggctgaggccggagactcacttgaacccgaggggcgaaggctgcagtaagccaacatcgcaccactgcactctagcctgggcgacacagcgagactctgtctcaaaaaaaaaaaaaaggtagcaaaggaaaaaaaaaaaataggtcagtgtttagaaaggatacaactatatcacgtcttttacttattttacattttgtattggtctagaagttgaaaatacgtgcccaaaacaactatacaacttgagcaatgattttaaaacaaatatgacactttatattagaagcagcaactatttattcagaaacatatactattagttacatttaaaatttatcttgttagaatacactgtttccaaatcaacagtccttacaaaatatggaacatatacttcagtattatttagctttacttttgtaatagtggccaaggtggccgggtggggtggctcacgcctgtaatcccagcactctgggaggccgaggtgggcagatcacaaggtcaggagttcgagaccagcctggccaatatggcgaaaccccgtttctactaaaaatacaaaaattaggtgggtgtggtgacgtgtgcctgtaatcccagccacctgggaggctgaggcatgagaatcgctgaatccagggaggtagaggttgcagtgagccaaaatcgtgccactgcactccagcctgggtgacagagtgagactccatctcaaaaaaagaaaaaaaaaaatagtggccaaggtggattttgtactctgaatataaactatatagtttatactatacatatgtctacttataaactaggcactactgcttcaatatattaaaaaaattattctagaagatagtttatcgtactcagggttccccccacctatagctgcagaccaataccactcggtagcctgttgggaaccaggccacacagcaggtgagcggcaggcaagccagcattaacctgagctcggcctcctctagatcagcagcggcattagattctcatagaagcacaaaccctattgtgaactgcacaagcaagggacctaggctgcatgcttcttatgagaatctaactaacctaactaatgcctgatgatctaaggtggaagagtttcacccgaaaaccatccactccgtgctccccctggggtctgtggaaaaaactctcttccacaaaactagtccctggtgccaaaaagtttggagaccactaacataaactacaaggttttgttaaaaaaaaaaaaaaaaaaaatgtagccaatgtcccttgagggttaatatcaaatatcttagaataggtaacagtctaatatgaatttaactgtgaacataatgaagttaattctacactatctaaaaaactgtttcacttaacatgcatctaattcatcaaactgggtgggtttctctctcttttttttttgagacagagtttccctctgttacccaggcttagtgttacccaggcttaagtgcagtggcgccatctcaactcactgcagtcttgacctccggagctcaacctgatccttccacctcagcctcccgattagctgggatcacacaagaatgtgccatcacacctggctaatttttgtattttttttagggtcagggtctcactatgttgtccaggctggtcttgaacgccttacctcgagtgatccacctgcctcagcctcccaaagtgctgggattagaggtgtgagccaccaagacccaccttaaaacaagttctttgaaaacatatttgctacgtaatagttatgagctttttaaaaaatttcttctaatgtaattaaattctggtaatcagattttcagaagaaatatgttaaaatgctggttaagtgggccaggtgcagtggctcacgcctgtaatcccagcattttgggaggccgaggcaggtgcatcaggaggtcaggagatcgagaccatcctggctaccacacagtgaaaccccatgtctgctaaaaatacaaaaaaaaaaaaaaaaaattagccaggtgtggtggcgggcgcctgtagtcccagcttcttgggaggctgaggcaggagaatcgcttgaacccaggaggcggagcttgcagtgagctgagatcacgccactgcactccagcctgggtgacagagcaagactccgtctcaaaaaaaataaaataaaataaaaataaataaaataaaatgctggttaagtgaccagaggttttatttcttgggtttttttttaaatcatcatggaattaaacacacatgaagaaatctgttgaaacccctcaaacttgcaatgctatacccgaatcacagtgttctttcagagacttttcaaattatacaaatatttcaaaatgctgagttactctactatagctaataaaactacttaaactaagtggaaaaccttgagaactaaagggggaggggatattatttattctcattactcttaaatcaaccaacttccaaatccagaatataaaacttttatgattatttgttctttccctgtttacaaacctagttctgatttcattattaaaaatataggccgggcacggtggctcatgccggtaatcctagcactttgggaggccaaggtagacagatcacgaggtcagcaattcaagaccagcctgaccaacatggtgaaaccccgtctctactaaaaacacaaaaaaattagctgggcatagtggctggcacctgtaatcccagctactcgggaggctgaggcagaagaatggcgtgaacccaggaggcggagcttgcactgagtcaagatcgcgccctcgcactccagcttgggcgacggaggaagaccctgtctcaaaaaaaaaaaaaaaaattagccaggtgtggaagcacacccctgtaatcccagctactcaggaggctgaggcagcagaatcgcttgaacctgggaggtggaggctgcagtgagccgagacagcgccactgcactccagcctgggcgacagagcaagactccatctcaaataaaataaaattttttttaagttttaatttatatatattatattataaatattatatataatgtataatttttatatatgagattatgtatatatgtatatgtatatgagatgtatatataatatatacatctcagccgggcccagtgactcacgcctataatcccagcattttgggaggttgaggtaggtggatcacttgaacccaggagctcgaggtcagcctgggcaacatcgagagacgccgtctctacaaaaaataaaagataaaaaaattagctggtggtgatggcacatccccacggccccagctacttgggaggctgaggtggaaggatcactggggttggaaggtcgaggctgcagtgagccaagatctcactcctgcacttcagcctggatgacagagcgagaccaagtctcaaaaaaaatatatatatggtgtgtgtatatatgtatatgtgtgtatatgtgtgcatacacacacaattctctataactagtgctgtcatacttaatgctttaataaggttaaatacataataaatacaatagttcattttgtctttaacagtacaatccaagtcaagtcatccttccaaaccagatacaaaaatatcctatgaaaagaaacaaaaactttttatccttaggatattttggggttctggccttttgttgtgccagatataataccacttgataagactttcagcttcatcccatcccatcctgcaacaatgttttcagtagggcgggatccgtggctcccaatcaagtccgacaacctgatctcatggcagggcccacacaagaaaaaaaagagcattttatttcgtgcaacttttatggcccagagaatctctgaccccccaccccctcaacacacaataatcagttgatctccctctccctccctctctcccacctccacaccatctatgagaaagaggagggggaagaaggtggaagaaaaggcacgagtagagaaagtagatccgacgtaaagcaggcacctaaaaaaaggtgggatggatttctccaaagcccagatcagggactctgctacagccagccagtggagaatgcctctaatgttaacgctttagtaaccacttacaagaacttcccctgtctactgcttaatttcaaataacccaacaggtccatttaattactttgtattatttaaagaaatctaggatttctttaaataataaaagggaaacgaacgcgttttaacatcattttgcatcacaatgttaaaatcttgggttaactccctcagtaaatctctaaatcctttccaatctactatctctggccaggaagtcaaaactgaaatattaaccaactaaaatgatcttcattctttggtcaattttgcagagcaaaaaatttaaataaataaataaatagatcttcaatgtgtatcaaggatgtcctacttgggcctcactctcccaaacagagcctattttcttccatttaacaaaggaaaattctcatttaaacaagtctaatgaagatgttgcaacctggccaagagcggtggctcatgcctgtaatcccagcagtttaggaggccaaggcaggctgatcacttgaggcaagagtttgagaccagtctggccaacatggtgaaacccgatctctactaaaaatccaaaaattagccgggcatcgtggcaggaacctgtaatcccagctactcaggaggctgaggcaggagaatggcttgaacccgggaggcggaggttgcagtgagctgagatcctgccactgcactccagcctgggcgacagagcaagactccctctcaaaaaaaaatttttttaatgttgcaaccaatttttcttcctcatatttatagatgtttatcatgttttttcttaaaagttttttaaaccaccttttccaaacctcaaaacaagcatctataattatagacaattattctcctggctccgtaaacaattctatttttccttctccaactttctaatcctctcatgaagctggccaaatgtattctactcctgacaccaaacaacagaaaaagaaacaacgtaactgcagtctacttcttttgttttaataaacaaataaactagcttaaatgcacagtggtcttggatcacataagaatttcaaaataaatgatttaaacactttaaatattgtggtgggggggatggtgctggtaaataagggtcaagttctgactttcttattgaggccaaggtcaagaaattacttttttcagatctataaaatcttaccaactcagaatcctgattatagattatcatctcctactcaatactttccaaatctacaatgatataggaatcccactaaaattcagaataattaaaaggagttaagatttaagacataaccaaaaaccagcccctctacaaggcagttgactgtacagttcatgcttgtatacagatggacagactaagaacaaactctacacttctgagaaaaaaaacaaaactaaactaacaatgtaaatctattcattcattataacaatttcttttttcggagacagggtctcactttgtccaggctggagtgcagtggtgcgattttacctcactgcagcctcgacctcctgggttcacgtcatcttcccacctcagcctcccgagtagctgggactactaacgcgggccaccatagctggataatttacgtattttttgtagagacagggttttgttatgctgcccagactagttgagctcctgagctgaagcaatccgcctgcctcagcctcctaaagtgctaagattacaggtgtaagccactgcgcccagccacaaaatttttaaatatcattccaaagaaccatctataatgaaatgtgaaattatgttaaatacatatgtttagaagatacaatgcaactttctagtttttatttccactgtaactaacttcaactatgaataaaattctacataagtttccatctcaggatttttgttctctttaaaattacaaaaactggccgggcatggtggctcacgcctgtaatcccagcactttgggaggccgaggcaggtggatcacctgaggtcaggagttcgagaccagcctagccaacatagcaaaaccccatctatactaaaaatacaaaaattagccaggtgtggtggcgggcgcctgtaatcccagctacttgggaggctgaggcaggaaaatcgcttgaacccaggaggcggaggttgcagtgagccgagatcgcaccactgcactccagtccgggtgacaagagcaaaactccgtctcaaaaaaaaaaaaaaatttacaaaagtcatttagaaaatgtatgaggccagacgcgatggctcatgcctgtaatcccaactctctgggaggccaaggcgggcggaccactaggtcagaaattcgagaccagcctgaccaacatggtgaaaccctgtctctactaaaaatacaaaatttagctgggcgtggtgtcgcacgcctgtgatcccagctactcaggagactgaggcaggagaattgcttgaacccaggaggcagaggttgcagtgagctaatactgtgccactgcactccagcctgggcgacatagtgagactctgtttcaaaaaaaaaaaaaaatgcatatgaaacacaaaaagctgggtgtggtggctggctcacacctgtaatcccagcattttgggaggccaagggggtgcggatcacctgaggtcaggagttcgagaccagcctgaccaacatggagaaaccccatctctactaaaaatacaaattagccgggcatggtggcgcatgcatgtaatcccagctactcaggaggctgaggcaggagtatcgtttgaacctgggaggcgaaggttgccatgagccgagattgtgccatcacactccagcctgggcaacaagcacgaaactctgtctcaaaaaaagaaagaaacacacagagttgccaatgtgaaaactactcaataagatttaataaaaatactgtatttggaaaaaatctttttttttttttagctgggattacaggcgcccggcatcatgcctggctcatttttgtatttttagtagggaagaggtttcaccatgttggtcaggccgatctcaaattctagacctcaggtgatccacccacctcagcatcccaaagtgctgggattacaggcgtgagccactgcacctggccttaactatttttcattaaggtaatgaaataagttaacttctcaatactttctttctttttttttttctttttgagacagggtcttgctctgctaccaggctagagtgcagtggcatgatcacagctcactacagcctcaatctccaaggctcaagcgatcctccctcctcagtctcccaaacagctgaggcaacaggtgcataccacatgcagctaattttttatttttttgtagagacaggatctcaccattttgcccagactgattttgaaatcctgagctcaagctatcagcctgcctcagcctcaagtgctgggattacaggtgatgg
